United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 40

SEQ ID NO: 178696 - protein, 795 aa, Glycine max
  Coding DNA Sequence Number=SeqID_61918
  Gene Ontology: Mol. function=structural constituent of ribosome; Cellular component=intracellular; Biological process=translation
  Homolog annotation: Hit_ID=Q8S7U7; Match level="QueryCoverage=95%, HitCoverage=68%, E-value=1e-107, Identity=29%"; Hit description =Putative pentatricopeptide repeat containing protein
  Pfam annotation: Domain name=PPR; Domain location=239-273; Score =18.4; E_value=0.025; Accession=PF01535.11; Description=PPR repeat
  Pfam annotation: Domain name=PPR; Domain location=328-362; Score =21.3; E_value=0.0035; Accession=PF01535.11; Description=PPR repeat
  Pfam annotation: Domain name=PPR; Domain location=442-475; Score=1.9; E_value=4.5; Accession=PF01535.11; Description=PPR repeat
  Pfam annotation: Domain name=PPR; Domain location=477-511; Score =20.7; E_value=0.0051; Accession=PF01535.11; Description=PPR repeat
  Pfam annotation: Domain name=PPR; Domain location=512-546; Score =10.8; E_value=0.39; Accession=PF01535.11; Description=PPR repeat
  Pfam annotation: Domain name=PPR; Domain location=547-581; Score=8.2; E_value=0.8; Accession=PF01535.11; Description=PPR repeat
  Pfam annotation: Domain name=PPR; Domain location=582-616; Score=8.3; E_value=0.78; Accession=PF01535.11; Description=PPR repeat
  Pfam annotation: Domain name=PPR; Domain location=617-651; Score =18.3; E_value=0.028; Accession=PF01535.11; Description=PPR repeat
  Pfam annotation: Domain name=PPR; Domain location=652-686; Score =24.7; E_value=0.00033; Accession=PF01535.11; Description=PPR repeat
  Pfam annotation: Domain name=PPR; Domain location=687-721; Score =11.3; E_value=0.34; Accession=PF01535.11; Description=PPR repeat
  Pfam annotation: Domain name=PPR; Domain location=722-756; Score =21.7; E_value=0.0027; Accession=PF01535.11; Description=PPR repeat
  Pfam annotation: Domain name=PPR; Domain location=94-128; Score=27.1; E_value=6e-05; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=239-273::328 -362::442-475::477-511::512-546::547-581::582-616::617-651::652 -686::687-721::722-756::94-128
MVKKVLVLNSEVSSLVFDEIAFGYCEKRDFKDLLSFFVEVKCAPSVTAANRVVNSLCSSYGVERAGEDEKCIELFVSYAIEKLCAALGILPDISTFRVLIAGYCKFRRFDEVKSLIHEMENRGLIKLALMENTISMAFLILGLDPLSVKLKRDNDGGLSKTEFFDEVGNGLYLDTDVDDDGNLKNALVLVEEMLCWGQELLFPEFSNLVRQLCSSLSQIKSMTKLLEQMPKSAHKLDPETLNLVVQAYSKKGLLSKAKIILDGMLQNEFHVKNETYTAILMPLCKKGNMKDFSYYWDVACRNKWLPGLTDTALVVLKQLQPCFNLDHTDYNHLIRGLCNEGIFSLAFTVLDDMLDRCLAPCLDVSVLLIPQLCKAHRYHKAIALKDIILKEQPSFSHAADCALICGFCNMGSTGKADTLFHDIKVGELLGVAIRKDWELSLTSYKNLVRLVCRKGRVQFALSLKNLLLAQCPLDGLIIYNILMFYLLKDGNSLDVNKILTEMEEKKVVLDEVGHNFVVYGFLQCRDLSSSLHYLTTMISKGLKPSNRGLRKVISKLCDAGNLKKALELSQEMRLRGWMHDSSIQTSIVESLLLCGNIQGAETFLDRMGEESLNPDNINYDYLIKRFCQHGRLNKAVHLMNTMLKKHNIPVSTSYDFIIHGFCAQNKLDIALNFYSEMLSWNLKPRIDTVEMLLHRFCQDGKTELAEQFLVDMSHGGETPTRKMYCPVIKSYHMKKNLRKASELLQAMQENGYQPDFETHWSLISNLNSAKAKDTDNASTGFLSRLLFKSGFLQKK

SEQ ID NO: 178697 - protein, 65 aa, Glycine max
  Coding DNA Sequence Number=SeqID_61919
MGVDIPNDVFHYNTKTSPAVAIWDEASYAYVAKIISCHTEKSHALCLPGKHENTLMVFFKNWQVS

SEQ ID NO: 178698 - protein, 228 aa, Glycine max
  Coding DNA Sequence Number=SeqID_61920
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q9SHJ5; Match level="QueryCoverage=97%, HitCoverage=47%, E-value=1e-48, Identity=45%"; Hit description =Glycerol-3-phosphate acyltransferase 1
LVKSGYGLARKLKSHGFHWGDLSSKPLHQPSPFPNIDKCDLECRGSQTLACDFHKVLLRTHSFFPYFMLVAFEGGSIFRAFFLLCSCPMLWILNYEMKLRVMIFISFCGLRMKDMENTSRAVLPKFYLENLNLEAYEVVASVGSRVFFTTMPKVMVEGFLKEYLNADAVIATELHTSGCYFTGLLSKSGLLVKHSALMDYFGDTKPDLGIGNTSLHDQLFISLCKVSL

SEQ ID NO: 178699 - protein, 269 aa, Glycine max
  Coding DNA Sequence Number=SeqID_61921
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q9SHJ5; Match level="QueryCoverage=95%, HitCoverage=49%, E-value=1e-86, Identity=57%"; Hit description =Glycerol-3-phosphate acyltransferase 1
  Pfam annotation: Domain name=Acyltransferase; Domain location=82-196; Score=42.7; E_value=1.2e-09; Accession=PF01553.11; Description =Acyltransferase
MTQEAYVVINEEGKVMPRNKYPKPLIFHDGRLAFLPTPSATLLMFMWLPLGFLMAIYRIFLGVFLCCKFTLALGIWSGLILNFNDKNQQRSESNKGVLYVCSHRTLMDPIFLSITLGRRLTAVTYSLSKVSELIAPIRTMRLTRDREQDGETMKRLLCEGDLVVFPEGTTCREPYLLRFSSLFAELADEIVPVAMNAHVTIYDIQVLGKVPRELTCAGGRSSHEVANYIQRQLADALGFECTNLTRRDKYMMLAGNEGVVQEKKGRRFC

SEQ ID NO: 178700 - protein, 276 aa, Glycine max
  Coding DNA Sequence Number=SeqID_61922
  Gene Ontology: Mol. function=zinc ion binding; Biological process =regulation of transcription
  Homolog annotation: Hit_ID=Q1T0F7; Match level="QueryCoverage=78%, HitCoverage=59%, E-value=7e-36, Identity=43%"; Hit description=Zinc finger, Dof-type
  Pfam annotation: Domain name=zf-Dof; Domain location=77-139; Score =133.3; E_value=6.6e-37; Accession=PF02701.6; Description=Dof domain, zinc finger
  Subcellular localization annotation: CTP_CleavageSite=86; ConfidenceScore=5.04e-01
MVYTSIPSYIDPANWQQQQPNHQQQGNNTAASSHLILPPPIQPPPPPPSQPHGLSGSTTAGSIRPGSMADRARMANIQEAPQKCPRCESTNTKFCYFNNYSLSQPRHFCKACRRYWTRGGTLRNVPVGGGCRRNKRSRGSSSSNTRSPANSDRQTASAGSASTTSGSSSADLVASLGGGTGVPPSLRFMAPLHQLGDHHHLGGGGGEIGLSYGLNYGAISGPMGGIGDLNFHIGGTLSGGGSMLSGLDQWRVPQTHQFPFLSGLEATSSHGLYPFE

SEQ ID NO: 178701 - protein, 111 aa, Glycine max
  Coding DNA Sequence Number=SeqID_61923
MKKKAAGTGRRRMRVVAVAVEIGRRRMHVVVVAIGTGTGERRRSYGHCSFIYIIRVKDIFVITSYAFGAPAKMMGAPSAPSILSYCQFCPLHNLKKYFFPYEFTKELLPLT

SEQ ID NO: 178702 - protein, 95 aa, Glycine max
  Coding DNA Sequence Number=SeqID_61924
MVMPILGSRDYVSDRERFCMYKAFKDRFNPKVKKNHVPFGMLFTHIMRDVEVDVSRMTLSARETQLKGMTFTKMGIADNFPEYAQKHIKKKGQEG

SEQ ID NO: 178703 - protein, 77 aa, Glycine max
  Coding DNA Sequence Number=SeqID_61925
MMGELKFFLGLQIKQDNKAPRKNEAVVFPGINNEKDAKNVLPKDSFILERWVNFQSLEKEGFLVKGIFDRVRWTNFL

SEQ ID NO: 178704 - protein, 105 aa, Glycine max
  Coding DNA Sequence Number=SeqID_61926
MDYLTSTLGETNTIQLPDLPERVTFDFKHGFLYMFENMFSGAAHEDPMQHLRKFIKLTNTEGMGLAMFTTREWHHYMESVHKYLLKEVFSPVEMNQYIKDIGNFV

SEQ ID NO: 178705 - protein, 57 aa, Glycine max
  Coding DNA Sequence Number=SeqID_61927
MDPVERETLEEAMLQSVIETSLVEANLGADLESPSFKDWEQSDYSPELIMKLSTYKE

SEQ ID NO: 178706 - protein, 117 aa, Glycine max
  Coding DNA Sequence Number=SeqID_61928
  Subcellular localization annotation: CTP_CleavageSite=56; ConfidenceScore=5.15e-01
MAPLATPSPHAPTTVLHRRCHREAIHLPEVNVTSHTTTRNASSATGVATKNHQTSNSNHLSFSSTHLNFNRSCFSDLFRLCTLDYSLTPLLGLVPLDRYAFACSSFRVFSPYEHSFS

SEQ ID NO: 178707 - protein, 172 aa, Glycine max
  Coding DNA Sequence Number=SeqID_61929
MEQATKVHLVSLEGLCVPKKHGGLGLYDMRRANQVSMLKNNWKLINNRTDKWVQLMCSSLGEIRIFLDTVSWKIMVWLALFVKGVRTLRIVMKSSKDNPDSLMGIHNNSNAITWSPPLHNFVKVNTNVAVVFDRRVATYGEVIRVLTMVSLWVSLPGWDYAPSSKLSSMGFI

SEQ ID NO: 178708 - protein, 167 aa, Glycine max
  Coding DNA Sequence Number=SeqID_61930
  Gene Ontology: Mol. function=protein serine/threonine kinase activity; Cellular component=integral to membrane; Biological process=protein amino acid phosphorylation
  Homolog annotation: Hit_ID=Q9LKZ6; Match level="QueryCoverage=57%, HitCoverage=16%, E-value=2e-20, Identity=42%"; Hit description =Receptor-like protein kinase 1
MHIPHLTRFYDATIVLEKHLRYLALSDNELTNEITPELGNLFALLELYIGYYNAYSSSILPKIENLFNLVNTLSDSLTSELGNLKSLKPMDLSNNMLYEELWENNFIESIPQSLGKNGRKGEGERVGRCGGGGQQRWWHNVVGGGGAVVVVAIGEGEEGDDVVLKCQ

SEQ ID NO: 178709 - protein, 104 aa, Glycine max
  Coding DNA Sequence Number=SeqID_61931
MVTSFLEDLISMSCLRSMMFWLLNGSEINMSIGIAHSQCCEKRWGSEDEDLLRLICRYELLVYGVAKDDEMARTKTPQVVVNNGDVLLEGSQIYKLFIYDTISY

SEQ ID NO: 178710 - protein, 167 aa, Glycine max
  Coding DNA Sequence Number=SeqID_61932
  Gene Ontology: Mol. function=RNA-directed DNA polymerase activity; Biological process=RNA-dependent DNA replication
  Homolog annotation: Hit_ID=Q1T5K4; Match level="QueryCoverage=98%, HitCoverage=19%, E-value=5e-15, Identity=27%"; Hit description=RNA -directed DNA polymerase
MNALDVKDEVGVLSDEEILQRKKLLEEYLTISTRLDSLLHQQSISRWLKEWDQNSRFFHSLVRGRRRVNVMKDLSIGGRWEDDLTLVKEEVKNFFQSRFLEEDLNRPTLDGVHFNSLESKDLALLDESFDELEDDFVKLVVESHTFGKLPKGKNAFFITLIPKRDNP

SEQ ID NO: 178711 - protein, 170 aa, Glycine max
  Coding DNA Sequence Number=SeqID_61933
MPKKVKDKVVRLKRAFREEVGKIARNTKSSIWWKDMLKFSVGIDEGGGGGASSNVTHLGRWEMENSAYRVLKSYTEVEDPDPIFKILWQTSIPSSILFMAWRLFGIEVSSGLVFNRYSTAIQKSTLNNFVLDLFGEIQQRGGEPFGSQLFGVSGVRISLIFILYTEAKNS

SEQ ID NO: 178712 - protein, 305 aa, Glycine max
  Coding DNA Sequence Number=SeqID_61934
  Gene Ontology: Mol. function=transmembrane receptor activity; Cellular component=membrane; Biological process=defense response
  Homolog annotation: Hit_ID=Q1T4Q1; Match level="QueryCoverage=76%, HitCoverage=26%, E-value=2e-43, Identity=40%"; Hit description=TIR
  Pfam annotation: Domain name=LRR_1; Domain location=176-198; Score =10.1; E_value=3.7; Accession=PF00560.23; Description=Leucine Rich Repeat
  Pfam annotation: Domain name=LRR_1; Domain location=200-221; Score =3.6; E_value=61; Accession=PF00560.23; Description=Leucine Rich Repeat
  Pfam annotation: Domain name=LRR_1; Domain location=223-245; Score =12.2; E_value=1.5; Accession=PF00560.23; Description=Leucine Rich Repeat
  Pfam annotation: Domain name=LRR_1; Domain location=247-273; Score =0.7; E_value=2.1e+02; Accession=PF00560.23; Description=Leucine Rich Repeat
  Pfam annotation: Domain name=LRR_3; Domain location=110-129; Score =22.5; E_value=0.0015; Accession=PF07725.3; Description=Leucine Rich Repeat
  Pfam module annotation: Pfam domain module=LRR_1::LRR_1::LRR_1::LRR _1::LRR_3; Domain location=176-198::200-221::223-245::247-273::110-129
MDVLRISFDELNDKDKKIFLDIACFFADYDEDYVKEIIDFCRFHPENGLRVLVDKSLISIEFGKIYMHGLLRDLRRYIVREESPKEPRKWNRLWDYKDLHKVMLDNKPHKLIEMSLPESNMKQLWEDKKIEIEEGPVIIYFASCYCSLHPLHNLRHLDNSHSKNLIKIPNLGEAINLERLNLKGCTLLRKIDASIGLLRKLAFLNLKDCTSLIKLQFFGEALYLETLNLEGCTQLRKIDPSIGLLRKLTILNLKDCKNLLFDEPRDDELSEKLCIREAPTQSQSTSSILKKVVFEAFTFGVCQST

SEQ ID NO: 178713 - protein, 548 aa, Glycine max
  Coding DNA Sequence Number=SeqID_61935
MRVEEHTTNSRIQTGDVYHRSTQHVTPLRTYANVVASTATDAGQRKQFQPRYTNQRHSQSTVQLEVQWEEKKWLTEAWVGRLKKLTAFESVEEDLPWELGVDRTRPGYRVIWAQCWGIPLEVWDIGSIWKIVVAVGELVEVDDDVEDFRRLDRARVLIRTPWSPFFHHTVQVTIGGEIHMVSIIEEASADARTRANRFRMAMELSEDIHSDDLDTDAEFDSVPAGHPFFCQPNNPDDEGMQSLPGDGRDNTDNTHRALLPDIPRSNGSPMGNTLQTSGLENRERPEPGKAKVPPLAPQIPAYPHAQLGKVNKDEAGKRKEAKTRGVSSEVEERAVFADKERDVEGQKDDDQHRNIGPKNISAALPRKSHIRGIEENKKLGHLNQKPAGPIPQESSRKGSMQSVIVCDIQQPPCGPTNQMGLPNQISANSKQQENNTHVIHNSSCSNECKVFVRRKVWNQKQGQQRGHQLPQGKSPTLDMASTSTGHGKQPDNNSTDKAENSKGTSENTRQVASSQWEVAKILGVINNSVHEAIINKIDEMEKRDTKEA

SEQ ID NO: 178714 - protein, 255 aa, Glycine max
  Coding DNA Sequence Number=SeqID_61936
  Gene Ontology: Mol. function=RNA-directed DNA polymerase activity; Cellular component=membrane; Biological process=RNA-dependent DNA replication
MALGPLSQTGGVMGKSNQLKQQNLVIKRETAWKVGGGEKFRFWENPWTDNGMPLMEKFPRLYLISSQQNTRIMQMGCINNSGWEWKLTWRRDLFDSKVEMADIFIGDISKQQVQPHRKDTWIWKHDQSGSYSTKSGYDLIRRELTGADHDSDFTDLWKLKISSKAAMFAWRIILNRLPTRMNLRRRQVMVNDSMCPLCGLREEKAAHLFFSCSKSLPLWWESFSWVNLATTLLQNPSDHYLQHSAGTAEGKLLTR

SEQ ID NO: 178715 - protein, 220 aa, Glycine max
  Coding DNA Sequence Number=SeqID_61937
  Gene Ontology: Mol. function=protein binding; Biological process =regulation of transcription
  Homolog annotation: Hit_ID=Q9ZS22; Match level="QueryCoverage=72%, HitCoverage=17%, E-value=5e-79, Identity=89%"; Hit description =Cysteine-rich polycomb-like protein
  Pfam annotation: Domain name=CXC; Domain location=125-165; Score =63.7; E_value=6.1e-16; Accession=PF03638.5; Description=TesminTSO1 -like CXC domain
  Pfam annotation: Domain name=CXC; Domain location=46-79; Score=0.3; E_ value=0.029; Accession=PF03638.5; Description=TesminTSO1-like CXC domain
  Pfam module annotation: Pfam domain module=CXC::CXC; Domain location =125-165::46-79
MDLNRSARAQELISFNNGFFASLFLCFLLCDTCAERTCPVESSGHKLNTGCALAHDSCLLITYCTNPCACQGCLNGPKYAETIVETKQQIESHNPIAFAPKIVQPTTDISSHMDDENLTTPSSARHKSGCNYKRSMCLKKYCECYQANVGCSSGCQCEGCNVHGKKEDYVAFEHTSSKERVSSIVEEGSAHTFHNKLEMVASKTVYDSLPLTYNAIIAML

SEQ ID NO: 178716 - protein, 171 aa, Glycine max
  Coding DNA Sequence Number=SeqID_61938
  Homolog annotation: Hit_ID=Q9LEX1; Match level="QueryCoverage=61%, HitCoverage=20%, E-value=5e-40, Identity=70%"; Hit description=CaLB protein
MGEGCCTQPYPCICKEAVSGFEPMTNKSPRHNFTAAPGKSWKIIKSFLKRQEPFQFWVSTPWPKLHPNTGIFSIPLAVDIKLLGSLNRDDLKKICGDNFPEWISFPVYEQVKWLNKQLSKLWPFVADAATLVIRESVEPILEEYRPAGISSLKFSKLSLGNVAPKIEEESV

SEQ ID NO: 178717 - protein, 106 aa, Glycine max
  Coding DNA Sequence Number=SeqID_61939
MPLTKNKKAYLDGENSTQRKRRPQSRQWRWHDRNRQRGSKKTKEEGEKGDGVVALRRGRNINAREGPKQMFNTHSTKCRESQVPRSKFKKLKLATCLSSSSDFESC

SEQ ID NO: 178718 - protein, 211 aa, Glycine max
  Coding DNA Sequence Number=SeqID_61940
  Gene Ontology: Mol. function=phosphopantothenoylcysteine decarboxylase activity; Cellular component=cytosol; Biological process=nucleotide biosynthetic process
  Homolog annotation: Hit_ID=P94063; Match level="QueryCoverage=88%, HitCoverage=93%, E-value=9e-37, Identity=45%"; Hit description =Probable phosphopantothenoylcysteine decarboxylase
  Pfam annotation: Domain name=Flavoprotein; Domain location=25-133; Score=94.1; E_value=4.4e-25; Accession=PF02441.9; Description =Flavoprotein
MDCSNPAITKAMSEGVRLHTVPRMPRILLAACGCIDALKFRLLCQEFSGWAKISVVFTKSSLRFIDTESLFPKGLNVYRSNSANELLQWADIMVIAPLSAHTLAKIVGGICDDLLTRIVQAWDRKKPFYVAPSMHLFMWKNPFTERHLKCIEEEHDITIITRKERGSMTVIEPQEDEDKGEECEIGAMVEPSEISYTVKIAHEIILTYYPC

SEQ ID NO: 178719 - protein, 208 aa, Glycine max
  Coding DNA Sequence Number=SeqID_61941
  Gene Ontology: Mol. function=phosphopantothenoylcysteine decarboxylase activity; Cellular component=cytosol; Biological process=nucleotide biosynthetic process
  Homolog annotation: Hit_ID=Q9SWE5; Match level="QueryCoverage=89%, HitCoverage=91%, E-value=2e-51, Identity=53%"; Hit description =Phosphopantothenoylcysteine decarboxylase
  Pfam annotation: Domain name=Flavoprotein; Domain location=23-139; Score=84.0; E_value=4.5e-22; Accession=PF02441.9; Description =Flavoprotein
MDCSDSASVKAKSEAKLGVPRKPRVLLAACGCVAAVKFGLLCHCFIEWADIRAVVTQSSLRFIDRASIPNGVFVYYDEYEWYSWKRMDIELLEWADIMVIAPLSAHTLAKIAGGYCDNLLTGTVRGWDPRKKPIFVAPSMNPFMWKNPSTEKHCKKCIDELGISLIPPISQRSGEGEYSTGAMAEPSDISRNVMISYSKFQKKNVGGV

SEQ ID NO: 178720 - protein, 73 aa, Glycine max
  Coding DNA Sequence Number=SeqID_61942
MRYKWDKRQPFPKGTRYERCTPLTTNHTTILEEAFNLEPSLLNGRTTTKQEQDLEDTNRSNIGTMKKTKEDIE

SEQ ID NO: 178721 - protein, 353 aa, Glycine max
  Coding DNA Sequence Number=SeqID_61943
  Gene Ontology: Mol. function=DNA binding; Cellular component=oxygen evolving complex; Biological process=DNA integration
  Homolog annotation: Hit_ID=Q1SDN3; Match level="QueryCoverage=60%, HitCoverage=16%, E-value=9e-69, Identity=58%"; Hit description =Polynucleotidyl transferase, Ribonuclease H fold
  Pfam annotation: Domain name=Flavoprotein; Domain location=194-281; Score=-32.5; E_value=0.0071; Accession=PF02441.9; Description =Flavoprotein
  Pfam module annotation: Pfam domain module=Flavoprotein::RVT_2; Domain location=194-281::29-239
MVFLRIMLPEEEEETKVAFGRGNSGGRGSIKPLVAKGYTQVEEQDYLDTFSPVVKLTIVRFLLALAAINKWHLKQLDVNNVFLHGNLNEEVYMVIPQGMQVARPWLVYKLQRSLYGLKQASRAWFARLSSFLISHGYKQCTSDHSFFIKHGCNTIVILLVYVGDIVLSGNDLSKIQRITNLLDNAFKIKDLGDFRYFLGFEVARSSIGINLYQRKYALDILNNVDMLGSKPVSTPCDYTTKHQHSGSPISAEDIAGGLCDDLLTTIVRAWDYRKPLFVAPSMSTCIWRNSFTEEHLGEIDGLGIMLIPPVPVNGDLERAMVEPATIISRVKASYKKQKMEQKEGSSSTSSGQV

SEQ ID NO: 178722 - protein, 274 aa, Glycine max
  Coding DNA Sequence Number=SeqID_61944
  Gene Ontology: Mol. function=RNA-directed DNA polymerase activity; Cellular component=mitochondrion; Biological process=RNA-dependent DNA replication
MDRVSKQQIGQNVEVYLDDMVVKSQTIAQHVADLEEVFAELCKYDMRLDLEKCTFGMHNPTNVQEVHKLNGRLASLSRFLLKFSKKAKPFYKLLKKIVPFLWFETCEQAFLAFKKTIAAPPVLSQPTPGIPLLLYLSVTNKVVSSTLIQDEGNHYLPIYFTNHILQDVEQCYQMIEKVALALITSARRLRPYFQSHQVVVKMNYPIKQNFQSSTSSKNLVAHEDTMVDSLVEFVGNDITTPDRWNLYFDYAFHVEYGTLVASLKLAREVRAKKL

SEQ ID NO: 178723 - protein, 79 aa, Glycine max
  Coding DNA Sequence Number=SeqID_61945
  Gene Ontology: Mol. function=adenyl-nucleotide exchange factor activity; Cellular component=cytoplasm; Biological process=protein folding
  Homolog annotation: Hit_ID=Q7N1U7; Match level="QueryCoverage=95%, HitCoverage=39%, E-value=3e-30, Identity=81%"; Hit description =Protein grpE
  Pfam annotation: Domain name=GrpE; Domain location=1-76; Score=10.8; E_value=7.4e-07; Accession=PF01025.9; Description=GrpE
MIEGIELTLKSLLGAVRKFGVEVVGETNVPFNPDVHQAMSMMESEEVAPNHVLMVMQRGYTLNGRLLRPAMVAVSKAKG

SEQ ID NO: 178724 - protein, 94 aa, Glycine max
  Coding DNA Sequence Number=SeqID_61946
MVLEIEAGEIRAIVVFNERSKLDPNSSINPDLNEKVTMWLFVRLVSKTSTDAHGWVGQTRGGNEPSCLSRVFGLAYVRFGSARLVYFKGQAQAF

SEQ ID NO: 178725 - protein, 77 aa, Glycine max
  Coding DNA Sequence Number=SeqID_61947
MTKLHRVRREDHRALGDRFSETGLKRRKRVKELRVFDRNNMEYSFDNNGGQKKSMRHNSNNVNEKAIELHEKVRERQ

SEQ ID NO: 178726 - protein, 204 aa, Glycine max
  Coding DNA Sequence Number=SeqID_61948
MEQEMISQEKQKEVTDIAEIGDITKMKTKLIESTGIMTDLSPAVVVVYHGDKNPIYEFGKLDTGKGLKELAQMGDPNKLQNSLKLLPNVKEVHVAGNIQIDPGQKASASFEMNKGDKLAYVVMFGVSNDWFYSNKEVIDSKVEGDLISKTTLLDLGTGIDQYPGAGNNQVLFGGFSQRESKNISKVGNIYPIPAMQNVLKINIE

SEQ ID NO: 178727 - protein, 120 aa, Glycine max
  Coding DNA Sequence Number=SeqID_61949
MDEFTIDEAYGFNDKENDGTVGERLFAITLIKDKTKGYLVDVYAGIETVQANEVYTKFDVINAYIHHIDDEETKYGLPRVKKILFDEAPDRYTFRIGFPDFPPCPFGNKFEALGWDKEHQ

SEQ ID NO: 178728 - protein, 83 aa, Glycine max
  Coding DNA Sequence Number=SeqID_61950
MQDCSQSVAPIVKGDFLINNFEWELMKNILYTSAIGSLMYPQRAFAKRDTQWLSASKNPKEDELSGSLTAPLQVIKQPLQLIR

SEQ ID NO: 178729 - protein, 77 aa, Glycine max
  Coding DNA Sequence Number=SeqID_61951
  Gene Ontology: Mol. function=4 iron, 4 sulfur cluster binding; Cellular component=integral to membrane; Biological process=electron transport
  Homolog annotation: Hit_ID=Q9SJI1; Match level="QueryCoverage=56%, HitCoverage=12%, E-value=9e-09, Identity=63%"; Hit description =Expressed protein
MNYKPWYVCEDHVLFLRSLGQAALDISAFILVKANEEVEERAKRVASAARRWKEYLRRVVDKPPTFKLPEASLSKDK

SEQ ID NO: 178730 - protein, 333 aa, Glycine max
  Coding DNA Sequence Number=SeqID_61952
  Gene Ontology: Mol. function=transmembrane receptor activity; Cellular component=membrane; Biological process=defense response
  Homolog annotation: Hit_ID=Q1SGR7; Match level="QueryCoverage=91%, HitCoverage=25%, E-value=6e-73, Identity=48%"; Hit description=TIR; Disease resistance protein; AAA ATPase
  Pfam annotation: Domain name=LRR_1; Domain location=200-221; Score =0.8; E_value=2e+02; Accession=PF00560.23; Description=Leucine Rich Repeat
  Pfam annotation: Domain name=LRR_1; Domain location=223-244; Score =6.0; E_value=22; Accession=PF00560.23; Description=Leucine Rich Repeat
  Pfam annotation: Domain name=LRR_1; Domain location=246-268; Score =11.2; E_value=2.3; Accession=PF00560.23; Description=Leucine Rich Repeat
  Pfam annotation: Domain name=LRR_1; Domain location=270-295; Score =2.6; E_value=93; Accession=PF00560.23; Description=Leucine Rich Repeat
  Pfam annotation: Domain name=LRR_3; Domain location=200-219; Score =29.3; E_value=1.4e-05; Accession=PF07725.3; Description=Leucine Rich Repeat
  Pfam module annotation: Pfam domain module=LRR_1::LRR_1::LRR_1::LRR _1::LRR_3; Domain location=200-221::223-244::246-268::270-295::200-219
MKETPSTDIMDVLRIIFDGLETMEKEIFLDIACFFSSDQFRGYDGWFETSKKILGYRGFYPEIGMKVLVEKSLISYHRGKICMHDLLKELGKTIVREKTPKEPRKWSRLWDYKDLQKVMIENKEAKNLEAIVIDIEKYQEEFLQRTMTVDALSKLIHLKLLMFKNVNFSGILNYLSNEMTYLYWKNYPFMSLPSSFHPDQLVELILPYSNIKELWKDTRYLPNLEILDLKYSQNLIEMPDLSGVPHLRDLDLEGCTKIVRIDPSIGTLRELVRLNLRNCKNLFLNLNIIFGLSSLVVLNLSGCYRNQGRQNIWKKLMKIEVPSNYQHPLYTKC

SEQ ID NO: 178731 - protein, 137 aa, Glycine max
  Coding DNA Sequence Number=SeqID_61953
MAGNGISESNKVKTYMNAIEEQFVSSDKSMASTLMKKLSSMKHDNIKEEERLKHEAPKSAHMVTHNKGNGKRGNGIPRLHKTVQMKQNGTKMNFFFYKKVGHMKKDCLKYKKWLEKKGLRILVKTKVILLHASFREF

SEQ ID NO: 178732 - protein, 1046 aa, Glycine max
  Coding DNA Sequence Number=SeqID_61954
  Gene Ontology: Mol. function=protein binding; Cellular component =membrane; Biological process=defense response
  Homolog annotation: Hit_ID=Q8GZF0; Match level="QueryCoverage=100%, HitCoverage=74%, E-value=0.0, Identity=68%"; Hit description =Resistance protein KR4
  Pfam annotation: Domain name=LRR_1; Domain location=1004-1027; Score =11.6; E_value=1.9; Accession=PF00560.23; Description=Leucine Rich Repeat
  Pfam annotation: Domain name=LRR_1; Domain location=576-598; Score =12.4; E_value=1.4; Accession=PF00560.23; Description=Leucine Rich Repeat
  Pfam annotation: Domain name=LRR_1; Domain location=600-621; Score =13.0; E_value=1; Accession=PF00560.23; Description=Leucine Rich Repeat
  Pfam annotation: Domain name=LRR_1; Domain location=623-645; Score =12.1; E_value=1.5; Accession=PF00560.23; Description=Leucine Rich Repeat
  Pfam annotation: Domain name=LRR_1; Domain location=647-669; Score =10.6; E_value=2.9; Accession=PF00560.23; Description=Leucine Rich Repeat
  Pfam annotation: Domain name=LRR_1; Domain location=671-692; Score =13.0; E_value=1; Accession=PF00560.23; Description=Leucine Rich Repeat
  Pfam annotation: Domain name=LRR_1; Domain location=694-716; Score =14.8; E_value=0.32; Accession=PF00560.23; Description=Leucine Rich Repeat
  Pfam annotation: Domain name=LRR_1; Domain location=718-740; Score =10.9; E_value=2.6; Accession=PF00560.23; Description=Leucine Rich Repeat
  Pfam annotation: Domain name=LRR_1; Domain location=742-764; Score =14.3; E_value=0.45; Accession=PF00560.23; Description=Leucine Rich Repeat
  Pfam annotation: Domain name=LRR_1; Domain location=765-787; Score =11.4; E_value=2.1; Accession=PF00560.23; Description=Leucine Rich Repeat
  Pfam annotation: Domain name=LRR_1; Domain location=789-810; Score =7.9; E_value=9.5; Accession=PF00560.23; Description=Leucine Rich Repeat
  Pfam annotation: Domain name=LRR_1; Domain location=926-947; Score =6.8; E_value=15; Accession=PF00560.23; Description=Leucine Rich Repeat
  Pfam annotation: Domain name=LRR_1; Domain location=949-971; Score =3.2; E_value=71; Accession=PF00560.23; Description=Leucine Rich Repeat
  Pfam annotation: Domain name=NACHT; Domain location=201-352; Score= -33.8; E_value=0.025; Accession=PF05729.3; Description=NACHT domain
  Pfam annotation: Domain name=NB-ARC; Domain location=162-461; Score =337.6; E_value=2.2e-98; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::NACHT::NB-ARC; Domain location=1004-1027::576-598::600-621::623 -645::647-669::671-692:...
  Pfam module annotation: Domain location=:694-716::718-740::742 -764::765-787::789-810::926-947::949-971::201-352::162-461
MAAEMVAGALVSTFVEKTIDSLASRFVDYFRGRKLNKKLLSKIKVKLLAIDVLADDAELKQFRDARVRDWLFKAKDVVFEAEDLLADIDYELSKCQVEAESQPILNQVSNFFRPSSLSSFDKEIESRMEQILEDLDDLESRGGYLGLTRTSGVGVGSGSGSKVLEKLPSTSSVVESDIYGRDDDKKLILDWITSDTDEKLSILSIVGMGGLGKTTLAQLVYNDPRIVSKFDVKAWICVSEEFDVFNVSRAILDTITDSTDDGRELEIVQRRLKEKLADKKFLLVLDDVWNESRPKWEAVLNALVCGAQGSRILVTTRSEEVASAMRSKEHKLEQLQEDYCWQLFAKHAFRDDNLPRDPGCPVIGRKIVKKCKGLPLALKSMGSLLHNKPFAWEWESVFQSEIWELKDSGIVPALALSYHHLPLHLKTCFAYCALFPKDYEFHRECLIQLWMAENFLNCHQGSKSPEEVGQLYFNDLLSRSFFQQLSEYREVFVMHDLLNDLAKYVCGDSYFRLRVDQAKCTQKTTRHFSVSMITERYFDEFGTSCDTKKLRTFMPTSHWPWNCKMSIHELFSKLKFLRVLSLSHCLDIEELPDSVCNFKHLRSLDLSHTGIKKLPESTCSLYNLQILKLNSCESLKELPSNLHELTNLGVLSLSSCHYLTEVPNSIGDLKHLRSLDLSHTGIKKLPESTCSLYNLQILKLDDCRSLKELPSNLHKLANLGVLSLSSCHYLTEVPNSVGNLKHLRSLDLSSTHITKLPDSTCSLSNLQILKLNSCEYLKELPSNLHELTNLHRLEFVNTEIIKVPPHLGKLKNLQVSMSSFHVGKSSKFTIQQLGELNLVHKGLSFRELQNIENPSDALAADLKNKTRLVELEFEWNSHRNPDDSAKERDVIVIENLQPSKHLEKLSIRNYGGKQFPNWLSNNSLSNVVSLELRNCQSCQHLPSLGLLPFLKKLEISSLDGIVSIGADFHGNSSSSFPSLETLKFSSMKAWEKWECEAVRGAFPCLQYLDISKCPKLKGDLPEQLLPLKELEISECKQLEASAPRAL

SEQ ID NO: 178733 - protein, 130 aa, Glycine max
  Coding DNA Sequence Number=SeqID_61955
  Gene Ontology: Mol. function=ribonuclease H activity
  Homolog annotation: Hit_ID=Q1T1H6; Match level="QueryCoverage=55%, HitCoverage=21%, E-value=1e-10, Identity=38%"; Hit description =Ribonuclease H
MMIWSPNVNGSYTSKSAYSWLLHQRRRIFFIASEIVFSLSGFGEGWVLRSLISFITLVMCSGFKHIPRVRTIAGSLLDCGVFGMLGMIFVSTISEGPCRKSISQLPLCCSYFHHLGSVERSAECSIEAYA

SEQ ID NO: 178734 - protein, 266 aa, Glycine max
  Coding DNA Sequence Number=SeqID_61956
  Gene Ontology: Mol. function=protein binding; Cellular component =membrane; Biological process=defense response
  Homolog annotation: Hit_ID=Q8GZF0; Match level="QueryCoverage=93%, HitCoverage=19%, E-value=1e-101, Identity=77%"; Hit description =Resistance protein KR4
  Pfam annotation: Domain name=LRR_1; Domain location=171-191; Score =11.2; E_value=2.3; Accession=PF00560.23; Description=Leucine Rich Repeat
  Pfam annotation: Domain name=LRR_1; Domain location=194-217; Score =7.8; E_value=10; Accession=PF00560.23; Description=Leucine Rich Repeat
  Pfam annotation: Domain name=LRR_1; Domain location=42-64; Score=5.9; E_value=22; Accession=PF00560.23; Description=Leucine Rich Repeat
  Pfam annotation: Domain name=LRR_1; Domain location=67-90; Score =10.8; E_value=2.7; Accession=PF00560.23; Description=Leucine Rich Repeat
  Pfam module annotation: Pfam domain module=LRR_1::LRR_1::LRR_1::LRR _1; Domain location=171-191::194-217::42-64::67-90
MSDNGFDSQKTFPLDFFPALRTLRLSGFRNLLMITQDQTHNHLEVLAFGKCPQLESLPGSMHMLLPSLKELVIKDCPRVESFPEGGLPSNLKKIELYKCSSGLIRCSSGLMASLKGALGDNPSLESLGIGKLDAESFPDEGLLPLSLINLSIYGFPNLKKLDYKGLCQLSSLKKLILDGCPNLQQLPEEGLPNSISNLWIINCPNLQQLPEEGLSNSISNLFIIACPNLEQRCQNPGGQDWPKIAHIPTVRCTSYFRDRRDACVIM

SEQ ID NO: 178735 - protein, 49 aa, Glycine max
  Coding DNA Sequence Number=SeqID_61957
  Subcellular localization annotation: CTP_CleavageSite=32; ConfidenceScore=5.07e-01
MTVASACKFQDPSLNRSFILRGLSPKPNGRVPCSNTQVKATFQSILGFY

SEQ ID NO: 178736 - protein, 387 aa, Glycine max
  Coding DNA Sequence Number=SeqID_61958
  Homolog annotation: Hit_ID=Q1SKD7; Match level="QueryCoverage=55%, HitCoverage=55%, E-value=2e-11, Identity=26%"; Hit description =Ankyrin
MVSRKRQAVPAQGGESTWDSSRFTSEIAWHRYQDNVHLRNILPERNVELAPGMFDDFLRELQRRQWHRVLTKLPEKQIDVALVKEFYSNIYDPEDGSHKYCRVRGHVIRFDAETINDFLDTPVILADGEDYSVYSQYLHTYPDHQAITTALCIPGGGFVLNADGAPWKLLRKDLTTLAQTWSVLSYFNLAPTSHTSDLNVDRARLIYGLVMKMDMDLGSFIFDQITQIAQSNTSRLGFPALITALCDAQGVVSDTLTFESLSPVINLAYIKKNCWNPADPSITFPGARRTRARATAPDALPPSQPPSQAVHHQQTSTLAPLDTHSQMLQSLYQGQQIIIQDLHRLSLHLKMDPPLTTPEAYVQQPFGVQDTMVGAEEDIIADLAATD

SEQ ID NO: 178737 - protein, 207 aa, Glycine max
  Coding DNA Sequence Number=SeqID_61959
  Gene Ontology: Mol. function=phosphopantothenoylcysteine decarboxylase activity; Cellular component=cytosol; Biological process=coenzyme A biosynthetic process
  Homolog annotation: Hit_ID=Q9SWE5; Match level="QueryCoverage=86%, HitCoverage=86%, E-value=2e-73, Identity=68%"; Hit description =Phosphopantothenoylcysteine decarboxylase
  Pfam annotation: Domain name=Flavoprotein; Domain location=23-143; Score=151.1; E_value=2.9e-42; Accession=PF02441.9; Description =Flavoprotein
MDCSDPASKKAKAEAGCAITRKPRILLGACGSVGAVKFGHVCRCFAEWAEVRAVVTKSSLCFIDEQTFPKDVVVFCDKHEWLTWKKLGDPVMHIELLRWAEIMVIAPLSANTLGKIAGGLCDNLLTCIVRAWDYSKPLFVAPSMNSIVWRNPFTERHCTEIDELGITLIPPVTHTTASGDFEHGAMAEPSTISSTVRVFYVLKMQKK

SEQ ID NO: 178738 - protein, 110 aa, Glycine max
  Coding DNA Sequence Number=SeqID_61960
  Gene Ontology: Mol. function=phosphopantothenoylcysteine decarboxylase activity
  Homolog annotation: Hit_ID=Q9SWE5; Match level="QueryCoverage=63%, HitCoverage=36%, E-value=5e-16, Identity=58%"; Hit description =Phosphopantothenoylcysteine decarboxylase
MEKEGRDDFREGFPYLRSSGFKGGLCDNLLTCIVRAWDYRKALFVASSMNISMGRRNPSREQHRIGIDELGITLIPPSGESEVRAMADPSTFYHLLNCKTLLLAKDEGKE

SEQ ID NO: 178739 - protein, 119 aa, Glycine max
  Coding DNA Sequence Number=SeqID_61961
MNVPSLTARSHHHQTPQQAQCYHTARIFFTRTHYSSKTWYTVLGNYAFAFEEVIRSKGYRVVVGVIQLDSSLIFSGHNILSIYGGSLERLLDDSFEVLRLIGVSQVGEQVYFDIALLGM

SEQ ID NO: 178740 - protein, 649 aa, Glycine max
  Coding DNA Sequence Number=SeqID_61962
  Gene Ontology: Mol. function=RNA-directed DNA polymerase activity; Biological process=RNA-dependent DNA replication
  Homolog annotation: Hit_ID=Q1S4Z4; Match level="QueryCoverage=13%, HitCoverage=10%, E-value=1e-21, Identity=55%"; Hit description=RNA -directed DNA polymerase
MVDVDDDVEEVQRMDRARVLIKTPWRPVIQHTVNIHVQGEELETDESDAGTPLKETICRMEREDDSQFTVVPGNTDTLTTTTPISSSGTKIHELALLPDGPKGNANHAFTRREQPLQPHCRIPSRQGTELTTQQLPTRISPRTIAWSQLTEKAIHTKTETRDPEGEFKTGLGFVTHTLTATTEQHISSPQTNKADPTSAWQVYSRKRWYKKQLDLGCAAGVILDTATALILSSPQQHHQENKDKCGTNQDEINAHLDDASAQDAAEDANSANIQKQEATALWNMAKELGEKYPMNIITYNVRGLGRGVKWPTIRRMVNKQHIDMIYIQETKKEVIEKFMYQALWGDSEVSWEAHPASNSAGKWLKEAQQVHVINIYSPCDIQNKRVLWDSKDWMGENNIREFNEWIEELEVEEVPWVRRKFTWFRPNGAARSKLDRFLGPKPFSILDCWLLDNPFKKTVQESWTSNQQRGWRGRLRMSNKLEEDTIDRHLSPQEVLIRKQLQEELWVAAQSHESLLRQKARSRWIKEESKRQSDYSSCTDFKNLIKIDPGWMVTDPQLLNDYRPISLIGCIYKIVVKLLANRLKKVMSLIIDGKQSAFIEGRHLLHSALIANEVVKEAKRSQKSCIVFKVDYKKAYDDAWLPVGVAADL

SEQ ID NO: 178741 - protein, 219 aa, Glycine max
  Coding DNA Sequence Number=SeqID_61963
  Homolog annotation: Hit_ID=Q6EUI5; Match level="QueryCoverage=74%, HitCoverage=5%, E-value=6e-20, Identity=37%"; Hit description =Putative lysosomal trafficking regulator 2
MAPNRGRGSTDGLVAQSVEFEDMVAQFIQFCRAEHCDVVMVVVGSIHGISLFTHDSKVARVLHLFYRLVVQPNTSRAHTFAEEFLACGGIETLLVLLQREAKAGDSCVLESLSMNPEPQKSEIDSGNEMTKGSQEDDGSKDKSEAIIQDNDQGFLSVDSGSSPDPSSPDVNSDRIFASEIPSAKNLGGISLSISADSARKNVYNVDKSDGIVVGIIGLL

SEQ ID NO: 178742 - protein, 59 aa, Glycine max
  Coding DNA Sequence Number=SeqID_61964
MEEWPEWILEVLISNYEVGSSKLSDSTTIGDIEDLIHNFLSIMLEHSMRQKDGWKVDIC

SEQ ID NO: 178743 - protein, 300 aa, Glycine max
  Coding DNA Sequence Number=SeqID_61965
  Homolog annotation: Hit_ID=Q6EUI5; Match level="QueryCoverage=99%, HitCoverage=11%, E-value=8e-68, Identity=46%"; Hit description =Putative lysosomal trafficking regulator 2
MQTQIIAAAAAGVAAEGLSPKDSKAEAENAAQLSVALVENAIVILMLVEDHLRLQNKQSSSARAPNSSPSPLSVVYATNNHSNPLSTIDESTEVVDDRRSLDSDSGGVPLNVLSSMADGSGQIPTSVMERLAAAAAAEPYESVSCAFVSYGSCAKDLADGWKYRSRLWYGVSLSPSQAPFGGGGSGWDFWKSALEKDANGNWIELPLVKKSVAMLQALLLDESGLGGGLGIGGGSGTGMGGMAALYQLLDSDQPFLCMLRMVLLSMREDDDGEDHMLMRNTSFEDAVSEGRKPRSALLWR

SEQ ID NO: 178744 - protein, 110 aa, Glycine max
  Coding DNA Sequence Number=SeqID_61966
PDLESILADFMTYQASSKGSCYGMQQQGTQFQRNQFSTGYQWESFWQPNYHDKTEGVLNLDDLLMQFKDTVESMQQAFRRIATKISKLVDDMASAAAKQEEERAKIETDK

SEQ ID NO: 178745 - protein, 117 aa, Glycine max
  Coding DNA Sequence Number=SeqID_61967
  Gene Ontology: Mol. function=nucleic acid binding; Cellular component= endoplasmic reticulum membrane; Biological process=DNA integration
MARSMLESKILPKEFLIEGVTCIVYLSNQSPTISLWEKTPQEAWSGKNPDISHPRVFGSISHEHVLDEKISKLDDKSKKYIFISYDSNSKGYRLYNPNSGNTIITQDVNFNEEGEWD

SEQ ID NO: 178746 - protein, 110 aa, Glycine max
  Coding DNA Sequence Number=SeqID_61968
  Gene Ontology: Mol. function=metal ion binding; Biological process =Notch signaling pathway
  Homolog annotation: Hit_ID=Q1T5D4; Match level="QueryCoverage=77%, HitCoverage=7%, E-value=9e-33, Identity=81%"; Hit description =Protein kinase; Zinc finger, RING-type
  Pfam annotation: Domain name=Ank; Domain location=35-67; Score=32.6; E_value=1.4e-06; Accession=PF00023.20; Description=Ankyrin repeat
  Pfam annotation: Domain name=Ank; Domain location=68-100; Score=30.4; E_value=6.1e-06; Accession=PF00023.20; Description=Ankyrin repeat
  Pfam module annotation: Pfam domain module=Ank::Ank; Domain location =35-67::68-100
LSHLILFAHAKYRGERIGANFAFCGADPSAQHSQHGRTALHTAVMIDDVKLVKVILAAGVDVNIRNVHNGIPLHIALARGAKSCVELLLCIGADCNLQDDDGNTALHIAA

SEQ ID NO: 178747 - protein, 90 aa, Glycine max
  Coding DNA Sequence Number=SeqID_61969
  Subcellular localization annotation: CTP_CleavageSite=19; ConfidenceScore=5.28e-01
MATPSASPPPPPAVALASPCTLKWTRKATWLRSLATRPPGAERPVVHVDLVTDKVDGPHKKKLGTYLGIVAHDKVEFDIPETSDCRTKKK

SEQ ID NO: 178748 - protein, 137 aa, Glycine max
  Coding DNA Sequence Number=SeqID_61970
  Gene Ontology: Mol. function=binding
  Homolog annotation: Hit_ID=Q1SPQ2; Match level="QueryCoverage=91%, HitCoverage=19%, E-value=3e-22, Identity=50%"; Hit description=IMP dehydrogenase/GMP reductase
MATSSNTGQKLKEWPQPAFFNYELLVVVAVASQGDQLGDNDRAILQGTCVEDQLVCSDQREVADVVSTTITGGDLKELGDVANGVLEKQGDLAEPDSGVKGEDALHEGVVMEIEGQGEGLVEDVFCFVNETARRGRC

SEQ ID NO: 178749 - protein, 392 aa, Glycine max
  Coding DNA Sequence Number=SeqID_61971
  Homolog annotation: Hit_ID=Q2HUH8; Match level="QueryCoverage=42%, HitCoverage=51%, E-value=3e-23, Identity=34%"; Hit description =Histidine triad (HIT) protein; Homeodomain-like
MPTFNNARFDIGARNDVETLLEPILESILKSFYVIVLCLVGRFLMERYIHAQIMIERMSKGSEGWDLTFDKNLLILSIIKDEEIPSLVPLYKVPFWLTRVHVDVRKPLKHIKKIEKEGLVRGGVKGKVRRKNEESTEREEEEKCEKERGDEKTREREEEKSDRYYVYSNGRKSGEENAKDTFADISYIPVNSPMKVSNNDVGSQFPQFSSQIGLDEIVIDEIEGSPTKKKPRVAFAVEEDTHLISSWLNISTDPIVGVGQGKEAFWLRVTKNYNKFRGSLQQAVSLKKSGCTENDVMLNAYTIWKEDEGTNFGLEHAWRLLKDKPKWKSKGNEVGTSTNPVDLTGVEEATRESNVVNAKLATLREKELENDYYDILMKDIVGSSGLEIIKKG

SEQ ID NO: 178750 - protein, 124 aa, Glycine max
  Coding DNA Sequence Number=SeqID_61972
  Gene Ontology: Cellular component=nucleus
  Homolog annotation: Hit_ID=Q6EUI5; Match level="QueryCoverage=81%, HitCoverage=3%, E-value=3e-28, Identity=58%"; Hit description =Putative lysosomal trafficking regulator 2
MDGSDSSVETGKQEKDRSWLMSSLHQIYSRRYLLRRSALELFMVDRSNFFFDFGNGEGRRNAYRAIVQARPPHLNNIYLATQRPEQLLKRIQLMERWARWEISNFEYLMQLNTLAGRSYNDITQ

SEQ ID NO: 178751 - protein, 86 aa, Glycine max
  Coding DNA Sequence Number=SeqID_61973
MARRLQEDCARDAREGPRVFMSLRWHLQSPFLLLHSTVIDLQEARSPLMKKIQGLQALHGATSRLDSISNKATKNKRFRTEGVNSG

SEQ ID NO: 178752 - protein, 692 aa, Glycine max
  Coding DNA Sequence Number=SeqID_61974
  Gene Ontology: Mol. function=protein kinase A binding; Cellular component=nucleus; Biological process=eye photoreceptor cell development
  Homolog annotation: Hit_ID=Q6EUI5; Match level="QueryCoverage=82%, HitCoverage=20%, E-value=0.0, Identity=55%"; Hit description =Putative lysosomal trafficking regulator 2
  Pfam annotation: Domain name=Beach; Domain location=10-233; Score =341.6; E_value=1.3e-99; Accession=PF02138.8; Description=BeigeBEACH domain
  Pfam annotation: Domain name=WD40; Domain location=381-419; Score =40.9; E_value=4.3e-09; Accession=PF00400.22; Description=WD domain, G-beta repeat
  Pfam annotation: Domain name=WD40; Domain location=461-499; Score =16.9; E_value=0.071; Accession=PF00400.22; Description=WD domain, G -beta repeat
  Pfam annotation: Domain name=WD40; Domain location=625-664; Score =1.3; E_value=26; Accession=PF00400.22; Description=WD domain, G-beta repeat
  Pfam module annotation: Pfam domain module=Beach::WD40::WD40::WD40; Domain location=10-233::381-419::461-499::625-664
MDLLIFKSLTKIINAKRIYTRYNHSKESCQKNLTVARKVVGKYESPETLLKSPAVLYYLVRVEPFTTLAIQLQGGKFDHADRMFSDISATWNGVLEDMSDVKELVPELFYLPEVLTNENSIDFGTTQMGGKLDTVKLPAWAENPVDFIHKHRKALESEYVSAHLHEWIDLIFGYKQRGKEAVTANNVFFYTTYEGTVDLDKISDPVQQRAIQDQIAYFGQTPSQLLTVPHLKKMPLAEVLHLQTIFRNPKEVKPYAVPFPERCNLPAAAIHASSDTVVVVDTNAPAAHVAQHKWQPNTPDGQGTPFLFQHRKAILASAGGTIMRMFKAPAASGGEWQFPQAVAFAVSGIRSQAIVSITSNKEVITGGHADNSIRLISSDGAKTLETAYGHCAPVTCLGLSPDSNYLVTGSRDTTVLLWRIHRALSSHSSVVSEHSTGTGTSSSTSNSSLHLIEKDRRRRIEGPIQVLRGHHSEILSCCVNSDLGIVVSCSHSSDVLLHSIRRGRLIRRLDGVEAHTVCLSSEGVVMTWNESQHTFSTFTLNGTPIASAQLSFFCSIGCMEISVDGTSALIGINSLENGRAYNSSPDSQSNKSGVVDFDSESEETFDNSRIDVPSPSICFLDMHTLEVFHVLKLGEGQDITALALNKDNTNLLVSTLDKQLIIFTDPALSLKVVDQMLKLGWEGDGLQPLIKS

SEQ ID NO: 178753 - protein, 573 aa, Glycine max
  Coding DNA Sequence Number=SeqID_61975
  Gene Ontology: Mol. function=oxidoreductase activity; Cellular component=membrane; Biological process=electron transport
  Homolog annotation: Hit_ID=Q2LAJ8; Match level="QueryCoverage=98%, HitCoverage=97%, E-value=1e-121, Identity=61%"; Hit description =Cytochrome P450 monooxygenase CYP76E3
  Pfam annotation: Domain name=p450; Domain location=112-564; Score =268.0; E_value=1.9e-77; Accession=PF00067.12; Description=Cytochrome P450
DLFVAGIDTTSSIVEWIVAELLRNPHKLAKVRTEIFEVIGKDGTLEEQHILKLPFLRAVVKEALRLHPPGPFLVPHKCDEIVSICGFKLPKNAQILVNVWAIGRDPTIWENPEMFMPERFLECEIDFKGHDFELIPFGTGKRICPGLPLAHRSMHLVVASLVHNFEWKLADGTIPHSVHALDHHKYSIVFMHPSPKWRKLRRVCATKIFSPQALDSTQILRQQKVHKLLDFVEERCKKGEVLDIGEAIFTTTLNSISTTLFSMDLSNSTSEESQENKNIIRAMMEEAGRPNVADFFPILRPLDPQRSFARMSNYFKKMFKIIDGITEERMCSRLLETDSKVYKDVLDSLINIEETGYQLSHNEMLHLFLDLLVAGIDTTSNTVEWIMAELLRNPDKMEKARKELSQTIDKDAIIEESHILKLPFLQAVVKETLRLHPPAPFLVPHKCDEMVSISSFNVPKNAQVLVNVWAMGRDPAIWENPEMFMPERFLEREIDFKGHDFEFIPFGAGKRICPGLPFAHRTMHLMVASLVHNFEWKLADGLMPEHMNMKEQYGLTLKKAQPLLVQAIAITHI

SEQ ID NO: 178754 - protein, 223 aa, Glycine max
  Coding DNA Sequence Number=SeqID_61976
  Subcellular localization annotation: CTP_CleavageSite=33; ConfidenceScore=5.56e-01
MTPLLSVGVAATGAPMVLPPCFMSLVASPFVVLAAVVSPSSSSHVSLDHLYTSSEADSLWGATYKLEQKTPVGFVSAFDNKLIRSIGVQNATDSTKVFLRRSFAILEENRLRHQEAMQKDHDGLVKSRMMWGHLRSCQPVRGGRTLDLLSFSSDGYEELVEASKCLADRRNLEGNLSRRHALSASSARSASRLSPSRFSASLALSESSLTRAKRENGTMRDVK

SEQ ID NO: 178755 - protein, 55 aa, Glycine max
  Coding DNA Sequence Number=SeqID_61977
MWVLWGSSDDDIGFPGNLWVRPTTMWVSTERFPADFGREEKKNSDFRQEDDKEKR

SEQ ID NO: 178756 - protein, 643 aa, Glycine max
  Coding DNA Sequence Number=SeqID_61978
  Gene Ontology: Mol. function=transferase activity, transferring hexosyl groups; Cellular component=integral to membrane; Biological process=carbohydrate biosynthetic process
  Homolog annotation: Hit_ID=Q9M3Y6; Match level="QueryCoverage=92%, HitCoverage=99%, E-value=0.0, Identity=86%"; Hit description=68 kDa protein
  Pfam annotation: Domain name=Glyco_transf_8; Domain location=303-617; Score=386.9; E_value=3.1e-113; Accession=PF01501.10; Description =Glycosyl transferase family 8
MTQLFRAKRLPDRKNGRHCRILNCFFQKRQAKADIYSYSVFHVLDVIVSNTNDVGPLSLENFRKNNLSASWRVAGLRTSNAMNQLNQPADNVREEKQNGKEGRFSGGIILSVDRAQWTGSPAQLSRRQLIEKRKEKRAAELVKQDDEVIVKLEDSAIEHSKSVDSAVLGKYNIWRKENENENADSTVRLIRDQIIMAKVYLSIAKMKNKLQLYQELESQLKESQRALGEATSDADMHHSDHEKMKTMGQVLSKAKEQLYDCELVTGKLRAMLQTADEQVRGLKKQSTFLSQLAAKTIPDGIHCLSMRLTIDYYLLPLEKRKFPRSENLENPSLYHYALFSDNVLAASVVVNSTIVNAKDPSKHVFHLVTDKLNFGAMNMWFLLNPPGKATINVENVDEFKWLNSSYCPVLRQLESATMKEYYFKAGHPTTTGASNLKYRNPKYLSMLNHLRFYLPQVYPKLDKILFLDDDIVVQKDLTGLWAVNLNGKVNGAVLTCGESFHRFDKYLNFSNPHIAKNFDPNACGWAYGMNMFDLKVWKKKDITGIYHKWQNLNEDRVLWKLGTLPPGLMTFYGLTHPLNKSWHVLGLGYNPSVDRSEIDTAAVIHYNGNMKPWLEIAMTKYRSYWTKYVKFNHPYLQNCKLRE

SEQ ID NO: 178757 - protein, 239 aa, Glycine max
  Coding DNA Sequence Number=SeqID_61979
  Gene Ontology: Mol. function=sequence-specific DNA binding; Cellular component=nucleus; Biological process=regulation of transcription, DNA-dependent
  Homolog annotation: Hit_ID=Q8LLR1; Match level="QueryCoverage=99%, HitCoverage=100%, E-value=2e-61, Identity=56%"; Hit description=MADS- box protein 3
  Pfam annotation: Domain name=K-box; Domain location=75-174; Score =100.6; E_value=4.8e-27; Accession=PF01486.8; Description=K-box region
  Pfam annotation: Domain name=SRF-TF; Domain location=9-59; Score =107.2; E_value=4.8e-29; Accession=PF00319.9; Description=SRF-type transcription factor (DNA-binding and dimerisation domain)
  Pfam module annotation: Pfam domain module=K-box::SRF-TF; Domain location=75-174::9-59
MGRGKVELKRIENKINRQVTFSKRRNGLVKKAKELSVLCDAEVALVIFSARGKPFTFPDDAESIMKTYDRYRKYYSHQHGNIELENQDWYQEMLKLNEKCESLQRTQRLLHGEDLGPLSIKELLILEEQLEKALSQARQRKTQLMIKQMEELRQKERHLEDLNKELRLKPPFQLEPYGFNLKASLWGSTSSADGDGSFPLQPSLTYPEPFLQIGYSVQGEPSIVPKSMASETNFQGWFL

SEQ ID NO: 178758 - protein, 49 aa, Glycine max
  Coding DNA Sequence Number=SeqID_61980
MTRVRGPKLLMLRQPLRKVLIETPQDRLGIEQSSAFYLFRARLRTTTYW

SEQ ID NO: 178759 - protein, 96 aa, Glycine max
  Coding DNA Sequence Number=SeqID_61981
MSPAMVEMEKFDHIEERLRVIEGGGNYAFPNMAELCLVPDVVIPPKFKVPNFDKYKGTTCPKNHLKVYCRKMRAYAKDEKLLMHFFQESLTGVAIT

SEQ ID NO: 178760 - protein, 63 aa, Glycine max
  Coding DNA Sequence Number=SeqID_61982
MKIESGLEDEASPSNVQPQHSPPPPSLSDTLNQPPVTRRATALVITQCMKGLSSCHKIIMSDL

SEQ ID NO: 178761 - protein, 44 aa, Glycine max
  Coding DNA Sequence Number=SeqID_61983
MANIMLQITRTSDEVLNTVHAKEQTCGEVSRLFSMRWKDMLECY

SEQ ID NO: 178762 - protein, 70 aa, Glycine max
  Coding DNA Sequence Number=SeqID_61984
MVNNIFTLSRHKENMVQPKPSAGLKGKPHQHALTHHAFLYFNKQKLGPPRPKSCFGIYPNSRKLSASKKW

SEQ ID NO: 178763 - protein, 78 aa, Glycine max
  Coding DNA Sequence Number=SeqID_61985
MGAKYLEAEPIGKITKKPYFPLTGGSVLDNGGCMNSTRQSIHGAPNKMLEDARTALGNQSALDGGGSMNANQFMGLRT

SEQ ID NO: 178764 - protein, 65 aa, Glycine max
  Coding DNA Sequence Number=SeqID_61986
MVTSMLQLDSMNLFVKARAWFNPITQGMAILIANTSSTIHRDERLGNMHAMHGKWENARVTHEQT

SEQ ID NO: 178765 - protein, 94 aa, Glycine max
  Coding DNA Sequence Number=SeqID_61987
MLYGALIELDGARVMGEVEEIQETMKADMEAIKEKMATMMEAMMSVKKIMEANAVAIAATSVVAKVNPTPPSGIPESSNLRYGRQRFGKYGRPP

SEQ ID NO: 178766 - protein, 166 aa, Glycine max
  Coding DNA Sequence Number=SeqID_61988
  Gene Ontology: Mol. function=chitin binding; Cellular component =extracellular region; Biological process=chitin metabolic process
  Homolog annotation: Hit_ID=O00839; Match level="QueryCoverage=97%, HitCoverage=28%, E-value=8e-18, Identity=41%"; Hit description=SAcP -2 protein
  Subcellular localization annotation: CTP_CleavageSite=82; ConfidenceScore=5.66e-01
AKACSPQMARTYSPLKAMACSLLKVRTYSPLMTKACSPLKVRARSPQKVRTYSPRLARTCSPLMASTCCPLTARMCSPLKVRAHGPQKVRTCSPLKVRARSPLMARTCSPLKVRACSPLKVRSHSPMNVRTCSPLMARMYSPLKARACSPLKVRTRSPLKVTARSP

SEQ ID NO: 178767 - protein, 178 aa, Glycine max
  Coding DNA Sequence Number=SeqID_61989
  Homolog annotation: Hit_ID=Q9FL02; Match level="QueryCoverage=44%, HitCoverage=63%, E-value=2e-08, Identity=43%"; Hit description =Arabidopsis thaliana genomic DNA, chromosome 5, P1 clone:MUD21
  Subcellular localization annotation: CTP_CleavageSite=58; ConfidenceScore=5.54e-01
MMLHTMKKFLTYPFTPFPISLSSNLGRGSTSVLTFSTHPDSVLDKTQHPTEKATENVMSNSFVEGYASRSDEKGFEGASEGKQSTSKVEMDKFIHENHPGSRKYLQNTRLRQERGLRTIGRIELAYGRIEVKATRFLDLAQFLTKLHKISSTSSNMDNRSKEQLCACKVYVAGHLALG

SEQ ID NO: 178768 - protein, 269 aa, Glycine max
  Coding DNA Sequence Number=SeqID_61990
  Homolog annotation: Hit_ID=Q337F4; Match level="QueryCoverage=98%, HitCoverage=81%, E-value=8e-26, Identity=29%"; Hit description=F-box domain containing protein, expressed
  Subcellular localization annotation: CTP_CleavageSite=37; ConfidenceScore=5.10e-01
MWNKACRDPSLWCKLDLSRLNSYFFNIPNNQPGACKRSNAKMTQFIKYVLSLSNGTTCLVFNYNVHLTDEQFIITAERTPNLKRLVLPKTVEFSRVDVHVAMKSWEGLESINITSNIPSHYIFPAIGKYCKNIIEMKFGYGCLFEEKHVEALIKCAPNLEGLSIRSKMTKMEALCGVFTFLEHLEAVNILHSFIIDASYRGLGDVDICYLQNHLPPSSLGKLIYCEGGSCLRCKNGNSITTGRIFQIASIIMRASEDLWREDEITSLAR

SEQ ID NO: 178769 - protein, 141 aa, Glycine max
  Coding DNA Sequence Number=SeqID_61991
  Gene Ontology: Mol. function=transporter activity; Cellular component= intracellular; Biological process=transport
  Homolog annotation: Hit_ID=Q1S4E3; Match level="QueryCoverage=59%, HitCoverage=28%, E-value=1e-32, Identity=76%"; Hit description =Cellular retinaldehyde-binding/triple function, N-terminal
  Pfam annotation: Domain name=CRAL_TRIO_N; Domain location=61-135; Score=30.3; E_value=6.8e-06; Accession=PF03765.5; Description =CRALTRIO, N-terminus
MTLAQTKSHETDQRCREKRENRVLIPVLTFSCVNGSVSEERKQTKLGWELVPLVVTMFLLRRQTQNHHENDSSYQDTKVAELKTALGPLSGRQLKYCTDACLRRYLEARNWNVDKTKKMLEETLEWRATYRPEEIRWVSLI

SEQ ID NO: 178770 - protein, 61 aa, Glycine max
  Coding DNA Sequence Number=SeqID_61992
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=P28147; Match level="QueryCoverage=88%, HitCoverage=27%, E-value=3e-22, Identity=92%"; Hit description=TATA -box-binding protein 1
MADQGLEGSQPVDLQKHPSGIVPTLQNIVSTVNLDCKLDLKTIALQARNAEYNPKASFICL

SEQ ID NO: 178771 - protein, 96 aa, Glycine max
  Coding DNA Sequence Number=SeqID_61993
  Subcellular localization annotation: CTP_CleavageSite=85; ConfidenceScore=5.26e-01
MSIAVAATSAVAKVNPMPPSDLNQMNHPTSDMVGKNLRSTDGPMIYKFKMSTPSHHMACLPTIHHPMWRTLPMRMSITPLPYSLRADNLMYMSLNS

SEQ ID NO: 178772 - protein, 173 aa, Glycine max
  Coding DNA Sequence Number=SeqID_61994
MGGALTLLDVPSGGNRAVKESKHLLGGWLRIFSLSMVIALDGWSSPASALDRASIYIKYLQGRTNRGFSICGVKIKSDGSTDKEAGSEGGIVEEEGVIASDAEVEGASDLLPLDFLPDRELSLQQREEKNEGLKKSHPSSRFFLALNCKSGALSGWLAKPEDWLSKKLKISTS

SEQ ID NO: 178773 - protein, 103 aa, Glycine max
  Coding DNA Sequence Number=SeqID_61995
MASSSTLTMDRLKILRHPPQEMLRLSNHSIFLTRDIQQGIPDKVNAPPMYIHNLHHHNVISTSSASRLDITLNMNVILFSMALSITTTSSHINIIINNIINSY

SEQ ID NO: 178774 - protein, 33 aa, Glycine max
  Coding DNA Sequence Number=SeqID_61996
MEPQCAIKKDATELLFVYAVRDNIIDPVKDEEL

SEQ ID NO: 178775 - protein, 1301 aa, Glycine max
  Coding DNA Sequence Number=SeqID_61997
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=85%, E-value=0.0, Identity=70%"; Hit description =Multidrug resistance-associated protein 3
  Pfam annotation: Domain name=ABC_membrane; Domain location=112-381; Score=85.0; E_value=2.4e-22; Accession=PF00664.13; Description=ABC transporter transmembrane region
  Pfam annotation: Domain name=ABC_membrane; Domain location=725-1002; Score=87.6; E_value=3.9e-23; Accession=PF00664.13; Description=ABC transporter transmembrane region
  Pfam annotation: Domain name=ABC_tran; Domain location=1074-1257; Score=160.4; E_value=4.5e-45; Accession=PF00005.17; Description=ABC transporter
  Pfam annotation: Domain name=ABC_tran; Domain location=455-626; Score= 147.5; E_value=3.5e-41; Accession=PF00005.17; Description=ABC transporter
  Pfam annotation: Domain name=MMR_HSR1; Domain location=1075-1161; Score=-14.8; E_value=0.022; Accession=PF01926.13; Description=GTPase of unknown function
  Pfam module annotation: Pfam domain module=ABC_membrane::ABC _membrane::ABC_tran::ABC_tran::MMR_HSR1; Domain location=112-381::725- 1002::1074-1257::455-626::1075-1161
GCAKGIEEPLLNGDANVPNEKVAKGGDTVTPFSHAGVFSVLTFSWVGPLVAVGNKKTLDLEDVPQLDTKDSVVGAFPSFRDKLEADCDANAINSITTLKLVKNLAKSAWKEILFTAFLALLNTLASYVGPYLIDVFVQYLDGRRQYENQGYVLVFVFFFAKIVECLSQRHWFFRLQQIGIRMRALLVTMIYNKALTLSCQSKQGHTSGEIINFMTVDAERVGNFSWYMHDLWMVALQVVLALLILYKSLGLASIAALVATVVVMLANVPLGSLQEKFQNKLMESKDTRMKATSEILRNMRILKLQGWEMKFLSKVIELRKTEQGWLKKYVYTAAMTTFVFWGAPTFISVVTFGTCMLIGIPLESGKILSALATFRILQEPIYNLPDTISMIAQTKVSLDRISSFLCLDDLRSDVVEKLPRGSSDTAIEVIDGTFSWDLSSPNPKLQNINIKVFHGMRVAVCGTVGSGKSTLLSCVLGEVPKISGILKVCGTKAYVAQSPWIQSGKIEDNILFGERMDRERYEKVLEACSLKKDLEILSFGDQTVIGERGINLSGGQKQRIQIARALYQDADIYLFDDPFSAVDAHTGSHLFKECLLGLLSSKTVVYVTHQVEFLPAADLILVMKDGKITQCGKYTDLLNSGTDFMELVGAHKKALSTLDSLDEVAKSNEISTLEQDVNVSSPHVFKEKEASREEPKGQLVQEEEREKGKVGFLVYWNYITTAYGGALVPFILLAQILFEALQIGSNYWMAWATPISTDVEPPVGGTTLIVVYVVLAVGSSFCVLVRSMLLVTVGYKTATILFNKMHFCIFRAPMSFFDSTPSGRVLNRASTDQSTVDTDIPYQIGSFAFSMIQLLGIIAVMSQVAWQVFIVFIPVIAVSIWYQQYYIPSARELSRLVGVCKAPIIQHFAETISGTSTIRSFDQQSRFQETNMKLTDGYSRPKFNIAGAMEWLCFRLDMLSSITFAFSLIFLISIPTGIIDPGIAGLAVTYGLNLNMIQAWVIWNLCNLENKIISVERILQYTSIPCEPPLVVEDNRPDPSWPLYGEVDIQDLQVRYAPHLPLVLRGLTCKFHGGMKTGIVGRTGSGKSTLIQTLFRIVEPTSGQVMIDNINISSIGLHDLRSRLSIIPQDPTMFEGTVRNNLDPLEEYTDEQIWEALDKCQLGDEVRKKEGKLDSTVSENGENWSMGQRQLVCLGRVLLKKSKVLVLDEATASVDTATDNLIQQTLRQHFSDSTVITIAHRITSVLDSDMVLLLSQDIAAGLIEEYDTPTTLLENKSSSFAQLVAEYTMRSKSSFEKSVDH

SEQ ID NO: 178776 - protein, 151 aa, Glycine max
  Coding DNA Sequence Number=SeqID_61998
  Gene Ontology: Mol. function=DNA binding; Cellular component =mitochondrion; Biological process=DNA integration
MVNETGIVVLPRQLWVSAGKEKTTMRGQQVVAKCNTEAKYCSLAQITIEISWIQTLLTELKVPFNTPIVFCDNQSAVAIAHNPIFHARKKHLELDLFVVREKVLTKKLIVQHVPTLDQWAEALTKPLSLARFVFLRAKLNIIEASSKSQPP

SEQ ID NO: 178777 - protein, 84 aa, Glycine max
  Coding DNA Sequence Number=SeqID_61999
  Gene Ontology: Mol. function=oxidoreductase activity
  Homolog annotation: Hit_ID=Q8LA26; Match level="QueryCoverage=84%, HitCoverage=21%, E-value=1e-10, Identity=50%"; Hit description=Allyl alcohol dehydrogenase, putative
MKIVETVTTLRNKQVVLRNYVTGFPKESLDMKIVETITTLKLPKDPNEVLLKNLYLSYDAYMQILMTKDRLVQVGPYALGRMVY

SEQ ID NO: 178778 - protein, 125 aa, Glycine max
  Coding DNA Sequence Number=SeqID_62000
  Homolog annotation: Hit_ID=Q1SD84; Match level="QueryCoverage=50%, HitCoverage=4%, E-value=7e-09, Identity=42%"; Hit description =Integrase, catalytic region
MFGLIIAGSLGTQRKPIGSSMVNHQIGRRNQEENDEYFRHLILKIKSRKIPQLSPFTKEKLEYLYKFFSSKMSVNTPSSLAQKDNKMVKVADGSFFAISGVGSVLSLESGKAIGSAKEVYDCYFV

SEQ ID NO: 178779 - protein, 136 aa, Glycine max
  Coding DNA Sequence Number=SeqID_62001
  Subcellular localization annotation: CTP_CleavageSite=21; ConfidenceScore=5.24e-01
MVFSKESTKYFSFVGIRPTIVATSRSVGATGSHDSSCMINVNSLASVDQFGFHTTLALSAIAALSEYGSILAQCVSHAKRAFTLKLSILPGAKRALSAKPMHHAKRLRHAKRADSDLQFASWALLCFSAPIIHQAS

SEQ ID NO: 178780 - protein, 118 aa, Glycine max
  Coding DNA Sequence Number=SeqID_62002
MAISKLINDEKGFILCQNREPSWKILLRLKGSSRCGVSTENNGGLWWLMVVVGDGEKFWDVGNGFRRKEEKEMAFFQNYMDFKAQNAQMTNALRNGNVAHTPDVFSEILTVRSSTIVL

SEQ ID NO: 178781 - protein, 79 aa, Glycine max
  Coding DNA Sequence Number=SeqID_62003
  Subcellular localization annotation: CTP_CleavageSite=41; ConfidenceScore=5.31e-01
MKKATSFPSLSLDALFSSHPCCMCPLVSLPLPVLKTFGLLRLRMHAQRACLTERVSDWALNGCGREKRQRLHWAGWLGA

SEQ ID NO: 178782 - protein, 536 aa, Glycine max
  Coding DNA Sequence Number=SeqID_62004
  Gene Ontology: Mol. function=methyltransferase activity; Cellular component=intracellular; Biological process=metabolic process
  Homolog annotation: Hit_ID=Q9LHH9; Match level="QueryCoverage=99%, HitCoverage=82%, E-value=1e-145, Identity=52%"; Hit description =Protein arginine N-methyltransferase 3-like protein
  Pfam annotation: Domain name=Methyltransf_11; Domain location=199 -331; Score=13.6; E_value=0.0025; Accession=PF08241.2; Description =Methyltransferase domain
MEKVAENRCWSCGLTCQSNRDLQNHLHDLVDFNEIKTLWNDDRYLIPFMEDDSLLYSFGDCDEEGEDEQITPIDEDLIKDLMNIEESIHDDQDVVNKMVVDDDKHEIASVSNDHLNKASSSKELINGKDLCCDKDPEGHLMVNSQNHIAKHIKKINESYFGSYSSFGIHREMLSDKVRMDAYGQAILKNPSLLNSAVVMDVGCGTGILRCYMKQCALWLYAVCLFSAKAGASRVIAVEASAKMAAVASQIAKDNGLLLSKSQNGVDGFQKGVIEVVHGMVEEIDKTVEVQPHSVDVLLSEWMGYCLLYESMLGSVLYARDRWLKPGGAILPDTATIFVAGFGKGATSLPFWENVCDFDMSCIGKELVIDAARIPIVDVVDSQDLVTCSAILQSFDLATMKPNEVDFTATATLELKPSYSGTCCWCYGVVLWFDTGFTSRFCQETPAVLSTSPYMPRTHWSQTILTFREPIAMGFGKGNRGKPEAIGTEVYPATKIDLRVSIVRSTEHRSIDISLEAAGVEPDGQKRSWPAQLFNLQ

SEQ ID NO: 178783 - protein, 89 aa, Glycine max
  Coding DNA Sequence Number=SeqID_62005
MFCENVPTIWDQHRLKGALKPGDPQDTLKSPSGPLPPDSVIPPIAPIEFSNVKETEKRLKPPLVLSSCDSFFSLHEYYLENPNGESVRN

SEQ ID NO: 178784 - protein, 173 aa, Glycine max
  Coding DNA Sequence Number=SeqID_62006
MKRLILLTACTLALAACSNPEEERKAQEAAAAAVQAQKEAKAEDVAKQYDMAVAAQDWERARLHGASLLDQYKDTAAAERIAAGFDEVKAKGDAARDLRRMQALWQYNQIPVGNKGNQRRQAGAAGVPRSSGVEAACVSGAAGRRFPLPAVLGESNRGRRQADFHGGVASEDR

SEQ ID NO: 178785 - protein, 72 aa, Glycine max
  Coding DNA Sequence Number=SeqID_62007
MPLQGEDESRTSSPPQKAMDKSLKIGEDEWREKERRSTKFYASNELWFSPLNQDQVEDSSLSVLRCHEACKA

SEQ ID NO: 178786 - protein, 106 aa, Glycine max
  Coding DNA Sequence Number=SeqID_62008
MMKHQWKRRCNRRQRRRGEGRHHPLGNKPWKKELHHQECALDNKLEEDALMEEKKERRGEHKIEGIKEGDKWNFEVCLIRISFIKVTTRVTHASIYKLGSFLEKLS

SEQ ID NO: 178787 - protein, 104 aa, Glycine max
  Coding DNA Sequence Number=SeqID_62009
  Homolog annotation: Hit_ID=Q6ZFC1; Match level="QueryCoverage=50%, HitCoverage=20%, E-value=2e-11, Identity=62%"; Hit description =Pentatricopeptide (PPR) repeat-containing protein-like protein
VYKLPNEKEVVYGALDKWTAWETEFLVIAMCKALKILRKMGHWVRVIQTVKKLSTSAFLRVCGGLLQAKGQYLGKMRFNFSCKVRIQVIEGFDEMIFEVHKILA

SEQ ID NO: 178788 - protein, 86 aa, Glycine max
  Coding DNA Sequence Number=SeqID_62010
MECDGKTAMEFNRTQRASDDEDLYKQYYIDANEDVTSYLVVVHILCIPKRNFIATNSHINKRPSIFQITLRLIAPHLLFHLPPVLH

SEQ ID NO: 178789 - protein, 316 aa, Glycine max
  Coding DNA Sequence Number=SeqID_62011
  Gene Ontology: Mol. function=nucleoside-triphosphatase activity; Cellular component=membrane; Biological process=defense response
  Homolog annotation: Hit_ID=Q1STU9; Match level="QueryCoverage=99%, HitCoverage=31%, E-value=8e-45, Identity=35%"; Hit description=H+ -transporting two-sector ATPase, alpha/beta subunit, central region; Disease resistance protein
  Pfam annotation: Domain name=NB-ARC; Domain location=119-316; Score= -64.9; E_value=3.8e-06; Accession=PF00931.13; Description=NB-ARC domain
MDSKIVEYSVKPVRSQFGLDYITSYKSNLGKLKIEVQNLEATKNSVQKSVDEAKRNGEKIVDNVQIWLKKVDAIISEGKKLIDNNDVHAKDKYCMRCFQNLWSRHQQNKKSKKTMQDIHEVLARGNFDKISKPSTLKEIQLVLKDPEIYMIGLYGIDGVGKTTLAKELAWQVEKDGSFDVVVMAEVTDSLDVENIQGQIANALCLNFEEKTKEGRAEQLRQRINKQKNMLIVLDDICRVDLAELGIPYGDDHMGCKLLLTTKNLNLLKRQMGTQKDFRLEVLSDDDSWKLFKNIAVVIAKALRNKDVSTWMDALNQ

SEQ ID NO: 178790 - protein, 131 aa, Glycine max
  Coding DNA Sequence Number=SeqID_62012
  Gene Ontology: Mol. function=metalloendopeptidase activity; Cellular component=cytoplasm; Biological process=proteolysis
  Homolog annotation: Hit_ID=Q1T0S6; Match level="QueryCoverage=90%, HitCoverage=15%, E-value=1e-50, Identity=83%"; Hit description =Peptidase M, neutral zinc metallopeptidases, zinc-binding site
MVNHLKVVNDSLQLRSTIEDVQTEKVKFQLRLGPSKPIYNAFKAIQESPNWQTLSDACKRLVESQIKEAVLNGVSLEDDKRESFNKIEQELEKLSQRFGGNVLDATKKFEKLITDKKEIEGLLATALGLAA

SEQ ID NO: 178791 - protein, 177 aa, Glycine max
  Coding DNA Sequence Number=SeqID_62013
  Homolog annotation: Hit_ID=Q1STU9; Match level="QueryCoverage=55%, HitCoverage=8%, E-value=2e-10, Identity=41%"; Hit description=H+ -transporting two-sector ATPase, alpha/beta subunit, central region; Disease resistance protein
MYMGNCNIQWEVEGEKSLTNNASLSELRNLNQLRSLDLSIQDASVLPTDIYIFGKLQTYIIFIGNIWKWSSLWSGDAHETSRHLSLPTLNTNILLNRGNCIGQDGDWVIKNCLSCGNGQIKIRSLFTFPKHFYHFHASPHSEGKGKNPFSSLDYSQNLFWSIITHYVPVCYISILGW

SEQ ID NO: 178792 - protein, 259 aa, Glycine max
  Coding DNA Sequence Number=SeqID_62014
MPEASVSNVKDREKSDKTQTRAVGQNIAQHPGVYGDWEVCGYNANMKVGTDSILANQMMNLGDLSHCTPNTRFAPYSSRTWRSTMKVTSWTCIGIASQRSCGYYPYQLRSSPSVLQCVLKDAKSQELNGSKANSLKDNLLIGNEGSGFYDVGSKGEEDDARNSEGGVKVVEDGIGPGLNFTVNLRGQGPYTGKGQNESEELGEISAKTEFVNEFIQLKGHGVKDQNGNMVDKIASSASNGSDIVLEVPRCGHLPHGPSS

SEQ ID NO: 178793 - protein, 120 aa, Glycine max
  Coding DNA Sequence Number=SeqID_62015
MSHVGGDYDNSNGGRCSRWKFTLSGKVLITNPPIILVTPKLLLTMRLVFLLTTSLLMLPWLALMPGRSSHLCLCQGRAVEEQVRSMPQPLSSGVSGKQKEPDSGLEPYPFIYKHPQPPWK

SEQ ID NO: 178794 - protein, 166 aa, Glycine max
  Coding DNA Sequence Number=SeqID_62016
MIFIRTHVSSDSDSSISSGSPEIPSVIHPTAPIEFPNVRETEKRLKPPLVLSSCDSFFSLQEYYLANPNGGSVRNLISNNISKFLENPTVNETGIVIVLRPFWVSAGKEKATMRKNWAANVVLKFQDDPTVNESEIVIFLRQVRWPAGKREGFGRREKKRNCEAGG

SEQ ID NO: 178795 - protein, 346 aa, Glycine max
  Coding DNA Sequence Number=SeqID_62017
MDWYYGNGINDYLVPRDQDLLDRHPSPDYWSNWGISATEGFNSPKNLFIMDFFEERFNNQIELEPSLHDKDHSSSSSTAFSCDQPNYQLQDLPRFEPMNDTFLDSVPEGLPCVDVENLDKSINISPENQCSSTPGILQKDIPASKSVSSNSESKNCLDIEAPLTKVLDIFEQCSRDDGMCEQSSSLEEFILKDLEMVIGQFTERTRICFRDALYRLARNTEEQPVMLDQNEDLNIQKAIPHTDHNETMRSQDKKPMESETNNIDRIIANLMFKSMEFNIHHSPITSSTNSVQQVIGSNNGPRGNNSKAMNMEDKSCYSHPQKLLVDAEIPRFGLSNQPRDTGSYIT

SEQ ID NO: 178796 - protein, 152 aa, Glycine max
  Coding DNA Sequence Number=SeqID_62018
  Subcellular localization annotation: CTP_CleavageSite=62; ConfidenceScore=5.08e-01
MVGRRCAKTVQWKPKVHRRQLGRSHEMHLPTISTHSSPHSNPNNHFTLSPTSFFGTRITLLRATSSSRSLLNTNCHATSATVSFSLPTPWSARAIKSYAMGELEARKLKNPNTGIEALLIGNLVEVSKEGTWKLIGTNKEQGPVSTKHEGED

SEQ ID NO: 178797 - protein, 132 aa, Glycine max
  Coding DNA Sequence Number=SeqID_62019
MEFICFGVVRPTAISAIVDLLALPLIENLGLLVLPQIFEDIESLSFSPLFSNTETLKPSNGQTLNTIEQGTTCKEVYIRSNQMEEKQENIPSSNTHKRKSLSALETAKMEESVHGVRSKVRVLPQLARVYQK

SEQ ID NO: 178798 - protein, 95 aa, Glycine max
  Coding DNA Sequence Number=SeqID_62020
MENNEPPWCLEPFAVGTLAILAYKEDMINTRIRNLFGYTLFFISTLSILILDLATSGKGGLGTFVGGTRLQAYSYKDSDPQRCSSLILSHQPDPI

SEQ ID NO: 178799 - protein, 508 aa, Glycine max
  Coding DNA Sequence Number=SeqID_62021
  Gene Ontology: Mol. function=calmodulin binding
  Homolog annotation: Hit_ID=Q1T1F5; Match level="QueryCoverage=87%, HitCoverage=72%, E-value=6e-78, Identity=49%"; Hit description =Calmodulin-binding, plant
  Pfam annotation: Domain name=CaM_binding; Domain location=119-233; Score=180.3; E_value=4.6e-51; Accession=PF07839.2; Description=Plant calmodulin-binding domain
MTNFRWCGPYSGPLGAQWQKSFQETISRREGWLVTHTVTVIEMEIKFIMAWLHPWWCTINATSHLKENKDAIELVQKAFDEILLPEPEDLFSDDQFKSEGIDSGEVHLEKSEVERKRNTSTSTESPTAQRMGTKPDQRAPRSWSNLKKLILLKRFVNALEKVRNINPKRPRRFPSDANLEIEKVFLKHQTAGEKNNAEEWMLDYALQKVVSKLAPAQRQKVTLLVKAFETILPFQVAENSPRFSPTMEPQANPVQPLDNSSNHSEEETSFSHDSSMELTENTSDDPMPELHNHTTLKERCLESLDFLGTKTVKNMPAFGATEEDLSGKQSLAGSYDNEEKISSDSDNIYLGEIKDTTSSSLNEPVEIIRSSHEEAPTNETVNDVPEDLLSSVNTENPDIKSKSPGRDVETKNLNGDNGEKISMSKSLVLEGLVRSLRSNLIGSGAPVNEPTANDRKEGIENVKQETETLEEFPTKEQYETHISAVVEPETPVEKQNNTGLWYLVYKHM

SEQ ID NO: 178800 - protein, 92 aa, Glycine max
  Coding DNA Sequence Number=SeqID_62022
  Gene Ontology: Mol. function=translation initiation factor activity
  Homolog annotation: Hit_ID=Q8H6S8; Match level="QueryCoverage=44%, HitCoverage=4%, E-value=1e-13, Identity=85%"; Hit description =Translation initiation factor
MYFLCLLKTFTVYDLSQLDCCARILLSKWLHASITIFHPIGTPICIPSREFIDIGRVAPIENNHLPVDYARKGQKVAIKIEEAKVAGLLGSA

SEQ ID NO: 178801 - protein, 37 aa, Glycine max
  Coding DNA Sequence Number=SeqID_62023
MAIEKQPGQRVPTRKREKQIWAMQLVVMKEGCLDGTD

SEQ ID NO: 178802 - protein, 136 aa, Glycine max
  Coding DNA Sequence Number=SeqID_62024
  Gene Ontology: Mol. function=protein serine/threonine kinase activity; Cellular component=flagellin-based flagellum; Biological process=protein amino acid phosphorylation
  Homolog annotation: Hit_ID=Q8GRZ5; Match level="QueryCoverage=99%, HitCoverage=50%, E-value=6e-51, Identity=77%"; Hit description =Phosphoenolpyruvate carboxylase kinase
EPSRRVPTNHFSQEILGNEGRSLEDSRRKPKLIPKHNFKYLRSRVSIKRGNHRQHYIQNHPIAPHINLLIVLPLQQNLQRHVVRRPHHAAHAPPVFETLRQTKVDEIKIVRRIKDNIVGLNITVGDIEAVALFDGF

SEQ ID NO: 178803 - protein, 150 aa, Glycine max
  Coding DNA Sequence Number=SeqID_62025
  Homolog annotation: Hit_ID=A0EFD6; Match level="QueryCoverage=94%, HitCoverage=5%, E-value=2e-13, Identity=32%"; Hit description =Chromosome undetermined scaffold_93, whole genome shotgun sequence
MLYVAITRTRQRLWICENTEEYSRPMFDYWRKKGLVQFKELDDSLAQAMKVASSPEEWKSRGKKLYYQNNYEMATMCFERAGDSYWDRKSKASSLRANANRLRDLNPEDSNAMLREAAEIFEGIGMAESAAQCFFDLGDYKRAGCRSKPA

SEQ ID NO: 178804 - protein, 154 aa, Glycine max
  Coding DNA Sequence Number=SeqID_62026
  Gene Ontology: Mol. function=isomerase activity; Biological process =carbohydrate metabolic process
  Homolog annotation: Hit_ID=Q6Z3M0; Match level="QueryCoverage=44%, HitCoverage=20%, E-value=5e-21, Identity=66%"; Hit description =Putative Aldose 1-epimerase
GKPFLALGGSSDIISIWNLEKKRLQLVVREAHDSVITSLHFVANEPVPMSSSTDNSVNIRTILKLHTLMWNPWDKKAKAMSDFGDDEYKYMLCVEAAAIEKPISLNLVEGWNGRLELSTVSSSYCSGKLIPKELFKEAERSSLCFVSCICIKCT

SEQ ID NO: 178805 - protein, 49 aa, Glycine max
  Coding DNA Sequence Number=SeqID_62027
MAKVVLSKSIQLGFLAWHGWELYFQRKPTVAYTQLANSQWGPLTKVPKP

SEQ ID NO: 178806 - protein, 191 aa, Glycine max
  Coding DNA Sequence Number=SeqID_62028
  Gene Ontology: Mol. function=isomerase activity
  Homolog annotation: Hit_ID=Q6V7U9; Match level="QueryCoverage=84%, HitCoverage=61%, E-value=5e-13, Identity=28%"; Hit description =Putative chalcone isomerase
MEIDLMEVLVGTGSRTMTIVKIKSLKVYAFGVYVHPYSLCEKLGPKYASISADELNNHHDFYKDLLREDINMTVRLVANCRGMKINSVKDAFEKSLRARLVKANPSTDFSCLKTFGSYFTENISIPLGTVIEFKRTVDGRLITKISGNQIGSVHSKDLCRAFFDMYIGDVPVCEQTKKEIGMNAANIINKC

SEQ ID NO: 178807 - protein, 199 aa, Glycine max
  Coding DNA Sequence Number=SeqID_62029
  Gene Ontology: Mol. function=DNA binding; Cellular component =intracellular; Biological process=DNA integration
MEIYKDRKSRQLWLSQWGYVEKVLDKFNMSNAKLVSIPLAKHFKLSIDQCPKTYVEVEYMSKVPYARAVGCLMWACLLEIHYSISCGNVNNCEVYMAVAEASKEAMWFAGLVKELGIKQGGVQLHCDSQSAIDLTKNHVYPTKTKHIDVRFHKIRELMTSSQILLRKVHTSENAADMLIKAVITDKFNHCLDLLNIVEG

SEQ ID NO: 178808 - protein, 91 aa, Glycine max
  Coding DNA Sequence Number=SeqID_62030
  Gene Ontology: Mol. function=signal transducer activity; Cellular component=heterotrimeric G-protein complex; Biological process=G -protein coupled receptor protein signaling pathway
  Homolog annotation: Hit_ID=P93163; Match level="QueryCoverage=85%, HitCoverage=20%, E-value=2e-30, Identity=96%"; Hit description =Guanine nucleotide-binding protein alpha-2 subunit
MAYSVELLINIYWYDQTLFEDENRNRMTETKELFEWILKQPCFEKTSFMLFLNKFDIFEKKILKVPLNVMRVVQRLPTSFNRANKTLSMLM

SEQ ID NO: 178809 - protein, 82 aa, Glycine max
  Coding DNA Sequence Number=SeqID_62031
MRDARVVVTWWLNKERCGSFVRVTSSTLGLGVVRQCTPSHGNDIDEEVTNTKTVLGNRRCDKVLGKENTMRGWEWRHNEVWE

SEQ ID NO: 178810 - protein, 60 aa, Glycine max
  Coding DNA Sequence Number=SeqID_62032
MARCHFNGQLCPFIYYARLFRSYKHYHGLNPNMEDFEAKKCHLKTEATKKLTNYDFNKER

SEQ ID NO: 178811 - protein, 171 aa, Glycine max
  Coding DNA Sequence Number=SeqID_62033
MAKERGFPQGERLRLWIFALESYEIRAHWASPCGPSRVERGLRTERDIALSLELPTKRALCAEPGLRTERAARGSNWAEEDGEGWLVEAGGTDDGGPAGARIGGAFGTGRGRTCLGPGKIMEGYVGFQQFFLMYAKLITGLSDSKVLDWAICVIWPDIMLPKSMSICETNP

SEQ ID NO: 178812 - protein, 291 aa, Glycine max
  Coding DNA Sequence Number=SeqID_62034
  Gene Ontology: Mol. function=5-formyltetrahydrofolate cyclo-ligase activity; Cellular component=actin filament; Biological process =folic acid and derivative biosynthetic process
  Homolog annotation: Hit_ID=Q1RV80; Match level="QueryCoverage=93%, HitCoverage=45%, E-value=1e-105, Identity=72%"; Hit description=SAM (And some other nucleotide) binding motif
  Pfam annotation: Domain name=Methyltransf_11; Domain location=20-139; Score=43.0; E_value=1e-09; Accession=PF08241.2; Description =Methyltransferase domain
  Pfam annotation: Domain name=Methyltransf_12; Domain location=20-137; Score=58.8; E_value=1.8e-14; Accession=PF08242.2; Description =Methyltransferase domain
  Pfam module annotation: Pfam domain module=Methyltransf _11::Methyltransf_12; Domain location=20-139::20-137
MGRILFLIFNFQGGGRKVILEVGCGAGNTIFPVIASNPDAFVYACDFSPRAIELVKVGSLLFVNSMPNHHLFTHEDFKESHVSAFVSDLTADDLCNEILPSSVDIVTMIFMLSAVSPEKMPLVLQNIRKVIKPNGYVLFRDYATGDLAQERFSSKDQKISDNFYVRGDGTRAYYFSNEFLTNLFKENGFDVHKHHVYCKQVENRSRELIMNRRWVQAVFRVSDSSNSSSCIGAEANHLDSGNDNKEIKKNSLNGGLNDSAVDLSEGVAVDMFGVLPSNEYELLFQLRSLMY

SEQ ID NO: 178813 - protein, 75 aa, Glycine max
  Coding DNA Sequence Number=SeqID_62035
MDRINEFQPNEFRSVVDRWGSLMVVGRAHGSVAVPKSLRGSAAVRIWALVMVARKRAQEREDYGRRVERKKKRKF

SEQ ID NO: 178814 - protein, 88 aa, Glycine max
  Coding DNA Sequence Number=SeqID_62036
HPGPFGPSRRFLQKAVASGGSNPARLGELGGNHLPYFAINRGGSGEVLVVQISFKFSACCYAFILVAVLSSFKCPYPYLGHKFLIFQC

SEQ ID NO: 178815 - protein, 133 aa, Glycine max
  Coding DNA Sequence Number=SeqID_62037
  Gene Ontology: Mol. function=transcription regulator activity; Cellular component=nucleus; Biological process=regulation of transcription
  Homolog annotation: Hit_ID=Q5N802; Match level="QueryCoverage=99%, HitCoverage=28%, E-value=2e-20, Identity=42%"; Hit description =Putative bHLH transcription factor
MLDEIINYVQSLQRQVEFLSMKLASVNTRLDFSIESLISKDIFQSNNSLAHPIFLIDSSAPPFYGQHPQPNPAVHNNIPNGTMTHNSVDPLDTGLCQNLGMHLPHLNDFNEGGSQAQIKYPYENQALITIHYG

SEQ ID NO: 178816 - protein, 54 aa, Glycine max
  Coding DNA Sequence Number=SeqID_62038
MTQGKKVKKKKRKMRRKHNNSGRSAHKVSSQEKVQGGCVLCDLHATLKAFDPLS

SEQ ID NO: 178817 - protein, 59 aa, Glycine max
  Coding DNA Sequence Number=SeqID_62039
MVKRVKLRRNYQDLLDLMPPKCHQILSKKDIFVLLLWPQPFDLDHQGFVEVLVASSGEV

SEQ ID NO: 178818 - protein, 421 aa, Glycine max
  Coding DNA Sequence Number=SeqID_62040
  Gene Ontology: Mol. function=transcription regulator activity; Cellular component=nucleus; Biological process=regulation of transcription
  Homolog annotation: Hit_ID=Q5N802; Match level="QueryCoverage=65%, HitCoverage=52%, E-value=1e-30, Identity=36%"; Hit description =Putative bHLH transcription factor
  Subcellular localization annotation: CTP_CleavageSite=37; ConfidenceScore=5.05e-01
MENQFFLNAGVPPQLHFEPSPHGHQPCPPPSWQSSLSSAMDVQVTVLNCSTEQTQDCFYNTTPTWDKSTDHGLQFDSALSSMVSSPAASNSNISSENFVIRELIGKLGNIGGGGGSDEISPHSQPLVGASFYINCNNNSTNTSCYSTPLSSPPKVNTIKIPTMVNHLVKEGMPPSLETPMSLNSTVAKFSADPGFAERAAKFSCFGSRSLNGRTTQLGLNNAELAQRSSLVENGKRLPRVSSSPSLKVLESQMGTQENKNSPLQDLMELANSQEESTISEQTPNGDTGVKPSPYVNSRKRKGPSKGKAKETSASINPPMAAEASEDWNAKRSKPNAGEGNENGQVKAEEESKGGNSNANDEKQNKSNSKPPEPPKDYIHVRARRGQATDSHSLAERVRREKISERMKLLQDLVPGAIRCMG

SEQ ID NO: 178819 - protein, 48 aa, Glycine max
  Coding DNA Sequence Number=SeqID_62041
MALMNTKQLALKPKPKLDKNLLERCMDWANIPPSKHICFNSVSEERLS

SEQ ID NO: 178820 - protein, 93 aa, Glycine max
  Coding DNA Sequence Number=SeqID_62042
MAVHGGKSKIRHKNMADGVAENGGYRRKAVRCRSSCLAGARREVSLRLRVRGVAGGGGWVCGLWVSPVAAAAGCGGVREDAEVREGRRGYSKS

SEQ ID NO: 178821 - protein, 203 aa, Glycine max
  Coding DNA Sequence Number=SeqID_62043
  Gene Ontology: Mol. function=transcription regulator activity; Cellular component=nucleus; Biological process=regulation of transcription
  Homolog annotation: Hit_ID=Q9LSL1; Match level="QueryCoverage=65%, HitCoverage=40%, E-value=2e-44, Identity=65%"; Hit description =Arabidopsis thaliana genomic DNA, chromosome 5, TAC clone:K21L13
MVGVLTVLIKTLYLTFQTLLVVKKFLKLTITTTPSVKSMAPYLMNHHHRLWIHSIAPLILHSIPLHFLVRTSILGDTIDYMKELLEKINNLRQEVEVDSNMAGIFKDVKPNEILVRNSPKFEVERSVDTRVEICCVGKPGLILSTVNTLKALGLEIQQCVISCFNDFTMQASCSEESEQRTMLSFEDIKQALFRSAGYGGRCL

SEQ ID NO: 178822 - protein, 42 aa, Glycine max
  Coding DNA Sequence Number=SeqID_62044
MARIGKGSVEFEDLLPVITGKLGGEGLIKELCYIDSNSKSEK

SEQ ID NO: 178823 - protein, 149 aa, Glycine max
  Coding DNA Sequence Number=SeqID_62045
MNKGRKIRADIRSNSIGIELFLTVLSSSTKYLSQGVEEESGCCRRHQLLACVVFGACVVPSSTSGETVRELALVRGAVIAKCPNHECHQVVDFDKVLNPNNKDDVVLSRVSDSIRWLARTDDKGHHEVNPMEQIEVVTEGWQKARITSS

SEQ ID NO: 178824 - protein, 368 aa, Glycine max
  Coding DNA Sequence Number=SeqID_62046
MASHKRKATALVSQARYDRSRFVSQNAWDRYADNVLGRKILLERNEFYANLYDPEDKSPKQVRVRGHLIKFDADTLNTFLKTSVIIEEGESFPSYSRFCMLRPDPQKLAARLCILGRRFELNANGLPLKILRKNLTTLAQTWSVLSFSNLAPTSHISNITLDGAKLIYGLVMKMNMNLGSLISGQISLIAQHDSSRLGFPTLITALCKARGVTSDSLTFESMSPTINLAYIKKNCWNLDDPSVTFPGTSKSRARRFEAPSTLAPHTSAPSTSAPAISHLPPAPAAPVLLNPSFQSSEPFFFMLQSLHQGQLLIMQSLQNVVHQRPIMSVEELFNRWPGQESNLLLWEGVRASTGSAGEHSRGCRAYTS

SEQ ID NO: 178825 - protein, 141 aa, Glycine max
  Coding DNA Sequence Number=SeqID_62047
MDKPEESSSMPARAQRVCSSLSEAVVFSALGARLTLSQISLTHAKRENGAKHTFEVSHPHKQVLFLGAKHVLKDVTNLVIGVELWECVTVVCPNMPVQVQTLPFLVLLLQLNYSSPLNSTLLPRIDIPILGFGFVSGTSIP

SEQ ID NO: 178826 - protein, 125 aa, Glycine max
  Coding DNA Sequence Number=SeqID_62048
MSKKNSTNPLMMYNKDNTDREDNLPNFISELDLDCEDEVQDNELEHCDEEGVAKKDEVEDNELEHYDREGATGEDELEDDDGIFGLPISVPVYLFTDDALKHCIEEGFVHDKDKDGDDALRSDAL

SEQ ID NO: 178827 - protein, 119 aa, Glycine max
  Coding DNA Sequence Number=SeqID_62049
  Homolog annotation: Hit_ID=Q9LIQ9; Match level="QueryCoverage=85%, HitCoverage=14%, E-value=3e-32, Identity=66%"; Hit description =Arabidopsis thaliana genomic DNA, chromosome 3, BAC clone:F14O13
MSIMILSLHIEDLTKEKFSLRRALEASRTLAESLATENSTLTDNYNQQRSVVDQLKSDMENLQEDIKARLVEFEAIKSEYTNAQLECNAADERAKLLASEVIGLEEKIYYTIHYCQNEW

SEQ ID NO: 178828 - protein, 183 aa, Glycine max
  Coding DNA Sequence Number=SeqID_62050
  Homolog annotation: Hit_ID=Q9ZU48; Match level="QueryCoverage=48%, HitCoverage=17%, E-value=6e-24, Identity=51%"; Hit description =Expressed protein
DKSGNGGDARGGGAVVLVDHVLEVLIDGDRDEGIEVLVGELVLKREGSSVQESFREARGEGDDVPTVAAHETELGGCRHKGLVPGVGVAGTRRGFHGVGVAEDGYEGFEYGSDDLVENGSEGFKYDGFEDFGGLNGYLFEDVVDSSSVEDPVMINDKNDILEVDLANIDCVVVERLNFVDLES

SEQ ID NO: 178829 - protein, 69 aa, Glycine max
  Coding DNA Sequence Number=SeqID_62051
  Homolog annotation: Hit_ID=P93147; Match level="QueryCoverage=65%, HitCoverage=9%, E-value=5e-15, Identity=76%"; Hit description =Cytochrome P450 81E1
MVLSAARRHREMTWSYLSERALKVRWRGHLTWWRLLIMGRNGGPGGRFWNFLAWRRSFKRRKRKKHRRK

SEQ ID NO: 178830 - protein, 105 aa, Glycine max
  Coding DNA Sequence Number=SeqID_62052
MGGCAILLQSWAWYRMPFFAPRVPRPKTTFPLAKRWSGGRLEYRATPYGDLVGYRSRIDHMESHEFGLQEDIPVDPMNLDLLHQIDMRDNHYIDWMEYHAGWINI

SEQ ID NO: 178831 - protein, 63 aa, Glycine max
  Coding DNA Sequence Number=SeqID_62053
MKDNRTWLKSNQAHANVSYWSSEYIGPTGAQLDGAEMVASGLATHFIPCSGKNIVFNTCLFYR

SEQ ID NO: 178832 - protein, 300 aa, Glycine max
  Coding DNA Sequence Number=SeqID_62054
  Pfam annotation: Domain name=Transposase_23; Domain location=46-116; Score=3.4; E_value=0.00048; Accession=PF03017.5; Description =TNP1ENSPM transposase
MMPMTAKEIAEKIGLALPPEPEVGPSGARVSTKESCVAPSGNDPETGDSDKCGLYIEENPSRPVALGRLYERSTAVHNIPLLHGQVKVCVEEVKDAEALVPMLTDEVTSMWQALNTFLAWPTHLVKSLSEQAVVSPAKPPESPDHEVDDPLYLMTLTIPQLFLKPLQVMWDATMFGVFNQNFSLYIKHKDLFEIAHGGQCLSISVIQLWILHLTETSLQAGNSDVYGFLDPQSIQRSGQSQFESKSYIKSWMQSLKRDVYLGAYLNGTTITHIRLYCSGHWQMVVILPKENLVGLVLFFT

SEQ ID NO: 178833 - protein, 78 aa, Glycine max
  Coding DNA Sequence Number=SeqID_62055
  Subcellular localization annotation: CTP_CleavageSite=43; ConfidenceScore=5.60e-01
MATPPALPPPPLPPPPADASTSLSTLKRTHKATQLRSLASRPPGAERSVVNVDPATGKADGPHKKKFRTFLGIVARDT

SEQ ID NO: 178834 - protein, 130 aa, Glycine max
  Coding DNA Sequence Number=SeqID_62056
  Gene Ontology: Mol. function=zinc ion binding
  Homolog annotation: Hit_ID=Q1SYK7; Match level="QueryCoverage=56%, HitCoverage=57%, E-value=3e-20, Identity=62%"; Hit description =Probable Mutator-like transposase
MEEIEGATRDQYKHLRSYAAKILDKNKNNTVKLKCDLTPHGLVFERIYVCLEEGCWAFISYQQKGLVEVIKELGHNVEHELSRKHLYGNWRKKYPGAHMKELMWMADRATIVPDWEKTMNQIKTYDANAW

SEQ ID NO: 178835 - protein, 36 aa, Glycine max
  Coding DNA Sequence Number=SeqID_62057
MGGSSNAVRIQGLTSPCMPYNDAIKNVRNKRNEFLM

SEQ ID NO: 178836 - protein, 138 aa, Glycine max
  Coding DNA Sequence Number=SeqID_62058
MSYIDFKKLINSFGYKSFKFLWYRNPRKALSRGLKPLNSDFNILQLAEVVFGFDVIDVYMNQGVIDTSSNKLNDVEDDDVVGEVEVEVQGDEQTLVEVQVEAEVQVDEQGLVEAVGEADVQAKMEVEVQVHEQTLVEV

SEQ ID NO: 178837 - protein, 606 aa, Glycine max
  Coding DNA Sequence Number=SeqID_62059
  Gene Ontology: Mol. function=transferase activity, transferring phosphorus-containing groups; Cellular component=membrane; Biological process=two-component signal transduction system (phosphorelay)
  Homolog annotation: Hit_ID=O22267; Match level="QueryCoverage=97%, HitCoverage=52%, E-value=1e-104, Identity=39%"; Hit description =Putative histidine kinase
  Pfam annotation: Domain name=HATPase_c; Domain location=478-606; Score=43.8; E_value=5.8e-10; Accession=PF02518.16; Description =Histidine kinase-, DNA gyrase B-, and HSP90-like ATPase
  Pfam annotation: Domain name=HisKA; Domain location=362-428; Score =31.3; E_value=3.3e-06; Accession=PF00512.15; Description=His Kinase A (phosphoacceptor) domain
  Pfam module annotation: Pfam domain module=HATPase_c::HisKA; Domain location=478-606::362-428
MVMHIEHHVILNSEYVLSQFQSEIEHSAGLIHPINSSSTNFAKLLSSTLQDTNLSFSDIKTKVAPLLFKAFETVPNLAQISYIEKKGLFFSYYTDYGQVLAMYSNSSSLSTSFGGASNLSIYYIQPVNRDTGELYGKAIISEVPSNIINTSWFVKAVNSSLSYASLGTKWNNDHDLLFVSSSRIKGTQVISLGIPVTTITDFFTPVGANLSLVTKDGKMLVEGIQNTRLGFSNDMVYFQSVNANGDQTSYDGVVSCKDGDAEAASILNIQGVEYLIRCSTIDIMEIKSVYVLAVPRKGLDHFVLDIKKKGLALLTTMIVMILIAMVSFLYINVRSLRREMHLCWSLIKQNEATQQAERKCMNKSLAFASASHDVRASLAGLTGLIEMSFHEVSPDSELGTNLRQMDSCTKDLLGLLNSILDASKVEAGKMLLEEEEFDVFQLLEDVVDLYHSVAMKKGVDIVLDPCNGSVLRYSRTKGDRGKLKQVLCNLLSNAVKFTEEGHIAVRAWAQKPSLQSSMIATHQYGSSRLLSRLCCRQNEARDDVEDLNIQQDPNCMDFTIEVDDTGKGIPKEKHKSVFENYVQVKETTLGQEGTGLGLGIVQSLSK

SEQ ID NO: 178838 - protein, 281 aa, Glycine max
  Coding DNA Sequence Number=SeqID_62060
  Gene Ontology: Mol. function=mismatched DNA binding; Cellular component=MutSalpha complex; Biological process=mismatch repair
  Homolog annotation: Hit_ID=Q6DQL6; Match level="QueryCoverage=97%, HitCoverage=29%, E-value=3e-61, Identity=49%"; Hit description=DNA mismatch repair protein
  Pfam annotation: Domain name=MutS_V; Domain location=137-278; Score= -84.1; E_value=7e-09; Accession=PF00488.12; Description=MutS domain V
MAQACSSLGVILSHVKSRQLHHLLTPGKVLPDVCMDLNHFKDAFDWAEANNSGRIIPREGVDTGFFRYWSPDIKVFLRELSHAESEKESLLKSTFQRLIGRFCEHHTKWKQLVSTTAELDVLISLAIAGDYYEGPTCRPTFVGTLCTKEAPYLHAKSLGHPVRRSDTLGKGDFVPNDITIGGSDHASFILLTGPKMGGKSTFFRQVCLTVILAQVGATASMLLLVRPSPDLSFVFQIFDRDSVLEHLVRMVQCRGLFSTHYHRLAVDYLKDPKVLPVFYPV

SEQ ID NO: 178839 - protein, 121 aa, Glycine max
  Coding DNA Sequence Number=SeqID_62061
  Subcellular localization annotation: CTP_CleavageSite=87; ConfidenceScore=5.78e-01
MFSPPENSSRGASVTFPWVISRRFSTILRRSSFDLRRSLVSNQLSSLVTDAWGANTFLVRKYNSRTFSLNVRRSRLFWFFRRFPQINVGGDSARIPFLEHAPASHASPSRRRVGCDSWRLH

SEQ ID NO: 178840 - protein, 292 aa, Glycine max
  Coding DNA Sequence Number=SeqID_62062
  Gene Ontology: Mol. function=mismatched DNA binding; Cellular component=MutSalpha complex; Biological process=mismatch repair
  Homolog annotation: Hit_ID=Q6DQL6; Match level="QueryCoverage=87%, HitCoverage=21%, E-value=4e-86, Identity=58%"; Hit description=DNA mismatch repair protein
  Pfam annotation: Domain name=MutS_II; Domain location=50-213; Score =12.3; E_value=0.002; Accession=PF05188.8; Description=MutS domain II
GYCILVVEQTETPEQKKGSKDKVVRREICSVVTKGTLTDGELLSANPEAAYLMALTEHHENHPTEVSEHIYGVCRVDVATSRVIFGQFKDDLECSALCCILSEIRPVEIVKPAKLLSAETERVLLKHTRNPLLNELVPIVEFWDADKTVDKLKRIYGKTNDVSVNDNELDCLPDVLLELVKTGDDSRSALSALGGALYYLRQAFPDERLLRFAQFKLLPCSGFGDLASKPYLVLDAAALENLEIFENSRNGDSSGYVCHMVICTVSILDKMGNLFVYFTEIMMLLVARSMPN

SEQ ID NO: 178841 - protein, 138 aa, Glycine max
  Coding DNA Sequence Number=SeqID_62063
MCKKEHESFKEYAQRWRDLATQVAPLMMEREMITMIVDTLPVFYYEKMVGYMPSSFADLVFAGERIEVSLRRGKFDYLAFMNRKPGANEENKKEEGTYVVTAIPTWPNFPPAQQYQYSANISPSHYPPPYQPRTPNHP

SEQ ID NO: 178842 - protein, 287 aa, Glycine max
  Coding DNA Sequence Number=SeqID_62064
  Gene Ontology: Mol. function=mismatched DNA binding; Biological process=mismatch repair
  Homolog annotation: Hit_ID=Q1RUT0; Match level="QueryCoverage=33%, HitCoverage=55%, E-value=1e-33, Identity=56%"; Hit description=Zinc finger, RING-type; RINGv
  Pfam annotation: Domain name=MutS_I; Domain location=241-287; Score= -20.0; E_value=0.001; Accession=PF01624.10; Description=MutS domain I
  Pfam annotation: Domain name=zf-C3HC4; Domain location=20-67; Score =64.7; E_value=3e-16; Accession=PF00097.15; Description=Zinc finger, C3HC4 type (RING finger)
  Pfam module annotation: Pfam domain module=MutS_I::zf-C3HC4; Domain location=241-287::20-67
MAEVVLLVDDLKLLSAIPRCRICHEEEFESVETLEAPCACSGTVKFAHRDCIQRWCNEKGNTTCEICLQEEEASNARIEIMVEGVAMESDYSECSSAADRSGSCCRSLAIAHYKDADYDTSMSEEDDEDEIHHNPSLYFAVKETSNGTGNVAITEISERFALREAQKFPFLKGQVLITVQCFEFFHAQITFMSLKRDFDAIRYYVVAVINYQLDAKRRRPGDENYDSRTLYLPPDFLRSLSYAQKQWWEFKSKHMDKVLFFKMGKFYELFEMDAHVGEKELDLQYMK

SEQ ID NO: 178843 - protein, 106 aa, Glycine max
  Coding DNA Sequence Number=SeqID_62065
  Gene Ontology: Biological process=response to stress
  Homolog annotation: Hit_ID=Q1RUT7; Match level="QueryCoverage=92%, HitCoverage=70%, E-value=2e-11, Identity=39%"; Hit description =Universal stress protein family
MERKERKIMVGVDESEESMFGLFLVYHQPYCRHPQRYTSPSMLHAWYSSHAILAMEQHGKDLANSVMERAEAICKDFKTTANMKMERVVGCGDAKDAICIRFTFKS

SEQ ID NO: 178844 - protein, 199 aa, Glycine max
  Coding DNA Sequence Number=SeqID_62066
  Homolog annotation: Hit_ID=Q10MK8; Match level="QueryCoverage=94%, HitCoverage=99%, E-value=1e-12, Identity=29%"; Hit description =Expressed protein
MGNQIARDATGKIVYWNGSVQEFDEPLTVAELMLEHPQQVVLDFHSAVKEKRPTPLPADEKLEMKKTYVMVPVKRGKPVLLSSEDSRRILFTVNSSLHSNHFVSSSGFLPWLARLFHAKGEVVAVLQRKEEVEKENTEERYGFSEFLPEMLEGSMPEYMSRQLSGKGWKPSLDTIKEKKVKTKLSPWLLFLRGFSAAKI

SEQ ID NO: 178845 - protein, 130 aa, Glycine max
  Coding DNA Sequence Number=SeqID_62067
  Subcellular localization annotation: CTP_CleavageSite=35; ConfidenceScore=5.50e-01
MSDSLTDLAPNTNSLHPNPGFRRAWWTVRRVQAMVAMRVASIALALTCASRTEVFPVALDACFENLKRLNDELSEKYLWLLIARSTFQTHVLRWMDYIQHKQEFVGLFEKILLQKPGFEPPVRHHSIVAF

SEQ ID NO: 178846 - protein, 271 aa, Glycine max
  Coding DNA Sequence Number=SeqID_62068
  Gene Ontology: Mol. function=zinc ion binding; Cellular component =nucleus
  Homolog annotation: Hit_ID=Q9FFP4; Match level="QueryCoverage=87%, HitCoverage=42%, E-value=2e-35, Identity=34%"; Hit description =Arabidopsis thaliana genomic DNA, chromosome 5, P1 clone:MBK5
  Pfam annotation: Domain name=Plus-3; Domain location=171-271; Score =94.0; E_value=4.5e-25; Accession=PF03126.8; Description=Plus-3 domain
  Pfam annotation: Domain name=SWIB; Domain location=42-115; Score =39.3; E_value=1.4e-08; Accession=PF02201.9; Description=SWIBMDM2 domain
  Pfam module annotation: Pfam domain module=Plus-3::SWIB; Domain location=171-271::42-115
MGDEPRAGSFWTEEINEAVPTPMRRKRKYRTKKKEYQGWGSTSLIWFLESIGRDTSTKIAQSEVANIVMEYVKQHNLFHKTKKKRIECDERLHSLFGRKTISRLKINDLLESHFKENCEESSDGVFFDSEDDENALTACETPRTAPSERKSQPKKPVFEKPRSCFAAIVPANIKLVYMKRSLVMDLLKDPETFETKVVGSFIRIRCDPNDYLQKNSHQLLQVTGTKKSSEVNGEIHLQVSGFIKDIRIQMLSDDNFSELYLAKIVDSVNEG

SEQ ID NO: 178847 - protein, 481 aa, Glycine max
  Coding DNA Sequence Number=SeqID_62069
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6RXY3; Match level="QueryCoverage=94%, HitCoverage=62%, E-value=0.0, Identity=75%"; Hit description=Beta xylosidase
  Pfam annotation: Domain name=Glyco_hydro_3; Domain location=76-321; Score=181.8; E_value=1.7e-51; Accession=PF00933.12; Description =Glycosyl hydrolase family 3 N terminal domain
  Pfam annotation: Domain name=Glyco_hydro_3_C; Domain location=371 -475; Score=-48.7; E_value=0.0015; Accession=PF01915.12; Description =Glycosyl hydrolase family 3 C terminal domain
  Pfam module annotation: Pfam domain module=Glyco_hydro_3::Glyco_hydro_ 3_C; Domain location=76-321::371-475
MSSTFSPLLNLIAVFLLLFLVRHTCEARDPFACDPKNGATENMPFCKASLAIPERVKDLVGRLTLQEKVRLLVNNAAAVPRLGMKGYEWWSEALHGVSNVGPGVKFNAQFPGATSFPQVITTAASFNASLWEAIGQVVSDEARAMYNGGTAGLTYWSPNVNIFRDPRWGRGQETPGEDPVLAGTYAASYVRGLQGTDGNRLKVAACCKHFTAYDLDNWNGMDRFHFNAQDIEETFDVPFRMCVSEGKVASVMCSYNQVNGVPTCADPNLLKKTVRGLWQLDGYIVSDCDSVGVFYDNQHYTPTPEEAAADAIKAGYEADVNGALVNTLTVQMRLGMFDGEPSAHAYGKLGPKDVCKPAHQELALEAARQGIVLLKNTGPVLPLSPQRHHTVAVIGPNSKATVTMIGNYAGVACGYTNPLQGIGRYAKTIHQLGCENVACKNDKLFGSAINAARQADATVLVMGLDQSIEAETVDRTGLLLP

SEQ ID NO: 178848 - protein, 108 aa, Glycine max
  Coding DNA Sequence Number=SeqID_62070
  Gene Ontology: Mol. function=transcriptional repressor activity; Cellular component=intracellular; Biological process=negative regulation of transcription, DNA-dependent
  Homolog annotation: Hit_ID=P0ACP7; Match level="QueryCoverage=50%, HitCoverage=15%, E-value=2e-20, Identity=94%"; Hit description=HTH -type transcriptional repressor purR
  Pfam annotation: Domain name=LacI; Domain location=55-80; Score=50.9; E_value=4.2e-12; Accession=PF00356.11; Description=Bacterial regulatory proteins, lacI f
  Subcellular localization annotation: CTP_CleavageSite=44; ConfidenceScore=5.37e-01
MQNGGKAKGNNHQQSSGGGGQCQFQIGRKTISRRKRLTIYLSVSCDKPRSTIFMATIKDVAKRAGVSTTTVSHVINKTRFVAEETRNAVWEAIKALHYSPSAVARSLK

SEQ ID NO: 178849 - protein, 65 aa, Glycine max
  Coding DNA Sequence Number=SeqID_62071
MNTTRERFSSGAELRTVVQAEVANPKSPQRGTTNKTTQLDKSATTDHLSKDTSNNKGHGNANHAT

SEQ ID NO: 178850 - protein, 65 aa, Glycine max
  Coding DNA Sequence Number=SeqID_62072
MIRIVAYNKCKLSVSCAPRLQWSHDILDERNIIEKSNSYKRKFLIQLASMLLALITFLPKFNSME

SEQ ID NO: 178851 - protein, 113 aa, Glycine max
  Coding DNA Sequence Number=SeqID_62073
  Gene Ontology: Mol. function=protein kinase activity; Cellular component=nucleus; Biological process=protein amino acid phosphorylation
  Homolog annotation: Hit_ID=Q9SYX2; Match level="QueryCoverage=94%, HitCoverage=10%, E-value=5e-28, Identity=58%"; Hit description =Phytochrome A supressor spa1
MKLKAENGTETKLQLEAENGKCIHVNRSFFEGLCKFAHYSKFDECGRLRNRDLVSSANVMCVLSFDRDEDHIAAGGVSKKIKIFDLNAISSDSVDIQYPVVEISNKSKLSCVK

SEQ ID NO: 178852 - protein, 440 aa, Glycine max
  Coding DNA Sequence Number=SeqID_62074
  Homolog annotation: Hit_ID=Q5GA22; Match level="QueryCoverage=34%, HitCoverage=44%, E-value=3e-34, Identity=45%"; Hit description =Hypothetical protein adh1B
  Subcellular localization annotation: CTP_CleavageSite=43; ConfidenceScore=5.38e-01
MKLASTSFSHFLLSAQLLRFIVALWEMRKPKSPPSPSSNSTTPATAGSHTRFGFRLAIGVDGEILPKTLQRMILICDHVFIDIQALICRFDNINGRVSHVSLRGSEFFHLLPHVVFLKASTDEPIFIDVEEVRKWCCVVVTHKKDGCEVDPTGVGDCFLGRFSAGIVKGLAMPDAALLGNFFGSIVVAQLGPPKLDFNLIQNVHHHVFTGSTKSPEFYCGVVLHWNNLFISALETHMILEKAGKCFKPYLDKLLSDGIVVKGKAYGICSIRVDGNDALVVYSALHTTREIAIREKRPVLMRGKKGAKQIWREKKRRGDAGGEARDVRWKSDCSCRHGLLLRSSGIEKATKFKRLALCSHTIQILQMFGLNTRKSAYTKIVGRNIFRQRLEAGDREADIEQCRGCNNQAIHLESRTIFSPGFHLSKNFGGVDKGIESIVYS

SEQ ID NO: 178853 - protein, 98 aa, Glycine max
  Coding DNA Sequence Number=SeqID_62075
MEIWKLNVPKKNQHFLWRALRGCVPTRNKLIMKVATCPSNDPLHGIGGPMARSKTKRMKQALQGLILKIKEKEDQCELRVAPNWVTFLQIDEDALRPT

SEQ ID NO: 178854 - protein, 51 aa, Glycine max
  Coding DNA Sequence Number=SeqID_62076
MKGDGEKACNAGNGFGRRKGEEMAFFLSYLDYKAQNAQVSNTLGTETSRTF

SEQ ID NO: 178855 - protein, 35 aa, Glycine max
  Coding DNA Sequence Number=SeqID_62077
MPTSSRRLGDSSPESYSLHPAAVILLPRTMFAIIT

SEQ ID NO: 178856 - protein, 134 aa, Glycine max
  Coding DNA Sequence Number=SeqID_62078
MGGQGEKAKVRLPKRRTRGSHHQRLFEENVRKKTKKRKNGTWDNGSLLRRVGARPGKLRLTPEVTGSPRRPGSFTLKSFGGPGEPKASLDELRSKKLNEKTLLPLIFGIFRILDQNIERSFILYGNWCQTMQFG

SEQ ID NO: 178857 - protein, 40 aa, Glycine max
  Coding DNA Sequence Number=SeqID_62079
  Gene Ontology: Mol. function=glycerone kinase activity; Biological process=glycerol metabolic process
  Homolog annotation: Hit_ID=O04059; Match level="QueryCoverage=92%, HitCoverage=6%, E-value=4e-11, Identity=86%"; Hit description =Putative 3,4-dihydroxy-2-butanone kinase
MELMIVARKIVPKLQLEHGLSVDRVYTGSFMTSLDMAGSD

SEQ ID NO: 178858 - protein, 103 aa, Glycine max
  Coding DNA Sequence Number=SeqID_62080
MAHTQPGPIDGLLLHLQHNHISNKVWEGEEVMLGLKIDGVAGANTSDVCVACQVLLGDIPPTKYITGKIYLTWLQQNFQELSLNADDVVIAQHAIAHIMMLIG

SEQ ID NO: 178859 - protein, 182 aa, Glycine max
  Coding DNA Sequence Number=SeqID_62081
  Gene Ontology: Mol. function=RNA-directed DNA polymerase activity; Biological process=RNA-dependent DNA replication
MTKLKEEPLGTCCAPYLLTLLSLGSPSEILMIFFSTDERIGTNGHLNWPLQGFHEAIIDFNLHDLPMEGYQFTWAKQHGEFNAIEEWLDKGLATLEWFDLFSNSKLINGLAAKSDHSPITIHLHGTNRRSFKRQFRFENSWLLELDMVNIVDLAWQPQQTSDFIQIRFQYQDQIDICKHELE

SEQ ID NO: 178860 - protein, 118 aa, Glycine max
  Coding DNA Sequence Number=SeqID_62082
  Homolog annotation: Hit_ID=Q2R4Y3; Match level="QueryCoverage=54%, HitCoverage=16%, E-value=7e-07, Identity=46%"; Hit description =Expressed protein
  Subcellular localization annotation: CTP_CleavageSite=32; ConfidenceScore=5.46e-01
MENCVFHHHLRSMITLPQPPSTPLFPKVMRVRASAGRRHCEFSSQNAPLEPRSLVGKFLSGVLQNRRQLFHVVAKEELKMLSDDRDSALARMHLSQHSDEALLHRCSFVSFCQRKRFK

SEQ ID NO: 178861 - protein, 102 aa, Glycine max
  Coding DNA Sequence Number=SeqID_62083
MQRKFDIPECEVAKKKVMSIVAMKYGLDPATWAKFAKSRQTPNWQVSQPTLLWASEARLTGASSIGGKCVESPPTFIERKMLEKPKETGHEEYSRFGSYLYV

SEQ ID NO: 178862 - protein, 315 aa, Glycine max
  Coding DNA Sequence Number=SeqID_62084
  Gene Ontology: Mol. function=identical protein binding; Cellular component=cytoplasm; Biological process=negative regulation of enzyme activity
  Homolog annotation: Hit_ID=Q2HV71; Match level="QueryCoverage=92%, HitCoverage=38%, E-value=1e-106, Identity=64%"; Hit description =Protease-associated PA; Proteinase inhibitor I9, subtilisin propeptide
  Pfam annotation: Domain name=PA; Domain location=25-117; Score=11.0; E_value=0.024; Accession=PF02225.12; Description=PA domain
  Pfam annotation: Domain name=Peptidase_S8; Domain location=35-258; Score=-81.0; E_value=0.019; Accession=PF00082.12; Description =Subtilase family
  Pfam module annotation: Pfam domain module=PA::Peptidase_S8; Domain location=25-117::35-258
MSTLVLGSLTLGDGKIIVGWTLFATNSIVENFPLIYNKIVSACNSVKLLTGVATRGIIICDALYSVSVLTQIACVIAASVYGAVFISEDLELIETGHLFTPSIVISPNDAKSVIKYAKSAQIPFANINFQQTFVGIKPSPAAAYYTSRGPSASYLGILKPNVMAPGSNVLAAFVPNKHSAKIGTNVFLSSDYNLLSGTSMACPHASGVVALLKAAHPDWSVAAIRSALVTTANPLDNTPNPVRDNGNPFQYASPLAMGAGEIEPNRTLDPSLIYDATSQNYVNLLCALGYTNNKMLTLIYDAIVSKSSPLDPTAI

SEQ ID NO: 178863 - protein, 1172 aa, Glycine max
  Coding DNA Sequence Number=SeqID_62085
  Gene Ontology: Mol. function=nucleic acid binding; Cellular component= nucleus; Biological process=regulation of transcription, DNA-dependent
  Homolog annotation: Hit_ID=Q9LTV5; Match level="QueryCoverage=99%, HitCoverage=56%, E-value=0.0, Identity=65%"; Hit description =Helicase-like protein
  Pfam annotation: Domain name=DEAD; Domain location=516-682; Score= -26.4; E_value=0.00096; Accession=PF00270.19; Description=DEADDEAH box helicase
  Pfam annotation: Domain name=HSA; Domain location=4-80; Score=95.0; E_ value=2.3e-25; Accession=PF07529.4; Description=HSA
  Pfam annotation: Domain name=Helicase_C; Domain location=1090-1168; Score=99.4; E_value=1.1e-26; Accession=PF00271.21; Description =Helicase conserved C-terminal domain
  Pfam annotation: Domain name=ResIII; Domain location=512-676; Score =6.2; E_value=1.4e-05; Accession=PF04851.6; Description=Type III restriction enzyme, res subunit
  Pfam annotation: Domain name=SNF2_N; Domain location=518-804; Score =399.1; E_value=6.4e-117; Accession=PF00176.13; Description=SNF2 family N-terminal domain
  Pfam module annotation: Pfam domain module=DEAD::HSA::Helicase _C::ResIII::SNF2_N; Domain location=516-682::4-80::1090-1168::512 -676::518-804
MALEAPREPRRPKTHWDHVLEEMVWLSKDFESERKWKLAQAKKVALRASKGMLDQATRGEKKMKLYLVQEEEQRLRKVALNISKDVKKFWTKIEKLVLYKHQMELDEKKKKALDKQLEFLLGQTERYSTMLAENLVDPYKSAENNSAEHHMSIQCKDVHDVINEPKEADVVEYQSDAADNDEEYDVQYDDESEDDERTIEQDEALITKEERQEELAALRDEMDLPIEELLKRYAGDKGESVMKESSPEHSEDGGKIVRAGDGKKGLASENGDDLLSVSKIGTSNSSIVSGRRCDESNGDVATPTNNLSQCENGQSENLKEVPSSFGGQCDIHEGERGDKQVVLEVGLLSEDGDFLLGIEDKDDETTLSEEEQLERVDAIDPKDEIALLQKESVMPVEELLARYKRDPSDDEDGEYESDYASALSENNSDSPVHEDAGQKDPAIPMDEDIKSGEHLAAIQSQEEQWESPHENLEKRESEDIIADAAAAARSAQPTGNTFSTTSVRTKFPFLLKYSLREYQHIGLDWLVTMYEKRLNGILADEMGLGKTIMTISLLAHLACDKGIWGPHLIVVPTSVMLNWETEFLKWCPAFKILTYFGSAKERKLKRQGWLKPNSFHVCITTYRLVIQDSKVFKRKKWKYLILDEAHLIKNWKSQRWQTLLNFNSKRRILLTGTPLQNDLMELWSLMHFLMPHVFQSHQEFKDWFSNPISGMVEGEEKVNKEVVDRLHNVLRPFLLRRLKRDVEKQLPMKHEHVIYCRLSKRQRNLYEDFIASSETQATLASANFFGMISIIMQLRKVCNHPDLFEGRPIVSSFDMRGIDIQLSSSVCSMLLPSPFSTVDLRGLGLLFTHLDYSMAAWESDEVQTIETPVTLIMERTDMAELEVIRPHKCQKKLQGTNIFEEIQWAIWEERLKQTKEHAAAIAWWNSLRCKKRPIYSTTLRDLVALRHPVNDIHQVKANPVSYLYSSKLADIVLSPVERFQKMTDVVESFMFAIPAARAPSPVCWCSTSETSVFLHPSYKQKCSEVLLPLLSPIRPAIVRRQVYFPDRRLIQFDCGKLQELAILLRRLKSEGHRALIFTQMTKMLDILEAFINLYGYTYMRLDGSTQPEERQTLMQRFNTNPKYFLFILSTRSGGVGINLVGADTVIFYDSDWNPAMDQQAQDRCHRIGQTRE

SEQ ID NO: 178864 - protein, 69 aa, Glycine max
  Coding DNA Sequence Number=SeqID_62086
  Subcellular localization annotation: CTP_CleavageSite=56; ConfidenceScore=5.27e-01
MKRRGMSFIGKRDVPGGPPLVDAPNRLPLLVTSGRPPLVVTPSRPPLPPLSHRPVKSCHVSRSGGMRPS

SEQ ID NO: 178865 - protein, 202 aa, Glycine max
  Coding DNA Sequence Number=SeqID_62087
  Gene Ontology: Mol. function=unfolded protein binding; Cellular component=cytoskeleton; Biological process=cellular protein metabolic process
  Homolog annotation: Hit_ID=Q6K3R8; Match level="QueryCoverage=83%, HitCoverage=30%, E-value=2e-75, Identity=85%"; Hit description =Putative chaperonin containing TCP1, subunit 3
MHAPVLVLKDSLKRESGSKVRYAIIQAAKAVADVVRTTLGPRSMLKMLLDAQGGIVVTNDGNAILRELDLAHPAAKSMIELSRTQDEEVGDGTTSVIILAGEMLHVADAFIDKIHPTVICRAYNKALEDAIAVLDKIAMPIDAQDRGIMLGLVKSCIGTKFTGQFGDLIAVSIPLSLLLGFLIDIILFFYIIVELFVLAYGA

SEQ ID NO: 178866 - protein, 80 aa, Glycine max
  Coding DNA Sequence Number=SeqID_62088
  Homolog annotation: Hit_ID=Q1RV80; Match level="QueryCoverage=46%, HitCoverage=6%, E-value=4e-09, Identity=78%"; Hit description=SAM (And some other nucleotide) binding motif
MVDRLAVELEILSFLSYHQIQMLLFIRVIAHHELLSWLRGWNGEGLSERQSCSIIHSVPLLNPNFLLPNWGTLDGTNFGS

SEQ ID NO: 178867 - protein, 297 aa, Glycine max
  Coding DNA Sequence Number=SeqID_62089
  Gene Ontology: Mol. function=translation initiation factor activity; Cellular component=nucleus; Biological process=mature ribosome assembly
  Homolog annotation: Hit_ID=Q9M060; Match level="QueryCoverage=99%, HitCoverage=98%, E-value=1e-126, Identity=70%"; Hit description =Eukaryotic translation initiation factor 6 (EIF-6)-like protein
  Pfam annotation: Domain name=eIF-6; Domain location=55-256; Score =418.2; E_value=1.1e-122; Accession=PF01912.9; Description=eIF-6 family
MPTVWLSLEVLKTSTAELAGVIPVVKTSISGIRVIGHLCAGNKNGLLLPHTTTDQGLQFENNCEVGVFSKLTNAYCLVAIGGSESFYSVFEAELADVIPVVKTSIGGTRIIGRLCAGNKNGLLLPHTTTDQELQQLRNSLPDQVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDTYV

SEQ ID NO: 178868 - protein, 156 aa, Glycine max
  Coding DNA Sequence Number=SeqID_62090
MLQILFCSYLFGKIVTLTHLAYRIFTTTRHHFPPSNPLHQIIIPSSQLPPDNPLATVHCRCRRFTAATFLIFFFRSQAPPTQQPQIIDSTKTEKCPEITKPKFHQGFEIAQNEVGAAVADGDGDSERKSRRKEEEVKSMVKERTRETIGWRRGRGG

SEQ ID NO: 178869 - protein, 750 aa, Glycine max
  Coding DNA Sequence Number=SeqID_62091
  Gene Ontology: Mol. function=triacylglycerol lipase activity; Biological process=lipid metabolic process
  Homolog annotation: Hit_ID=Q1SDA9; Match level="QueryCoverage=80%, HitCoverage=89%, E-value=1e-155, Identity=53%"; Hit description =Lipase, class 3
  Pfam annotation: Domain name=Lipase_3; Domain location=326-465; Score= 115.1; E_value=2e-31; Accession=PF01764.16; Description=Lipase (class 3)
  Pfam annotation: Domain name=RNA_pol_Rpb7_N; Domain location=689-750; Score=36.1; E_value=1.2e-07; Accession=PF03876.7; Description=RNA polymerase Rpb7, N-terminal domain
  Pfam annotation: Domain name=Thioesterase; Domain location=324-562; Score=-50.3; E_value=0.1; Accession=PF00975.10; Description =Thioesterase domain
  Pfam module annotation: Pfam domain module=Lipase_3::RNA_pol_Rpb7 _N::Thioesterase; Domain location=326-465::689-750::324-562
  Subcellular localization annotation: CTP_CleavageSite=73; ConfidenceScore=5.36e-01
MDALCLHSSICGIAPSPSILITATARANDYASHSRVKAVGSSSLFSIFSFRYPLKSFWPRPTGNATGYNDAVLAENATAETEQPEGEGEGQNGNWVFKIFHIRSVWRGEQRSDDNDEEEAVTNGQTDEEEEECDDCRVDYDDDEEEEENEEVSFDRDSFSRMLRRPGKLFKHYGLRFVTSSIEKKELAMAAEKNQISQKEETNEKDVDETKEEKNNGGYMISASAVYEIAASAASYLHAQTRSILSLTSSDAAEGEGSIEAINESFNGDKIRNTEEANLKATTDSVTAVVAANEQVKQAFADDLNSTSSSPCEWFVCDDDQTSTRYFVIQGSESFASWQANLLFEPVQFEGLDVHVHRGIYEAAKGTYQQMLPEIRAHLKSHGSRATFRFTGHSLGGSLALLVNLMLPIRKEALFSSLLPVITFGAPSIMCGGDTLLDMLGLPRSHVQAITLHRDIVPRAFSCQYPNHLVELLKAVNGNFRNHPCLNNQKLLYAPMGELLILQPDENFSPSHHLLPSGSGLYILSGSLSESSDTLKQIYKAQMVFLNTPHPLEILSDRSAYGFGGTIQRDHDMNSYLKCVRTVIRQELNQIRKARREQRQKSRKTQPTTQVRNPNAKLLVAPKASAVSVAPESRHSVVNIFLTKRRSMEGHQFFRMSIEQNHNQKHLYLPLASQLYSSIGSMFYLSKIEHKLPLPPSRFVLPIREAIHMELEKLFLDKVIANLGLCISVYDIRSIDGGFIFPGDGAPTYT

SEQ ID NO: 178870 - protein, 96 aa, Glycine max
  Coding DNA Sequence Number=SeqID_62092
MAFIGEAVVRGYVRVWNFRETVLVERVYWEEDKNIVGARKRVLWRGMCNVLIFEKWLCARNLELKPTNDFVHFGGVTMRDDSFYIRYDVISGDHQI

SEQ ID NO: 178871 - protein, 263 aa, Glycine max
  Coding DNA Sequence Number=SeqID_62093
  Homolog annotation: Hit_ID=Q1SDA3; Match level="QueryCoverage=77%, HitCoverage=98%, E-value=8e-28, Identity=36%"; Hit description=IMP dehydrogenase/GMP reductase
METQPECAVINIPNIIKTEQEAKPLQQHASESPKNKSGGGMRFLRVALFKMRGRSAKPTMALQVNNNNDDIDDGSKSTWGRFVGSMRPLHLQSTQSPRSSPDLPSSEYKKDCGGYVSDFVADEQEPYSPSPPISCYASAVGLSELVQNDEENEYKQEVIVEDSHVDGDGDWMIDAKAEDFIAQFYQEMKLQRLDSVDRRYVERSQSVSTRKTCSPSKSPRTTSHPLWATFLVCAGAANMGSVPFAAQQRQRLAWDHRVLECKF

SEQ ID NO: 178872 - protein, 166 aa, Glycine max
  Coding DNA Sequence Number=SeqID_62094
  Gene Ontology: Mol. function=nucleic acid binding; Cellular component= intracellular
  Homolog annotation: Hit_ID=Q69TF6; Match level="QueryCoverage=21%, HitCoverage=13%, E-value=2e-09, Identity=75%"; Hit description=Zinc finger protein-like
  Pfam annotation: Domain name=zf-C2H2; Domain location=23-45; Score =21.9; E_value=0.0023; Accession=PF00096.16; Description=Zinc finger, C2H2 type
MSDETWPPKLFGFPLTEQEDRKFRCHYCKRVFGNSQALGGHQNAHKKERQRARRFQIHTHRRAIAAAASISSHAIITSVPSIYLRGHPPTPTSLLPIFDPHRQPNNTKHFPSRPTFIPSSSNYHLTNYTQCFPFRLYASPTHVLQSSTPKVPHFSAEGEVDVHLKL

SEQ ID NO: 178873 - protein, 349 aa, Glycine max
  Coding DNA Sequence Number=SeqID_62095
  Gene Ontology: Mol. function=DNA binding; Cellular component=nucleus; Biological process=regulation of transcription
  Homolog annotation: Hit_ID=Q1SDA6; Match level="QueryCoverage=98%, HitCoverage=100%, E-value=3e-71, Identity=43%"; Hit description=Myb -like DNA-binding domain, putative
  Pfam annotation: Domain name=Myb_DNA-binding; Domain location=14-51; Score=24.5; E_value=0.00039; Accession=PF00249.21; Description=Myb -like DNA-binding domain
  Pfam annotation: Domain name=Myb_DNA-binding; Domain location=57-102; Score=48.6; E_value=2.2e-11; Accession=PF00249.21; Description=Myb -like DNA-binding domain
  Pfam module annotation: Pfam domain module=Myb_DNA-binding::Myb_DNA -binding; Domain location=14-51::57-102
MVRAPCCEKVGLKKGRWTEEEDDILTKYIQANGEGLLRCGKSCRLRWINYLRADLKRGNISFEEESIILKLHASFGNRWSLIASHLPGRTDNEIKNYWNSHLSRKIYTFHGTTSTSKDIIITLPPRRKRGRSSRWAMKKNKQQQIHTTHNNEVAVPLPPTPPLIETEKYLSTNIMLMEEQFDGSSTASTITHQHENNINTTQEEEEEQNVGVEEGEKEEIINEDIWGPCDEEVINGGEVVLNFDDIMDNCYFQEASGVWTISDHEQRESNDNINVAGNEKGVDDTCTNIVMSSGDDDQLHSSSFMASGLDQNLLTWLWEDEDWETDLQSLGEIHSDKLKAMVDWFLSSS

SEQ ID NO: 178874 - protein, 157 aa, Glycine max
  Coding DNA Sequence Number=SeqID_62096
MASSLPLLSSLFIFFLASTVFAINNITHATSVEKDLVPCTMCAECENPCQPLLPPPPPPLPSPPPPPPSVINIECPPPPKTPCPDNCEEVPQGQGPVPRPPYPPVLYFPPGTPYPNYVPYNMNTSGGMMRPYSIYFTKSFSLIIYVACLCLTYYLFI

SEQ ID NO: 178875 - protein, 1091 aa, Glycine max
  Coding DNA Sequence Number=SeqID_62097
  Gene Ontology: Mol. function=protein transporter activity; Cellular component=cytoplasm; Biological process=intracellular protein transport
  Homolog annotation: Hit_ID=Q1STD0; Match level="QueryCoverage=98%, HitCoverage=99%, E-value=1e-132, Identity=32%"; Hit description =Prefoldin
  Pfam annotation: Domain name=DUF869; Domain location=64-974; Score =422.7; E_value=5.1e-124; Accession=PF05911.2; Description=Plant protein of unknown function (DUF869)
MDHKSWLWGKKATLKTNLVTDKTNLTSKENGEVQAPLTDKEKLEKDLKRLNDKLAFTLSECNSKDEQIKKQTKIVQEAVADSFEGWEKAEAEILSMKQHIDESIQQQLVYKERVAQLDGALKECMQQLRFVREEQEQRIHDAVMKASKEFEEARIVLEEQLSETSKGLAKSGVESSRLNKSIIAKENLIEDLKRQLAHAEADHNALMIRLESIEKDNASLKYEAQVLEKELAIRNEEREFNRRAADASHKQHLQSVKKIANLESECQRLRILVRKRLPSQASLAKMKNEVEMLEHDSLEMRRKNLNSTSVVVESSLDSSPETTIRRITALTDQLCTVEEENKTLKESLNRKTNEVQFSRVMLARTASKLMRLESEIESRGHVNMELPKSNPALQDISLSSMSDIGSDDKVSCADSWASALISELEHFRSVKQKESMSCKSVGPSDISLMDDFLEMEKLAVVSVEKAPKISCASLEENNEIDGLPEARPNGISSEVISKEIIPVSDHLSEFSTSNQESCSIDILNGDIPGWLLDVVKAILEQNCVTHKNFDDICEDIRLALSYLNNADQCRFDSSKGHPFDGSKPLHFSQLTSWKPLNNSVVDPCGEVNDAEILSIKGTKQKSQRDLSQSIGKIIELIEGISMPAEDYDNSDSLYKRDGNIRAHKNQGIPTDYMVRVFQWKTSELSNVLQQFLHVCYDLLNDKADHEKFATELTTSLNWIMNHCFSLQDVSSMRDAIKKQFDLDETLSENEAETGMFADADKLHLPIEQLSCLPVLTNSDCHDVPTKDMQYVDKEEIKNIEDEVISSESEKEGRLQSAINQLQESEKTIGSLRLELQTLKELNRMLEEQVQNHAFINADLDTQLTETELKEANHKVLALEVEVENKNQYCEELETRCIELQLQLERLAHSYHQIYLHSMTKKWSDNDAYQKDEPLQTDWEITAASEKLAECQETILNLGKQLKALAAPKDASLFDNAIAAQRHTVTDTNTVPLKDMKVKNRSSLFDQMLADDDTKAKVSKASERGSSPTSIPGFKQPLEKILLLNELKGQDDSASVDSMAIVPAKKSGGRNFWRRLFGRKKSKKKTQFSLNT

SEQ ID NO: 178876 - protein, 346 aa, Glycine max
  Coding DNA Sequence Number=SeqID_62098
  Homolog annotation: Hit_ID=Q94JY0; Match level="QueryCoverage=87%, HitCoverage=90%, E-value=1e-123, Identity=71%"; Hit description =Cyclin delta-3
  Subcellular localization annotation: CTP_CleavageSite=30; ConfidenceScore=5.24e-01
MKVGGVVLYGGVPRGSVVPLLLSRRRVSLRASSSSYSSISDHVSFVKDVAATQPPQHLSQLLSILKTRGESIISPGARQGLIPLAIPLSKSSSGNVTALLRWPTAPPEMEMPVVEVRNYGVWLLAKSVDQFIHRMLVEEDAKNGQERNEEVFYASGDAGEKLYRKGDFAESGISNLDVYLLKKVGLFPDIIERKVARHFEEGDLVSALVTGEFYTKKEHFPGFARPFVFNSEVLLRVGRKVEAKDAARGALKSPWWTLGCKYQDVANIAQWEDEQIEYIKEKVTEEGRQEDLKKGKAPAQVVLDEAAFLLDLASIEGEWDEYLERIAKCYEEAGLQDVAKFILYRD

SEQ ID NO: 178877 - protein, 543 aa, Glycine max
  Coding DNA Sequence Number=SeqID_62099
  Gene Ontology: Mol. function=DNA binding; Cellular component=nucleus; Biological process=regulation of transcription, DNA-dependent
  Homolog annotation: Hit_ID=Q76I95; Match level="QueryCoverage=98%, HitCoverage=64%, E-value=1e-142, Identity=48%"; Hit description =PHCLF2
MQSNKVEDSSPAGKDVLLVIDSLKKQVAAERVVSVKKRIEENRQKLVGVTNHVCTMSMERRNFSITDTNRSLDLLTKRQKDAIDMHNGVHASNGDVESNGYHDDSHGSTAVLLGSNVAVKNAVRPIKLPEVKKLPPYTTWIFLDRNQRMTEDQSVVGRRRIYYDQNGGEALICSDSEEETMDDEEEKRQFIESEDYILRMTVKEFGLTDIVLESLAQCFSRNTSEIKAKYETLSIQDNAGGCSKAGDSEENSQSGNSFLEKDLEAALDSFDNLFCRRCLVFDCRLHGCSQDLVFPAEKQPTWNPPDTENASCGPNCFRSVLKSERFAKTSSAQADEQKSSGGALSRKKSSAKRRIKCSQSESASSNAKNISESSDSENGPGQDAVSASHSAPPKTKPVGKGGIGKRNSKRVAERVLVCMQKRQKKTMVSDSDSISEALDRSSNDMVTDPHAMSSEDNTRKEEFVDDNVCKPEITDNKSWKALEKGLLEKGMEIFGRNSCLIARNLLNGLKTCWDVFQYINCEDGKMSGPPGDVANSLMDGYSK

SEQ ID NO: 178878 - protein, 291 aa, Glycine max
  Coding DNA Sequence Number=SeqID_62100
  Gene Ontology: Mol. function=protein transporter activity; Cellular component=membrane; Biological process=intracellular protein transport
  Homolog annotation: Hit_ID=Q9SUJ1; Match level="QueryCoverage=88%, HitCoverage=89%, E-value=8e-78, Identity=57%"; Hit description =Syntaxin-43
  Pfam annotation: Domain name=SNARE; Domain location=203-262; Score =52.6; E_value=1.3e-12; Accession=PF05739.9; Description=SNARE domain
  Pfam annotation: Domain name=Syntaxin; Domain location=69-166; Score =69.2; E_value=1.4e-17; Accession=PF00804.15; Description=Syntaxin
  Pfam module annotation: Pfam domain module=SNARE::Syntaxin; Domain location=203-262::69-166
  Subcellular localization annotation: CTP_CleavageSite=53; ConfidenceScore=5.34e-01
MATRNRTLEFRKHRDAVKSVRAPLSSSASSPVIEMVTTSLLPSNRSSYAPLSTQEHAPSTSRDAFTVGLPPSWVDDSEEIATNIQRARVRISELTKAHAKALMPSFGDGKEDQRHIETLTQEITSLLRKSEVRLKRLSAAAGSSEDSNVRKNVQRSHATDLQNLSMDLRRKQSAYLKHLQQQQEGYDGVDLEMNFNGSKFVSHNDEFSDVVVKSVHELAQIMKDLSVLVIDQGTIVDRIDYNIQSVSTSVEEGLKQLQKVWGFVFEVPWAKMIGSLLRGKLGMALDSIPSC

SEQ ID NO: 178879 - protein, 172 aa, Glycine max
  Coding DNA Sequence Number=SeqID_62101
  Gene Ontology: Mol. function=nucleic acid binding; Cellular component= intracellular
  Homolog annotation: Hit_ID=Q8GT87; Match level="QueryCoverage=97%, HitCoverage=98%, E-value=2e-19, Identity=31%"; Hit description=Fiber protein Fb2
  Pfam annotation: Domain name=Di19; Domain location=10-167; Score =102.3; E_value=1.5e-27; Accession=PF05605.3; Description=Drought induced 19 protein (Di19)
MEDETLSFVLSTPSRSYQSRLKSHFAELFIDLDEVNGDEELRTAYPCPFCAENFDLLELCCHVDLDHPIEAKSGGERDGHWQSFSTGLSPTTSKAASDPWLSFLCGPSAVDECENVQPDSSSEVSIEEIHSNDNVLERDVQPSLSDKDQIEKAQHSKFVQGLLMSTILDPDF

SEQ ID NO: 178880 - protein, 1151 aa, Glycine max
  Coding DNA Sequence Number=SeqID_62102
  Gene Ontology: Mol. function=cellulose synthase (UDP-forming) activity; Cellular component=membrane; Biological process=cellulose biosynthetic process
  Homolog annotation: Hit_ID=Q09HT5; Match level="QueryCoverage=93%, HitCoverage=93%, E-value=0.0, Identity=65%"; Hit description =Cellulose synthase-like D6
  Pfam annotation: Domain name=Cellulose_synt; Domain location=276 -1151; Score=2056.4; E_value=0; Accession=PF03552.5; Description =Cellulose synthase
  Subcellular localization annotation: CTP_CleavageSite=34; ConfidenceScore=5.75e-01
MVNTASSPSSSPVTITVSSGGRRRSMGLTSPVPRASVSANNPASPLRVSGGRGGGASKDGGIEETNTEYVSYTVHIPPTPDRRPLTASEDGGKNSTSFISGTIFTGGYNSVTRGHVMECSMDSDAQAKTTSLTVCGMMGCDEEAMKGRLCGGGPCECGFKICRECYSECGGKCPGCKAPYKYVSDDDEEEEDDVEGSEGEDQPLPLPSMAEFKLDKRLSVVKSFKTQNHPPDFDHTRWLFETKGTYGYGNAVWPKDGCGANGFEPPPEFGEKARRPLTRKVGVSAAIISPYRLLILLRLVALGLFLTWRVRHPNHEAIWLWAMSITCELWFAFSWILDQLPKLCPVNRVTDLSVLKERFESPNLRNPKGRSDLPGIDVFVSTADPEKEPPLVTANTILSILAVDYPVEKVACYLSDDGGALLTFEALAETASFARIWVPFCRKHHIEPRNPETYFGQKRDFLKNKVRLDFVRERRRVKREYDEFKVRINSLPESIRRRSDAYNAHEELRAKKKQMEAGSNVSEPIKVPKATWMSDGSHWPGTWASGDQDHSRGDHAGIIQAMLAPPNAEPEFGAEADGDNLIDTTDVDIRLPMLVYVSREKRPGYDHNKKAGAMNALVRTSAIMSNGPFILNLDCDHYIYNSLAMREGMCFMLDRGGDRICYVQFPQRFEGIDPSDRYANHNTVFFDVSMRALDGLQGPMYVGTGCIFRRTALYGFSPPRATEHHGWLGRRKIKLFLRKPKVSKKEEDEICVPINGGYNDDDADIESLLLPRRFGNSTSLAASIPVAEYQGRLLQDLQGKGTQGRPAGSLAVPREPLDAATVAEAISVISCFYEDKTEWGKRVGWIYGSVTEDVVTGYRMHNRGWRSVYCVTQRDAFRGTAPINLTDRLHQVLRWATGSVEIFLSRNNALLASPRMKFLQRVAYFNVGMYPFTSIFLIVYCFLPAVSLFSGQFIVQSLSATFLVFLLGITITLCLLALLEIKWSGITLHDWWRNEQFWLIGGTSAHPAAVLQGLLKVIAGVDISFTLTSKSATPEDGDDEFADLYEVKWSFLMVPPITIMMVNSIAIAVGVARTLYSPFPQWSRLVGGVFFSFWVLCHLYPFAKGLMGRRGKVPTIIYVWSGLLSIIISLLWVYINPPSGRTQDYMNFQFP

SEQ ID NO: 178881 - protein, 87 aa, Glycine max
  Coding DNA Sequence Number=SeqID_62103
  Gene Ontology: Mol. function=nucleic acid binding; Biological process= DNA integration
MSRVPYASVVCSLMYAMVCTRSDLAQADNVLSKYMGDPGEEHWSVTGYAFTIGNTLASWKATFQPTLDLSTTKAQYMALEEALKEGI

SEQ ID NO: 178882 - protein, 145 aa, Glycine max
  Coding DNA Sequence Number=SeqID_62104
MTLSSNRVQVVLVGPVVVKSERESDFLSSQLPVGGVATIGGAIHPDAGITATILPNIRGDKAKSPLPNPITNVINLDSEATVVQVIALCPIIHPSSFSPKKPKKEYPHITLPSYSLVYGRMAKFDYQSIKKAQVEKTKADKGKGK

SEQ ID NO: 178883 - protein, 83 aa, Glycine max
  Coding DNA Sequence Number=SeqID_62105
MQQGHAYIPIVRFPDPNYVASNGGSWWPPVVVSGGEEGVRFGWAFREEENPNGQTVGTCVRNLQSKFEDDPTFNKSKIVVLPE

SEQ ID NO: 178884 - protein, 108 aa, Glycine max
  Coding DNA Sequence Number=SeqID_62106
MTIVGLWFKLEKLFMTKSIYNKLLMKLCLLGLRMRKGNDFITLEEAKSSLYSRELRLKASENGDEVSTSILSVNDYAKRQKKKKFKVKKSKVDPKDICNYFKELVHWQ

SEQ ID NO: 178885 - protein, 655 aa, Glycine max
  Coding DNA Sequence Number=SeqID_62107
  Gene Ontology: Mol. function=nucleic acid binding; Cellular component= nucleus
  Homolog annotation: Hit_ID=Q9LTV5; Match level="QueryCoverage=82%, HitCoverage=28%, E-value=1e-85, Identity=36%"; Hit description =Helicase-like protein
MLAEVKQRGAAAAAAGQAISAFENELRPIDRYAIRFMELWDPIIDKTALESEVRIEDTEWELDRIEKYKEEMEAEIDEDEEPLVYESWDADYATTAYRQHVEALAQHQLMEELEYEARQKEAEETCDSKKTQTPGDSKPKSKKKPKKAKFKSLKKGSLTSGLRPVKEESQAEPMNIDDEDVTGVDFLSPNSTKQKKRKKSKLTTDGEEEKRLKKSKKSKRDPPDIYASDLESNSLVVQDEHAESKTCESLVDLEQKTASRSKIGGKISITPMPVKREDAILCAVVHEYGPNWSLVSETLYGMSGGGSYRGRYRHPVHCCERFGELFQKYVLLSLDNANHEKINSPGSGKALLKVTEDNIRMLLDVASEQVASHVDRRRNPLPTCNGLYFDQSFYTSIGQPSQNSLKKSSKRMTFTNLAQSKKLVAAALDDITTRQVNDKVILSNQGEDMPVSADQLDITLEFTKEDSDVLSSFPSVINLSIIGTEPTPSLNKQTGEDDLKVGLFIAENRFREAARVCEEDSSGWASSAFPTNDARSRAGSRIQSSGKQKSSMSDSSKPSRSKSKKASMDPSEMHHHQADSKFQSMPSLKDLRIDLTSLTTDEVGIDSMGSIFSFDLNGESSLEMESVGMIPHDYVAGLISDLDDCTAFPEYTDIR

SEQ ID NO: 178886 - protein, 92 aa, Glycine max
  Coding DNA Sequence Number=SeqID_62108
MVVGCRLDSPTCSATMSPTSSPSLCMSNELNQDDNNLKYFSSPKAISMVLVGCSRCLMYVMVNEDNLKCPKIKSIALIHFVDANNNPTIKKG

SEQ ID NO: 178887 - protein, 124 aa, Glycine max
  Coding DNA Sequence Number=SeqID_62109
  Subcellular localization annotation: CTP_CleavageSite=43; ConfidenceScore=5.63e-01
MSSVISCFEKATMPSFTLSKTTMFSSQRLQCLLSLCFIGLNVLCFTAWTSASGRLDAPRPTRKLRDEVTSSLGGPEVPKVQRSREKRKEEKKKLKRRQIVTTIDFYIVLHSFFGHSSFVLCSSP

SEQ ID NO: 178888 - protein, 100 aa, Glycine max
  Coding DNA Sequence Number=SeqID_62110
MVGYTPSSFANLVFTGEMIKVGLEKGKSDHPALMNAKIGANEEDENEGETLAMTTIPIRSKFPSSQQCHYSANNSPSNPIIHKACPPHIQCLNTNQKGIL

SEQ ID NO: 178889 - protein, 190 aa, Glycine max
  Coding DNA Sequence Number=SeqID_62111
  Gene Ontology: Mol. function=DNA binding; Cellular component=nucleus; Biological process=regulation of transcription, DNA-dependent
  Homolog annotation: Hit_ID=Q76I95; Match level="QueryCoverage=92%, HitCoverage=23%, E-value=3e-88, Identity=72%"; Hit description=PHCLF2
  Pfam annotation: Domain name=CXC; Domain location=18-58; Score=9.6; E_ value=0.0016; Accession=PF03638.5; Description=TesminTSO1-like CXC domain
  Pfam annotation: Domain name=SET; Domain location=33-163; Score=44.3; E_value=4.2e-10; Accession=PF00856.18; Description=SET domain
  Pfam module annotation: Pfam domain module=CXC::SET; Domain location =18-58::33-163
MISFFPLFISRCPKSCKNRFRGCHCAKSQCRSRQCPCFAADRECDPDVCRNCWVSCGDGTLGIPSQRGDNYECRNMKLLLKQQQRVLLGRSDVSGWGAFLKFVLDAYRKGDKLKFANHSPDPNCYAKVIMVAGDHRVGIFAKERICAGEELFYDYRYEPDRAPAWARKPEASGSKKEDGAPSSGRAKKLA

SEQ ID NO: 178890 - protein, 141 aa, Glycine max
  Coding DNA Sequence Number=SeqID_62112
  Gene Ontology: Mol. function=caffeoyl-CoA O-methyltransferase activity; Cellular component=integral to membrane; Biological process=lignin biosynthetic process
  Homolog annotation: Hit_ID=Q9SWB8; Match level="QueryCoverage=71%, HitCoverage=41%, E-value=8e-40, Identity=79%"; Hit description =Caffeoyl-CoA O-methyltransferase 2
  Pfam annotation: Domain name=Methyltransf_3; Domain location=67-141; Score=-10.7; E_value=1.4e-11; Accession=PF01596.8; Description=O -methyltransferase
MTRMGGRVVQRSCLTRGDDGLANIQRIPKTEMTLIKELEQQPNQIAGHKELAHKSLLQSDALYQYILETSVYPREHESLKELRELTEKHPWNLMATPPDEGQLLGMLLKLINAKNTMEIGVFTGYSLLSTALALPSDGKVP

SEQ ID NO: 178891 - protein, 335 aa, Glycine max
  Coding DNA Sequence Number=SeqID_62113
  Gene Ontology: Mol. function=phospholipase C activity; Cellular component=membrane; Biological process=intracellular signaling cascade
  Homolog annotation: Hit_ID=Q93XX5; Match level="QueryCoverage=73%, HitCoverage=59%, E-value=1e-107, Identity=72%"; Hit description=PI -PLC X-domain containing protein At5g67130 precursor
QPAINTLREVEAFLTQNPTEIVTIVIEDYVHTPKGLTNLFRNAGLDKYWFPVSDMPKKGEDWPTVTEMVQVNHRLLVFTSDASKEAEEGIAYQWSYMVENESGDPGVEGGSCPHRKESKPLNSRSASLFLQNYFPTDPVEADSCKEHSVPLVDMVNTCYKAAGNVLPNFLAVNFYMRSDGGGVFDIVDKMNGHSLCGCNTISACQEGAPFGSCKNIAVPNTSPVTNTAGSFTGSVQFSRSASPVHSPNCWCYNQGSVRSSEVDGNQERLRTHPEQFRICTKVTLVNDRIGNLQYRIRMAESSWSLLRAYGFLQLYNDDSYHLPFPFHFCIDVETI

SEQ ID NO: 178892 - protein, 313 aa, Glycine max
  Coding DNA Sequence Number=SeqID_62114
  Gene Ontology: Mol. function=transferase activity, transferring glycosyl groups; Biological process=pyridine nucleotide biosynthetic process
  Homolog annotation: Hit_ID=Q1SHA1; Match level="QueryCoverage=95%, HitCoverage=66%, E-value=1e-106, Identity=60%"; Hit description =Nicotinate phosphoribosyltransferase related
  Pfam annotation: Domain name=NAPRTase; Domain location=104-313; Score= -79.3; E_value=0.0014; Accession=PF04095.6; Description=Nicotinate phosphoribosyltransferase (NAPRTase) family
MVTPMLADQYQFIMAYAYWKAGKHQEQAVSDGFLDYLRGIDCSDVEFYAIPKGSVVFLKVPLLRIEGPIAVVQLLETPFVYLINFASLVSTNAARHRFVAGKPKTLLEFGLRRAQGPDGGVGASKYSYIGGFDATRYYRFNNFHSVVRGYPMSLYIVIEKGQSAWYILVVVPKILRSNSLRGNFAETNQSELAAFTYALAFPDNFLALVDADDVMRSGIPNFCVVALALSDLGYKAIGIRLDSGDLGYLSCEIRKLFCSIEKEFGLPGFGKMNITTSNDLNEEKLDALNKQVNSFGNCSYFAVNSSNSKCKNH

SEQ ID NO: 178893 - protein, 529 aa, Glycine max
  Coding DNA Sequence Number=SeqID_62115
  Gene Ontology: Mol. function=protein serine/threonine kinase activity; Cellular component=membrane; Biological process=protein amino acid phosphorylation
  Homolog annotation: Hit_ID=Q1SH98; Match level="QueryCoverage=97%, HitCoverage=98%, E-value=0.0, Identity=70%"; Hit description=Protein kinase
  Pfam annotation: Domain name=Pkinase; Domain location=170-467; Score =117.4; E_value=4e-32; Accession=PF00069.15; Description=Protein kinase domain
  Pfam annotation: Domain name=Pkinase_Tyr; Domain location=170-467; Score=98.2; E_value=2.5e-26; Accession=PF07714.7; Description =Protein tyrosine kinase
  Pfam module annotation: Pfam domain module=Pkinase::Pkinase_Tyr; Domain location=170-467::170-467
MNSSTSAAAAMNDQLSNPTSIFGLRLWVVLGVCVGAAIVLILFLISVWLAFKRSKTNPVSIPDVSKEIQEIRLDHAPNLNPTLQPEPPLSEPDPVPPTEEETTPLGYHRIQFEIGKNHRISYPERPLVRSSSNDPSSCEVQVPTVIPEVSHLGWGHWYTLRELEDSTNAFAPENVIGEGGYGIVYHGILNDNTNVAIKNLLNNRSLHLLLSFLSSISTMFYLIIIIHNARGQAEKEFKVEVEAIGRVRHKNLVRLLGYCAEGAHRMLVYEYVDNGNLEQWLHGDVGPCSPLTWEIRMNIILGTAKGLTYLHEGLEPKVVHRDIKSSNILLSKKWNAKVSDFGLAKLLGSDSSYITTRVMGTFGYVAPEYASTGMLNERSDVYSFGILIMELITGRNPVDYSRPPEEVNLVDWLKKMVSNRNPEGVLDPKLPEKPTSRALKRALLVALRCTDPNAQKRPKMGHVIHMLEAEDSPYKEDRRAKRDAGHSPNDRVGDGLKEEVTVSVSVDDGKLENGMCANETRSNPQIEKQ

SEQ ID NO: 178894 - protein, 62 aa, Glycine max
  Coding DNA Sequence Number=SeqID_62116
MSNREPEERVTLPPFIVGQPIPYLKYGNIVLFCPSDMLSDEVHHLLACRHVVNCQRMSQLTS

SEQ ID NO: 178895 - protein, 1049 aa, Glycine max
  Coding DNA Sequence Number=SeqID_62117
  Gene Ontology: Mol. function=microtubule motor activity; Cellular component=microtubule associated complex; Biological process =microtubule-based movement
  Homolog annotation: Hit_ID=Q1RV39; Match level="QueryCoverage=99%, HitCoverage=99%, E-value=0.0, Identity=77%"; Hit description =Calponin-like actin-binding; Kinesin, motor region
  Pfam annotation: Domain name=CH; Domain location=52-179; Score=40.2; E_value=7.2e-09; Accession=PF00307.21; Description=Calponin homology (CH) domain
  Pfam annotation: Domain name=Kinesin; Domain location=435-758; Score =512.9; E_value=3.6e-151; Accession=PF00225.13; Description=Kinesin motor domain
  Pfam module annotation: Pfam domain module=CH::Kinesin; Domain location=52-179::435-758
MAAEAALFFSVASVVEDVLQQHGPRLKDLDLESRKAEEAVILKWKVLYFAASRRYEAAGWLRKMVGVVAAKDLPAEPSEEEFRLGLRSGIILCNVINKVQSGAVPKFIRLFKVVESPVDSALIPDGAPLTAYQYFENVRNFLVAVQEIGIPISEASDLEQGGKSSRIVNCVLALKSYSEWKMSGSNGVWKFGGNLKPTVSAKSFVRKNSDPFTNSLSRTSSLNDKSIAALNSDVENIKMSGSHSLSMLVRAILSDKKPDEVSTLVESVLNKVVEEFEQRIASQGEQTKVTSRDPVSQSNGSAMADKKGEKKIHVATKKEDYIHKNQVATMVTTKKEGHSHKNQVADEESQRQLMKQKMLFDQQQREIQELRHTLHSTKDGMQFMQMKFHEEFSNLGMHIHGLANAASGYHRVLEENRKLYNQVQDLKGSIRVYCRVRPFFPGQANHLSAVENIEDGTITVNIPSKNGKGRRSFNFNKIFGPSATQAEVFLDMQPLVRSALDGFNVCIFAYGQTGSGKTYTMTGPKEITEKSQGVNYRALSDLFLIADQRRDTFHYDVSVQMIEIYNEQVRDLLVTDGTNKRYPFTKIRSSSQKGLSVPDASLVPVSSTIDVIELMNLGQRNRAVGATALNDRSSRSHSCLTVHVQGRDLTSGAILRGCMHLVDLAGSERVDKSEATGDRLKEAQHINKSLSALGDVIASLAQKNSHVPYRNSKLTQLLQDSLGGQAKTLMFVHISPESDAIGETISTLKFAERVATVELGASRVNKDSADVKELKEQIASLKAALARKEGESEHSFSSSSEKYRTKASELSPYHINQRDPDTVDQLGCRQPMVEVGNIEQLQSNTTVRHKTQSFDFDEISANSPPWPPVNNSLAQNYGEDDKESGSGEWVDKVMVNKQDVNKTENLLGCWQAANNGNLSEAFYQKYIEDSPKMYSEQSYTMFMGANQFNIAGSDDIMDELDAATSDSSEPDLLWQFNHSKLSSVTNGIGSKTMRSISKAAKNSPELSKNAVHSSPLGPSPSLKNSNGVPHRSGRHPAPVDVKRRTGNRK

SEQ ID NO: 178896 - protein, 50 aa, Glycine max
  Coding DNA Sequence Number=SeqID_62118
  Homolog annotation: Hit_ID=Q8LEI6; Match level="QueryCoverage=95%, HitCoverage=12%, E-value=4e-07, Identity=40%"; Hit description =Receptor-like protein kinase
SISKTGCKSDEGEFMKGLHMLTSLRSDNVEGDGEVLEWSTRVSIVKGIAK

SEQ ID NO: 178897 - protein, 348 aa, Glycine max
  Coding DNA Sequence Number=SeqID_62119
MEDKRTAITNNQARKKIHPLIRSLSIGGEGGIAGLVVFGGALAIAGFMAVASFASNKNKAKDTHDDHQPPKPKPKPQQLLLEEHICKSEEDHDTTQSLTSLIQHGDSTCCWASNMSKTQVSDSSESLSVQSLILEEKNELKARSVEESPTDFHHQEIVFSDSSHPESAASSNEGGVAEECMMSLLNSPSGQDEEPQDDSTSSETETVTEDDDIKDDDDDDDEMLSDDVSEIGEQDGSKVATGTTSMEPVWPEELIQHAKQKFKGDSHVCSDSEVDGSDDLDEAMMTVANQATMNQNLNFFMVPNNQPLTTWVFPFLLLALLLILVLLTRRPQESFYVLDEGTTVVKRI

SEQ ID NO: 178898 - protein, 248 aa, Glycine max
  Coding DNA Sequence Number=SeqID_62120
  Gene Ontology: Mol. function=catalytic activity; Biological process =guanosine tetraphosphate metabolic process
  Homolog annotation: Hit_ID=Q84LE7; Match level="QueryCoverage=98%, HitCoverage=29%, E-value=2e-74, Identity=55%"; Hit description=RelA -SpoT like protein RSH1
MALSTKSAFQRHKQWLQHAKTRSARHKIMKFLREQAARSAADITTEAVNDFVIDSDGDSESEEVSKGSSGSKYTWGKMFVNGAEISTSGRSETVLQSNNGSAWIPKVNGKHNKHVQHESFNGKGEMLLQGNLVAKMIQVNIPRYKEVLPGLESWQAQKIASWHNMEGHSIQWLSVVCIDRKGMMAEVTTALATAGIAICSCVAEIDGGRGMAVMVTACSKVDLILGVLGWSTGCSWPSLMEDRGVLEC

SEQ ID NO: 178899 - protein, 84 aa, Glycine max
  Coding DNA Sequence Number=SeqID_62121
MEGCHPNHEKYNVARDIKFSWERVKGERKEEKSLKEKYNVATSTFFQSPEEEVVWCLKSLQDQIQIINHKFMKKLRLYARLREW

SEQ ID NO: 178900 - protein, 385 aa, Glycine max
  Coding DNA Sequence Number=SeqID_62122
  Gene Ontology: Mol. function=catalytic activity; Biological process =guanosine tetraphosphate metabolic process
  Homolog annotation: Hit_ID=Q84LE7; Match level="QueryCoverage=100%, HitCoverage=45%, E-value=1e-139, Identity=65%"; Hit description=RelA- SpoT like protein RSH1
  Pfam annotation: Domain name=HD; Domain location=169-276; Score=64.3; E_value=3.8e-16; Accession=PF01966.12; Description=HD domain
MASASSLSVSLECVNACKLWRGDGNGRFDCSLLSSAWKAPRVLTGFLASTAHPHQCSDLSNGRNGRRNRYNFGCETFSVDGSCRDEPIDIVLFEGCSRSMLSQNAPRRWQLCCSLAPDAVTDFSAESLWEDLTPVISYLSPKELELVYNAFMLAFKAHDGQKRRSGEPFIIHPVEVARILGELELDWESIAAGLLHDTVEDTNVVTFERIEEEFGATVRHIVEGETKVSKLGKLKYKNENDSVQDVKAEDLRQMFLAMTEEVRVIIVKLADRLHNMRTLSHMPPHKQTSIAMETLQSELENLSFMYTNAEDYAKVKRRVAELYKEHEKELLEANKMLMKKIQDDQFLDLLTVKTEVRAVCKEPYSIYKAVLKSKSSINEINQIAQ

SEQ ID NO: 178901 - protein, 191 aa, Glycine max
  Coding DNA Sequence Number=SeqID_62123
MEVNVAGLNQINHPTLDMVGQEGKELGSTGGPHFLQVQNKHAFLPYGLPPNYTPPNVVDTPDENVNNSNPTLTESQQPQSDHAYVSQPMREAHEIPHHNLANFKPNLGYATEGQAVDGVPLPKTLEEPQFRSQPQPLHFVAGRVPPAMVEKGKLDHIKERLKAIEEGRDHAFANMVELYLVPDVVIPLKFK

SEQ ID NO: 178902 - protein, 369 aa, Glycine max
  Coding DNA Sequence Number=SeqID_62124
  Gene Ontology: Mol. function=bile acid:sodium symporter activity; Cellular component=membrane; Biological process=sodium ion transport
  Homolog annotation: Hit_ID=Q7AY87; Match level="QueryCoverage=79%, HitCoverage=87%, E-value=1e-104, Identity=64%"; Hit description=CtsX protein
MDKQQLVDIANTAMPFGKYKGRMLIDVPEEYLLWFARKNEFPAKKLGELMQLTLAIKIEGLQGLVKPLKRTLGNERAHHQLDLMEDHQRQDNNPHCAGREQDVGHWYTVCQALFRAAKQHHNLIRTAKAKQPGSAKVDGQCDEQNQQAASQNPQQGINADAMPDAVNHRLTERRIDHQQNRGLIGFANQAAMLLHPATNPAACQVAQHKGHQQLQHDFTNLLQTIAWSIAVHIHHQVNQQRRNKDAQQTGGGGSTHRRGNVTARHGGESNRGLHRRRQDTQVEETGVDLRADVDRMPPHQQQAKDRENHEGTAHNPQMQPPVAAAGDDLLARQFGTVHEEQQGDGRSGQVFEEIDKPAFGRKEAWPAAR

SEQ ID NO: 178903 - protein, 977 aa, Glycine max
  Coding DNA Sequence Number=SeqID_62125
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=94%, HitCoverage=96%, E-value=0.0, Identity=37%"; Hit description =Tyrosine protein kinase, active site
  Pfam annotation: Domain name=LRRNT_2; Domain location=40-80; Score =37.4; E_value=4.9e-08; Accession=PF08263.3; Description=Leucine rich repeat N-terminal domain
  Pfam annotation: Domain name=LRR_1; Domain location=109-131; Score =14.3; E_value=0.44; Accession=PF00560.23; Description=Leucine Rich Repeat
  Pfam annotation: Domain name=LRR_1; Domain location=133-155; Score =2.8; E_value=87; Accession=PF00560.23; Description=Leucine Rich Repeat
  Pfam annotation: Domain name=LRR_1; Domain location=157-178; Score =16.4; E_value=0.1; Accession=PF00560.23; Description=Leucine Rich Repeat
  Pfam annotation: Domain name=LRR_1; Domain location=180-202; Score =17.3; E_value=0.056; Accession=PF00560.23; Description=Leucine Rich Repeat
  Pfam annotation: Domain name=LRR_1; Domain location=204-226; Score =17.9; E_value=0.037; Accession=PF00560.23; Description=Leucine Rich Repeat
  Pfam annotation: Domain name=LRR_1; Domain location=228-250; Score =6.1; E_value=20; Accession=PF00560.23; Description=Leucine Rich Repeat
  Pfam annotation: Domain name=LRR_1; Domain location=252-274; Score =19.8; E_value=0.0097; Accession=PF00560.23; Description=Leucine Rich Repeat
  Pfam annotation: Domain name=LRR_1; Domain location=276-298; Score =7.3; E_value=12; Accession=PF00560.23; Description=Leucine Rich Repeat
  Pfam annotation: Domain name=LRR_1; Domain location=300-319; Score =7.3; E_value=12; Accession=PF00560.23; Description=Leucine Rich Repeat
  Pfam annotation: Domain name=LRR_1; Domain location=324-346; Score =8.8; E_value=6.5; Accession=PF00560.23; Description=Leucine Rich Repeat
  Pfam annotation: Domain name=LRR_1; Domain location=348-370; Score =12.6; E_value=1.3; Accession=PF00560.23; Description=Leucine Rich Repeat
  Pfam annotation: Domain name=LRR_1; Domain location=372-394; Score =9.3; E_value=5.1; Accession=PF00560.23; Description=Leucine Rich Repeat
  Pfam annotation: Domain name=LRR_1; Domain location=396-415; Score =14.2; E_value=0.48; Accession=PF00560.23; Description=Leucine Rich Repeat
  Pfam annotation: Domain name=LRR_1; Domain location=420-442; Score =14.5; E_value=0.39; Accession=PF00560.23; Description=Leucine Rich Repeat
  Pfam annotation: Domain name=LRR_1; Domain location=444-466; Score =7.1; E_value=13; Accession=PF00560.23; Description=Leucine Rich Repeat
  Pfam annotation: Domain name=LRR_1; Domain location=468-490; Score =9.5; E_value=4.8; Accession=PF00560.23; Description=Leucine Rich Repeat
  Pfam annotation: Domain name=LRR_1; Domain location=492-513; Score =14.2; E_value=0.49; Accession=PF00560.23; Description=Leucine Rich Repeat
  Pfam annotation: Domain name=LRR_1; Domain location=515-537; Score =13.6; E_value=0.71; Accession=PF00560.23; Description=Leucine Rich Repeat
  Pfam annotation: Domain name=LRR_1; Domain location=539-559; Score =14.0; E_value=0.54; Accession=PF00560.23; Description=Leucine Rich Repeat
  Pfam annotation: Domain name=LRR_1; Domain location=560-581; Score =13.9; E_value=0.58; Accession=PF00560.23; Description=Leucine Rich Repeat
  Pfam annotation: Domain name=LRR_1; Domain location=84-107; Score =1.8; E_value=1.3e+02; Accession=PF00560.23; Description=Leucine Rich Repeat
  Pfam annotation: Domain name=Pkinase; Domain location=685-955; Score =136.4; E_value=7.7e-38; Accession=PF00069.15; Description=Protein kinase domain
  Pfam annotation: Domain name=Pkinase_Tyr; Domain location=679-955; Score=84.3; E_value=3.8e-22; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=40-80::109-131::133-155::157-178::180-202::204-226::228 -250::252-274::276-298::300-319::324-346::348-370::372-394::396 -415::420-442::444-466::...
  Pfam module annotation: Domain location=468-490::492-513::515 -537::539-559::560-581::84-107::685-955::679-955
MMFSKLSLLRLILCSLLSLHSSQLFTSTSFAFAAITAENQEREAAALLEWRVSLDNQSQASLSSWSSGVSPCTWKGIVCDDSNSVTAINVANLGLKGTLHSLKFSSFPKLLTLDISNNSFNGIIPQQISNLSRVSQLKMDANLFSGSIPISMMKLASLSLLDLTGNKLSGTIPSIRNLTNLEHLKLANNSLSGPIPPYIGELVNLKVLDFESNRISGSIPSNIGNLTKLGIFFLAHNMISGSVPTSIGNLINLESLDLSRNTISGVIPSTLGNLTKLNFLLVFNNKLHGTLPPALNNFTKLQSLQLSTNRFTGPLPQQICIGGSLRKFAANGNSFTGSVPKSLKNCSSLTRVNLSGNRLSGNISDAFGVHPKLDFVDLSNNNFYGHISPNWAKCPSLTSLKISNNNLSGGIPPELGWAPMLQELVLFSNHLTGKIPKELGNLTSLFDLSIGDNELFGNIPTEIGALSRLENLELAANNLGGPIPKQVGSLHKLLHLNLSNNKFTESIPSFNQLQSLQDLDLGRNLLNGKIPAELATLQRLETLNLSHNNLSGTIPDFKNSLANVDISNNQLEGSIPSIPAFLNASFDALKNNKGLCGNASGLVPCHTLPHGKMKRNVIIQALLPALGALFLLLLMIGISLCIYYRRATKAKKEEAKEEQTKDYFSIWSYDGKLVYESIIEATEGFDDKYLIGEGGSASVYKASLSTGQIVAVKKLHAVPDEETLNIRAFTSEVQALAEIKHRNIVKLIGYCLHPCFSFLVYEFLEGGSLDKLLNDDTHATLFDWERRVKVVKGVANALYHMHHGCFPPIVHRDISSKNVLIDLDYEARVSDFGTAKILKPDSQNLSSFAGTYGYAAPELAYTMEANEKCDVFSFGVLCLEIMMGKHPGDLISSFFSSPGMSSASNLLLKDVLDQRLPQPVNPVDKEVILIAKITFACLSESPRFRPSMEQVYNEFVMPTSSSVNLFSMVTLSQLVDN

SEQ ID NO: 178904 - protein, 363 aa, Glycine max
  Coding DNA Sequence Number=SeqID_62126
  Gene Ontology: Mol. function=ubiquitin-protein ligase activity; Cellular component=ubiquitin ligase complex; Biological process =protein ubiquitination
  Homolog annotation: Hit_ID=Q6ZKH8; Match level="QueryCoverage=96%, HitCoverage=96%, E-value=1e-53, Identity=37%"; Hit description =Putative armadillo repeat containing protein
  Pfam annotation: Domain name=Arm; Domain location=116-154; Score=9.5; E_value=0.8; Accession=PF00514.13; Description=Armadillobeta-catenin -like repeat
  Pfam annotation: Domain name=Arm; Domain location=155-196; Score=6.0; E_value=2.2; Accession=PF00514.13; Description=Armadillobeta-catenin -like repeat
  Pfam annotation: Domain name=Arm; Domain location=200-238; Score=6.9; E_value=1.7; Accession=PF00514.13; Description=Armadillobeta-catenin -like repeat
  Pfam annotation: Domain name=Arm; Domain location=239-275; Score=1.2; E_value=8.7; Accession=PF00514.13; Description=Armadillobeta-catenin -like repeat
  Pfam annotation: Domain name=Arm; Domain location=276-317; Score=8.2; E_value=1.2; Accession=PF00514.13; Description=Armadillobeta-catenin -like repeat
  Pfam annotation: Domain name=Arm; Domain location=319-359; Score=8.3; E_value=1.1; Accession=PF00514.13; Description=Armadillobeta-catenin -like repeat
  Pfam annotation: Domain name=HEAT; Domain location=139-175; Score =10.3; E_value=2.4; Accession=PF02985.12; Description=HEAT repeat
  Pfam annotation: Domain name=HEAT; Domain location=204-240; Score =1.9; E_value=25; Accession=PF02985.12; Description=HEAT repeat
  Pfam annotation: Domain name=HEAT; Domain location=325-361; Score =4.2; E_value=13; Accession=PF02985.12; Description=HEAT repeat
  Pfam annotation: Domain name=U-box; Domain location=4-79; Score=77.3; E_value=4.9e-20; Accession=PF04564.6; Description=U-box domain
  Pfam module annotation: Pfam domain module=Arm::Arm::Arm::Arm::Arm::Ar m::HEAT::HEAT::HEAT::U-box; Domain location=116-154::155-196::200 -238::239-275::276-317::319-359::139-175::204-240::325-361::4-79
MDSHLPDHFKCPISLEIMSDPVILSSGHTFDRSSIQRWLDAGHRTCPITKLPLPDHPALIPNHALRSLISNYAFLSPLHHTVSQPEALISTLASNSSSSDSKIEALKHLTRLSKRDSAFRRRLAESGAVPAVIAAVDDPSLQERALPLLLNLTLDDDSKVGLVAEGVVARVVEVLLHAPTPDCRAVAATIVTSLAVVEVNKATIGAFPAAIAALVAILRDGKGRERKEAATALYALCSFPDNRRRAVNCGAVPILLQNVEIGLERCVEVIGFLAKCKEGREQMECYDGCVQILVNVLRNGSSRGIQYALFALTSLCSYNQEMVLVALEEGVLEASLGFVEDDNEKVRRNACNLIKVLRFNHNR

SEQ ID NO: 178905 - protein, 555 aa, Glycine max
  Coding DNA Sequence Number=SeqID_62127
  Gene Ontology: Mol. function=enzyme inhibitor activity; Cellular component=cell wall; Biological process=cell wall modification
  Homolog annotation: Hit_ID=Q7XAF8; Match level="QueryCoverage=98%, HitCoverage=98%, E-value=1e-169, Identity=53%"; Hit description =Papillar cell-specific pectin methylesterase-like protein
  Pfam annotation: Domain name=PMEI; Domain location=27-183; Score =59.9; E_value=8.3e-15; Accession=PF04043.6; Description=Plant invertasepectin methylesterase inhibitor
  Pfam annotation: Domain name=Pectinesterase; Domain location=241-541; Score=694.8; E_value=6.4e-206; Accession=PF01095.10; Description =Pectinesterase
  Pfam module annotation: Pfam domain module=PMEI::Pectinesterase; Domain location=27-183::241-541
MAFNSLYFLMLCVSLVLSFLTSISIADNNHAVVPPETICYSTLDPSYCKSVLANQYGSIYDYCRISVRKSLSQSRKFLNNMYSYLQNPSSYSQSTIRALEDCQFLAELNLEYLSTTHDTVDKASAVLPTSQAEDVHTLLSAVLTNQQTCLDGLQTSAPDPRVKNDLSLQLAENAKLDSVSLYLFTKAWDSENKTSTSWQNQNDRLPLKMSNKVRAIYDSARGQGRKLLQTMDDNESVLVSDIVLVSKDGSGNFTTINDAIAAAPNNTAATDGYFIIFISEGVYQEYVSIAKNKKFLMLIGDGINRTIITGDHNVVDGFTTFNSATFAVVAQGFVAMNITFRNIAGPSKHQAVAVRNGADMSTFYSCSFEGYQDTLYTHSLRQFYRECDIYGTVDFIFGNAAVVLQNCNMYPRLPMSGQFNAITAQGRTDPNQNTGISIQNATIKSAQDLAPVVGTVETYLGRPWKEYSRTVYMQSFMDSLIAPSGWHEWNGNFALSTLYYAEYDNTGPGSNTGNRINWPGYHVINATDAASFTVSNFLNGDDWVPQTSVPYQTSL

SEQ ID NO: 178906 - protein, 500 aa, Glycine max
  Coding DNA Sequence Number=SeqID_62128
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9SSU7; Match level="QueryCoverage=92%, HitCoverage=91%, E-value=0.0, Identity=83%"; Hit description=Endo-1 ,4-beta-glucanase
  Pfam annotation: Domain name=Glyco_hydro_9; Domain location=38-493; Score=998.1; E_value=3e-297; Accession=PF00759.9; Description =Glycosyl hydrolase family 9
MRTFSLFSCLFFFLSVFSTTLFHPGHSLHHHPHSATHNYRDALTKSIIFFEGQRSGKLPSNQRMSWRRDSGLSDGSAMHVDLVGGYYDAGDNVKFGFPMAFTTTMLSWSVIEFGGVMKGELQNAREAIRWATDYLLKATAHPDIIYVQVGDAVKDHACWERPEDMDTPRSVFKVDKNNPGSDVAAETAAALAAASLVFKKVDPTYSKTLVRRAIRVFQFADKYRGPYSNGLKPVVCPFYCSYSGYQDELLWGATWLHKATKNPMYLNYIKVNGQTLGAPDSDNTFGWDNKHVGARILLSKEFLVRKVQTLHDYKGHADNFICSVIPGSSSSQFTPGGLLFKMGDSNMQYVTSTSFILLAYAKYLTKAHVVVNCGGTIVTPKRLRAIAQKQVDYLLGDNPLKMSYMVGYGPRYPQRIHHRGSSLPSVAVHPGKIQCSAGFSVMNSQSPNPNILMGAVVGGPDLHDGFPDERSDYEQSEPATYINAPLVGALAYLAHSFGQL

SEQ ID NO: 178907 - protein, 562 aa, Glycine max
  Coding DNA Sequence Number=SeqID_62129
  Gene Ontology: Mol. function=enzyme inhibitor activity; Cellular component=cell wall; Biological process=cell wall modification
  Homolog annotation: Hit_ID=Q7XAF8; Match level="QueryCoverage=95%, HitCoverage=96%, E-value=0.0, Identity=57%"; Hit description =Papillar cell-specific pectin methylesterase-like protein
  Pfam annotation: Domain name=PMEI; Domain location=26-184; Score =64.4; E_value=3.6e-16; Accession=PF04043.6; Description=Plant invertasepectin methylesterase inhibitor
  Pfam annotation: Domain name=Pectinesterase; Domain location=249-547; Score=708.0; E_value=6.6e-210; Accession=PF01095.10; Description =Pectinesterase
  Pfam module annotation: Pfam domain module=PMEI::Pectinesterase; Domain location=26-184::249-547
  Subcellular localization annotation: CTP_CleavageSite=68; ConfidenceScore=5.32e-01
MAFKNLSVLTLCVSLVLSFFAPNSIAANNRAVVPPETICNSTVNPSFCKTVLANQNGSIVDYGRISVRKSLSQSRKFLNSVNSLLQDRSSLSLPTIRALEDCQFLAELNFEYLTNALDTVDKASDVLPTAQAEDQQTLLSAVLTNEETCLEGLQQSTASDQRVKSDLISSLSDDKKLHSVSLDLFTKGWVAEKKISTSWQVNGRHLDFHNGRLPLKMSNRVRAIYDSARGHGRKLLQDNSQSVLVSDIVVVSQDGSGNFTTINDAIAVAPNNTVANDGYFLIFITQGVYQEYISIAKNKKNLMMIGDGINQTIITGNHNVVDNFTTFNSATFAVVAQGFVAVNITFQNTAGPSKHQAVAVRNGADMSTFYSCSFEGYQDTLYTHSLRQFYRECDIYGTVDFIFGNAAVVLQTCNLYPRLPMSGQFNAITAQGRTDPNQNTGTSIHNATIKPADDLAPSVGTVQTYLGRPWKEYSRTVYMQSFMNSFINPSGWHEWSGDFALSTLYYAEYNNTGPGSNTANRVTWPGYHVINATDAANFTVSNFLDGDSWLPQTGVPYVTGLI

SEQ ID NO: 178908 - protein, 143 aa, Glycine max
  Coding DNA Sequence Number=SeqID_62130
  Gene Ontology: Mol. function=hydrolase activity; Cellular component =peroxisome; Biological process=aromatic compound metabolic process
  Homolog annotation: Hit_ID=Q76E11; Match level="QueryCoverage=63%, HitCoverage=29%, E-value=3e-37, Identity=77%"; Hit description =Soluble epoxide hydrolase
MEKIEQKTVSTNGINMHVASIGSGPVVLFLHGFPELWYTWRHQLLSLSAAGYRAIAPDLRGYGDTDAPPDASSHSILHIVADLVGLLDALGIEFQKPGEVEEEFARAGAARIIKTFLASRDPQPPRVPKEIGFGGSPNLRIAD

SEQ ID NO: 178909 - protein, 102 aa, Glycine max
  Coding DNA Sequence Number=SeqID_62131
MSEYKGGGNGNWALRDFKCVMASSTWPNWVRTRIMEVREGCGMWCILAVARMRVVTCDASSSFDPWEVRVVTRLAMQEVKTEVRWYLELLLEVSNFGTVTVN

SEQ ID NO: 178910 - protein, 438 aa, Glycine max
  Coding DNA Sequence Number=SeqID_62132
  Gene Ontology: Mol. function=enzyme inhibitor activity; Cellular component=cell wall; Biological process=cell wall modification
  Homolog annotation: Hit_ID=Q7XAF8; Match level="QueryCoverage=98%, HitCoverage=77%, E-value=1e-169, Identity=67%"; Hit description =Papillar cell-specific pectin methylesterase-like protein
  Pfam annotation: Domain name=Pectinesterase; Domain location=126-423; Score=703.9; E_value=1.1e-208; Accession=PF01095.10; Description =Pectinesterase
NKTTRFLPSFQADDIQTLLSAILTNQQTCLDGLKDTASAWSVRNGLSVPLSNDTKLYSVSLALFIKGWVPRTKAKAMHPTKKQLGFKNGRLPLKMSSRTRAIYESVSRRKLLQAKVGDEVVVRDIVTVSQDGSGNFTTINDAIAAAPNKSVSTDGYFLIYVTAGVYEENVSIDKKKTYLMMVGDGINKTIITGNRSVVDGWTTFSSATLAVVGQGFVGVNMTIRNTAGAVKHQAVALRSGADLSTFYSCSFEGYQDTLYVHSLRQFYSECDIFGTVDFIFGNAKVVFQNCNMYPRLPMSGQFNAITAQGRTDPNQDTGISIHNSTIRAADDLASSNGVATYLGRPWKEYSRTVYMQTFMDSVIHAKGWREWDGDFALSTLYYAEYSNSGPGSGTDNRVTWPGYHVINATDASNFTVSNFLLGDDWLPQTGVSYTNNLI

SEQ ID NO: 178911 - protein, 682 aa, Glycine max
  Coding DNA Sequence Number=SeqID_62133
  Gene Ontology: Mol. function=GTP binding; Cellular component=exocyst; Biological process=vesicle docking during exocytosis
  Homolog annotation: Hit_ID=Q8S213; Match level="QueryCoverage=98%, HitCoverage=84%, E-value=0.0, Identity=56%"; Hit description=SEC15 (S. cerevisiae)-like protein
  Pfam annotation: Domain name=Sec15; Domain location=455-682; Score= -140.8; E_value=0.018; Accession=PF04091.3; Description=Exocyst complex subunit Sec15-like
MLSSKPPRRKVVPANGDDSADKLDQLLLSSAISNNEDLGPFIRKAFTSGKPETLHHHLRHFARSKESEIEEVCKAHYQDFILAVDDLRSLLSDVDSLKSSLSDSNSRLQHVARPLLSSLDAFVETRNVSKNVNLAIDSVRTCVKLMEVCTRANRHLADDNFYMALKCVDAIEREYLDQTASSTLRRMLEKKIPEIRSYIERKVNKEFGDWLVEIRVVSRNLGQLAIGQASAARQREEDLRIKQRQAEEQSRLSVRDCIYALEEEDEDGIIAGGIGEDGGGAAGFDLTSLCRAYHIHQTLGLEDRFKQYYFENRKLQLTSDFQVSSMTPFLESHQTFFAQIAGFFVVEDRVLRAGGGLISKMEVENLWDIAVSKMCSVLEDQFSRMQTANHLLLIKDYVSLLGVTLRRYGYPIDALLDVLSKHRDKYHELLLSDCRKLIAEAVAADKFEQMLMKKEYEYSMNVLSFQIQTSDIIPAFPYVAPFSSTVPDCCRIVRSFIEDSVSFMSYGGQLEFYEVVKKYLDRLLSEVLDEALVKLINTSINGVSQAMQMAANMAVLERACDFFFRHAAQLSGVPLRMVERSRRNFPLRKARDAAEEMLSGLLKAKVDGFMTLIENVNWMGDEAPQSGNEYVNEVIIYLEILVSTAQQILPSQVLKRVLQEVFAHISEKIVGTLVSDSVKRFN

SEQ ID NO: 178912 - protein, 183 aa, Glycine max
  Coding DNA Sequence Number=SeqID_62134
  Homolog annotation: Hit_ID=Q8L9T5; Match level="QueryCoverage=26%, HitCoverage=16%, E-value=9e-09, Identity=59%"; Hit description=RING -H2 finger protein ATL3F
MAFSDTQSAEAKTMRSNPHPLRKPNPVQCQLNPWPHAALVAVGELRQANGAVLERAVGGGGESKSGKGLDDGRVEARVVERGGGGGIGRKRTREEATAATAAEADEGVEENNDYYKNEEENGGAHHDLAVVGILGFNVWLHSSHDDGERVKRVTSISQFVILVGALLKETANEWAVSKSLPTT

SEQ ID NO: 178913 - protein, 179 aa, Glycine max
  Coding DNA Sequence Number=SeqID_62135
  Gene Ontology: Mol. function=enzyme inhibitor activity; Biological process=metal ion transport
  Homolog annotation: Hit_ID=Q1S041; Match level="QueryCoverage=80%, HitCoverage=80%, E-value=1e-47, Identity=68%"; Hit description =Pectinesterase inhibitor
  Pfam annotation: Domain name=PMEI; Domain location=24-169; Score =65.0; E_value=2.4e-16; Accession=PF04043.6; Description=Plant invertasepectin methylesterase inhibitor
  Subcellular localization annotation: CTP_CleavageSite=64; ConfidenceScore=5.00e-01
MYPTINHCLHPLSIPRPGSSLTGSKRKEANQQGMHNRPKQRPLRSILSSDPIRSPNADLKDLAVISLRVAARNASGILSDTKMLIDDDNLDPDVQQGLADCKETILDAESQLEDTIASLLVGSDTDAQVWLKAAVAAIDTCDASIPGDDDVLSVKSAMFRRLCNIAIAISKLLNKPLKF

SEQ ID NO: 178914 - protein, 893 aa, Glycine max
  Coding DNA Sequence Number=SeqID_62136
  Gene Ontology: Mol. function=nucleotide binding; Cellular component =nucleolus; Biological process=ribosome biogenesis and assembly
  Homolog annotation: Hit_ID=Q10LM2; Match level="QueryCoverage=94%, HitCoverage=92%, E-value=0.0, Identity=45%"; Hit description=Utp14 protein, expressed
  Pfam annotation: Domain name=Utp14; Domain location=125-856; Score =685.9; E_value=3e-203; Accession=PF04615.4; Description=Utp14 protein
MTEKKRKERDEGNRRRLKPKKKSNTQWKKTGPRLPSSLQKHIDRLNPTTSFDSADSDDDNDVYEYEEERAEEESKKNKRYDSASVDDDLAQEIEYLKHLDDENVQSDDESEDDDYIGTKRNENAASDDSGEEDDGRHARMLQAITGMPSEAFEENKKKKVMKDTVIPELYPESEYNPSRDVVDGDGRISIEDLLNPLREKSGYGKLRKRYQQIEKNARTIHVPLSKAVQAKVERKAAYEVSKKDVTKWQHIIQRNREAPTIFFDENVDLGFSTVGAIASEFEPRTEFEKKMAALVYDDEVMEAHKKDGSKLLEMNKVSIEDEKDRQNRIAKMRSLLFRHEMKAKHIKKIKSRTFHRLLKKDKLKAEASQIQMDPEAAKEYAMKQERQRAEERMTLKHKNHNPWAARIIQRGLHNQDEGTRAAIHEQLQRHAELTRKMKSMKGSSSSGEDSSEEEEDDNSAGSDQDMDYKILGKAKEKTMKVLEEEEEVPKSGLLSLPFMRRGLEKRKEAAVEEANLAFQEYEDSLKKLENSGGSEDPKAASTSGRRVFGTAKAQIDASNKVKSDNCYDGSDSEDDLGTSKSGNIENEGSDLLHKDVNKDLVVIQDDTDTHQESVFKNIDEIIKKPGPKTTYEVSIFVSDTWKKAKNKNEEITMKKSPKLPGLVRQAIKDTENEFREDSDTDSEGQMVDGILSSVSKVPYELPSQEELIRQAFAGDDVEDDFEKDKQEILNEENPEPEKPLLLPGWGQWTHVQQKKGLPSWMLKKHEDAQKKRAEALKKRKDAQLNNVIISEKIDKKAEKLHTKSLPYPFTSKEVFEQSMRVPIGPEYNPATAIGPLNRPEVVKRPGVIIKPIEFKEVNPHEKTEQRNGDKRKFKKNKGNAGNIMKKAKVGGKS

SEQ ID NO: 178915 - protein, 1127 aa, Glycine max
  Coding DNA Sequence Number=SeqID_62137
  Gene Ontology: Mol. function=transmembrane receptor activity; Cellular component=membrane; Biological process=defense response
  Homolog annotation: Hit_ID=Q2HUD1; Match level="QueryCoverage=90%, HitCoverage=89%, E-value=0.0, Identity=40%"; Hit description=TIR; Disease resistance protein; AAA ATPase
  Pfam annotation: Domain name=LRR_1; Domain location=608-629; Score =1.2; E_value=1.7e+02; Accession=PF00560.23; Description=Leucine Rich Repeat
  Pfam annotation: Domain name=LRR_1; Domain location=654-676; Score =2.9; E_value=83; Accession=PF00560.23; Description=Leucine Rich Repeat
  Pfam annotation: Domain name=LRR_1; Domain location=678-697; Score =6.8; E_value=15; Accession=PF00560.23; Description=Leucine Rich Repeat
  Pfam annotation: Domain name=LRR_1; Domain location=701-722; Score =12.3; E_value=1.4; Accession=PF00560.23; Description=Leucine Rich Repeat
  Pfam annotation: Domain name=LRR_1; Domain location=725-747; Score =0.2; E_value=2.6e+02; Accession=PF00560.23; Description=Leucine Rich Repeat
  Pfam annotation: Domain name=LRR_1; Domain location=749-771; Score =8.2; E_value=8.4; Accession=PF00560.23; Description=Leucine Rich Repeat
  Pfam annotation: Domain name=LRR_1; Domain location=773-793; Score =8.9; E_value=6.2; Accession=PF00560.23; Description=Leucine Rich Repeat
  Pfam annotation: Domain name=LRR_1; Domain location=842-865; Score =13.1; E_value=1; Accession=PF00560.23; Description=Leucine Rich Repeat
  Pfam annotation: Domain name=LRR_1; Domain location=867-889; Score =9.2; E_value=5.4; Accession=PF00560.23; Description=Leucine Rich Repeat
  Pfam annotation: Domain name=LRR_1; Domain location=891-912; Score =7.3; E_value=13; Accession=PF00560.23; Description=Leucine Rich Repeat
  Pfam annotation: Domain name=LRR_3; Domain location=608-627; Score =34.8; E_value=3e-07; Accession=PF07725.3; Description=Leucine Rich Repeat
  Pfam annotation: Domain name=NACHT; Domain location=217-371; Score= -25.5; E_value=0.0056; Accession=PF05729.3; Description=NACHT domain
  Pfam annotation: Domain name=NB-ARC; Domain location=178-474; Score =92.1; E_value=1.6e-24; Accession=PF00931.13; Description=NB-ARC domain
  Pfam annotation: Domain name=TIR; Domain location=21-154; Score =110.5; E_value=4.8e-30; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_3::NACHT::NB -ARC::TIR; Domain location=608-629::654-676::678-697::701-722::725 -747::749-771::773-793::...
  Pfam module annotation: Domain location=842-865::867-889::891 -912::608-627::217-371::178-474::21-154
MLRGESSSNSPNASSRLTYHVFLSFRTEGTHLDFANTLCTSLQRNGISTFRYDKQKERGYLILEKLHKVIEQCLVVIVLLSENYASSTWCLDELHKILESKRVLGTPVFPLFYDVVPSDVRHQKNKFAEAFEEHATRPEEDKVKVQKWRESLHEVAGFSGWESKNWKKEELIEEIIESVWTKLRPKLPSYDDGLVGIDSRVEKMNSLLKLELKDKVCFIGIWGMGGIGKTTLARVVFKKIRNKFDISCFLENVREISQNCDGMLSLQGKLLSHMKMKDLKIQNLDEGKSIIGGILFNNNVLLVLDDVNDIRQLENFSVNDQKWLGPGSRIIIITRDMEVLRSHGTVESYKIDLLNSDESLQLFSQKAFKRDQPLEHILQLSKVAVQQAGGLPLAIEMMGSSFCGRSESQWKEFLEVKEYTKKDVVMDKLIISYDGLPPSYKILFLDIACFFNGWVKEHVTQILTICGRYPANGIDVLIDKSLATYDGSRLWMHDLLQEMGRKIVVEECPIDAGKRSRLWSPQDTDQALKRNKENELIQGIVLQSSTQPYNANWDPEAFSKMYNLKFLVINYHNIQVPRGIKCLCSSMKFLQWTGCTLKALPLGVKLEELVELKMRYSKIKKIWSGSQHFAKLKFIDLSHSEDLIESPIVSGVPCLEILLLEGCINLVEVHQSVGQHKKLVLLNLKGCINLQTLPTKFEMDSLEELILSGCSKVKKLPNFGKNMQHLSLVNLEKCKNLLWLPKSIWNLKSLRKLSICGCSKFSTLPNSMNENGSLEELDVSGTPIREITSSKVCLENLKELSFGGRNELASNSLWNLHQRISMHRRQQVPKELILPTLSRLTSLKFLNLSYCDLNDESIPDSLGSLLSLLGLNLSGNNFVSPPTRCISNLHTLQSLTLIDCPRLESLPMLPPSAQCLGTTNSTQMKPLNSDAYMLWKIYELHMNQTYFLYTHSLPTLPLTHPNYFHKVCAYQMEDRPHFLFIIPGREIQKWNEVFFLIDPSHHPYNRLGSDSVASIIVDVPNYLVSSGWLGIAICLALEPPNMQHSSPSHVSPHPVGNEDTCIYYWACKVPQGEPDLTFPIGPKFSHFVYECNEEKCQLQLIFYVENHSKPWKPRIRKCASVMRFCQE

SEQ ID NO: 178916 - protein, 42 aa, Glycine max
  Coding DNA Sequence Number=SeqID_62138
MPEIPYYDSDRIRNHKMTSKSYLQLERQTDFCNSARASSFKN

SEQ ID NO: 178917 - protein, 536 aa, Glycine max
  Coding DNA Sequence Number=SeqID_62139
  Gene Ontology: Mol. function=hydrolase activity, hydrolyzing O -glycosyl compounds; Cellular component=membrane; Biological process =carbohydrate metabolic process
  Homolog annotation: Hit_ID=Q1SPW5; Match level="QueryCoverage=79%, HitCoverage=90%, E-value=0.0, Identity=80%"; Hit description =Glycoside hydrolase, family 17
  Pfam annotation: Domain name=Glyco_hydro_17; Domain location=107-426; Score=449.0; E_value=6.1e-132; Accession=PF00332.9; Description =Glycosyl hydrolases family 17
  Pfam annotation: Domain name=X8; Domain location=468-536; Score =113.9; E_value=4.8e-31; Accession=PF07983.3; Description=X8 domain
  Pfam module annotation: Pfam domain module=Glyco_hydro_17::X8; Domain location=107-426::468-536
MKLEVPQFDGTNPLGWIFKITQYFEYHGTLDRDRLTIASFYMEGRTLAWYQWISSNAQFTSWLAFLQALQTRSHKSHHWASVALPPQLFHLWFNPGDSLGGPDGGSIGVNYGRIANNLPSAVKVVQLLKSQGLTRVKVYDTDPAVLRALSGSGIKVTVDLPNQQLFAAAKAPSFASSWVERNVAAYYPHTQIESIAVGNEVFVDPHNTTKFLVPAMKNIQKALTKHNLDKDIKVSSPIALSALANSYPSSAGSFRPELVEPVFKPMLDFLRETGSYLMVNVYPFFAYESNADVISLDYALFRDNPGVVDPGNGLRYYNLFDAQIDAVFSALSALKYDDVKIVVTETGWPSKGDSNEVGASVENAAAYNGNLVRKILTAAGTPLRPKADLTVYLFALFNENQKPGPTSERNFGLFYPDERRVYNVPLTVEELKDYHDRPSAPVNGGGQKKETPAPVVSGGVSKSTTGNTWCVANPDADKVKLQAALDFACGEGGSDCGPIQRGATCYDPNTLVAHASFAFNSYYQKQSRKGGSCYFG

SEQ ID NO: 178918 - protein, 998 aa, Glycine max
  Coding DNA Sequence Number=SeqID_62140
  Gene Ontology: Mol. function=protein-tyrosine kinase activity; Cellular component=integral to membrane; Biological process=protein amino acid phosphorylation
  Homolog annotation: Hit_ID=Q1SX58; Match level="QueryCoverage=94%, HitCoverage=93%, E-value=0.0, Identity=47%"; Hit description =Tyrosine protein kinase, active site
  Pfam annotation: Domain name=Brevenin; Domain location=696-736; Score= 4.1; E_value=0.091; Accession=PF03032.6; Description=Breveninesculenti ngaegurinrugosin family
  Pfam annotation: Domain name=LRRNT_2; Domain location=63-103; Score =41.9; E_value=2.2e-09; Accession=PF08263.3; Description=Leucine rich repeat N-terminal domain
  Pfam annotation: Domain name=LRR_1; Domain location=132-154; Score =15.7; E_value=0.17; Accession=PF00560.23; Description=Leucine Rich Repeat
  Pfam annotation: Domain name=LRR_1; Domain location=156-178; Score =3.9; E_value=54; Accession=PF00560.23; Description=Leucine Rich Repeat
  Pfam annotation: Domain name=LRR_1; Domain location=180-202; Score =13.8; E_value=0.65; Accession=PF00560.23; Description=Leucine Rich Repeat
  Pfam annotation: Domain name=LRR_1; Domain location=204-226; Score =13.8; E_value=0.63; Accession=PF00560.23; Description=Leucine Rich Repeat
  Pfam annotation: Domain name=LRR_1; Domain location=228-249; Score =17.9; E_value=0.038; Accession=PF00560.23; Description=Leucine Rich Repeat
  Pfam annotation: Domain name=LRR_1; Domain location=251-273; Score =19.0; E_value=0.017; Accession=PF00560.23; Description=Leucine Rich Repeat
  Pfam annotation: Domain name=LRR_1; Domain location=275-297; Score =12.6; E_value=1.3; Accession=PF00560.23; Description=Leucine Rich Repeat
  Pfam annotation: Domain name=LRR_1; Domain location=299-321; Score =11.2; E_value=2.3; Accession=PF00560.23; Description=Leucine Rich Repeat
  Pfam annotation: Domain name=LRR_1; Domain location=323-345; Score =15.3; E_value=0.22; Accession=PF00560.23; Description=Leucine Rich Repeat
  Pfam annotation: Domain name=LRR_1; Domain location=347-369; Score =5.2; E_value=30; Accession=PF00560.23; Description=Leucine Rich Repeat
  Pfam annotation: Domain name=LRR_1; Domain location=371-390; Score =3.0; E_value=78; Accession=PF00560.23; Description=Leucine Rich Repeat
  Pfam annotation: Domain name=LRR_1; Domain location=395-417; Score =3.2; E_value=71; Accession=PF00560.23; Description=Leucine Rich Repeat
  Pfam annotation: Domain name=LRR_1; Domain location=419-441; Score =10.0; E_value=3.9; Accession=PF00560.23; Description=Leucine Rich Repeat
  Pfam annotation: Domain name=LRR_1; Domain location=443-465; Score =8.6; E_value=6.9; Accession=PF00560.23; Description=Leucine Rich Repeat
  Pfam annotation: Domain name=LRR_1; Domain location=467-489; Score =15.0; E_value=0.27; Accession=PF00560.23; Description=Leucine Rich Repeat
  Pfam annotation: Domain name=LRR_1; Domain location=491-513; Score =19.6; E_value=0.011; Accession=PF00560.23; Description=Leucine Rich Repeat
  Pfam annotation: Domain name=LRR_1; Domain location=515-537; Score =10.4; E_value=3.2; Accession=PF00560.23; Description=Leucine Rich Repeat
  Pfam annotation: Domain name=LRR_1; Domain location=539-561; Score =6.2; E_value=20; Accession=PF00560.23; Description=Leucine Rich Repeat
  Pfam annotation: Domain name=LRR_1; Domain location=563-585; Score =12.5; E_value=1.3; Accession=PF00560.23; Description=Leucine Rich Repeat
  Pfam annotation: Domain name=LRR_1; Domain location=587-609; Score =15.3; E_value=0.22; Accession=PF00560.23; Description=Leucine Rich Repeat
  Pfam annotation: Domain name=LRR_1; Domain location=611-631; Score =13.0; E_value=1; Accession=PF00560.23; Description=Leucine Rich Repeat
  Pfam annotation: Domain name=LRR_1; Domain location=632-653; Score =13.8; E_value=0.64; Accession=PF00560.23; Description=Leucine Rich Repeat
  Pfam annotation: Domain name=Pkinase; Domain location=757-996; Score =102.3; E_value=1.5e-27; Accession=PF00069.15; Description=Protein kinase domain
  Pfam annotation: Domain name=Pkinase_Tyr; Domain location=757-988; Score=30.2; E_value=2.5e-14; Accession=PF07714.7; Description =Protein tyrosine kinase
  Pfam module annotation: Pfam domain module=Brevenin::LRRNT_2::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=Pkinase::Pkinase_Tyr; Domain location=696-736::63-103::132-154::156-178::180-202::204 -226::228-249::251-273::275-297::299-321::323-345::347-369::371 -390::395-417::419-441::...
  Pfam module annotation: Domain location=443-465::467-489::491 -513::515-537::539-561::563-585::587-609::611-631::632-653::757 -996::757-988
MGGVRIKVGLRKGKWADNIKHEFCARKIFEDSGNDSAFSFCRYPQTKSFRFSSFAFAAITAYEGTEASALLEWRASLDNQSQASLSSWTSGVSPCRWKGIVCKESNSVTAISVTNLGLKGTLHTLNFSSFPKLLTLDISYNRFSGTIPQQIANLSRVSQLIMDDNLFNGSIPISMMKLSSLSWLNLASNKLSGYIPKEIGQLRSLKYLLLGFNNLSGTIPPTIGMLANLVELNLSSNSISGQIPSVRNLTNLESLKLSDNSLSGPIPPYIGDLVNLIVFEIDQNNISGLIPSSIGNLTKLVNLSIGTNMISGSIPTSIGNLVNLMILDLCQNNISGTIPATFGNLTKLTYLLVFENTLHGRLPPAMNNLTNFISLQLSTNSFTGPLPQQICLGGSLDQFAADYNYFTGPVPKSLKNCSSLYRLRLDGNRLTGNISDVFGVYPELNYIDLSSNNFYGHISPNWAKCPGLTSLRISNNNLSGGIPPELGQAPKLQVLVLSSNHLTGKIPKELGNLTTLWKLSIGDNELSGNIPAEIGDLSRLTNLKLAANNLGGPVPKQVGELHKLLYLNLSKNEFTESIPSEFNQLQSLQDLDLSRNLLNGKIPAELATLQRLETLNLSNNNLSGAIPDFKNSLANVDISNNQLEGSIPNIPAFLNAPFDALKNNKGLCGNASSLVPCDTPSHDKGKRNVIMLALLLTLGSLILVAFVVGVSLCICNRRASKGKKVEAEEERSQDHYFIWSYDGKLVYEDILEATEGFDDKYLIGEGGSASVYKAILPTEHIVAVKKLHASTNEETPALRAFTTEVKALAEIKHRNIVKSLGYCLHSRFSFLVYEFLEGGSLDKVLTDDTRATMFDWERRVKVVKGVASALYYMHHGCFPPIVHRDISSKNVLIDLDYEAHISDFGTAKILNPDSQNLTVFAGTCGYSAPELAYTMEVNEKCDVFSFGVLCLEIMMGKHPGDLISSLLSPSAMSSVSNLLLKDVLEQRLPHPEKPVVKE

SEQ ID NO: 178919 - protein, 34 aa, Glycine max
  Coding DNA Sequence Number=SeqID_62141
MPSKDILEGGLSCWPHHSSSNVIIEHERPCFEPG

SEQ ID NO: 178920 - protein, 178 aa, Glycine max
  Coding DNA Sequence Number=SeqID_62142
  Gene Ontology: Mol. function=catalytic activity; Cellular component =integral to membrane; Biological process=cellular metabolic process
  Homolog annotation: Hit_ID=Q1RUS0; Match level="QueryCoverage=99%, HitCoverage=38%, E-value=5e-83, Identity=87%"; Hit description=NAD -binding site; Nucleotide sugar epimerase
MDYHRGAGVEVRIARIFNTYGPRMCLDDGRVVSNFVAQALRKEPLTVYGDGKQTRSFQYVSDLSSDGERKSGDNIITVEGLMRLMEGEHVGPFNLGNPGEFTMLELAKVVQETIDPEAKIEYRPNTEDDPHKRKPDISRAKEQLGWEPKVDLRKGLPLMVSDFRQRIFGDQKEGTTSA

SEQ ID NO: 178921 - protein, 204 aa, Glycine max
  Coding DNA Sequence Number=SeqID_62143
  Gene Ontology: Mol. function=hydrolase activity, hydrolyzing O -glycosyl compounds; Cellular component=cell wall; Biological process= carbohydrate metabolic process
  Homolog annotation: Hit_ID=Q5MB21; Match level="QueryCoverage=96%, HitCoverage=68%, E-value=1e-90, Identity=79%"; Hit description =Xyloglucan endotransglucosylase/hydrolase
  Pfam annotation: Domain name=Glyco_hydro_16; Domain location=1-124; Score=34.5; E_value=5.8e-10; Accession=PF00722.11; Description =Glycosyl hydrolases family 16
  Pfam annotation: Domain name=XET_C; Domain location=148-198; Score =98.8; E_value=1.7e-26; Accession=PF06955.3; Description=Xyloglucan endo-transglycosylase (XET)
  Pfam module annotation: Pfam domain module=Glyco_hydro_16::XET_C; Domain location=1-124::148-198
MIGILQLSSQNAEHDEIDFEFLGNRTGQPYILQTNVFTGGKGDREQESFSGLIPQKHTTDTLYYGTCIKLCKFLVDNIPMRVFKNLNGLGVKFPFDQPMKVYNSLWNADDWATRGGLEKTDWSKAPFIAEYIGFHIDGCEASVNAKFCATQGKRWWDQAQYRDLDASQWRWLRWVRRKYTIYNYCTDRSRYPQLPLECRRNRDI

SEQ ID NO: 178922 - protein, 139 aa, Glycine max
  Coding DNA Sequence Number=SeqID_62144
  Gene Ontology: Mol. function=catalytic activity; Biological process =cellular metabolic process
  Homolog annotation: Hit_ID=Q1RUS0; Match level="QueryCoverage=55%, HitCoverage=17%, E-value=1e-35, Identity=94%"; Hit description=NAD -binding site; Nucleotide sugar epimerase
MVLTSQERLNDVVSDELEVGVPKMVHHVFFHSGEKIVDDDDAVSSGNQPIHQVRPDEAGPTGDDDPEPLPLNPERDFSHGMHGDDVVASGVGGPAGVGKGTMMGGGRRRGLRGQSRGGGSGDAVRGGGSRRRAMASAAS

SEQ ID NO: 178923 - protein, 193 aa, Glycine max
  Coding DNA Sequence Number=SeqID_62145
MTTLTQIWMTLLLSNIPPDDHNADLPPTEVLVGITPTRHPVDSKKSNRALGFPALVTGLCPSYRVLVPPTRSCHRDIGVAPTRHPVDPEEPNRALGFLALVTGLCQSYRAPVPPASSCHHDIGIMPARHSVDPEKSNRVLGFPALIMGLCQFYGVPVTPSKVIKPPTNRAFIKKYCAPRQAQGETPQQPGDGR

SEQ ID NO: 178924 - protein, 66 aa, Glycine max
  Coding DNA Sequence Number=SeqID_62146
  Homolog annotation: Hit_ID=Q1M2R7; Match level="QueryCoverage=43%, HitCoverage=2%, E-value=6e-08, Identity=75%"; Hit description=PDR -like ABC-transporter
MGVTSKVAVVAILTMTVFLGSEMHRDLVADGGVFSGGYSLVLVLPNAWFAYGNNIGLTGAIRYTMP

SEQ ID NO: 178925 - protein, 68 aa, Glycine max
  Coding DNA Sequence Number=SeqID_62147
MSWNIQSRNASEWNSISFKSSNKIILSWECKLFVSDEIGIEGDGGREVVDNEIEVALEKSLPMRLRLR

SEQ ID NO: 178926 - protein, 184 aa, Glycine max
  Coding DNA Sequence Number=SeqID_62148
MASSVVGGFVTQAFVFMLKDCYGNKFFELEKAIRDYTCTLDPYFHCFHCSIGNIDSLVHLVMMLLMHDKEEGEKSREIVATEVEVALGMAPAREMHGATRRIKMCNKGFHEFTAETNREERTVKKNRRPQMKRSPWGSELQEELSCLGGIEEVALNWNAICENCLGWQGDSWGAIVWCGRYVGV

SEQ ID NO: 178927 - protein, 114 aa, Glycine max
  Coding DNA Sequence Number=SeqID_62149
MDSEKESLWSLVLKLKYEDLVGSPFWRVCNLDFVVEELGGKAFFEFLPKRNIGWRYWEVGGWYMEMEVIMEKETVQLGATNAGLIYEGVGGINLVPNGVDIVLWKLKWFNRVLN

SEQ ID NO: 178928 - protein, 274 aa, Glycine max
  Coding DNA Sequence Number=SeqID_62150
CDKLRDVNMTTTEALKRETKRAQKEEWSRNKYRGALWGSNNELKLRRVERDESRLESMYKEKVNLAASHGQRLEDEHAKVSALQMEREARERVIESLHGEVVKWMDRFSLTLNGSQELPRLLARAKAMADVYLAPDEVHGLFDYCQHMIELIGSARADEGQHGGLEGPNNLHDGGHDEYEKDDGGQCDCSCHHQLRRLGGSNSPIWHKPNKSSSPRCGRSGRRSVGKYGRSPYGAKTPTTSFPFSLKASNPNWGMHPLLNLWEKPMKSPGTMLW

SEQ ID NO: 178929 - protein, 303 aa, Glycine max
  Coding DNA Sequence Number=SeqID_62151
  Gene Ontology: Mol. function=nucleic acid binding; Cellular component= nucleus; Biological process=mRNA processing
  Homolog annotation: Hit_ID=Q7XI72; Match level="QueryCoverage=62%, HitCoverage=51%, E-value=3e-74, Identity=72%"; Hit description =Putative pre-mRNA splicing factor SF2
  Pfam annotation: Domain name=RRM_1; Domain location=130-197; Score =37.5; E_value=4.7e-08; Accession=PF00076.12; Description=RNA recognition motif. (a.k.a. RRM, R
  Pfam annotation: Domain name=RRM_1; Domain location=26-94; Score =80.4; E_value=5.8e-21; Accession=PF00076.12; Description=RNA recognition motif. (a.k.a. RRM, R
  Pfam module annotation: Pfam domain module=RRM_1::RRM_1; Domain location=130-197::26-94
MQERAGLAIVFGRHEKRMSRRSSRTVYVGNLPGDIREREVEDLFLKYGHITHIDLKVPPRPPGYAFVEFEDAQDAEDAIRGRDGYDFDGHRLRVEPAHGGRGHSSSRDRYNSHSNGRGGRGVSRRSEYRVLVSGLPSSASWQDLKDHMRKAGDVCFSQVFHDGRGTTGIVDYTNYDDMKYAIKKLDDSEFRNAFSKGYVRVREYDSRRDSSRSPSRGPSHSRGRSYSRSRSRSRSYSRDRSQSKSPKGKSSQRSPAKSPSRSPSRSRSRSRSLSGLLFVLKGIKGWNLFHLHPSFIEIESHRD

SEQ ID NO: 178930 - protein, 53 aa, Glycine max
  Coding DNA Sequence Number=SeqID_62152
  Gene Ontology: Biological process=response to stress
  Homolog annotation: Hit_ID=Q1RSS0; Match level="QueryCoverage=77%, HitCoverage=25%, E-value=3e-11, Identity=76%"; Hit description =Universal stress protein
MANLHLMVNDVAVEVLEGDPRNVLCDAVEKHHASMLVVGSHSYGALKRSYRRV

SEQ ID NO: 178931 - protein, 275 aa, Glycine max
  Coding DNA Sequence Number=SeqID_62153
LRAIEGGKDYAFVDMTELCLVPDVVIPLKFKMLNFDKYKGTICPNNHLKMYYRKMGVYAKDEKLLMHFFQESLTGYQYNSNMAPGRMQLQNLCKKEHELFKEYAQRWRDSAAQLVPPMTEKEMMTMIVDTLPLFYCEKMVGYTPSSFVNLVFAGERIEVGLKRGKFDHPALMNRKLRANGENENEGGTHVVTVVPTWPHFPPAQQCSMRSFNGDFPPWRCSGRQRRRGEGRHHPLGNKPWKKELHHQGCAFDKKLEEDALMEEEKERRGSMKLKE

SEQ ID NO: 178932 - protein, 136 aa, Glycine max
  Coding DNA Sequence Number=SeqID_62154
MLHCHIHTLSLSFFAIFKFPLDFETYVPIKRSFLIGVAVIASFGYCKEHDGSWVKKGAQPADEEGNLPVEDNSSLLQRLLDEFDGLQTFVGDKFDAMELQVDMRFDAMESRITKVEEDVSFIRTCFDPPPPPPSSS

SEQ ID NO: 178933 - protein, 54 aa, Glycine max
  Coding DNA Sequence Number=SeqID_62155
MADDEHQNVNSLADLPATTKASTKSGLTHSLTIKLDEKIFSCGVNRFPLQFAVD

SEQ ID NO: 178934 - protein, 74 aa, Glycine max
  Coding DNA Sequence Number=SeqID_62156
  Subcellular localization annotation: CTP_CleavageSite=51; ConfidenceScore=5.09e-01
MGLCQFYGVPVTSSKGIRPPTNRAFIKKYCAPSHSRTHLVAHDPRNLNKTSTSSEGSKIPHGKKRAKGERARKG

SEQ ID NO: 178935 - protein, 217 aa, Glycine max
  Coding DNA Sequence Number=SeqID_62157
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=3e-36, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=9; ConfidenceScore=5.28e-01
MARTCSPLKARMCSPLKERASSPLKTRTCSPLKVRACNPLKARMCGPQKEKACSPTKARTCSPIKVRAYSPTKARTCSPLMARACSPLKARKCCPLKARTCSPLKVRACNPLKARMCGPQKVKACSPTKARTCSPIKVRAYSPTKARTCSPLMARACSPLKARKCCPLKARTCSPLKARKSSPLNVRACSPLMMRTCSPLKARTCSPLKARACSPLK

SEQ ID NO: 178936 - protein, 68 aa, Glycine max
  Coding DNA Sequence Number=SeqID_62158
MSLKDKPKEENFQVVDDSLSEADPLGNPLSEAYSSLNGLGNPTRGSVRDVFAQHAASLPNEVIVSSCA

SEQ ID NO: 178937 - protein, 62 aa, Glycine max
  Coding DNA Sequence Number=SeqID_62159
MEAPSGGATLKVQSARIKDVDLHLFSPLFFNSFGRRLGIDFTEENPGRWVREDQGPAGARGS

SEQ ID NO: 178938 - protein, 99 aa, Glycine max
  Coding DNA Sequence Number=SeqID_62160
MMGVKVIFCANVSTVLLRASDSLSEHSVTFEFSGFKLMRLAGQARLAQFEIVGSHLARRSRLAQCRSRESFGLSGYDPLSPIDMGVQAESDLRLVHRCA

SEQ ID NO: 178939 - protein, 133 aa, Glycine max
  Coding DNA Sequence Number=SeqID_62161
MRWDFHSISQQESVLVDFHRKSNLPVTEIPNLIRIVYLRIGEKLSTHKPAIEAMPQLFYPTRPRTSNACQRKKYSESISDNLARASSAREYQIELQQSSMSLGRQIKVDEPLPDASSRLGIDNGSWSFSSLPV

SEQ ID NO: 178940 - protein, 246 aa, Glycine max
  Coding DNA Sequence Number=SeqID_62162
  Homolog annotation: Hit_ID=Q75LK9; Match level="QueryCoverage=36%, HitCoverage=50%, E-value=5e-27, Identity=48%"; Hit description =Expressed protein
MATSLPKAKQVLVVEIDDSDFSTYALQWTLDHLLAPANIPNFKLFLVYARPSVTSTVGFVGPGAAEVLPVVEANLKRTAAKLSPTLTLSFHSRLLLSFHSSLSRPSNLCALSHSSFHCALCLMNFCEATPSQFLSQLSPSKLSVKCFFSFHKRDPNVFAQLLEYDKRFGQYGSEYTFYDYNHLKDIPSELKHSYKVVVADPPYLKEKAAEILGLHPCGFSPQHSSKLGNEFRMFSNYDLGMRLGGQ

SEQ ID NO: 178941 - protein, 195 aa, Glycine max
  Coding DNA Sequence Number=SeqID_62163
  Homolog annotation: Hit_ID=O04892; Match level="QueryCoverage=48%, HitCoverage=17%, E-value=1e-27, Identity=79%"; Hit description =Cytochrome P450 like_TBP
MESRAPSGPFLGIGLKFLNRDVAADGNVRESGDVGGGPGKSYLFCLTSLPTLETAQPEVGSSGWKSTHVAWCPVRPRRPLKIRRTECLPRPVVLITASGLQGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 178942 - protein, 208 aa, Glycine max
  Coding DNA Sequence Number=SeqID_62164
  Gene Ontology: Mol. function=ATPase activity, coupled to transmembrane movement of substances; Cellular component=integral to membrane; Biological process=transport
  Homolog annotation: Hit_ID=Q1RSS5; Match level="QueryCoverage=71%, HitCoverage=15%, E-value=1e-29, Identity=50%"; Hit description=ABC transporter, transmembrane region, type 1
MMSVERIKQFTNISFEPAWNMKDHLPPSNWPVEDNVDIKDLQVRYRPNTPLVLKGITLSISGGEKEPVLFEGTVRSNIDPIEQYIDEEIRKWQIMERTGVWGQRQLLCLGGLYSSEAGSSLWMRQLLLLILKPMHCSQNSHSHGLRQSFSWSADLNVYPALVGVNQMETGASSQPSLPRQARCHGQIDRDSDEGSDTAHVACSITPYL

SEQ ID NO: 178943 - protein, 83 aa, Glycine max
  Coding DNA Sequence Number=SeqID_62165
  Homolog annotation: Hit_ID=Q1RSS7; Match level="QueryCoverage=59%, HitCoverage=21%, E-value=1e-09, Identity=66%"; Hit description=CS domain containing protein
MTFTLLKKVLGENSKIVDGKCKALVQFVKLGWANIVTSEYILENDSTQGSRHPEVKWAQRLDKVYITVQLADSKNAKVDLTPR

SEQ ID NO: 178944 - protein, 196 aa, Glycine max
  Coding DNA Sequence Number=SeqID_62166
  Gene Ontology: Cellular component=membrane; Biological process =electron transport
  Homolog annotation: Hit_ID=Q2QTH8; Match level="QueryCoverage=68%, HitCoverage=37%, E-value=2e-44, Identity=62%"; Hit description =Transducin family protein, putative, expressed
  Pfam annotation: Domain name=WD40; Domain location=131-169; Score =6.5; E_value=6.3; Accession=PF00400.22; Description=WD domain, G -beta repeat
  Pfam annotation: Domain name=WD40; Domain location=86-126; Score =44.2; E_value=4.3e-10; Accession=PF00400.22; Description=WD domain, G-beta repeat
  Pfam module annotation: Pfam domain module=WD40::WD40; Domain location=131-169::86-126
MVFFSSSATLTYRNPTSVHMETSAAMDVEDQPSPNSNNVKRFGLKNSIQTNFGDDYVFQIVPKEDWSAMAVSLSTNAVKLYSPVAGQYFGEFKGHSETVNQISFSGPSNPHILCSCSSDGTIRAWDARTFQQVSSINAGPSQEVFSFCMGGTSGNLVAAGCKSQVLFWDWRNMKQVACLVDSHVDDVTQVCAVQIA

SEQ ID NO: 178945 - protein, 93 aa, Glycine max
  Coding DNA Sequence Number=SeqID_62167
MQPLIGRFKILGTLCCTICPLGPSRFFLQKAVASGGSNLARLGELGCKLLPYFAINSGRSEEGRGSAFLALLILSKLLRKIVSVKKIQAEALP

SEQ ID NO: 178946 - protein, 47 aa, Glycine max
  Coding DNA Sequence Number=SeqID_62168
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=Q6JAD5; Match level="QueryCoverage=97%, HitCoverage=16%, E-value=1e-14, Identity=85%"; Hit description=TATA sequence-binding protein 1
  Pfam annotation: Domain name=TBP; Domain location=1-47; Score=-2.3; E_ value=0.002; Accession=PF00352.12; Description=Transcription factor TFIID (or TATA-binding protein, TBP)
RFAAVIMRIRDPKTTALIFASGKMVCTGAKSEQQSKLAARKMESLVK

SEQ ID NO: 178947 - protein, 90 aa, Glycine max
  Coding DNA Sequence Number=SeqID_62169
MSQNFTDYTTIPSSASGMLRNFTDCAIMFPFDSRHVAELHRLLNDGCQVPRSGQAKVAINSWDSELDDGGCTNSARQSICEAPDSMVEDA

SEQ ID NO: 178948 - protein, 52 aa, Glycine max
  Coding DNA Sequence Number=SeqID_62170
MEDKFGSMHHAIMESLISQMEYKLISNCPSTYLEPKDKDLGTSEVSFVVKYI

SEQ ID NO: 178949 - protein, 112 aa, Glycine max
  Coding DNA Sequence Number=SeqID_62171
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=Q6JAD5; Match level="QueryCoverage=92%, HitCoverage=36%, E-value=8e-53, Identity=97%"; Hit description=TATA sequence-binding protein 1
  Pfam annotation: Domain name=TBP; Domain location=14-100; Score =151.5; E_value=2.2e-42; Accession=PF00352.12; Description =Transcription factor TFIID (or TATA-binding protein, TBP)
YARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQCKVADVVY

SEQ ID NO: 178950 - protein, 212 aa, Glycine max
  Coding DNA Sequence Number=SeqID_62172
  Homolog annotation: Hit_ID=Q9SN00; Match level="QueryCoverage=40%, HitCoverage=9%, E-value=7e-18, Identity=52%"; Hit description =Aminopeptidase-like protein
NVIRGRPEEDLEELPPEPAVDALDFLEGDEDPLLEVDSPEEVMSASEADSTEDIEKQLLSASDRFGILDDSFALCMARQESLTSLINLMGSYREEVNYTVLSNLMTTSLKVQRIAADAIPDFLEYFMQFFINLFQYSAERLVVVCCGLVWVKLMKATAIEIALSGYPRNTRVDEAQPVPAMVEVEAVASEVVVVDVAAGVDVDDEQSKAESQ

SEQ ID NO: 178951 - protein, 211 aa, Glycine max
  Coding DNA Sequence Number=SeqID_62173
  Gene Ontology: Mol. function=protein serine/threonine kinase activity; Cellular component=cytoplasm; Biological process=protein amino acid phosphorylation
  Homolog annotation: Hit_ID=Q6DXR4; Match level="QueryCoverage=98%, HitCoverage=47%, E-value=6e-57, Identity=47%"; Hit description =Putative serine-threonine kinase
  Pfam annotation: Domain name=Pkinase; Domain location=2-208; Score =92.2; E_value=1.6e-24; Accession=PF00069.15; Description=Protein kinase domain
  Pfam annotation: Domain name=Pkinase_Tyr; Domain location=1-210; Score=-135.2; E_value=0.00036; Accession=PF07714.7; Description =Protein tyrosine kinase
  Pfam module annotation: Pfam domain module=Pkinase::Pkinase_Tyr; Domain location=2-208::1-210
MVLKAVSKPTLEKNGYAVHVECKVAIMRQLRHPHTISLYEVLATRTKIYFVMEFAVRGELFHVVAVEAVYHHQKYFWQLLSSMRHCPSHGVYHRDLKLDNIHFDQDMNLNVSDFGLSALRSRIQHDGMLHNLCGTPAYVAPEILARKGYDGAIMDVWSCDIVLFVLNAGYLPFNDYNVTILYRKIKNLVTRLLDTNPETRIVMNKNYYMLC

SEQ ID NO: 178952 - protein, 201 aa, Glycine max
  Coding DNA Sequence Number=SeqID_62174
  Gene Ontology: Mol. function=DNA binding; Cellular component=Golgi stack; Biological process=protein amino acid phosphorylation
  Homolog annotation: Hit_ID=Q1SMD3; Match level="QueryCoverage=92%, HitCoverage=92%, E-value=2e-63, Identity=34%"; Hit description=TonB box, N-terminal; Tetratricopeptide-like helical
  Pfam annotation: Domain name=PPR; Domain location=121-155; Score =49.6; E_value=1e-11; Accession=PF01535.11; Description=PPR repeat
  Pfam annotation: Domain name=PPR; Domain location=15-49; Score=46.9; E_value=7.1e-11; Accession=PF01535.11; Description=PPR repeat
  Pfam annotation: Domain name=PPR; Domain location=156-190; Score =18.7; E_value=0.022; Accession=PF01535.11; Description=PPR repeat
  Pfam annotation: Domain name=PPR; Domain location=50-85; Score=16.5; E_value=0.083; Accession=PF01535.11; Description=PPR repeat
  Pfam annotation: Domain name=PPR; Domain location=86-120; Score=37.8; E_value=3.7e-08; Accession=PF01535.11; Description=PPR repeat
  Pfam module annotation: Pfam domain module=PPR::PPR::PPR::PPR::PPR; Domain location=121-155::15-49::156-190::50-85::86-120
MFHSMVQTGVNPSVHSYSIMINGLCKSKRVDEAMNLLREMPHKNMVPNTVTYSSLIDDGLCKNQNHDKAIALFMKMKKRRIQPTMYTYTALIDGLCKGGRLKNAQELFQHLLVRGYCLNVWTYTVMISGLCKEGMFDEALAIKSKMEDNGCIPNAVTFEIIIRSLFEKDENDKAEKILHEMIAKGLLRFRNFHGEHSPVTN

SEQ ID NO: 178953 - protein, 163 aa, Glycine max
  Coding DNA Sequence Number=SeqID_62175
  Gene Ontology: Mol. function=carbon-sulfur lyase activity; Cellular component=vacuole
  Homolog annotation: Hit_ID=Q942G1; Match level="QueryCoverage=98%, HitCoverage=35%, E-value=4e-30, Identity=43%"; Hit description =Alliin lyase-like
  Pfam annotation: Domain name=Alliinase_C; Domain location=1-162; Score=-87.0; E_value=3.8e-09; Accession=PF04864.4; Description =Allinase, C-terminal domain
MGYSYSDGSYISQLLVEYIKKLDAIVGNAISEGKYIVFGSGSTLFSMLLFMPCLPTLQCFQQKCSIETKLTQIFNSRDFSYEGDTSLWKNNTNSSFRFIEFVTSPNNPDGKLNKGVLKGSDVKTIYDRAYYWPHFTAISSPADDDLMVFTISKLTGHAGSRFW

SEQ ID NO: 178954 - protein, 174 aa, Glycine max
  Coding DNA Sequence Number=SeqID_62176
  Gene Ontology: Mol. function=endonuclease activity
  Homolog annotation: Hit_ID=Q9FF11; Match level="QueryCoverage=98%, HitCoverage=14%, E-value=3e-45, Identity=54%"; Hit description =Similarity to HepA-related protein Harp
VSPYTGRIHLYTCILGTDKRPQPLHENFRPEELELLSSVADDEKQAHDEKQKTEFVTVKDNPAYRHALMAFAEEWKNLRSIERRKLLGKPLQLPLAVELCYLSESNNHNNKGLLNGGSKRRRTPLMEISYPLPSDAVWRKVSLRSGLGKKEKEYTQGWSVTDEPLCKLCQKQCL

SEQ ID NO: 178955 - protein, 311 aa, Glycine max
  Coding DNA Sequence Number=SeqID_62177
  Gene Ontology: Mol. function=calcium ion binding; Cellular component =mitochondrion; Biological process=protein amino acid phosphorylation
  Homolog annotation: Hit_ID=Q1RSC6; Match level="QueryCoverage=88%, HitCoverage=92%, E-value=9e-96, Identity=42%"; Hit description =Pentatricopeptide repeat
  Pfam annotation: Domain name=PPR; Domain location=102-136; Score =29.0; E_value=1.7e-05; Accession=PF01535.11; Description=PPR repeat
  Pfam annotation: Domain name=PPR; Domain location=137-171; Score =20.7; E_value=0.0052; Accession=PF01535.11; Description=PPR repeat
  Pfam annotation: Domain name=PPR; Domain location=172-206; Score =26.9; E_value=7.4e-05; Accession=PF01535.11; Description=PPR repeat
  Pfam annotation: Domain name=PPR; Domain location=207-241; Score =47.2; E_value=5.4e-11; Accession=PF01535.11; Description=PPR repeat
  Pfam annotation: Domain name=PPR; Domain location=242-276; Score =43.7; E_value=6.4e-10; Accession=PF01535.11; Description=PPR repeat
  Pfam annotation: Domain name=PPR; Domain location=277-311; Score =45.4; E_value=2e-10; Accession=PF01535.11; Description=PPR repeat
  Pfam annotation: Domain name=PPR; Domain location=67-101; Score=4.7; E_value=2.1; Accession=PF01535.11; Description=PPR repeat
  Pfam module annotation: Pfam domain module=PPR::PPR::PPR::PPR::PPR::PP R::PPR; Domain location=102-136::137-171::172-206::207-241::242 -276::277-311::67-101
  Subcellular localization annotation: CTP_CleavageSite=47; ConfidenceScore=5.51e-01
MSFSLFSLSRRLSSSLSLSIPNFPPFLPNPTFPLCFHSQPPSIDNVVDDAVSQFNDMLLMRRTPPIIEFNKILGSLAKLKHYLTVISLSKQMEVKGIEPCLVTLNILINCFCHLGQMAFSFAVLGKILKLGYQPNTITLTTLMKGLCLKGEVKKSLHFHDKVVALGFQMNQVSYGTLLNGLCKIGGTRSANKLLRMIEDRSTRPNVVMYTTVIDGLCKDKLVNEAYDLYSEMDARGIFPNVITYNTLICGFCLAGQLMEAFGLLNEMILKNVNPGVNTYTILIDALCKEGKVKEAKNLLAVMTKEGVKPDV

SEQ ID NO: 178956 - protein, 332 aa, Glycine max
  Coding DNA Sequence Number=SeqID_62178
  Gene Ontology: Mol. function=RNA-directed DNA polymerase activity; Cellular component=chromatin; Biological process=chromatin assembly or disassembly
  Subcellular localization annotation: CTP_CleavageSite=71; ConfidenceScore=5.16e-01
MVHMFQPQSVMKAYNLAKVYESAAMQGTAATLPSKNKSTVPIKSLLGPKPLVVTKPEFMKTKPRLTKNLTPAFMSERRVKVLCYFCDEPFFVEHGLTHKKLQIQFMEVDDIEEDTVEIENHAGEVATHFEEAQISVNALTGVPNFRTMCVIGRYNKKPLHILINSGNTHNFLDVHVAARIRCKIEDLKPLVVIVADGTKVQISSVGRRHVLKGSNPSNCKSVKSPTLDKIVNNSVHLSMIQVGIEDGVDIPTAIERILCQYADAFVTPTQLPPSRGGHDHKIPLLQSTELVNKRPYRYAKQQKDIIDKIIHEMLDSGIIQTSNSPLLVVIYD

SEQ ID NO: 178957 - protein, 202 aa, Glycine max
  Coding DNA Sequence Number=SeqID_62179
  Homolog annotation: Hit_ID=Q8VZ37; Match level="QueryCoverage=29%, HitCoverage=34%, E-value=4e-12, Identity=73%"; Hit description =Putative clathrin coat assembly protein
MSEEVNMNYENEEECDVNVPHVDCSEAFNTSQVFDSRGDVLRWAQSIAYENGFVAVIVRFDTYRGSRGRTSFVLIGCERSGEYRCRKKEFVRRDTRTRKCECPFKFRGKPVDGEQGWMENTVHPIGDRRLNWCGQFNFRKKQDDKSSAGVEHGGEASSRQILPISDQSVEKQHEAIRNVFSVLCCRPEHVSNFVDAESFFGP

SEQ ID NO: 178958 - protein, 50 aa, Glycine max
  Coding DNA Sequence Number=SeqID_62180
  Homolog annotation: Hit_ID=Q10PM8; Match level="QueryCoverage=81%, HitCoverage=25%, E-value=3e-08, Identity=71%"; Hit description =Clathrin adaptor complex small chain family protein, expressed
MYVSLISCSTIMHTILDEIILGGQVLETSSNEVMKAIEEISRCSSFPSGF

SEQ ID NO: 178959 - protein, 155 aa, Glycine max
  Coding DNA Sequence Number=SeqID_62181
  Gene Ontology: Mol. function=oxidoreductase activity, acting on paired donors, with incorporation or reduction of molecular oxygen; Biological process=carotenoid biosynthetic process
  Homolog annotation: Hit_ID=Q9FGZ1; Match level="QueryCoverage=93%, HitCoverage=24%, E-value=3e-65, Identity=74%"; Hit description =Phytoene dehydrogenase-like
MEEIHSACQDAVNGVPSRRPVIEMTIPSVLDKTISPPGASLYLIYPPIQESFAQKCFKLIDEYAPGFSTSIIGYDMLTPPDLEREIGLTGGNIFHGAMGLDSLFLMRPAKGWSNYKTPLRGLYLCGSGAHPGGGVMGAPGRNAARLVLQEVGERT

SEQ ID NO: 178960 - protein, 90 aa, Glycine max
  Coding DNA Sequence Number=SeqID_62182
  Gene Ontology: Mol. function=ribonuclease H activity; Cellular component=mitochondrion; Biological process=DNA integration
MAMSHGRLYQQRMKNVFDKKVRSRKFHEGDLVLKKVSHAVKDNRGKWAPNYEGPFVVKRAFSEGALVLTNMDGEELPSPVNSDVVKRYYA

SEQ ID NO: 178961 - protein, 109 aa, Glycine max
  Coding DNA Sequence Number=SeqID_62183
MRTVITDSDKPATPREGRMNQNKVVLLMLAIAMSGCAERPTAVSPATPPTDVTVSPPAVQPQMDASTRSKLHEILALRGGWHATQPHGRTVDLISREFLGTPYLANRLI

SEQ ID NO: 178962 - protein, 227 aa, Glycine max
  Coding DNA Sequence Number=SeqID_62184
  Gene Ontology: Mol. function=transferase activity, transferring acyl groups; Biological process=metabolic process
  Homolog annotation: Hit_ID=Q1YY33; Match level="QueryCoverage=33%, HitCoverage=50%, E-value=4e-27, Identity=72%"; Hit description =Acetyltransferase
MAADKSVTDFAIERQIPEQRDFVIGDLRLGAVQQTVDAAENKPVMLRPGDALTARVSADRDLVDQGVTVPVFAQRDVANGLVLAIRQESRAVFVGERRQGILFAKRRHRAGWPAVDRGVELRQGVTADGKAEIAARQLPQQARRVAGINPLAGDVAGHDRPGADHRVAADLHRQDGGAGADGHTIADARAPPAGRIGIGRAVFEQIVGEGDAVADQNTLRRGLRIRK

SEQ ID NO: 178963 - protein, 92 aa, Glycine max
  Coding DNA Sequence Number=SeqID_62185
MRRGEKPLVSGNHDEHTKRLAALSDFIASIEDYGFPDECAKPNYRVKWLLVREKLQLQCPGHDMIHQDLYPKMPGIVMQTMSLAERSFRKGM

SEQ ID NO: 178964 - protein, 146 aa, Glycine max
  Coding DNA Sequence Number=SeqID_62186
  Gene Ontology: Mol. function=RNA binding; Cellular component =ribonucleoprotein complex; Biological process=mRNA metabolic process
  Homolog annotation: Hit_ID=Q38JH9; Match level="QueryCoverage=48%, HitCoverage=48%, E-value=9e-38, Identity=100%"; Hit description =Glycine rich protein-like
  Pfam annotation: Domain name=LSM; Domain location=1-57; Score=46.5; E_ value=8.9e-11; Accession=PF01423.12; Description=LSM domain
MLVELKNGETYNGHLVNCDTWMNIHLREVICTSKDGDRFWRMPECYIRGNTIKYLRVPDEVIDKVQEETKSRAGDLIRRDKGRLQDRKPPGVGRGRGRGREEGPGGRPTKGIGRGLDDGGARGAGGSRGRGGPSGKPGGNRGRGRG

SEQ ID NO: 178965 - protein, 38 aa, Glycine max
  Coding DNA Sequence Number=SeqID_62187
MSKANLSRLRSDPVRIAAFCFKNLKRTEVLDTDISSAV

SEQ ID NO: 178966 - protein, 168 aa, Glycine max
  Coding DNA Sequence Number=SeqID_62188
  Homolog annotation: Hit_ID=Q6TF28; Match level="QueryCoverage=66%, HitCoverage=99%, E-value=2e-29, Identity=60%"; Hit description=Rapid alkalinization factor 2
  Pfam annotation: Domain name=RALF; Domain location=49-114; Score =118.5; E_value=1.9e-32; Accession=PF05498.2; Description=Rapid ALkalinization Factor (RALF)
MSSVSFLLALFMVVALSIFPSIVGAIGEHRLRWVPETTTPCQSSIEECMAEGEFGMDSESHRRILATSQYISYKALQRNTVPCSRRGASYYNCKPGADANPYTRGCPTITRCRFYFDLKSTTISFRLDYVSFGHHVGACSMRTGRESNFSEHYYSKIEWGCVRYPQKD

SEQ ID NO: 178967 - protein, 151 aa, Glycine max
  Coding DNA Sequence Number=SeqID_62189
MSEIGGDKENNLKVAISRDKGGQVQHDLGVEVVHTSATFEKEGTSQYLTVGIEDKKFELFGLKAQDQKIQSTKQHKQKAVISDGVVSSSKWDKFMENSKCPTWVLDIERNTELKEEALGATFTNLDEGPIRSSKNIKSGIRSSSEGHVSGD

SEQ ID NO: 178968 - protein, 132 aa, Glycine max
  Coding DNA Sequence Number=SeqID_62190
  Gene Ontology: Mol. function=thiamin diphosphokinase activity; Biological process=thiamin diphosphate biosynthetic process
  Homolog annotation: Hit_ID=Q5JK24; Match level="QueryCoverage=97%, HitCoverage=39%, E-value=1e-23, Identity=48%"; Hit description =Putative thiamin pyrophosphokinase 1
  Pfam annotation: Domain name=TPK_catalytic; Domain location=66-131; Score=-26.4; E_value=0.018; Accession=PF04263.7; Description=Thiamin pyrophosphokinase, catalytic domain
MELMCHCSSFLLPPENPNTTCSLSLKYALVVLNQSLPRFAPLLWDHGISPCTHRTPFFLFTILIHALMYVYVVATAQVRVCADGGANRVYDEMPLFFPHQQPSHVRTRYKPDVIKGDMDSIRTEVLDFYAKL

SEQ ID NO: 178969 - protein, 241 aa, Glycine max
  Coding DNA Sequence Number=SeqID_62191
  Gene Ontology: Mol. function=RNA-directed DNA polymerase activity; Biological process=RNA-dependent DNA replication
MGDDPLSKFSQKGLLCFWNEDDFVLQNSISGNGYIGLEGTWLEGNRQVTIVNVYSPFDLEGKRALWLELKNLKALSSNSRWCATWDFNAIRRRRERIGVNNVSQGGREMEDFNQFIKDLELINVPLVRKKYTCFQPNGKEKSHIDRVLISRDWLETWHSCTQCWGPKSFRVLNGWFQDKRFHKVVKEAWLNQNVVGWGVYVLKEKLKGIKEVLKIWNMKRRKNLLKRLHVIDVQVEELLRQ

SEQ ID NO: 178970 - protein, 460 aa, Glycine max
  Coding DNA Sequence Number=SeqID_62192
  Gene Ontology: Mol. function=nucleic acid binding; Cellular component= intracellular; Biological process=DNA integration
MDIEVSPQNSPTDLLLESWDKFQSSISAFQEKVPIEDERLSVIPPKSKNLDATPQSKFQGVGRPKQDSATPESMHVSTPAVREQPPFSRKRRVGLDRMIVLSNKAVIKNIKSAKDLVRFPFPRESRRTLLNAHCVQRQRESPISSLPNRFYEPLLPCSSSELQLLFSKKKMKLPNSLKIVETPGNLDVPESPIAGTPLSPSQSSDSLEIEETRRVLDVPESQASGFPKHKATDSQTPPLSQHENIEIESLETNEVPNLMDENDSLSVVNNYNNILKRHWFVTYEKKFSGNILMGNNVPCKFVGIGSIQIRMHDGVVRTLTKVRHIPELKKNLVFVGAMDLKSFSYWVEGGVMHIKGKGKFVWHPCLGHISEKGMDILNKRELLGNHKVEPLQLYQHCVYGMQHWMKFPKVVHTTKAMLDYVHFDYWGSSRVPSLGGAMYFLSIIDDYSRMTWVFMMKHKS

SEQ ID NO: 178971 - protein, 140 aa, Glycine max
  Coding DNA Sequence Number=SeqID_62193
  Gene Ontology: Cellular component=nuclear chromosome; Biological process=chromosome organization and biogenesis (sensu Eukaryota)
  Homolog annotation: Hit_ID=Q1SKA6; Match level="QueryCoverage=77%, HitCoverage=13%, E-value=7e-19, Identity=46%"; Hit description =Rad21/Rec8 like protein, C-terminal; Rad21/Rec8 like protein, N- terminal
  Pfam annotation: Domain name=Rad21_Rec8_N; Domain location=1-57; Score=-12.4; E_value=0.0093; Accession=PF04825.4; Description=N terminus of Rad21  Rec8 like protein
MDVVSYRVLGYLLVGIIRIFSKKVEYVLEDCNEVLIKINKFVVNKEGIVRVETLRMPVTIPDRLELDVFELDELENVDRGHTAPPEEITLRDKENVCKTEGFGLFSHEKLFTNICQINFCLMNALCLPCVYLSVSVGFKK

SEQ ID NO: 178972 - protein, 145 aa, Glycine max
  Coding DNA Sequence Number=SeqID_62194
MLMLYKRYNIIDRIKCDTTTLTVIQHEESCDPHEQKKWSMHMLARLALYMFTLQVLLPPLETQRAQHSQNMKPHVSGESSNLAKESSRSVGEKLHQVCKAAMVAIITDGSNQPSSSSRLLTNQRLSLQSEDPIRTLMFLVSWSHT

SEQ ID NO: 178973 - protein, 267 aa, Glycine max
  Coding DNA Sequence Number=SeqID_62195
  Gene Ontology: Mol. function=methylenetetrahydrofolate dehydrogenase (NADP+) activity; Cellular component=cytoplasm; Biological process =folic acid and derivative biosynthetic process
  Homolog annotation: Hit_ID=Q9ZTV0; Match level="QueryCoverage=99%, HitCoverage=100%, E-value=1e-131, Identity=82%"; Hit description=5 ,10-methylenetetrahydrofolate dehydrogenase-5,10- methenyltetrahydrofo late cyclohydrolase
  Pfam annotation: Domain name=THF_DHG_CYH; Domain location=3-120; Score=231.3; E_value=2.1e-66; Accession=PF00763.13; Description =Tetrahydrofolate dehydrogenasecyclohydrolase, catalytic domain
  Pfam annotation: Domain name=THF_DHG_CYH_C; Domain location=111-263; Score=289.9; E_value=4.8e-84; Accession=PF02882.9; Description =Tetrahydrofolate dehydrogenasecyclohydrolase, NAD(P)-binding domain
  Pfam module annotation: Pfam domain module=THF_DHG_CYH::THF_DHG_CYH _C; Domain location=3-120::111-263
MATVIDGKAVAQTIRSEIADEVRQLSQKYGKVPGLAVVIVGNRKDSQSYVGMKRKACAELGIKSFDVDLPEQVSQAELIKQVHQLNANPDVHGILVQLPLPKHINEEEVLTEISLEKDACIELLQRSGVSIKGKKAVVVGRSNIVGLPASLLLLKADATVTIIHSHTSQPESIIREADIVIAAAGQPMMIKGSWIKPGAAVIDVGTNAVDDPTKKSGYRLVGDVDFGEASKVAGWITPVPGGVGPMTVTMLLKNTLDGAKRYIEQNN

SEQ ID NO: 178974 - protein, 366 aa, Glycine max
  Coding DNA Sequence Number=SeqID_62196
  Gene Ontology: Mol. function=RNA-directed DNA polymerase activity; Cellular component=extracellular region; Biological process=RNA -dependent DNA replication
MAGREVLVTAVPRAIPAYCMSTFLIPISLAEEIQRMINSLWWGCNRGEGRGIKWLSWDRLAVRKEFGGMGFRHFFGFSLAMLAKQGWKLASDPDAIISRVFKARYYPQGVFLEASLGHIQTMWRSIQASQVDSNGRESAFEIRDIDEVFKIPICKELGEDHVIWKLSRWKDLWKLQVPNKVKVFLWRAVRGCLPTRLRLQTKGVVCTVQVDSADSFDDLIFRLLASISKAKISQVVMLMWVLWWRSNGKVWEDADRSPSVTVRRATNCLTDWGKCHRRRVSVPQRQISPPQWVKPPLVFAKCNLDAAVFGNQRRFGLGMCLRDSLGRFIIAKSVLVEAREAQFHASNQLFENIPACIQDLIISDMN

SEQ ID NO: 178975 - protein, 251 aa, Glycine max
  Coding DNA Sequence Number=SeqID_62197
  Homolog annotation: Hit_ID=Q8TGM6; Match level="QueryCoverage=47%, HitCoverage=97%, E-value=9e-09, Identity=43%"; Hit description =Protein TAR1
MLSLEPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 178976 - protein, 64 aa, Glycine max
  Coding DNA Sequence Number=SeqID_62198
MLIVEDGFDERTDLDLDYGAGLEGEYCVGDWRAAVMRCDGAQCAYEPSCASVQKARTFSDRERI

SEQ ID NO: 178977 - protein, 120 aa, Glycine max
  Coding DNA Sequence Number=SeqID_62199
MQQWYRQRRASRHCGHPKSSLGLAISLLHDYLAIGGLPFSPTAVASPLPRLCARDDFVIIVGVLHGFYVVKQSYVEICFKRAPFLKISLKKKLYQDNWPADEFWETGNQLSFPISLYCYV

SEQ ID NO: 178978 - protein, 132 aa, Glycine max
  Coding DNA Sequence Number=SeqID_62200
  Homolog annotation: Hit_ID=Q1RWK6; Match level="QueryCoverage=69%, HitCoverage=12%, E-value=6e-10, Identity=38%"; Hit description =Pancreatic ribonuclease; Tetratricopeptide-like helical
MECDVAGRGVDVEDGVADAEVLVVAEFKDVGVDALRLRDVAGVGEGLEEGREGEVVGEDGVEAHAGVDEERVVWSLVLGMGEGSDEGVEGVNVGVVKRTRAVLRRPCDWHAPMKCSAILVTVTLSVSEPFYI

SEQ ID NO: 178979 - protein, 179 aa, Glycine max
  Coding DNA Sequence Number=SeqID_62201
  Homolog annotation: Hit_ID=Q1T6I5; Match level="QueryCoverage=33%, HitCoverage=21%, E-value=8e-10, Identity=65%"; Hit description =Calcium-binding EF-hand; Endonuclease/exonuclease/phosphatase
MGRQIDQQESLKELGKRRRLWLPQDIIQVLKDNTNLLTCMRRNLGMLATISSSFLKPTIAETLVTPLVQNPKGSVPQEFLIVNTHLLFPHDSSLTDFERTSLSSLVKGHSGYESLALDISGGHLAAGVASLFIDGVGCGACFQFGPSKSSDSTSLRDIEDLIYKFLVFMLEHSMREKDG

SEQ ID NO: 178980 - protein, 312 aa, Glycine max
  Coding DNA Sequence Number=SeqID_62202
  Gene Ontology: Mol. function=protein binding; Biological process =ubiquitin-dependent protein catabolic process
  Homolog annotation: Hit_ID=Q9SLV3; Match level="QueryCoverage=91%, HitCoverage=72%, E-value=5e-39, Identity=34%"; Hit description=ZW9 protein
  Pfam annotation: Domain name=MATH; Domain location=182-303; Score =42.3; E_value=1.7e-09; Accession=PF00917.16; Description=MATH domain
  Pfam annotation: Domain name=MATH; Domain location=29-157; Score =41.1; E_value=3.8e-09; Accession=PF00917.16; Description=MATH domain
  Pfam module annotation: Pfam domain module=MATH::MATH; Domain location=182-303::29-157
  Subcellular localization annotation: CTP_CleavageSite=44; ConfidenceScore=5.04e-01
METKTADPLFSVQTLKGRKAPPSQYTFKIKSFSWLSKAPVQKCTSEEFEAGGYKWSLSIYPTGNTKGGGEGHVSIYLVLMDSSSLPVDWEVNAIVNFSAYNFIDDEYVATQDTNVRRFHVLKTEWGVAKFIDIDTFNDPSNGYLMDDTCVFGAEVFVVKTTTKGDCLSMIHGPIPLSHSWKFDNFSLAKLDKYESESFVGGNYRWKLILYPNGIVEGKGNSISLFLTLEVSTLPPNTKLVVECTLRAKKQISGHHAQTGFCRKFSSSNSTWGTRQLVALAKLTDPNSGFLVNDTCILEAEFTILGLMTPRID

SEQ ID NO: 178981 - protein, 255 aa, Glycine max
  Coding DNA Sequence Number=SeqID_62203
  Gene Ontology: Mol. function=diacylglycerol kinase activity; Cellular component=nucleus; Biological process=protein kinase C activation
  Homolog annotation: Hit_ID=Q94DX0; Match level="QueryCoverage=65%, HitCoverage=38%, E-value=3e-37, Identity=43%"; Hit description =Pentatricopeptide (PPR) repeat protein-like
  Pfam annotation: Domain name=PPR; Domain location=55-89; Score=27.6; E_value=4.4e-05; Accession=PF01535.11; Description=PPR repeat
  Pfam annotation: Domain name=PPR; Domain location=90-124; Score=8.0; E_value=0.85; Accession=PF01535.11; Description=PPR repeat
  Pfam module annotation: Pfam domain module=PPR::PPR; Domain location =55-89::90-124
MPHRDVVSWSILITGYNSVGSYAMPWLSLNRCSMRVWESGRGVECVWSMKEKNVFTWNAVIKGLALAKSGQEAIWWFNRTEKDGVKADEVTLLAVLTACSHSGLVDKGREIFGLLVDGRYGVCPNVIHYACMVDMLARSGLLKETVEFMGSQGDLELALLAARKLIELEPDNTAYYIHLSNLYAVMGRWSDVEKERGLMKDRQLTKDSGDGRNCSPYLCQKPPVVLSLLSFTGKVSVSVPVEALQLLSFLKIANH

SEQ ID NO: 178982 - protein, 118 aa, Glycine max
  Coding DNA Sequence Number=SeqID_62204
MVIDQSLFHDLTKLPSDGVPFEASFGYRKERDGSWVKKGVPPADDEGHIPVEDNSTLLQRLMDKFDGLQTFVGDKFDAMELQVDMRFDAMESRITRVEEDVSFIRTCFDPPPPPPSSS

SEQ ID NO: 178983 - protein, 874 aa, Glycine max
  Coding DNA Sequence Number=SeqID_62205
  Gene Ontology: Mol. function=DNA binding; Cellular component=nucleus
  Homolog annotation: Hit_ID=Q10LJ1; Match level="QueryCoverage=55%, HitCoverage=53%, E-value=2e-94, Identity=40%"; Hit description =Expressed protein
MDSRCIDDKKEDNEMKSAEEFEDIFGDPEVLPRVGEEYQAEIPSLVTAPYLSQLVNKARDSEITVIEKESMSLGLPIPLKWAHCKFEGSCGCGTSESFTSEAGPIISENECPAVEVTLQTVSHVGGFSNFESSSKSNEKNQPRGKYLLPGLLDDQSWTDIEYNSFLLGLYVFGKNLKFLKRFVGGRTMGDILFLYYGKFFKSKEYCRWSECRKLRTKRCIYGQKIFTGWRQQELLSRLFSRVPGECQTTLVEISRKFVEGKMPFEEYVFALKDAVGIDLLIAAVGIGKGKQDLTGTAVEPTKTNHTFSVRPEIPIGKACSSLTPADVIKFLTGDFRLSKARSSDLFWEAVWPRLLAKGWHSEQPIDQVVSGSKQSLVFLVPGVKKFSRRKLIKGDHYFDSISDVLNKVASDPGLLETESQATEGSVDREKTEDKGDLEGVPNREQVHYLQSQSSKSYQDLTKFTIVDTSMVHDMNQRKVTQMRSLPFQTISVSTIPSCSSESEQDTSEESEDQAEQDNASSPIEDRVEQDNASSPIEDRVEQDNASSPNKDKLEQANSSYPIQDQVEQGHSSNPIEEFSDKGLSIDSSDCTHVPEALNTTNEVKYHRCHSDLHNEEHSREINEHPFIQKMTSMQKLRACNHGEFNHCTESTSVDRKFDLNEPISPSNLHEESDGMVLSMGLENLPFPSYLAKGSPNMSNEISVTENHLVGEVSAENSETRMLIDLNFPQVSPELGLEMEIPSSMVRMQNDNQCANTSSSPSEITQFNAAQEFPDGNKEQQSSLVNRRQSTRNRPLTTKALEALEYRFINSKRKRKNTECSDNNTKSKCVRVSSGTIISATSDNGIEDSMADTRAEEENVIQAYSCSINLNEGSL

SEQ ID NO: 178984 - protein, 161 aa, Glycine max
  Coding DNA Sequence Number=SeqID_62206
  Gene Ontology: Mol. function=nucleic acid binding; Cellular component= intracellular; Biological process=chromatin modification
  Homolog annotation: Hit_ID=Q1RSK1; Match level="QueryCoverage=78%, HitCoverage=23%, E-value=3e-70, Identity=91%"; Hit description=Zinc finger, C2H2-type
  Pfam annotation: Domain name=RS4NT; Domain location=115-152; Score =14.8; E_value=0.034; Accession=PF08071.2; Description=RS4NT (NUC023) domain
  Pfam annotation: Domain name=zf-C2H2; Domain location=130-152; Score =24.2; E_value=0.00046; Accession=PF00096.16; Description=Zinc finger, C2H2 type
  Pfam annotation: Domain name=zf-C2H2; Domain location=54-76; Score =26.4; E_value=0.0001; Accession=PF00096.16; Description=Zinc finger, C2H2 type
  Pfam module annotation: Pfam domain module=RS4NT::zf-C2H2::zf-C2H2; Domain location=115-152::130-152::54-76
MGKKFIKKVSTNINKANFMTQVQDHPLMDAFDETDPNAEVVVLSPTTLMATNRFVCEICNKGFQRDQNLQLHRRGHNLPWKLRQRTSAEVKKRVYVCPEPSCVHHNPARALGDLTGIKKHYSRKHGEKKWKCDKCSKRYAVQSDWKAHQKTCGTREYKCDC

SEQ ID NO: 178985 - protein, 164 aa, Glycine max
  Coding DNA Sequence Number=SeqID_62207
  Gene Ontology: Mol. function=oxidoreductase activity, acting on paired donors, with incorporation or reduction of molecular oxygen; Biological process=carotenoid biosynthetic process
  Homolog annotation: Hit_ID=Q9FGZ1; Match level="QueryCoverage=65%, HitCoverage=16%, E-value=5e-45, Identity=85%"; Hit description =Phytoene dehydrogenase-like
MCWSLLNLFVDLFKDVYLTTLCSTCIDYMRVSLRASVSSLGQKDMVNFMDLLLSPASKVLNNWFETDVLKATLATDAVIGSTASVHTPGSGYVLLHHVMGETDGERGIWSYVEGGMGSISKAIGNAAIEAGAHVVTNAEVCYQESLLSFKYTSSTVSSASNFTF

SEQ ID NO: 178986 - protein, 244 aa, Glycine max
  Coding DNA Sequence Number=SeqID_62208
  Homolog annotation: Hit_ID=Q2R2S2; Match level="QueryCoverage=81%, HitCoverage=87%, E-value=1e-55, Identity=59%"; Hit description=Maf family protein, putative, expressed
  Pfam annotation: Domain name=Maf; Domain location=33-244; Score=84.4; E_value=3.6e-22; Accession=PF02545.5; Description=Maf-like protein
  Subcellular localization annotation: CTP_CleavageSite=24; ConfidenceScore=5.05e-01
MSQNLLFFSEAALDSSAAAVKSFVDMATKNPPFKIILGSSSKARREILSEMGYEFTVMTADIDEKCIRREKPEDLVMALAEAKADAIVQRLPTGGPLEEDASTTLLITADTVVVYRGVIREKPTSEKEARDFIKGFHNGCQFPAFVAVIGYSGSHAAVVGSVVVTNLATGKRCGGWDSAEVYFLEIPDEVIDNLIDEGITFNVAGGLMLEHPLTLPFVDAVVGSTDTVMGLSKALTEKLLLEAL

SEQ ID NO: 178987 - protein, 95 aa, Glycine max
  Coding DNA Sequence Number=SeqID_62209
MARHDPCNAASSSEEIQHNSHVIILLSSIVVPMGPCGSCPYLKIRLIPRLGNRGPELLGGRPLEKTGVLALLASHILHVPVHLELYPSQVSGDGL

SEQ ID NO: 178988 - protein, 257 aa, Glycine max
  Coding DNA Sequence Number=SeqID_62210
MPLEPGQLENRRLEEGAWGLLLARRWKAAMGSGVDMGAGHGGGVGMGGKALGEAVHDLLQVVGGRLAGGVFWHDKGKGRGRVDGCVERLERKEVGHNHGGQVGSNCYELKTLAYQNQSSFPSKNQGGSESRCSHWGNPKHVVDNYFKLHGYPDWWDNLNEQKSHDWRNQKDVDKRDSKVAMMMPPLSMLPSITLTSTLVTTMLTGNVKLALMSTDTIKDTRWIIDSSATDYMTFDKGHSYVDTFIIIRTHFTCSLYL

SEQ ID NO: 178989 - protein, 287 aa, Glycine max
  Coding DNA Sequence Number=SeqID_62211
MTEGSEGPIEEREIAIAIPNTSPCNTGNGEHHLAGVPVLHSLDQPMKSLKQTLTSVCTIHTRCCSALCYLVFGPLSFCTSSMLYLYPSSMMNDINMNFSPISVAYYRSSPYSRIQGLHLPSVHNNLVRPATHGCVPPLSIPASPHSHPPCLYLCPCHAKTHHSPDNHDRLEEVMNCLTQGFITLSQNYTALNNKLDSILDRLLVLTLVPTSPKSPPPDAPMPNLLPMAAFHLPANSKPHVPSFDFRFFHRLGSGDISSIYLIELNGSSLSVIIAAKVMVSLMAPKDV

SEQ ID NO: 178990 - protein, 69 aa, Glycine max
  Coding DNA Sequence Number=SeqID_62212
MVVIAKFHPGTIVDRFGRLNTHRGGIRKVSPFRNILEVGLLKEEVTGQQAPPRCSKMVSRASGTSVMLP

SEQ ID NO: 178991 - protein, 96 aa, Glycine max
  Coding DNA Sequence Number=SeqID_62213
MAPPDSSPSVEQFNETVPQHVEDESSEATIHEPFDIGEEAEETQVRQVAVATPERSIEATSEPSPPMVNLPSPQPAANPSTPLLQIPEDPTTPVLA

SEQ ID NO: 178992 - protein, 233 aa, Glycine max
  Coding DNA Sequence Number=SeqID_62214
  Gene Ontology: Mol. function=nucleic acid binding; Biological process= DNA integration
YPWFYSGMPKVKDFMKVIDEQFQSSEKALARTLMSKLSSMRLIGVTAEFRIYNSNEKKLDLRTISAYFIGYAERSKGYKFYCPTHSTRIVELRNAKFIENDVASGSDLTQGIGLEKNQCEGTVPTSNPVEQHQTQNVQLPIEQHQTQDVEQPVEQQPEESQFDFGVENDPESFSQVINSDLVELPNGIKPIGYKWIFKTKKDSLGNIERHKTRLVAKGFAQREGVDYGETFFP

SEQ ID NO: 178993 - protein, 198 aa, Glycine max
  Coding DNA Sequence Number=SeqID_62215
  Homolog annotation: Hit_ID=Q764N7; Match level="QueryCoverage=86%, HitCoverage=25%, E-value=2e-07, Identity=31%"; Hit description=Zinc finger protein
  Subcellular localization annotation: CTP_CleavageSite=10; ConfidenceScore=5.28e-01
MSATALLQKAAQMGATASNSINSPMMQKGFVGGTTTGPDHVSFTTRPPYYGAMLQHNNSYDHFSPQHDLSNMAGVSGGGAFINQLFHKGQEISQVFDTNTTMNGVGMFSQMPMGSEHNHNQGLMKNVEQEVSNGSSLIHVRDVSDGNHTMQPSRFGGSDMTTVHDFLGIGGSTSRVMNHFHHHFPHEDSAIEEPMWDV

SEQ ID NO: 178994 - protein, 92 aa, Glycine max
  Coding DNA Sequence Number=SeqID_62216
RIPASIKKYCIPRQAQGETPQQPRDGQQRATNALPPPLESPQLIHKKVRALPTTHGRPIGDQVQSQSRTHLAAHDPRNFNKTSTSSEGRKIP

SEQ ID NO: 178995 - protein, 1120 aa, Glycine max
  Coding DNA Sequence Number=SeqID_62217
  Gene Ontology: Mol. function=sequence-specific DNA binding; Cellular component=nucleus; Biological process=regulation of transcription, DNA-dependent
  Homolog annotation: Hit_ID=Q9SWE0; Match level="QueryCoverage=68%, HitCoverage=70%, E-value=1e-113, Identity=34%"; Hit description =Flowering-time protein isoform alpha
  Pfam annotation: Domain name=Homeobox; Domain location=149-205; Score= 13.3; E_value=0.0002; Accession=PF00046.19; Description=Homeobox domain
MAASKVIPEIHPGPEHGLILSHPIRLSTLSNFLSPELAPSQTLTSSVPNWESVRSIERFIQSPQVKCVLLRIAAKQLRSTMDAWNEDFSELEIGSSTESFQKFLVSQRELFHSQIDQFQEIVVTQCKLTGVNPLSQEMAAGALSIKIGKRPRDLLNPKAVNYMQSVFSIKDAISKKELREISALLGVTVTQVRDFFNAQRSRVRRSVQLSRERALSSNSCEEPHDDQINSDPMRPINPTPLNSAGLSNTEEASCSTQEVTLSDLDDSDKQFVDSIFSLMQKEETFSGQEKLMEWILTIQNFSVLLWFLSRGGGMNLATWLSKAAVEEQTSVLLLVLKVLCHLPLHKAVPMHISAILQSVNKLRFYRTSDISNRARVLLSKWSKLFARNHVIKKPNGVKTSSDGHKEMMLSRRQACILSLFCAQFVGTSFLNYCDLYFCSIGQLMGSESWHSNIDVPEDILALSSECSNNFRKIGSPQGYISLIFLNTLSESRERRKVQLVEQPGQKSVSRSSQVTRAGPVSQGRPMSADDIQKAKMRALFMQSKYGKSGSKESSETKIDSPYKQPQTNPASIAACSSKVPTPPKIEENEKPLLLASKATNKLEASYSKPKMDVKEPLWEKCKRVQIPWKTPAEVELKDTWRVGGGENSKEVEVQRNRNRRDKEIIYKTVQEMPPNPKEPWDLEMDYDDTLTLEIPIEQLPDGDADIAISPNHVATHSVQGVASTSSTSVATAEPDLELLAVLLKNPELVFALTSGQGGSIPSEETVKLLDMIKSGGVNLGLSENTNGSYGTSVKAPEKVEVSLPSPTPLSDPRTSGWSSEASKNPFSRQSLAPDRITQKHTAVATTNLLSQIPITVTTVRQQPTVVVPSSRHLTSISVSPYSLPQATNVIPEKPPPLGHVQTSSDVGLTMKKNLITANASSVNFTGTHSTLAMRGDGTNYVKPVPNLSVQHEGLSNSFPQPFMPPSPTPSHSASQQQRHQHLAQEVHYTEPPYRNPGRSYPPQIEKSDHGSDNMWRVRQDHVSSSYLSQRNHNNNYNTIVGGSRQSGFYDRNNHARGEFESWSPENSPTRNPRYAPGRNYPESRMNHGRNHRPEWSRQRGSSGHWDPGRQGNRKWHDQRR

SEQ ID NO: 178996 - protein, 422 aa, Glycine max
  Coding DNA Sequence Number=SeqID_62218
  Gene Ontology: Mol. function=protein binding; Cellular component =nucleus; Biological process=cell cycle
  Homolog annotation: Hit_ID=A0ELU7; Match level="QueryCoverage=95%, HitCoverage=58%, E-value=1e-172, Identity=69%"; Hit description =Cullin 1-like protein C
  Pfam annotation: Domain name=Cullin; Domain location=30-422; Score =273.4; E_value=4.4e-79; Accession=PF00888.12; Description=Cullin family
MDSFNALLGFRADSCTGAMERKIIDFDQGWDYMQKGITKLKKILEGAPETPFSSEEYMMLYTYPFSCNYHHRTIYNMCTQKPPNDFSQQLYDKYKDAFDEYIKITVLPSLREKHDEFMLRELVQRWLNHKVMVRWLSRFFHYLDRYFISRRSLPGLGAVGLTCFRESVYMEVRVNARKAVIALIDKEREGEQIDRSLLKNVLDIFVEIGMGEMGQYEQDFEAEDCLRRERDRVSHYLHCSTEQKLVEKVQLELLVTHANQLLEKENSGCHALLRDDKVEDLSRMYRLYHKIPKGLDPVANVFKQHITVEGTSLVQQAEEATSNQVLVRKFLELHDKYMVYVNDCFMNHTLFHKALKEAFEIFCNKTVAGSSSAELLSTFCDNILKKGGSEKLSDEAIEDTLEKVVKLLAYISDKDLFAEFYR

SEQ ID NO: 178997 - protein, 124 aa, Glycine max
  Coding DNA Sequence Number=SeqID_62219
MREWPHFATPDGLQGFLNWELGDRYTLYPYVVITSDCHLHDYVRPSRPERIDGKVWTLIGESVICLEEPHVVVNYVTCCLCLTIVCLWHLRSGGLIPTTNNFQVLTKSAPRHLRAWCSLQKERV

SEQ ID NO: 178998 - protein, 114 aa, Glycine max
  Coding DNA Sequence Number=SeqID_62220
MGSNNKKSNSTSEEQTLISDDSLKPLNKKQYRIMPTQTLGTKRGIEPQPNPNSNLRLRPLVRLAPAATHCRSSTLACSRTWPWCPSRMGRVMEVVVASNFVWVTLMVVRSGGSG

SEQ ID NO: 178999 - protein, 65 aa, Glycine max
  Coding DNA Sequence Number=SeqID_62221
MEKEGNYMEAEKARMNLKTNFATLSSSKGKAPPKGEKPKKQWMKLVLNQMGTGSSSSLAVLHWSM

SEQ ID NO: 179000 - protein, 155 aa, Glycine max
  Coding DNA Sequence Number=SeqID_62222
MEGKSTYIKSLPILVLIHVNSPSLVIFLRGAVFRRNLHAWRHHQWRLRQGRATRHSHQRLAFCLRDIENASTNGELVMALVKCKVLGLQHCRVQQVRVAVTQGQQVRGERRAIGYCELHKGDVIPSSDYSESLIRSASLVYCCYLDFLVVVINFK

SEQ ID NO: 179001 - protein, 1730 aa, Glycine max
  Coding DNA Sequence Number=SeqID_62223
  Gene Ontology: Mol. function=zinc ion binding
  Homolog annotation: Hit_ID=Q10LI9; Match level="QueryCoverage=59%, HitCoverage=99%, E-value=1e-39, Identity=32%"; Hit description=CW -type Zinc Finger family protein, expressed
  Pfam annotation: Domain name=zf-CW; Domain location=725-773; Score =74.6; E_value=3e-19; Accession=PF07496.5; Description=CW-type Zinc Finger
CAFNSAIVFVVVKSEAVISTRARNRVEFFKLLAGVICLGGFLIPGNGSKRECDFDWDEGFSMRRFKLEGGRDAIKGLGLGLGLGAGRREMVESELEEGEACSFQNHEDYDATVDPDVALSYIDEKLQDVLGHFQKDFEGGVSAENLGAKFGGYGSFLPTYQRSPVWSHPRTPLKNHSQNTPRSPNNLQPEGGQGDAVQCSTGTQSSRLGPGSGNSSRMPANKGLSLDDGTNQEKYMTTTNADTSTSKHESLNKKVNSTSDQKTLKVRIKMGPDSLSTRKNAAIYSEIGLDVSPSSSLDDSPSESEGISRGPQDAPFESPTIILQIMTDLPQLLSPIPDDTIELTVKETRARDSISGPVHMDDPESFDMYESNNVKGDRKLLGGSGRKMKSLEGCESSMEVNGSTKKNTRNDVGVLSRKEQSTDALTMEELVSKTMKLPLLSSSYSFGDDLLKAVDGQCDSSKEANKVMVREKTFSDQGQREQVESTSTEVNGSAEKAKGSSGRKVVGDKVSLDDYPVKENPQGDKNFNSMIVESNVSKVRTEPNTEELPKKANQRGNLSEPDGIEHPFPGGKKKPKGSHGTMVMEREKENLKVGSSLVPKTKKSSDDSSASRNETEDARIQKSLGKTRDTYRDFFGELEDEEDRMGSLETPYEEKLKESEVVERSAPMTSYGAKERSGGKKADKPFTAIYPKTATNVSCTGNANGTDIENGKGVPVMIPPVEMDDNWVQCDQCHKWRLLPVGTNPDNLPEKWLCSMLDWLPDMNRCSFSEDETTKARIALYQGLPLDGRSNLQNVSGSVMVGGTMATSQHPYQYQLNNDLHAVPGGKKKFMKEISNSISKDNFSQSSYSIKKNLQSAVKSKSLNDVNKSPVASEADVPADKHKNKQRMLEHNSDRGDMKVKCRRDSDQDSSRPSKKSKSDKVHSINEEWIIEESGTTRKVGSNSTFPTTSVGKDRPRQKNHSSSQDFKSGKDGLPDSAETTKDKGQGSLDEGSLDLGICDSIGSVKKRKLKGYQDAQTYSPGNPCLQESKTSEHEFSNSRKEKKAKNSKYEGKESNASKGSGRSDKKVSHTKTQKFRQKPESSLSQRSLDGLDCSKRDLGSVQASVAATSSSSKVSGSHKTKASFQEVKGSPVESVSSSPIRISNADKFTNKEIIGKDDSHDIAAADSPRRCSGREDDGENDRSGTARKDKSFTISHRSDFQDKGVNHLSDTKLKAQTTGYCTDGGVDTIVPDGTHPGTEQIKHPGEDNIVYYANTSQARKNGIESGLEGNNPNDSCKSESHADKVKSTSSPCQLKDQSPLHEAKNKDGKIKLQEKFGFKPDLNGITYAGKNDYTGKKESRKKENHSNRGHDFQDVSTDTPCKQEVFHAPIQNQLPDCDTERSTKRSLLERTDQEVHGKGKPLPSFPSEGSQVETLGHCPRPVGLHKGNGDMEVDPSKVDDVSKLQKKQLKKTGHQNGNQQIGSRNPILNGHKSKELDAPSPARRDSYTHAANNALKEAKDLKHLADRLKVFMQSLLDFYAFALLSPYFTNFGFIKQNTGSSAEGTSLYFQAALKFLHGASLLESGNNDNAKHNEMIQSMQIYSSTAKLCEFCAYEYEKSKDMASAALAYKCMEVAYMRVVYSSHTSASRDRHELQTALQMVPLGESPSSSASDVDNVNNSTAADKAQDVNFAMEASRKSRNAFVAANSSLAVDKIADGISSIKKALDFSFQDVEELLRLVKVAAEAINR

SEQ ID NO: 179002 - protein, 73 aa, Glycine max
  Coding DNA Sequence Number=SeqID_62224
MVRGFMQKEGRGRSVNKILGAQVGGGGLSLRRGRKCLIGWISLLFFPNDFHGHTTGFFYSFWCTDPREFLIAR

SEQ ID NO: 179003 - protein, 45 aa, Glycine max
  Coding DNA Sequence Number=SeqID_62225
MLKSNGSLSASQVKGYIHKTSPSIGLDLICIFDEYDDEDVIDPAK

SEQ ID NO: 179004 - protein, 84 aa, Glycine max
  Coding DNA Sequence Number=SeqID_62226
MGAVTVGELKPSISGKRTFRPSSSIRHATEWPISDVSSDLTIEVGASTFALHKVKETSYHSDKSSFEENFMPNLSPLALMADKW

SEQ ID NO: 179005 - protein, 470 aa, Glycine max
  Coding DNA Sequence Number=SeqID_62227
  Gene Ontology: Mol. function=translation release factor activity, codon specific; Cellular component=cytoplasm; Biological process =translational termination
  Homolog annotation: Hit_ID=Q2R068; Match level="QueryCoverage=83%, HitCoverage=90%, E-value=1e-151, Identity=68%"; Hit description =Peptide chain release factor 1, putative, expressed
  Pfam annotation: Domain name=PCRF; Domain location=154-269; Score =210.3; E_value=4.4e-60; Accession=PF03462.9; Description=PCRF domain
  Pfam annotation: Domain name=RF-1; Domain location=285-408; Score =190.3; E_value=4.5e-54; Accession=PF00472.11; Description=Peptidyl -tRNA hydrolase domain
  Pfam module annotation: Pfam domain module=PCRF::RF-1; Domain location=154-269::285-408
  Subcellular localization annotation: CTP_CleavageSite=60; ConfidenceScore=5.41e-01
MYVPSASLSGYSVAMNSLTASFTARICATRRDLLLPIRHRSLHPFTTRRVATKLTPPRIVCMAEPYLITKLESAEKTWKELSVFIPLRATMLSIFCKVFFFSKMKFQVKLADPDVVSDPKEYQKLAQSVSELDEVVSTYRRFKDCEKVLEETKALAKDDGNDEDMVEMISFEIDTLSKQLAELEEKIKVLLLPSDPMDARNILLEVRAGTGGDEAGIWAGDLVRMYERYSERNSWKYSLVSSSAAEKGGYKTYVMEIKGNRVYSKLKYESGVHRVQRVPLTETQGRADEVEVVIDPKDIELTTARSGGAGGQNVNKVETAIDLFHKPTGIRIFCTEERTQLKNRNRAFQLLRAKLYEIKVREQQESLRNQRKLQVGTGARSEKIRTYNYKFMTLSNFSYQDNRVTDHRLKINYELTSFLDGDIEDAVQVCIKMKIGLVSKGLQRESLKSLRETQNHCNSWIGFDNVEWGL

SEQ ID NO: 179006 - protein, 78 aa, Glycine max
  Coding DNA Sequence Number=SeqID_62228
MRIVRTYRVVSVLEKIGALFGSESISVYVVGGMRRCHGEDLECERFEIRRGEGGLAKEKTRKEKRREAVQEHRRIMYQ

SEQ ID NO: 179007 - protein, 720 aa, Glycine max
  Coding DNA Sequence Number=SeqID_62229
  Gene Ontology: Mol. function=protein binding; Cellular component =cellular_component; Biological process=multicellular organismal development
  Homolog annotation: Hit_ID=A0F0B0; Match level="QueryCoverage=94%, HitCoverage=81%, E-value=0.0, Identity=88%"; Hit description=Cold -induced thioredoxin domain-containing protein
MAIPFEVGYSTCHWCHVMEVESFEDEAVAKLLNDWFVSIKVDREERPDVDKALYGGGGWPLSVFLSPDLKPLMGGTYFPPDDKYGRPGFKTILRKVKEAWDSKRDMLIKSGSYAIEQLSEAMSASSDSDKLPDGVPADALRLCSEQLSGSYDSKFGGFGSAPKFPRPVEINLMLYHSKKLEDTGKLGVANGSQQMVFFSLQCMAKGGIHDHIGGGFHRYSVDECWHVPHFEKMLYDQGQLANVYLDAFSITKDTFYSYISRDILDYLRRDMIGPEGEIFSAEDADSAETEGAARKKEGAFYIWTSKEVEDLLGEHAALFEEHYYIKQLGNCDLSGMSDPHDEFKGKNVLIERKEPSELASKYGMSVETYQEILGECRHKLFEVRSRRPKPHLDDKVIVSWNGLAISSFARASKILKGEAEGTKFYFPVIGTEPKEYMGIAEKAASFIRKQLYNVETHRLHHSFRHSPSKAPAFLDDYAFLISGLLDLYEFGGGISWLLWAIELQETQDALFLDKTGGGYFNNTGEDASVLLRVKEDHDGAEPSGNSVSAINLIRLASMVAGSKAEHYKRNAEHLLAVFEKRLKDMAMAVPLMCCAADMLRVLSRKQVVVVGERTSEDFENMLAAAHAVYDPNRTVIHIDPNNKDEMEFWEVNNSNVALMAKNNFAVNKVVALVCQNFTCSPSVTDHSSLKALLSKKPSSSFTKLKRFANLRHSSVFETFY

SEQ ID NO: 179008 - protein, 622 aa, Glycine max
  Coding DNA Sequence Number=SeqID_62230
  Gene Ontology: Mol. function=nucleoside-triphosphatase activity; Cellular component=membrane; Biological process=peroxisome organization and biogenesis
  Homolog annotation: Hit_ID=Q93X55; Match level="QueryCoverage=99%, HitCoverage=83%, E-value=1e-127, Identity=52%"; Hit description =Peroxin 6
  Pfam annotation: Domain name=AAA; Domain location=406-564; Score =100.2; E_value=6e-27; Accession=PF00004.19; Description=ATPase family associated with various cellular activities (AAA)
MLVFPSCDFPSNGSVLDDQVAYISPLLAFNLNLHVTCLKSIFHHGQDALVSYFKRGDEDAAKGTVDSVINVELEPLAQPPKFATLLRVSFVKIPECGILESIRASSPGYVFGINISWNCNSPICIPCNQRSLNKNDNLVCFKGVSSPSALPPDLLIGGPAEEPVPLQGDTVNILALILTPTFCPLVLSSKFRVSVLLYGLAAQAFKMARSMLVKVEKKNAEKTSGHQVLLVAAADSSEGLPPTIRRCFSHEISMGPLTEEQRAEMLFQSLQSVSGLLSNTDSEALVKEIVGQTSGYMPRDICALIADAGANLFPRNNAKVDKDVPDDVGSSLSSKVAEDNNQRKVSPLITGKEDLLNALERSKKRNASVLCTPKVPNLKWEDVGGLEDIKKSILDTVQVGFLYNSTLSLVSLDKFLKKNLRKEKGPELINMYIGESEKNVRDIFQKARSACPCVIFFDEFDSLAPARGASGDSGSVMDRVVSQMLAEIDGLSDSTQTRRRFDKLLYVGVNSDASYREQVLKALTRKFKLHEDASLYSIAKKCPPNFTGADMYALCADAWFYAAKRKVLSENSESSSQDNEADSVVVEYNDFVRVLEELSPSLSMSELKKYEQMRDQFEGTSK

SEQ ID NO: 179009 - protein, 82 aa, Glycine max
  Coding DNA Sequence Number=SeqID_62231
MHVNSEAEAAVEESIVPTAMPRTGLALVYVFYTSSLFEAHMPSSPFIFVLHWLNVFLSYYNAMLLFRMALGVCRRYFNTQIR

SEQ ID NO: 179010 - protein, 214 aa, Glycine max
  Coding DNA Sequence Number=SeqID_62232
  Gene Ontology: Mol. function=signal transducer activity; Cellular component=membrane; Biological process=response to light stimulus
  Pfam annotation: Domain name=NPH3; Domain location=1-65; Score= -110.3; E_value=0.0025; Accession=PF03000.5; Description=NPH3 family
ALDSNLLPSKFTALAELLPDHARVVSDGLYRAVDIFLKVHPNMKDSERNRLCKTIDCQKLSQEACSHAAQNERLPVQMVVQVLYFEQMRLRNAMNGGHNQLFFGQFPHRSGSGAGSGAISPRDNYASVRRENRELKLEVARMRMRLTDLEKDHVSMKQELVKSHPANKLFKSFTRKLSKLNSLFRINSIKPLIGGKASSETRFPFPKRRRHSVS

SEQ ID NO: 179011 - protein, 105 aa, Glycine max
  Coding DNA Sequence Number=SeqID_62233
  Gene Ontology: Mol. function=protein disulfide oxidoreductase activity; Cellular component=chloroplast; Biological process=cell redox homeostasis
  Homolog annotation: Hit_ID=Q9LYC8; Match level="QueryCoverage=96%, HitCoverage=100%, E-value=8e-29, Identity=59%"; Hit description =Glutaredoxin-like protein
  Pfam annotation: Domain name=Glutaredoxin; Domain location=13-75; Score=64.5; E_value=3.4e-16; Accession=PF00462.14; Description =Glutaredoxin
MDVVTSLTADKPVVIFSKSTCFMSHTVKALICSFGASPSVIELDKMQSGHQVERALIQLGCKPSVPAVFIGQQFIGGADEVIKLNVQNKLAQLLLGAKAIFIWSR

SEQ ID NO: 179012 - protein, 153 aa, Glycine max
  Coding DNA Sequence Number=SeqID_62234
MARYILVYDEFGYNSLIFRMEGFLVSEKYVALQICDDKDVETMIENFQQQEQMSVIELYIENDVTSGSLDEDDIVDDISDTDDEVTHMIESLTIVQPREGVEGIHNPFWNDVLHYNNINWGHPDEENICGLKPSSFNIGQELYVGMNFDSKDA

SEQ ID NO: 179013 - protein, 913 aa, Glycine max
  Coding DNA Sequence Number=SeqID_62235
  Homolog annotation: Hit_ID=Q1SD81; Match level="QueryCoverage=14%, HitCoverage=10%, E-value=8e-18, Identity=43%"; Hit description=H+ -transporting two-sector ATPase, alpha/beta subunit, central region; TonB box, N-terminal
  Subcellular localization annotation: CTP_CleavageSite=55; ConfidenceScore=5.11e-01
MGLNVKDIQIRLFKVVQDSAKSSYSFMRRHPLVSGASLVCSILYAFLSYIYSFLVCMSPFLVCAVIFIKIFWSSEQTQLKYVKTKEEKGGQKKVEPKCPKIPNNRRPEMLCKYPSQNATSKRRKFSDKNWDVYSGLEDKAKDLSAVFHNEFTKRNIENKGARSFEKGESSLDNRLSAKKTQVPKRQILRSEPSMVDLVECGDLEIEKKIEDGDDEDGEETQEESNKAIEWTEDDQKNHMYLRNSEMERNRRMESLIARRRAKKLFKGQIEKGQIDKKSMAPVLTKRRNHLDSSKDFDDGLDMPGSAPSFMPRSPYDIPYDPSEEKPNLTGDSFPKEFSSQKDMPFSRHGSFSSTHLFPSETKHDHGAREHYYFNKGSKYSDRLAYSRFRRHHTDKGTHDWLIDQLIYNEGGENGLQIPNTLTNGEESTHEEDRKCKTDGENMKDENDHETKSMSGQISEPGSDRSRPWPTFPKPHRRLLTFPVSTTATTHTTNINEALYETVTSIVDKRQESIFLTHGRICHTPTYSVASDLQVEVSEVGSPTSTVGENAETNSSIDRDSILYDGDIDRDVSSGSEELWGASFHGGKEAQGVRSEADDNAEVNNNSKDVVSSTTPRHIDENEADVSSMSSKSDVPEDTPTHASHHNFFGYMKHPVRKLKHHNLPILLMLWINYPMKHTQKDQRRVTLEWCNMPENVTNEAQVINAVNNSTSTEQDNTDNLRSNEDPGTSVMRQESIDETFNGSVSSSPRSVLPEITMADEVSPSAFDQDLHIDAQQFIMEGLAQETLNSESPPDTMPQTIQPTMDDTTDESHSVDFNFNHCQEQTNHLENCIEESNVFGSMNDEVSNMEEEDKSKNDENSEDNSYHLNRQEATTESTRPISEIATLEDMVPSTELIEDDKNDKPSSSSNIQKE

SEQ ID NO: 179014 - protein, 236 aa, Glycine max
  Coding DNA Sequence Number=SeqID_62236
  Homolog annotation: Hit_ID=O04892; Match level="QueryCoverage=30%, HitCoverage=13%, E-value=3e-23, Identity=76%"; Hit description =Cytochrome P450 like_TBP
MPERGEARGNSVSLRIAGARGRVLSGRCGCSVEPRHGIESSKWAIFGKQNWRCGMNRKLGYGAQLRANLDPTKGVGRLRQQDGGHGSRNPLRRARRSAAKPQGAKPGGAIVGTGGSPSDSALCAYSEKGIGLPTLETAQPEVGSSGWKSTARRVVSASGRWNNVGKGSRQNGSVTSGKGLALRAGHGGPSPEPVGCRWTARAASAARAGRRVPVGGRIGNGPFGASSPGVEQSTQN

SEQ ID NO: 179015 - protein, 66 aa, Glycine max
  Coding DNA Sequence Number=SeqID_62237
MTPRSKQGLFVMGWTPFVGRVASWMSFWRGPKNSDGAEHTGEYYEGFARILAKQEPRGDIVKLPPF

SEQ ID NO: 179016 - protein, 357 aa, Glycine max
  Coding DNA Sequence Number=SeqID_62238
MWAIINEYKEKLDLAATHEQKLEDEYAKVSVLQAERVIDSFHGEAMMWMDKFAFTLNGSQDIPRLLAKAKAMSNVYSAPKEIHGLLNYCQHMLELIDTITKLAPKHPYRTCSKSRVMGEVEEVQEHMKVDMSVLKNQMASIMEAMLSMRRLIESNTATATATSTATEADLVLPSATNQANQLAPDMVGRGRDALGNTSGLHRGDADKEPREHAQLDIDSYPLFTTKGSAPNALPQPNTVGVSQPLPMQPLHFSVKESPLEAEGREKLDFIEERLRAVEGFGDYPFVNMTDLCLVLDVVIPPKFKVPDFDRIEVGLKRGKFDYVSPANTNNRRYGPTGAKRKERDAHAVTSAPAWPKF

SEQ ID NO: 179017 - protein, 164 aa, Glycine max
  Coding DNA Sequence Number=SeqID_62239
HSITGESMHSVIGDFEHPDLEHYNFEHSDSEHSDFAHSENMTQPPPRERTLREMAAPDFTYESLCIQYPDEDVPYVLKTGLIHLLPKFHGLAEGVAKDWLYYLAPRSITSWDDLKRVFLEKFFPASRTTTIRKDISVIWRESMIDAASGGALGDMTPAEAQKFN

SEQ ID NO: 179018 - protein, 177 aa, Glycine max
  Coding DNA Sequence Number=SeqID_62240
YILCGTSRGYIYLGLTENKRGYISCGSVLVEGTSTRFKENKGGYIPCGSLLVKGFLQGGRHEAHGCVFPNEDLINKVLRCLSREWQPKEHEIELQRLNQNEETDKKKRSIALKASSSMQEENEEEELDDEEDFSLFVKKFQKFVKKRRIERRQNINNRKRPQEDSQGMIDRGRTRIK

SEQ ID NO: 179019 - protein, 113 aa, Glycine max
  Coding DNA Sequence Number=SeqID_62241
  Gene Ontology: Mol. function=ribonuclease H activity; Biological process=DNA integration
MMHMLAMLPQKKKCYHRKIITDNATNLNNKMIKETCEDFKIQHHNSMPCRPKTNGEVEAENKNIKKIVLKMTVSYKDWTEMLLFSLHGYQTLVHTSTGATPFSLVYGMGPNSL

SEQ ID NO: 179020 - protein, 291 aa, Glycine max
  Coding DNA Sequence Number=SeqID_62242
MGETDKVHERIKADLEAMKEQMAAMMEAMMGMKKIMEVNAARVAATSATAKVDLTPTSGLNQINHAISDMVGQRGKELGSTGGPYFVQVQNKYSFPPYGLAPNHTPPNVAHTPIEDVNNSAPIPIESQKPEADHAHVSQPMGETHEIPHYNLTNFESHLGYATKGQAVGGVPLPNTLEGPQFLPQPQPLHFEAGRIPLAMAEKGKLDHIEERLGAMEGVGSYAFADMAELCLVPYIAIPLKFKVLDFNKYKGTTCPKNHLKVYCRKIRAYTKDEKLLMHFFQESLTGAAVS

SEQ ID NO: 179021 - protein, 287 aa, Glycine max
  Coding DNA Sequence Number=SeqID_62243
SLCYPETIESDNMQRQIWSSAPIVEDLMSFDRDYCSLPLPSTDKYVSLCYPETIESDSMQRQIRSSVPFCRRLDVFRPRLLQSPFAIKRQLCPIACRDKYGHLPPLSKTRCLLIETIRVSLFYLETIKSDNMQRQIWSFAPFVEDSMYFDRDYCSLPLQSRDKYAHLPLWSKTQCLSFETIVVSLCYPETMESDSTLRQIRTSALFFRRLNVFRPRLLQSPFAIKRQSSSIACRDKYGHLPSLSKNRCLSTETIAVSHYHPNTSMCDGMQRQIWSSAPFVEDLVSFV

SEQ ID NO: 179022 - protein, 82 aa, Glycine max
  Coding DNA Sequence Number=SeqID_62244
MSAGKYQSRLYNDRCRLLEMFDRRHPVMLLDENPKIGQIQAKGPMEKDEGSSGEGQSPRVEKDEGLEAETLSRLLIVAEGPN

SEQ ID NO: 179023 - protein, 370 aa, Glycine max
  Coding DNA Sequence Number=SeqID_62245
  Gene Ontology: Biological process=peptidoglycan metabolic process
  Homolog annotation: Hit_ID=Q080W9; Match level="QueryCoverage=33%, HitCoverage=45%, E-value=5e-26, Identity=47%"; Hit description =Hypothetical protein precursor
  Pfam annotation: Domain name=PG_binding_1; Domain location=19-88; Score=19.1; E_value=0.0018; Accession=PF01471.9; Description =Putative peptidoglycan binding domain
DYMSTIRISQAVGIRQPNKYRDVKTVQSLLNANSVITTPGNELKVDGYIGEKTIAKIKDFQEKVVKLNNPDGIISPHGPTMRRLHGNITPAKNIKINLDTTASQVTDEMYISMAKALNCEPAAIKAVVMSETKQSPFDASGRPTILYERHYFSRLTNKKYDKSHPDISGEPYEVYGKFSEQYGKLNKAIALDRTAALQSASWGAFQIMGSNYATSGYANVEAFVQGMNTISVLLMTSHIAAASTALSSSKESSYKENILNEAEQHGLSRVQLDESQTFRLTRDGTVLGTLIQGKGWIREVQPVCFIGWSKDGKKIDAFIPTVGQGDWETVGCHKVDSVGLISKKDDANVKVAVVYTTEAPGRYSNAYFIV

SEQ ID NO: 179024 - protein, 276 aa, Glycine max
  Coding DNA Sequence Number=SeqID_62246
  Gene Ontology: Mol. function=protein binding; Cellular component =cellulose and pectin-containing cell wall; Biological process=xylan catabolic process
  Homolog annotation: Hit_ID=Q949G8; Match level="QueryCoverage=96%, HitCoverage=79%, E-value=2e-63, Identity=32%"; Hit description =HcrVf2 protein
  Pfam annotation: Domain name=LRR_1; Domain location=111-133; Score =11.2; E_value=2.2; Accession=PF00560.23; Description=Leucine Rich Repeat
  Pfam annotation: Domain name=LRR_1; Domain location=135-157; Score =12.8; E_value=1.2; Accession=PF00560.23; Description=Leucine Rich Repeat
  Pfam annotation: Domain name=LRR_1; Domain location=14-33; Score =11.6; E_value=1.9; Accession=PF00560.23; Description=Leucine Rich Repeat
  Pfam annotation: Domain name=LRR_1; Domain location=207-229; Score =7.9; E_value=9.6; Accession=PF00560.23; Description=Leucine Rich Repeat
  Pfam annotation: Domain name=LRR_1; Domain location=231-253; Score =15.9; E_value=0.15; Accession=PF00560.23; Description=Leucine Rich Repeat
  Pfam annotation: Domain name=LRR_1; Domain location=255-275; Score =4.8; E_value=37; Accession=PF00560.23; Description=Leucine Rich Repeat
  Pfam annotation: Domain name=LRR_1; Domain location=38-60; Score=8.1; E_value=8.6; Accession=PF00560.23; Description=Leucine Rich Repeat
  Pfam annotation: Domain name=LRR_1; Domain location=62-84; Score =10.5; E_value=3.1; Accession=PF00560.23; Description=Leucine Rich Repeat
  Pfam annotation: Domain name=LRR_1; Domain location=86-109; Score =11.5; E_value=2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=111-133::135 -157::14-33::207-229::231-253::255-275::38-60::62-84::86-109
MQDFLCNNQDKPMQLEFLNLASNNLSGEIPDCWINWPFLVEVNLQSNHFVGNFPPSMGSLAELQSLEIRNNLLSGIFPTSLKKTSQLISLDLGENNLSGCIPTWVGEKLSNMKILRLRSNSFSGHIPNEICQMSLLQVLDLAKNNLSGNIPSCFRNLSAMTLVNRSPFPQIYSYAPNDTAYSSASGIVSVLLWLKGRGDEYGSILGLVTSIDLSSNKLLGEIPREITDLNRLNFLNLSHNQLIGPIPEGIGNMGSLQTIDFSRNQLFVESLQPFLI

SEQ ID NO: 179025 - protein, 111 aa, Glycine max
  Coding DNA Sequence Number=SeqID_62247
  Gene Ontology: Mol. function=ribonuclease H activity; Cellular component=mitochondrion; Biological process=DNA integration
MGIMVFVPYAFRLVKSSTQGPENDSISCLCMSVSLRMFNRGDKVLDPYPCQEVFVSLSFELSVVVGDDSIWEVVLGDKVSLAPRAFGSSPSMSIPHMAKGQAPHGEGPRGA

SEQ ID NO: 179026 - protein, 392 aa, Glycine max
  Coding DNA Sequence Number=SeqID_62248
  Gene Ontology: Mol. function=sulfate porter activity; Cellular component=integral to membrane; Biological process=sulfate transport
  Homolog annotation: Hit_ID=Q8H7X0; Match level="QueryCoverage=77%, HitCoverage=70%, E-value=1e-47, Identity=39%"; Hit description =Putative sulfate transporter
  Pfam annotation: Domain name=Sulfate_transp; Domain location=140-344; Score=49.7; E_value=9.6e-12; Accession=PF00916.10; Description =Sulfate transporter family
MASSAMETCKSEDLHMQVDIEKNAKDIRSQWVLNAHEPPSPWRVVADSVSKTISHYKHKLSSLIDQPCTTLLLSVLQVVFPILASGRNYTATKFRKDLLAGLTIASLCIPQSIGYATLAHLDPQYGLYTSVVPPLIYAVMGTSREIAIGPVAVVSLLLSSMMEKLVDPATDPVDFLRTPQWNPRNFILGCSFLVFILTTRFLGKRKKKLFWLASISPLVSVVVSTLIVFITRADKNGVKIVKHVKGGLNPSSIHQLDFNNPYIGEVAKIGLVVAVVALTVTILASVILSALPGLIDLSEAYKIWKVDKIDFLACAGAFFGVLFASVEIGLLAAGTQRFLQRLELYASVVMGLEAPALIFETEPFLDVMVKTELLSESTAFHVQSLDSVHMNF

SEQ ID NO: 179027 - protein, 166 aa, Glycine max
  Coding DNA Sequence Number=SeqID_62249
  Subcellular localization annotation: CTP_CleavageSite=43; ConfidenceScore=5.75e-01
MSNHSSVSSVHPSAGLNSSLPSSSGIGLSNNLTSSGPLAAPARDSRYGVSRTPPLSVDEQKRIQQYNQMISSRNMPQSTMSVPGSLSGSDLGGVRMLPGGNGMGMLGSGGMPSSSMVGIPSPVNMHAGVGAGQGNSMLRPRETVHMMRVRSGLVLSSNLIGSIGDN

SEQ ID NO: 179028 - protein, 335 aa, Glycine max
  Coding DNA Sequence Number=SeqID_62250
  Gene Ontology: Mol. function=zinc ion binding; Cellular component =intracellular
  Homolog annotation: Hit_ID=O82256; Match level="QueryCoverage=63%, HitCoverage=56%, E-value=4e-52, Identity=48%"; Hit description=Zinc finger protein CONSTANS-LIKE 13
  Pfam annotation: Domain name=zf-B_box; Domain location=3-50; Score =56.9; E_value=6.7e-14; Accession=PF00643.14; Description=B-box zinc finger
  Pfam annotation: Domain name=zf-B_box; Domain location=51-93; Score =9.2; E_value=0.013; Accession=PF00643.14; Description=B-box zinc finger
  Pfam module annotation: Pfam domain module=zf-B_box::zf-B_box; Domain location=3-50::51-93
MSGEARSCDYCGHSTALLYCRADSAKLCFSCDREVHSTNQLFSKHTRTLLCDACDHSPATILCSTDTSVLCQNCDWEKHNPALSDSLHERRPLEGFTGCPSVSELLSIVGFSDLSKKSLLSSPQGSGADGIFGGEIEGLSDLFVWDSPSFVTLDDLISSSPSSHSFQAMEVPPLPKNRKAACGQHKEEILSQLRELAKSEPLDLEPYVSSGNLSSGFEREPEADIFPSHEWHRESSEPMYQVVPPDPLMRTYTEEIPFKHSTSAVGETQTYGDNGGKPSISLKSETLSTTPKAAACIYYFLMLESAYLRLSRTISDMLSSQYTISQAFNRNMLKL

SEQ ID NO: 179029 - protein, 224 aa, Glycine max
  Coding DNA Sequence Number=SeqID_62251
  Gene Ontology: Mol. function=metal ion binding
  Homolog annotation: Hit_ID=Q2QP88; Match level="QueryCoverage=48%, HitCoverage=35%, E-value=8e-44, Identity=65%"; Hit description=CHY zinc finger family protein, expressed
  Pfam annotation: Domain name=zf-CHY; Domain location=18-100; Score =159.5; E_value=8.9e-45; Accession=PF05495.3; Description=CHY zinc finger
MEPATEKREDFGKLQYGCEHYKRRCKIRAPCCNQIFPCRHCHNDAANSSSNPADRHELVRRDVKQVICSVCDTEQEVAKVCSSCGVNMGEYYCEICKFYDDDTDKGQFHCDECGICRLIFVYPDLSSFIGSGVYPDLSSFTGSGVYRDLSSFTGSGVYPDLSSFIGSGVIQNLRSLGVYPDLSSLTGSGVYPDLSSFTGSGVIQKLYSLYQVIRPVRFTSSYTF

SEQ ID NO: 179030 - protein, 123 aa, Glycine max
  Coding DNA Sequence Number=SeqID_62252
MERPGSSSSAPNNRERDYHNDSRHITDLVFANERIEVGLKRGKFNHPTWTNEKTGVNKEGENEEETHAAAAIPIRPSFPPTQQCHYSANNNPSPYPPPSYPQKPSLNQTTKLVYRTSNSKHHL

SEQ ID NO: 179031 - protein, 84 aa, Glycine max
  Coding DNA Sequence Number=SeqID_62253
MASYGDELLLDSLLLGVASPLSLPFSISLPFIFQEAKESIDEEDPRPTSSNGACIMWYQEHLHLDSYMMPMMKLSCGAELWLDL

SEQ ID NO: 179032 - protein, 1136 aa, Glycine max
  Coding DNA Sequence Number=SeqID_62254
  Homolog annotation: Hit_ID=Q6Z6I6; Match level="QueryCoverage=24%, HitCoverage=55%, E-value=2e-73, Identity=45%"; Hit description =Putative phosphatidylinositol/ phophatidylcholine transfer protein
  Pfam annotation: Domain name=CRAL_TRIO; Domain location=283-457; Score=-0.1; E_value=1.2e-05; Accession=PF00650.10; Description =CRALTRIO domain
  Pfam annotation: Domain name=CRAL_TRIO_N; Domain location=225-315; Score=40.2; E_value=7.1e-09; Accession=PF03765.5; Description =CRALTRIO, N-terminus
  Pfam annotation: Domain name=RRM_1; Domain location=552-623; Score =12.8; E_value=0.0094; Accession=PF00076.12; Description=RNA recognition motif. (a.k.a. RRM, R
  Pfam module annotation: Pfam domain module=CRAL_TRIO::CRAL_TRIO _N::RRM_1; Domain location=283-457::225-315::552-623
MALCSIFLNLHLLFFVCLTIEALGVAKPSVASYLCQEILAEQEADRVHELPAQPPVKFNNMVVISLLMKLKEEHCSICFSRPLTNQNKNPFFYGSMEVRVISSEFSFKILHATPNAFDNNVCSYFLHSLLSLRVSVSVCGSVRVSLVSILDPGLDLLLLKVVLVFPLVQRQSRCKLLVLNRMPREEVLAQEDERGRCFEPETSEDEWQKSRTRSLRRKAMTASTRLAYSLRKRNTRVANSDFASIFIEDVRDANEEKAVNSFRQVLLTRDLLPDSHDDYHEMLRFLKARKFDIDKKVQMWADMLHWRKEYGVDSILQEFVYKEYEEGFEKMFKEKFPACSIAAKRHIDKTTTILDVHGVNWVSFSKVAHDLVMRMQKIDGDNYPETLNQMFIVNAGSGFKLLWNTAKGNKFQSRLLQIIDTSQLPDFLGGSCSCPNDGGCLRSDKGPWNDPDILKLLHSREAMKLTKFGSSSVADGVDVKSYASKVKSTGISEPLSASEVRLNPSAFVQSVPSSEKRLGINFDVTQNVTHAHLIGEKHRALSWRNNKDITSFYFSHFPDSVNETYLWNLFQEWGKVWEVFIPQSKNKQGQRYGFVRFKGVEDAGWLERQLDNKIYIEGKKLFVNKPKFQRRGKREVGRTGGEVVRVRKVSMNPMEPKQARINSTTSTSMKSYAEAVKHDHKTKEKEITMPLMGKKGPEVPDVSVVIQTGKDKTSWLDNLWVGRLKNRGMFEKAVDEVQEMVGMDVKDTEHFQTLLSTFGEIVDLDEETADRSRLDVARILIRTKEKPIFSKSMMAMVNDNEHHLFLREEVARPIGKRGWRPELETFPPSSFTMVMEDSNKDSITCVPDGASSEYRRDGQRRRWTNDINLWCADSEVSSDGDVSPHQREPLHAMSLLHCATQQEVFNGPLTEPLHGSRMEARRISSLAQKTLPIKEKEDAGPKEDDIVKGADLRVLQYSPEDITPVLCPAVNTSLNSPTKVSHGLNNSIHNRGPKGVMQNLGLNIKGPESIGEVTTHNLKVYSKKKVGAGSRYSGHTKIAETSRNDNKSSPLDIADSGLIYREDDVSGGVHPADVVTPQTQTCLSPISSTSFTNALAEDEEVFHHEVARHLGLTFDGHFSEDAVASPAMMGRNTLAS

SEQ ID NO: 179033 - protein, 110 aa, Glycine max
  Coding DNA Sequence Number=SeqID_62255
MPKVDAQVPDWVQQHTWIHGIQIPITLWVIWRARNKSILRRRWGQLLSDMRKWICWVRPPLRAVTLKVNGSMMGSPPRAGFGGLCRVHHGSFLVGLYGHVGGQEILYAEI

SEQ ID NO: 179034 - protein, 181 aa, Glycine max
  Coding DNA Sequence Number=SeqID_62256
  Gene Ontology: Mol. function=transporter activity; Cellular component= intracellular; Biological process=transport
  Homolog annotation: Hit_ID=Q9LRX7; Match level="QueryCoverage=74%, HitCoverage=20%, E-value=4e-16, Identity=37%"; Hit description =Phosphatidylinositol/phosphatidylcholine transfer protein-like
MASYGGDSNNNYLRRLQEKPIPYIISILAQIAVKLLTCIYVVFAALGKCFVVRSVDNQPRSHEKTKSAQSNSEEQLMTPAIKEPLWQRIQNLEAVVTEMANKPNTIPPEKEDILQESLSRIKCIEYDLQKTKKALLATASKQVELAESLESLKESKFDETLPSGLRLLEECGLWGVHSPNV

SEQ ID NO: 179035 - protein, 274 aa, Glycine max
  Coding DNA Sequence Number=SeqID_62257
  Homolog annotation: Hit_ID=Q9LRX3; Match level="QueryCoverage=48%, HitCoverage=6%, E-value=1e-26, Identity=52%"; Hit description =Arabidopsis thaliana genomic DNA, chromosome 3, TAC clone:K7P8
MSGYHLVGSCNGLHCGVSEIPKGYHVCFWNKATRVISRESSALSFSPGIGRRTMFGFGNDPSSDKYKVVAIALTMLSLDVSEKTEMKVFGVGDNSWRNLKGFPVLWTLPEVGGVYLSGTINWVVIKGKETIHSEIRDHAKKRLDSHHFEPNGSSGLYGQHSVKKLKPTKQSLDNFDNVAPIANSIPSPAASQMSNMSSPSKFIRIISGGRDRGRKAKALKVSVGQPGSGSPWSLFEEQALVVLVHDMGPNWELVSDAINSTREGFRSYDLTRMT

SEQ ID NO: 179036 - protein, 234 aa, Glycine max
  Coding DNA Sequence Number=SeqID_62258
  Gene Ontology: Cellular component=integral to membrane; Biological process=defense response to bacterium
  Homolog annotation: Hit_ID=Q9ZV02; Match level="QueryCoverage=73%, HitCoverage=66%, E-value=3e-21, Identity=32%"; Hit description =Similar to MtN3 protein
  Pfam annotation: Domain name=MtN3_slv; Domain location=51-136; Score =48.3; E_value=2.6e-11; Accession=PF03083.6; Description=MtN3saliva family
MEVAYLIICYIYANFRAKTVIVRWVFLFNGATYLVILFLTSLVSPLSNRLKVVGWICATFSVGVYVTSLINPMMRTVVRTKCISMPLLISLTLSSIVWFFYGFFSHDYFIVMPNVLHFWLGVAQMILCFIYRNGGADERERVQSETGEINNENDEILETIEMQIAEAKNTNVDHQTDNDDIKKKENGSSSRVELEPCEIVHLQNNIVVVTRNGTRIVCNEIQSVAEPEIVEIPG

SEQ ID NO: 179037 - protein, 332 aa, Glycine max
  Coding DNA Sequence Number=SeqID_62259
  Homolog annotation: Hit_ID=Q2QP93; Match level="QueryCoverage=46%, HitCoverage=79%, E-value=8e-16, Identity=36%"; Hit description =Expressed protein
  Pfam annotation: Domain name=rRNA_processing; Domain location=58-184; Score=-42.9; E_value=0.0014; Accession=PF08524.2; Description=rRNA processing
MKKNEERSDNQSMKKKQIMMKKKNVSRLGGSGLSLNAFANAKFKNNHYNPAIIKKQREFYKNAKNVNKFKKLVKQQNQQNEPSLAQRHIENVNETEENKDDSERRKRKNSALSLEELYKKQHEEKEKEIMEREAVLRVKKEEREQAEARRKAMREKMLKKTRKGQPVMKYRIEHLLETIQGSTKNAAGTVIITEVIVVVATILARIKLKRVSIYLAMRGRGNEDGTSPVNCFQLYELHQIKSQRKSVAIDRDILGREKGQGQRCTTTRLLGEEQMIMRVRAITSAMRSPMKSIHNSVQAIVVPWSCVSLALPKRSKGKIRSCMATVFAYLIL

SEQ ID NO: 179038 - protein, 583 aa, Glycine max
  Coding DNA Sequence Number=SeqID_62260
  Gene Ontology: Mol. function=protein binding; Cellular component =nucleus; Biological process=multicellular organismal development
  Homolog annotation: Hit_ID=Q570C0; Match level="QueryCoverage=98%, HitCoverage=96%, E-value=0.0, Identity=77%"; Hit description =TRANSPORT INHIBITOR RESPONSE 1 protein
  Pfam annotation: Domain name=LRR_1; Domain location=104-130; Score =3.0; E_value=78; Accession=PF00560.23; Description=Leucine Rich Repeat
  Pfam annotation: Domain name=LRR_1; Domain location=155-177; Score =12.0; E_value=1.6; Accession=PF00560.23; Description=Leucine Rich Repeat
  Pfam annotation: Domain name=LRR_1; Domain location=210-232; Score =4.8; E_value=36; Accession=PF00560.23; Description=Leucine Rich Repeat
  Pfam annotation: Domain name=LRR_1; Domain location=288-314; Score =3.9; E_value=53; Accession=PF00560.23; Description=Leucine Rich Repeat
  Pfam annotation: Domain name=LRR_1; Domain location=480-503; Score =6.6; E_value=16; Accession=PF00560.23; Description=Leucine Rich Repeat
  Pfam annotation: Domain name=LRR_2; Domain location=183-209; Score =0.5; E_value=14; Accession=PF07723.3; Description=Leucine Rich Repeat
  Pfam annotation: Domain name=LRR_2; Domain location=210-233; Score =13.9; E_value=0.2; Accession=PF07723.3; Description=Leucine Rich Repeat
  Pfam annotation: Domain name=LRR_2; Domain location=288-312; Score =15.6; E_value=0.12; Accession=PF07723.3; Description=Leucine Rich Repeat
  Pfam annotation: Domain name=LRR_2; Domain location=454-479; Score =0.6; E_value=13; Accession=PF07723.3; Description=Leucine Rich Repeat
  Pfam module annotation: Pfam domain module=LRR_1::LRR_1::LRR_1::LRR _1::LRR_1::LRR_2::LRR_2::LRR_2::LRR_2; Domain location=104-130::155 -177::210-232::288-314::480-503::183-209::210-233::288-312::454-479
MAYTFSFPEEVLEHVFSFIWSERDRNAISLVCKSWYEIERWCRRKVFVGNCYAVSPLMVIKRFPELRSIALKGKPHFADFNLVPEGWGGYVCPWIAAMARAFPCLEEIRLKRMVITDESLELIAKSFKNFKVLVLTSCEGFTADGLTAIASNCRNLRELDLQESEVEDLSGHWLSHFPDSYTSLVSLNISCLNHEVSLSALERLLGRCRNLRTLRLNRAVPLDRLPNLLLRCPQLVELGTGVYSTEMRPEVFSNLEAAFSGCKQLKSLSGFWDVLPSYLPAVYPICSRLTSLNLSYAIIQSSDLIKLISQCPNLLRLWVLDYIEDAGLYALAASCKDLRELRVFPSEPFGLEPNVSLTEQGLVSVSEGCPKLQSVLYFCRQMSNAALHTIARNRPNLTRFRLCIIEPRTPDYLTLEPLDSGFGAIVEQCKDLQRLSLSGLLTDRVFEYIGTYAKKLEMLSVAFAGDSDLGLHHVLSGCDNLRKLEIRDCPFGDKALLANAEKLETMRSLWMSSCSVSYGACKLLGQKMPRLNVEVIDERGPPDSRPDDCPVEKLYIYRTVAGPRLDMPGFVWTMEDDSSLRLE

SEQ ID NO: 179039 - protein, 169 aa, Glycine max
  Coding DNA Sequence Number=SeqID_62261
SLTKWGIDGVDLDLEPGYTDAGFNAGDWELYIKAFAKYFGPGSNSGKLLIIDTNVGLSELGVSSATLSKIDLIYIQDYWGSEASSDNKIDGYIQSGFPKKNILLISADFESSYSYSNDSQGPLRLKKYYTSTKYQAKAGGYGAYGFNFDKKQDYKIYSEMITSINQLNQ

SEQ ID NO: 179040 - protein, 63 aa, Glycine max
  Coding DNA Sequence Number=SeqID_62262
MTGMTLRCHVNLLLRTTKRRRRVKKMTGMTKNQPSQWWWLDSHTTSNRSPWLQSTLSGFLALE

SEQ ID NO: 179041 - protein, 179 aa, Glycine max
  Coding DNA Sequence Number=SeqID_62263
  Gene Ontology: Mol. function=oxidoreductase activity; Cellular component=intrinsic to endoplasmic reticulum membrane; Biological process=electron transport
  Homolog annotation: Hit_ID=Q9FVQ0; Match level="QueryCoverage=46%, HitCoverage=21%, E-value=2e-20, Identity=51%"; Hit description =Flavin-containing monooxygenase, putative
  Pfam annotation: Domain name=Pyr_redox; Domain location=72-138; Score= 0.9; E_value=0.013; Accession=PF00070.17; Description=Pyridine nucleotide-disulphide oxidor
MAYKWTSKRGMKTFHTYRRSGEVEEYAGWYLVLASGETAEPRVPQIEGLESFNGKVIHSTGYNNGKEFKDKLVLVVGSGNSGMEIALDLSNFGAKPSIIVRSPIGVASGNRSKSIRGDEVLFRDGKSRPFDSIVFCTRFKRSTQKWLQIINLVAETVHDTFFFRDMLGAPSNIAGAPSN

SEQ ID NO: 179042 - protein, 88 aa, Glycine max
  Coding DNA Sequence Number=SeqID_62264
  Subcellular localization annotation: CTP_CleavageSite=37; ConfidenceScore=5.62e-01
MASFWSFLAMLMAMLACSCSLALASSSQQSMQVTSITAAPASAPLVSPTQSPDIEPLFPTPGAGTVLDSLPSEAPAFHYSYQPLYSIS

SEQ ID NO: 179043 - protein, 94 aa, Glycine max
  Coding DNA Sequence Number=SeqID_62265
MSHNIKSWAHSLIYTIISSQVKFHRVKCHNVRVAEKLKIRDVRNGIRANLSPSMVWFEDERGECWWTCNTLMNHTKKKEIHTSCKYETVQMMMT

SEQ ID NO: 179044 - protein, 124 aa, Glycine max
  Coding DNA Sequence Number=SeqID_62266
  Gene Ontology: Mol. function=sodium:hydrogen antiporter activity; Cellular component=integral to membrane; Biological process=sodium ion transport
  Homolog annotation: Hit_ID=Q93YH1; Match level="QueryCoverage=99%, HitCoverage=25%, E-value=9e-38, Identity=66%"; Hit description =Na+/H+ antiporter, isoform 2
MASELEISPADARKAPGKEQQAAGVGILLQIMMLVLSFVLGHVLRRKKVYIIPEASASLLIGLIVGILANISDTETNIRLFSGADIGIVDFPQGVKPFFSNFGAIVTFAIFGTFIASIVTGILV

SEQ ID NO: 179045 - protein, 246 aa, Glycine max
  Coding DNA Sequence Number=SeqID_62267
  Gene Ontology: Mol. function=two-component sensor activity; Cellular component=membrane; Biological process=two-component signal transduction system (phosphorelay)
  Homolog annotation: Hit_ID=Q6D2E7; Match level="QueryCoverage=84%, HitCoverage=40%, E-value=5e-45, Identity=42%"; Hit description =Putative regulator
MTFKRKNEAAIISGSSLLRSILLSGGLLICAIIALTLWTLREDWHGAVRQTEEMAVNLSLSQSRQAEDTVLQTELALREVQRDLQAQPLEKLNAANLSQIMRDLQSRLPQLHGLFYYDEQGRWIATSTRSVPVGTNNSDREYFRYHRNNSRDSLHIGPVIRSRSTGDLVIPVSLRVSDAARDFKGILLATIKVDYFRRIYSYYELGPRDVLGTDAGRTSTVLYARSMPDSYIGKSLSASHLFQQML

SEQ ID NO: 179046 - protein, 120 aa, Glycine max
  Coding DNA Sequence Number=SeqID_62268
MKKELMDKLQRLRQGSVIVKEYRQQMEVLLLRVGLRQEERTSIATFLSGLNMKVRDKDQAQGILGATPSKPKEDKGKTIEKCGSKAFQVYFDHAKDSSQEPKVKQVSRIKESFNQDSRLK

SEQ ID NO: 179047 - protein, 51 aa, Glycine max
  Coding DNA Sequence Number=SeqID_62269
MWAIIDEYKEKLNLAATHKQRLEDEYTKIPVEREAREREPLRQLYCRFDFV

SEQ ID NO: 179048 - protein, 325 aa, Glycine max
  Coding DNA Sequence Number=SeqID_62270
  Gene Ontology: Mol. function=DNA binding
  Homolog annotation: Hit_ID=Q1S0F5; Match level="QueryCoverage=54%, HitCoverage=36%, E-value=4e-17, Identity=32%"; Hit description=IMP dehydrogenase/GMP reductase
MGQLQRQAFRKAYGKIWDLAMVEVSVEAIASLTQYYDHPLRCFTFEDFQQVPIVEEFEEILGCPLGGRKAYLFSGFYPSMARVSKVVKILAQELDQVKQNKNEVVRVPRRFLEGKAKASVNQGEWVSFIDILALLVFGVVLFPNMEGLVDVAAIDAFLAFHHSKESSVVAILADMYDTFDHSCTEKGKANWDQLLASMEGGDPNARVLQGVHKAWDAARRKDKELRGSNNGIIGGYRKWLRVRTQGLDWLPKLRVVRNKEAEALEESEEVQALKTELERARAIKEKFKSMAIKVQREYDELRDVNMATTEALERETKRARKEEHG

SEQ ID NO: 179049 - protein, 49 aa, Glycine max
  Coding DNA Sequence Number=SeqID_62271
MENWRIALRNNFAWLQTRSGEWRNGEQRYAITSRGSRLEGGGHMNSARQ

SEQ ID NO: 179050 - protein, 82 aa, Glycine max
  Coding DNA Sequence Number=SeqID_62272
MEREEKREVYWIRCSSEENNVEEGIGAGCALEAPWHRVSVAAFWEKGLSRGRENKKTAFLTFCIYRWRRAVIDYTVIVIDYM

SEQ ID NO: 179051 - protein, 101 aa, Glycine max
  Coding DNA Sequence Number=SeqID_62273
  Subcellular localization annotation: CTP_CleavageSite=69; ConfidenceScore=5.76e-01
MALRSNKMARNFKLSSTLVPSGGVYVGFSSSHSSKSSVGGSVGSSEGFPAVLKTMWDNVGVERAVADFRREEKEKSDFRQEEKEKSECKVFKHAGCEMSTF

SEQ ID NO: 179052 - protein, 102 aa, Glycine max
  Coding DNA Sequence Number=SeqID_62274
  Subcellular localization annotation: CTP_CleavageSite=24; ConfidenceScore=5.06e-01
MVCRDVSFQKKILNFFTGNRLLVVATYPLAGGRRRPHGCVFPERKMRGVATNVYLRKTLEKPERCGLQTLIVKGSGVIFTHWEGCFPRSYVSSIAMREIKSM

SEQ ID NO: 179053 - protein, 130 aa, Glycine max
  Coding DNA Sequence Number=SeqID_62275
  Gene Ontology: Mol. function=unspecific monooxygenase activity
  Homolog annotation: Hit_ID=O04892; Match level="QueryCoverage=71%, HitCoverage=17%, E-value=3e-28, Identity=79%"; Hit description =Cytochrome P450 like_TBP
STARRVVSGAPPAALEIRRTECLPRPVVLITASGLQGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 179054 - protein, 293 aa, Glycine max
  Coding DNA Sequence Number=SeqID_62276
  Gene Ontology: Mol. function=tRNA isopentenyltransferase activity; Cellular component=intracellular; Biological process=tRNA processing
  Homolog annotation: Hit_ID=Q09Q94; Match level="QueryCoverage=89%, HitCoverage=84%, E-value=9e-61, Identity=44%"; Hit description =Isopentenyltransferase
  Pfam annotation: Domain name=IPPT; Domain location=49-230; Score= -41.1; E_value=3.9e-08; Accession=PF01715.8; Description=IPP transferase
MAPLSCSTPFLTEKKKVLFIMGATERGKTKLSINLDTQFPSEIINSDKIQIYKGLDIITNKVPESECRGISHHLIGIINDPDYDFTVDDFCKHVLNALDLIFENGHLPIIVGGSNTYLATLLEDLNMTFHSKYDCCFIWYLDKRVDKMVDAGVVDEIQENFVPGANYSRGVRRAIRVPELGEYFLVEKEISDKAEKEKMLQHAIARTKENTCKLVEMQLLKIHRINYELGWGMTKIDSTVVFEAILKGVDYKNLYHEIIFKPSMEIVKRFLQETTRMWGKTPCQYDEQVTIYT

SEQ ID NO: 179055 - protein, 224 aa, Glycine max
  Coding DNA Sequence Number=SeqID_62277
MQDEDPAAALRLLLTTSQADISSEKIPGASSSSDAEINSSVRQDSLLLKLSMEYAREDVFKSIEENPSAAFGHLNFLKKLHNPLTSDEILGKVIQIEAIIDQFATRAAQHEVERLTKEAKEGSSEIKACDDNISSWEATITDLLSQVDDLRQKIVTEQAKRKELQEKAANSIQKLVAEKGREGLKAFSASQAIADEARVMESADQVLTKEMATLKKLYEDLVMH

SEQ ID NO: 179056 - protein, 147 aa, Glycine max
  Coding DNA Sequence Number=SeqID_62278
  Gene Ontology: Mol. function=structural constituent of ribosome; Cellular component=ribonucleoprotein complex; Biological process =translation
  Homolog annotation: Hit_ID=Q9TJW3; Match level="QueryCoverage=91%, HitCoverage=81%, E-value=7e-57, Identity=71%"; Hit description =Ribosomal protein S4
  Pfam annotation: Domain name=Ribosomal_S4; Domain location=2-65; Score=43.2; E_value=8.8e-10; Accession=PF00163.9; Description =Ribosomal protein S4S9 N-terminal domain
  Pfam annotation: Domain name=S4; Domain location=66-113; Score=91.3; E_value=2.9e-24; Accession=PF01479.15; Description=S4 domain
  Pfam module annotation: Pfam domain module=Ribosomal_S4::S4; Domain location=2-65::66-113
  Subcellular localization annotation: CTP_CleavageSite=47; ConfidenceScore=5.01e-01
MSRYRGPRFKKIRRLGSLPGLTSKRPTVKSELRNQSRSKRQLLKYVRIAGKAKGSTGQVLLQLLEMRLDNILFRLGMAATIPQARQLINHRHVLVNGHIVDIPSYRCKPQDIITAKDEQKSKTLIQNYLDSAPRENCQIIDSSPIPI

SEQ ID NO: 179057 - protein, 74 aa, Glycine max
  Coding DNA Sequence Number=SeqID_62279
MTKLGLCLSSGPPPLDDKRVRITVRMTKLGLCLSSGPPPLDDKRVRITIRYLRVSWVQNDQTWSLLVIGPAASG

SEQ ID NO: 179058 - protein, 51 aa, Glycine max
  Coding DNA Sequence Number=SeqID_62280
MRVIEGGILETRLLCRLTRIPQEELSSTFLNLDLDHITMLCGNSCVSFGCM

SEQ ID NO: 179059 - protein, 107 aa, Glycine max
  Coding DNA Sequence Number=SeqID_62281
MVGRIFNSKKYAVGRDIRNDVYALPEYTTHLWLHLHLQLRFPPLRDKCQNHFPQPRHLLNCPEIADLSVEPCDGEFVIVVVFEIKNTEIPAFIEKESGRARQVHRIA

SEQ ID NO: 179060 - protein, 418 aa, Glycine max
  Coding DNA Sequence Number=SeqID_62282
  Gene Ontology: Mol. function=sequence-specific DNA binding; Cellular component=intracellular; Biological process=response to DNA damage stimulus
  Homolog annotation: Hit_ID=Q6DAV7; Match level="QueryCoverage=51%, HitCoverage=97%, E-value=3e-74, Identity=66%"; Hit description=DNA repair protein radC homolog
  Pfam annotation: Domain name=HHH; Domain location=176-205; Score =17.8; E_value=0.016; Accession=PF00633.13; Description=Helix-hairpin- helix motif
  Pfam annotation: Domain name=RadC; Domain location=220-344; Score =255.8; E_value=9e-74; Accession=PF04002.6; Description=RadC, DNA repair protein
  Pfam annotation: Domain name=Ribosomal_L28; Domain location=345-403; Score=-1.9; E_value=0.079; Accession=PF00830.9; Description =Ribosomal L28 family
  Pfam module annotation: Pfam domain module=HHH::RadC::Ribosomal_L28; Domain location=176-205::220-344::345-403
MATGAALARQAVVTRSFAMPAVMRAIRSAVIKHRIAGNRLQAERRNKGFGRIGHHHADIRAAIAQTAHQFRVPRLARQMQATLSQNRRPAFSLPAPFASRLWNLSRAAGGLQCTGAEWRHCREGGTMTELAPREKLTLLGAEALSDAELLAIFLRTGTRGNSVMGLARLMLNEFGSLYRIMTASKEELGQIKGVGSAKMTQLHAIAELGRRFFASQLARENVMENPQVTRHYLQSVLAHQEREIFMALFLDNQHRVLQAQKMFSGSIASVEVHPREIVREALKLNAAAVILAHNHPSGMAEPSRADREITSKVAQACALLNIRLLDHLVIGHGEFTSFAERGWLGVYYATFENLGFGVWASLAGSHGTRLGGLRPDEAAKTYEKRFVTLRVSAKGMRVIDKKGIDTVLAEIRARGEKY

SEQ ID NO: 179061 - protein, 119 aa, Glycine max
  Coding DNA Sequence Number=SeqID_62283
  Gene Ontology: Mol. function=ammonia ligase activity; Cellular component=cytoplasm; Biological process=L-phenylalanine catabolic process
  Homolog annotation: Hit_ID=Q0QGJ2; Match level="QueryCoverage=74%, HitCoverage=12%, E-value=9e-39, Identity=88%"; Hit description =Phenylalanine ammonia lyase
MVEEYRRPVVKLGGETLTISQVAAIAAHDQGVKVELAESSRAGVKASSDWVMESMDKGTDSYGVTTGFGATSHRRTKQGGALQKELISYTIDVGSATLHYTANCTRCCTSRINEQKQYS

SEQ ID NO: 179062 - protein, 182 aa, Glycine max
  Coding DNA Sequence Number=SeqID_62284
  Homolog annotation: Hit_ID=Q1RVN3; Match level="QueryCoverage=43%, HitCoverage=11%, E-value=1e-08, Identity=37%"; Hit description =Nucleotide-binding, alpha-beta plait
  Pfam annotation: Domain name=RRM_1; Domain location=78-148; Score =23.4; E_value=0.0008; Accession=PF00076.12; Description=RNA recognition motif. (a.k.a. RRM, R
MERNRHGEEPYGGRRVNIFGRDNDYAEEENWTKVVSRRSMKVMQKSSLAGRQSQNLEIGDNNKHYRLNWRNNADITSFYFTHFPDEANEELLWRHFKNWGDVREVYIAKRLNKDGRRYGFMRFKGVSDAKGLEVRLDNIFINDCKLFVNLPRFDRPVRNTRVAEKEPHWEEVHRRKQVSPAG

SEQ ID NO: 179063 - protein, 280 aa, Glycine max
  Coding DNA Sequence Number=SeqID_62285
  Gene Ontology: Mol. function=drug transporter activity; Cellular component=membrane; Biological process=multidrug transport
  Homolog annotation: Hit_ID=Q9SFB0; Match level="QueryCoverage=98%, HitCoverage=60%, E-value=4e-74, Identity=59%"; Hit description =Putative integral membrane protein
  Pfam annotation: Domain name=MatE; Domain location=96-233; Score= -29.3; E_value=0.069; Accession=PF01554.9; Description=MatE
DSPMLNPAEKYLRLRSFGAPAVLLSLAMQGIFGGFKDTATPLYVIVSGYSLNVILDPILIFTLKLGIEGAAIAHVLSQRIFDAKSNSSDILCDLGSIIGIKARFNSYGSISNMLTGLVDIVPPSRWFGCCCSACSFAEKDHKKTTAAATRTLQMSFVLGVGLSLAVGLGLYFGAGVFSRNVHVVHLIKIGIPFVAATQPINSLAFVFDGVNYGASDFAYSAYSLASSGVTSKCSYRTPSLQDQTFRWDLDCTNHLYDSSHVGWMGTGTGPWRYLRDGSLP

SEQ ID NO: 179064 - protein, 90 aa, Glycine max
  Coding DNA Sequence Number=SeqID_62286
MARRGCNIVEVGLWPRKMKELQQCRRERFKPRVGVTVDARGGSLSEAVVSSVLSARSALSQISLTRAKRENGAKRAFEVLRGGGDIPTAL

SEQ ID NO: 179065 - protein, 127 aa, Glycine max
  Coding DNA Sequence Number=SeqID_62287
MTTLVSACYRTLSLTDSERVFIRITTWVRITETVCTDNHLGISIRQLTSRVRMIETVCTDKHMGITVRNLTSWVRMTETVCTDNRLGISIRHLTSWFRMTESAKDDVNLHMSTSSLAPIDKGCRRRR

SEQ ID NO: 179066 - protein, 92 aa, Glycine max
  Coding DNA Sequence Number=SeqID_62288
MQSLQNVVHQRSVMSVEEFIQQVAWPGVQPSPLGGGEASAAQEPQQEDIPEAAEPTPPEPFTLESDPIIVQADPAISPQPEPSALVSDLPLS

SEQ ID NO: 179067 - protein, 80 aa, Glycine max
  Coding DNA Sequence Number=SeqID_62289
MAQSSKKKDPKELELLVLEGEEGADVEGAEVRGAEVDGASDPLALDLWVPRKVTEGLSRDSKVRESDVTPRGLYKAVIRA

SEQ ID NO: 179068 - protein, 323 aa, Glycine max
  Coding DNA Sequence Number=SeqID_62290
MIKPSMLTKIHFETAKTRFLQQRDPKIPNLQNLISPSILDQITTYKAQNSSFFILFHLHQSKLPKNPSNGRTIEEAKGRFDFIRSHRNSKLRSIQSADNQNSSLHIISYFFDDEVFDCFQAFQNFGLIQFISMKLPFCPELVKASYSILEIQEDSLIYEVYGIKMVIDQSLLFELTQLSCDGVPFEGTLDDEWKFDFSVSDARRMVCTNQADMTGRLLAGSLAFECRIMHYFIICILLPRSSNLTHPFVKVKRSFSICSNVVSSFGYRKERDGSWVKKDAPVQAAEDRSPSPQPQRDDSSSLMHNILDRLDGLHTFVGDALTR

SEQ ID NO: 179069 - protein, 215 aa, Glycine max
  Coding DNA Sequence Number=SeqID_62291
MAYGHGLYLLLTDADAPIPVPTDEVSLVGQALHTFLAWPTHLVKSLSQQVAVSSPKPPPKPDPEVNDPLYLMTLTIPELFLRPYQVRWDATVFGVVNPDFPLYIKHEDLSEIAHGGQCLSISVLQLWIQHLTETCMRVGNSDIYGFLEPRSIQRSGQSQFEFESYIKSWMQSSQRDVYLGAYLNGPDNYLKGIINRVLMMLHSLNQRLLLGGLSS

SEQ ID NO: 179070 - protein, 123 aa, Glycine max
  Coding DNA Sequence Number=SeqID_62292
  Subcellular localization annotation: CTP_CleavageSite=25; ConfidenceScore=5.01e-01
MRISLKRVVPCQYVLVCSSLSEAVVSSALSARLALSQISLTRAKFENGAKRAFEVRKPFLSLICTKKRKGEHDNVKDALNFSIDNCTVSLELDRAGLYNYSARHSVQGSKFNKRHLRMKLSLN

SEQ ID NO: 179071 - protein, 54 aa, Glycine max
  Coding DNA Sequence Number=SeqID_62293
MASGTPIIFEAGLPLVDATHELGGNLLPFFPINRQKRAVLRIPNPQAMHFSCFG

SEQ ID NO: 179072 - protein, 212 aa, Glycine max
  Coding DNA Sequence Number=SeqID_62294
  Gene Ontology: Mol. function=DNA binding
  Homolog annotation: Hit_ID=Q1RTB4; Match level="QueryCoverage=93%, HitCoverage=49%, E-value=1e-20, Identity=29%"; Hit description=IMP dehydrogenase/GMP reductase
MIEVSTEAIASLAQYYDQPLRCFTFGDFQLSPMVEEFEEILGCPLGGRKPYLFTGFYPSLARISKIVQISAQELDHRKQVENGVVGIPRKYLEVKARILADKGEWIPFIDILTLLIFGGVLFPNVDGLVDLAAIDAFLAYHNHKESLVVAMLADLYDTFDRKCEKNNTRIVCCTPALYVWGCISYNPVLAIRQLGYPMRGAPLEEEIVPVIS

SEQ ID NO: 179073 - protein, 71 aa, Glycine max
  Coding DNA Sequence Number=SeqID_62295
MQSSKRDVYLGAYLNGALKGLDDAPQPKSKAPARWIVVKCNRQKGSTECSYYVMHWMSTIILGSFRNNWEV

SEQ ID NO: 179074 - protein, 315 aa, Glycine max
  Coding DNA Sequence Number=SeqID_62296
  Gene Ontology: Mol. function=DNA binding; Cellular component=nucleus; Biological process=regulation of transcription, DNA-dependent
  Homolog annotation: Hit_ID=Q70KC5; Match level="QueryCoverage=96%, HitCoverage=97%, E-value=3e-81, Identity=54%"; Hit description=MYB transcription factor
  Pfam annotation: Domain name=Myb_DNA-binding; Domain location=22-69; Score=39.4; E_value=1.2e-08; Accession=PF00249.21; Description=Myb -like DNA-binding domain
  Pfam annotation: Domain name=Myb_DNA-binding; Domain location=75-120; Score=49.8; E_value=9.3e-12; Accession=PF00249.21; Description=Myb -like DNA-binding domain
  Pfam module annotation: Pfam domain module=Myb_DNA-binding::Myb_DNA -binding; Domain location=22-69::75-120
MRKPDLMANKDKMNNIKSKLRKGLWSPDEDERLVRYMLTNGQGCWSDIARNAGLQRCGKSCRLRWINYLRPDLKRGAFSPQEEDLIVHLHSILGNRWSQIAARLPGRTDNEIKNFWNSTLKKRLKTNTSTPSLNNSTGSSESNKDVLSGIMPFNEHDIMTMCMDSSSSISSMQAMVLPDQFDPFFMLANNQCDMTNVSSDFSNMPAACLTQIGMVDGHQGNYGILEPNKMGSGIDFSLPSLESRSIESNSVPIDVKSHNNHFNYGSFKNTDKIQGSKVEDLIGFGNHGQGENLKMGEWDLENLMQDITSFPFLDF

SEQ ID NO: 179075 - protein, 239 aa, Glycine max
  Coding DNA Sequence Number=SeqID_62297
ADSSHRDRYSIACFKRYEIARRGLRSTDRDRPANAMRKSSSFLAQDLSWKTPDWIPSSILYPISMRALKSDNTGCRSGMRSSISNSTSVFSRLIQDGGLFQSQLINIEGWRAVLATLTTVDLPPGTYDRFRLGRAFASVASAFSPEYQQPAHGDVPLTGFRTQPSSEPSATKSHGGLWLEPITNLKSTSAGRQMRAPVVAVLNERQVWNQTGAPLHLFPLTTTKPLTAPPRLLAPFLLQ

SEQ ID NO: 179076 - protein, 385 aa, Glycine max
  Coding DNA Sequence Number=SeqID_62298
  Gene Ontology: Mol. function=helicase activity; Biological process =viral genome replication
  Homolog annotation: Hit_ID=Q9LTU4; Match level="QueryCoverage=99%, HitCoverage=26%, E-value=1e-106, Identity=52%"; Hit description =Helicase-like protein
  Pfam annotation: Domain name=DUF889; Domain location=92-343; Score =430.4; E_value=2.4e-126; Accession=PF05970.5; Description=Eukaryotic protein of unknown function (DUF889)
MVASSGIASLLLPEGRTAHSKFKIPISVFEDSTCNIYQGTQLAELLNETSPIIWDEAPMAHKFCFEALDHSLRDIVKHNSKDNKIFGGKVMVFGGDFRKILPVIPRGSRSDIVNATINSSYLWDHCQILRLTKNMRLQNNMQATNQEETAAFAQWIIDIGDDIIGDENDGYATIEIPQELLITEYNDPIHSIISSTFPDLSHHHNDPEYFQTRAILASTNETVQQVNDYMLIMIPGEQMEYLSYNSVDKSEKIESCHFRSLTTEFLNSSTTSGLPNYCLKLKIGTPIMLLRNLDQTQGLCNGTRLIITRLAKHVIAADIISGTNIGDHVYIPRMSLLPSQSPWPFKLLRRQFPIMLSYAMTITKSQGQSLSSVGLYLPKPVLSHD

SEQ ID NO: 179077 - protein, 134 aa, Glycine max
  Coding DNA Sequence Number=SeqID_62299
MEFQAHEMLKQKNLEKQVKYPTFEDLWFTFHEAESGSAVAVAQNGEINLDREVKTRESSEGSPEQSNPTKILATSNAFDAATHNVGSHLQGNFIEPSSVSLFKEFMTKFRSSLRSHSNLSLLLITIVALIFFIQ

SEQ ID NO: 179078 - protein, 452 aa, Glycine max
  Coding DNA Sequence Number=SeqID_62300
  Gene Ontology: Mol. function=nucleoside-triphosphatase activity; Cellular component=membrane; Biological process=carbohydrate transport
  Homolog annotation: Hit_ID=Q8YCU6; Match level="QueryCoverage=66%, HitCoverage=93%, E-value=1e-124, Identity=56%"; Hit description =RIBOSE TRANSPORT ATP-BINDING PROTEIN RBSA
  Pfam annotation: Domain name=ABC_tran; Domain location=182-368; Score= 187.4; E_value=3.5e-53; Accession=PF00005.17; Description=ABC transporter
DVEARPVDAATLAAALNSDRQQTVARYGVGSPLPVLPVKLQGVVQPGQMGVFPLQVAGLPAGTQLRLQTGPAITGTDLRDASGKIQFGDFTNQIEYQNAGAAINRAMKAAVLEKLDRDALPGKTVQSDQLADYAGARGGAMKPFNVNPALLKGEVILQARNVSKVYGSTHALKGVNFEIRRGEVTTLFGENGAGKSTLMKILSGVITPTSGEILLNGEAKVFRSATEARDCGISIIHQELNLAPNMNVRDNIFMGREIMRPGGVDYAEEARLTRHLMAALEEEIDPLTPVENLRLGQQQIVEIARALSVNSQILIMDEPTSALSAAEVAVLFQVIRDLTSQGVAIVYISHHLEEALEITDRAVVLRDGVMTAYARRDEIDLEWIVRNMVGEHFDLGSPPGGYAFGGDALTVQALTVKSKTGIRLVDQLSLTVQAGEIVCIYGLMGAGRTELL

SEQ ID NO: 179079 - protein, 542 aa, Glycine max
  Coding DNA Sequence Number=SeqID_62301
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-58, Identity=28%"; Hit description= UPI00006A17C9 related cluster
MARACSPLIARACSPLKGRASEDVQSSEGKDVQPSESEGVQPSEGEGVWPSEGEDVWPSDGEDVRPSEGEDMKPSEGKDMRPSEGEDLWPSEVEGVRPSNREGVKPSEGEDPYEGEESSPLKARTNSPLKVKACSSQKARTCNPMTARTCSLLKSRTCSPLKARTCSPLKATTCSPLKARTDNPLKVTTCSPRKERACSPSKAGVCGSRKARTCNTLKARTCSFLKVRTCSPLKARTCCPLKERRCSPLKSRTCSPLKMRTCSPLKAWTCNPLKTRACSPLKTKACSPLKAWACNPPKVRACSPLKLRACSPLKARACSPLKARTCNPLKARMCSPRKARACSQPKARVCNPQKARACGPRKARTCGPQKGRTCHPLRARTCGPLKAKTCSPLKARTCSPLKARGEGMEPSEGEDVQSSEGEESRPLKARTCNPLKVRMCNTLKVRACCPLMAITCSLLKARTCRPLKAKACSPLMARTCSPLKVRACSPLMGRMCSHLKGRACSPLKARTRSLLKARTRSPLKVRMRSPLKARACNPLKAR

SEQ ID NO: 179080 - protein, 80 aa, Glycine max
  Coding DNA Sequence Number=SeqID_62302
  Gene Ontology: Mol. function=transferase activity, transferring glycosyl groups; Biological process=metabolic process
  Homolog annotation: Hit_ID=Q43716; Match level="QueryCoverage=82%, HitCoverage=14%, E-value=8e-13, Identity=54%"; Hit description =Anthocyanidin 3-O-glucosyltransferase
MEIKRKKDVISFAMLIAKDLEVGIEVNRSEDGDFKKEDILKAVKTIMVEDDKDPGKHIKENHMKWKEFLSRFGNSEQIHH

SEQ ID NO: 179081 - protein, 114 aa, Glycine max
  Coding DNA Sequence Number=SeqID_62303
MLETFKQQDQMSVLELYIEKDVAGGSMFHSANSLTSCGNYLSNDETQPPINMSNLHVDEDDDDDDDDDYYLVSNSYVEESLDKDDSVDGISDTDDEVTDMIQPIRIVHPAEGAQ

SEQ ID NO: 179082 - protein, 529 aa, Glycine max
  Coding DNA Sequence Number=SeqID_62304
  Gene Ontology: Mol. function=ATPase activity, coupled to transmembrane movement of substances; Cellular component=integral to membrane; Biological process=peptide transport
  Homolog annotation: Hit_ID=Q6D874; Match level="QueryCoverage=58%, HitCoverage=56%, E-value=1e-101, Identity=61%"; Hit description =Putative ABC transporter ATP-binding protein
  Pfam annotation: Domain name=ABC_membrane; Domain location=228-501; Score=-44.4; E_value=0.085; Accession=PF00664.13; Description=ABC transporter transmembrane region
HGDCHHCAGSRRLGHRADGARHRACQSAGAETASGGVSDYEAGRRLQPLDVATEPLAEGAVILRRRAREQADALLAAIHDVAALNPFAHRITPGGHRMSVAMTNCGDFGWSTDSRGYQYTEQDVSSGRKWPPMPALFRALAQQTAQEAGFAGFNPDACLINRYEPARRCDAARAAGARRYRGVGRSVAPALSRHFAAKSGHPSAGWRVPLQPDLPPRPVVFRQYRWPFIGVIVLTLLSAALGIGLIAYINNELIVAVNTSLTVLPGFLAQLFLLMAVTLASQLALTQLGHHFVWRLRGEFIKRILDTRVERIEQIGNAQLLAGLTSDVRAITIAFVRLPELIQGIIITLGSAIYLAWLSPQMLLITTLWLVVTLIGGWLLVSRVYQHMAKLRDIEDELYRDFQTIIEGRKELQLNRERARLIYDTVYQENATDYRRHIVRADTFHLSAVNWSNIMMLGAIGIVFFMANGLGWANTAVAATYSLTLLFLRTPLLAAVGALPTLLSAQVALRKINTFDLAPYSAGFNALAT

SEQ ID NO: 179083 - protein, 134 aa, Glycine max
  Coding DNA Sequence Number=SeqID_62305
QASSQLPGSSQFSAEDRFFYKAKAKSLSEINKISEEIVCVTVGTIGSRIVMKNHSWCYAACIQYNKKIDIDNTPFTCACGRYNQQDADDLNTSLEALDKILGYTLAFKVKAVASGGSNLARLGELSLPGRAELA

SEQ ID NO: 179084 - protein, 69 aa, Glycine max
  Coding DNA Sequence Number=SeqID_62306
MATARWALKHPVYGIVILRLGIYTDRPNVSKLCSFISSMNSSIFISVHSGKYTLSISPLFPEDTFALYE

SEQ ID NO: 179085 - protein, 115 aa, Glycine max
  Coding DNA Sequence Number=SeqID_62307
  Gene Ontology: Cellular component=chloroplast
MVGAGLKKDLRVSRVVPGGSLNAFLFLLIGVISQRLAMGFLIWDPGEEDQAGPCEQLDALSPFNPFERNVAKGKRIHGPTPSSPPRRNYEITPRTPSASRGRGPTIEPCSKSGTH

SEQ ID NO: 179086 - protein, 90 aa, Glycine max
  Coding DNA Sequence Number=SeqID_62308
  Gene Ontology: Mol. function=carboxypeptidase activity; Cellular component=cytoplasm; Biological process=fucose metabolic process
MRDRLKDMICDPGQESFQQGARITSLLQVVYDLLPEKNTLPKSYYQPRRYCVRWVWSIRRFMLARMIAYCTGMHSKKCPNALGVGRHSTK

SEQ ID NO: 179087 - protein, 157 aa, Glycine max
  Coding DNA Sequence Number=SeqID_62309
  Gene Ontology: Mol. function=chitin binding; Cellular component =extracellular region; Biological process=chitin metabolic process
  Homolog annotation: Hit_ID=UPI0000612705; Match level="QueryCoverage =87%, HitCoverage=93%, E-value=9e-13, Identity=27%"; Hit description =UPI0000612705 related cluster
MRGIVHEPQVNIGADQNTLTFRGLHVLIIRGLQTLTCRGLHILAFQGLHVLTFRGLHVLAIRGLHALTFIGLHALTFRALHVFAFRGLHVLTFRGLHALAFRGLYVLAFRGLHVLAIRGLHVLAFRALHVLTLRGLHTLIFRGLHVLTFRGVTHPHL

SEQ ID NO: 179088 - protein, 86 aa, Glycine max
  Coding DNA Sequence Number=SeqID_62310
MGSRCFGRMLQPCGIGICLEEHSNRTTPKAYTSKSPSGPLPPDSGPIPKKVLHADTTNELYNTHDLTLVFYTCLTQLRYNLTPIPE

SEQ ID NO: 179089 - protein, 154 aa, Glycine max
  Coding DNA Sequence Number=SeqID_62311
  Subcellular localization annotation: CTP_CleavageSite=39; ConfidenceScore=5.26e-01
MSIWQTSVHFALPSTTFPLSVIVHIRAWQSGFSFALSSRFAERMNDNITLILHHGGRFTPRASDGKVEYIGEEFDVWEDISADFLDAFILYDLVKACKKYSNMGDCFWLIDKDLVMQSYPARALARRLQVDWARDPRKGPRVLMSLRVDFEPMG

SEQ ID NO: 179090 - protein, 132 aa, Glycine max
  Coding DNA Sequence Number=SeqID_62312
  Gene Ontology: Mol. function=ATP-dependent DNA helicase activity; Cellular component=DNA-dependent protein kinase complex; Biological process=double-strand break repair via nonhomologous end joining
  Homolog annotation: Hit_ID=Q8S562; Match level="QueryCoverage=89%, HitCoverage=18%, E-value=1e-26, Identity=54%"; Hit description=KAP-2
MESIIMRGKLSQDANKGIMDENDRLLNIFSKETSTRLLYVENPISLFGALRTRNGAPVIVLEGHLEINPTLSIKGAKIGATLWQKLFPEYEAKLQCGSAYVIQNIKEIDRPEIPPNVHVITQFGVAPRDTLV

SEQ ID NO: 179091 - protein, 161 aa, Glycine max
  Coding DNA Sequence Number=SeqID_62313
MPHQPPGWKHEIKARLCIPCKGFILNAEGQPWKLLRKDLTTLAQTWSVFSYSNLVPTSHTSYLNMDRARLVYGLVTHMDMNIGALISGQISSIALSNSSLLGFPALITALCRARGVTSDSMTYQSLSLAINLAYIRKKCWNVDDLTVNFRGARKARARPAD

SEQ ID NO: 179092 - protein, 241 aa, Glycine max
  Coding DNA Sequence Number=SeqID_62314
MWFVRLSEGVSLSQSYVSKASKKRKASASRPREPYDTTGFVSKVAWERYAQNVHSRNIIPKRNITLYISEYDEFNWELEQRQWHRALTRQPDNHIDVALVKEFYANLYDLEEKSQRHVRVWSKLIKFDVASLNEFVARLCILGRGFVLNAEGALWKLLRKDITTLAQTSSVLSYSNLAPTSYTSDLNMDRANLVYSLIMKMDMDAWISSSYHNLMHSPGSRLRFSDLRALLIMKVIISHNL

SEQ ID NO: 179093 - protein, 80 aa, Glycine max
  Coding DNA Sequence Number=SeqID_62315
MWRLSKKVSDTNFFRILSFADILILASQIMVFDTSYSTKQGITQCFDQEYKRIPRKGVKGLFGIFLDPGLPKIAFDSPEP

SEQ ID NO: 179094 - protein, 92 aa, Glycine max
  Coding DNA Sequence Number=SeqID_62316
MATPFKTKDVNEEITTKDIRSLMEQANYTNKYLEVLQESISEEKEKGVFERKEAQASKSKKEEVVAMRESVLEIKRLREREGVLRELHHEGK

SEQ ID NO: 179095 - protein, 178 aa, Glycine max
  Coding DNA Sequence Number=SeqID_62317
MVVISLTKIPQPPFPRGYNLSQPTLWQEGDARLMGASSKEGKRAESPPTFIRGKRWKNRKRRSLRTLSVKGSGVVFMHGEGISTSRVRHKGCQPLIKEKEGGGCRPARPGELDCFHQKAPPSVGTSWKAQNVTELHGLPNDGYQVPRSGQARHCMILKHKVQSLIDVGWMRFEEENHL

SEQ ID NO: 179096 - protein, 144 aa, Glycine max
  Coding DNA Sequence Number=SeqID_62318
MHYIICHIFLPRSTNLAQASEEDLILLWALQTGGQIDWAYLVRYWMHKALRANAPLLYPHLVTLFLHHFNVPLDDEPFVKVKHSFSIGVGAVTSIGYQKDMDGQWVRKQDMPLPIPDECTPSPPPQRDASSSLVAGVLMELHDL

SEQ ID NO: 179097 - protein, 239 aa, Glycine max
  Coding DNA Sequence Number=SeqID_62319
  Homolog annotation: Hit_ID=Q10Q33; Match level="QueryCoverage=37%, HitCoverage=27%, E-value=9e-12, Identity=40%"; Hit description =Expressed protein
  Pfam annotation: Domain name=Remorin_C; Domain location=116-235; Score=82.7; E_value=1.1e-21; Accession=PF03763.4; Description =Remorin, C-terminal region
MENFFNQMRDSKIPIQKTQSFKGEKKQGGENWFQKQFSRKRSGDHDSRDMDHAAAVAAAAFAVNLQDVSEQKSETPEASLTKIKSKVDGTKPPIPLLNSASKRLSSSFRSKNEQGKKPEESITPAPSMRKSSLSLMKSLRLQQSLPLYDKLREVIDSWENKKKMKARRKLDKEERGVAQRRMKALEDFQNKITAIDQIADGARTKAEESRRNEEQKAKEKANAIQTTGEMPGICFCFCF

SEQ ID NO: 179098 - protein, 103 aa, Glycine max
  Coding DNA Sequence Number=SeqID_62320
MEALARTARRRRRRAILLACWAAMRVSTWWAASNRACLTVQPCPMTAEATDTASHRSRTRMGVQCESDAGHAGDVPRPCFLAFQVVQFLLKADTTGFPSSAPS

SEQ ID NO: 179099 - protein, 99 aa, Glycine max
  Coding DNA Sequence Number=SeqID_62321
  Subcellular localization annotation: CTP_CleavageSite=33; ConfidenceScore=5.10e-01
MAGHSSYTSGRCHTGHRHGLSHVLTARAPLHTMGVAEKARFRGTFRGLRRARFEGNLGTDFAKGTVERGVRVRAQQREGRERGSTMLWKERVRFSRERG

SEQ ID NO: 179100 - protein, 350 aa, Glycine max
  Coding DNA Sequence Number=SeqID_62322
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=97%, HitCoverage=97%, E-value=1e-109, Identity=54%"; Hit description=SRG1 protein
  Pfam annotation: Domain name=2OG-FeII_Oxy; Domain location=199-299; Score=149.6; E_value=8e-42; Accession=PF03171.10; Description=2OG -Fe(II) oxygenase superfamily
MSKYGTSLLVPSVHELVKQPITKVPDQYLHPNQDPPDISNTTLPQVPVIDLSKLLSEDVTELEKLDDACKEWGFFQLINHGVNPSMVENVKRDVQEFLNLPMEKKKQFWQIPDELEGFGQLFVVSEDQKLEWADMFFIHTLPINARNLRLFPNFPQPLRDNIENYSSQLKKLCLTIIERMAMALKIESNELLDYVFEDVFQTMRWTYYPPCPQPENVIGINPHSDACALTILLQANETEGLQIKKDGNWIPVKPLPNAFVINVGDILEILTNGIYRSIEHRATINKEKERISVATFHRPLMNKVIGPTPSLVTSERAAVFKRIAVEDYYKAYFSRGLKGKSCLDLIRVQK

SEQ ID NO: 179101 - protein, 251 aa, Glycine max
  Coding DNA Sequence Number=SeqID_62323
  Gene Ontology: Mol. function=heat shock protein binding; Cellular component=integral to membrane; Biological process=protein folding
  Homolog annotation: Hit_ID=Q7Y151; Match level="QueryCoverage=81%, HitCoverage=28%, E-value=2e-60, Identity=54%"; Hit description =Putative heat shock protein
MKINMAKPCVQENESICSQRAPVIEPTVVEVSPQANPHVEVINVPSFVPTTLAQNGRHGFFPSGFARSDADGKDPFGDSRRIACKRCAGFHVWIHTKKQKSRARWCQDCQDFHQAKDGDGWFEQSSQPFLFGLLQKVDAPSAYVCAGSRIYDATEWYICQGMRCPANTHKPSFHVNTNLMSKHNSGKGTSSGQRGGHMPTPNIEETMTEEELFEWLQNAVHAGAFDNFSGTATKSPSPKSGNGMKSLCDPC

SEQ ID NO: 179102 - protein, 132 aa, Glycine max
  Coding DNA Sequence Number=SeqID_62324
MGVQIAPRPIWALQKIPPEGAEALPKRFSNVSREEFRKDFNRSSTFFIRSSSFFDLQRDSNAVAARKQNMEARSEGTTTEKSRGVKNLMRGMYTLKNKCDYRNVRRQGYCAAASSEKNVFLRLPLRCCRRTE

SEQ ID NO: 179103 - protein, 35 aa, Glycine max
  Coding DNA Sequence Number=SeqID_62325
MTQSDINKDEHQTPTNTTQDDQFVGDDSSDSTDND

SEQ ID NO: 179104 - protein, 574 aa, Glycine max
  Coding DNA Sequence Number=SeqID_62326
  Gene Ontology: Mol. function=protein serine/threonine kinase activity; Cellular component=membrane; Biological process=protein amino acid phosphorylation
  Homolog annotation: Hit_ID=Q9LH71; Match level="QueryCoverage=95%, HitCoverage=56%, E-value=1e-98, Identity=39%"; Hit description =Receptor-like serine/threonine kinase
  Pfam annotation: Domain name=Pkinase; Domain location=257-461; Score=- 4.5; E_value=2.7e-08; Accession=PF00069.15; Description=Protein kinase domain
  Pfam annotation: Domain name=Pkinase_Tyr; Domain location=257-511; Score=-13.2; E_value=1.2e-11; Accession=PF07714.7; Description =Protein tyrosine kinase
  Pfam module annotation: Pfam domain module=Pkinase::Pkinase_Tyr; Domain location=257-461::257-511
MFKLTILLDSVSYSLHINCGGKQITVNGNGTYDDDTDTAGPARFHLGGKKWGSSSTGHFMDNDRAEYSIWLNQSKLFIIDVELYMDARKYGAEGFQYCRRSRGVNKAVTKSFTIVISSNTLEIRLYWAGKETIGIPFKSVYGRLISAIPVNPRTIKTCHISSYNNVFYNNQADFILSSENGSSMSAGSVAAIVAGVVVFLVLLIKCANGENSINNLELSQLLEIYNLSLFEFTELKGLKLQMGIFTLRQIKAATNNFNKANKIGEGGFGPVYKGNLSDGTIIAVKQLSSKSRQGNREFLNELGMISALQHPCLVKLYGCCVEGDQLLLVYDEYMENNSLARTLFAEYHIKLDWPTRQKICVGIARAKLDEEDNTHISTRIAGTYGYMAPEYTMHGYLTDKADVYSFGVVVALEIVSGRSNMIQRQKEEAFHLLDWVNTSIMCSRKCYFPLAIEYLIVLGWYMFGNLIELVDRRLGLDFYKNEVTARINVSLLCTNVTASLRPTMSLVVSMLEGRSVVQEVFSESSEALDEKKLEAMRQRYQEIIEENKLTENKLTEIQRMTYWLLHHLQQISIL

SEQ ID NO: 179105 - protein, 297 aa, Glycine max
  Coding DNA Sequence Number=SeqID_62327
  Gene Ontology: Mol. function=protein serine/threonine kinase activity; Cellular component=cell cortex; Biological process=protein amino acid phosphorylation
  Homolog annotation: Hit_ID=Q1SH92; Match level="QueryCoverage=89%, HitCoverage=83%, E-value=9e-45, Identity=40%"; Hit description =Protein kinase
  Pfam annotation: Domain name=Pkinase; Domain location=4-271; Score =164.4; E_value=2.9e-46; Accession=PF00069.15; Description=Protein kinase domain
  Pfam annotation: Domain name=Pkinase_Tyr; Domain location=4-271; Score=-31.9; E_value=1.6e-10; Accession=PF07714.7; Description =Protein tyrosine kinase
  Pfam module annotation: Pfam domain module=Pkinase::Pkinase_Tyr; Domain location=4-271::4-271
MAAWKKLAILGKGSYATVYLATVALPQECNEKVVAVKSSSPFSFSIASMQKEKRILDSFLGCKEILQCYFDQFTVERNYVTYNLFMECAPYGSLLGLVNKKGPISDSEVRVYTRMLLKGLSCIHRKGVVHCDLKPDNILLFPSSDDHARYQLKIADFGLSKTREDANAEYGKVKFRGTPFYMSPESVVGQIEPALDIWSLGCIVIEMITGFRAWKNLRTQKEIMFKLVVLQEAPEIPNGLSWDCTNFLSKCFVKDPRQRWTATMLLNHPFLYPTCYMRSSSFFSYDIVSHVPFKTVM

SEQ ID NO: 179106 - protein, 90 aa, Glycine max
  Coding DNA Sequence Number=SeqID_62328
MRMEAEGVTSKSKKKTEEKKKIGSMPGLVRTLSACHVLSGPGSTSPKQGVKHEDAESVTHAKRGARAKRTIQQKHTLSLQHVLSARSERA

SEQ ID NO: 179107 - protein, 316 aa, Glycine max
  Coding DNA Sequence Number=SeqID_62329
  Homolog annotation: Hit_ID=Q1SZB7; Match level="QueryCoverage=16%, HitCoverage=9%, E-value=7e-19, Identity=92%"; Hit description=WD40 -like
MGEVADEGQYFRSEIALLNYSDATFKPPLSSLLIHIDPLIIPNGHTCSASESDPSPTSQHHQQEQHPKDAWLPITESRNGNAYYAAFHILNSNIGFQALMLPVAFATLGWYLRVQISYIRKTTHPCTGRTQRFGSFNSKKIEWPKIVRTQLQERIPFMQRGNTPVGLKRNTSHRPGHPCITLPSKVVIIRMSPCLQQLQITICIQLKMCPVIVLILNFFLSAEDDVSSVAANIEHFQFDPIKSIHFSNSNPVCQAFDQDAKDGRDLLIGLNSGDVYSVSLRQQLQNVGKAYRRFIVYYRLFIVHVVVTANNAVLYV

SEQ ID NO: 179108 - protein, 126 aa, Glycine max
  Coding DNA Sequence Number=SeqID_62330
  Gene Ontology: Mol. function=DNA binding; Cellular component =mitochondrion; Biological process=DNA integration
  Homolog annotation: Hit_ID=Q1SFD6; Match level="QueryCoverage=92%, HitCoverage=8%, E-value=8e-45, Identity=69%"; Hit description =Integrase, catalytic region
KSLVSWRAKKQATVSRSSSEAEYRALSSAAYLRVQLTRTPTLYCDNQSAVHIASNPVFHERTKHLEIDCHLVREKLLKGTLKLLPVSTSDQVADFLTKALAPPKFHDFVSKLSMINIYHDKLEGGC

SEQ ID NO: 179109 - protein, 367 aa, Glycine max
  Coding DNA Sequence Number=SeqID_62331
  Homolog annotation: Hit_ID=Q2HRX8; Match level="QueryCoverage=82%, HitCoverage=53%, E-value=3e-18, Identity=39%"; Hit description=IMP dehydrogenase/GMP reductase
  Pfam annotation: Domain name=DUF1723; Domain location=130-179; Score =41.3; E_value=3.2e-09; Accession=PF08330.1; Description=Protein of unknown function (DUF1723)
IMVKTRGLGHALGRVVARVPADSPAVPEAHATVVGDEPMDTGPETDAQDIGAQDATDEPEGFPGGPRDPSVLTEYLDHVAASVWSGQECPKLKLSSHGRKVHNLGRPVPAIEDMVVGIGLSPLIACSIDTGDRGLISSFIERWHRETSSFHLPMGEVSITLDDVASLPHLPIVVAFHDFQPLRTDGAMVLLVELLMVSTEVAMAETGQCGGPYALRDLTFADGELLASSICTINLMMPVSALADNLLCNADLDYDEVSPRACRWIATKKTVKKVSTTTYKQCLDRLRILYVCWMPYAEHRPAQDFHLISCFSGQLRWGPVVVRYRPEKVMRQFSYVQCIPTHPIHSWVSYDDMDDTWTHYSDHLAAA

SEQ ID NO: 179110 - protein, 66 aa, Glycine max
  Coding DNA Sequence Number=SeqID_62332
MRNSDLRSSCKSDSKTYPLKNEERMKNDEERMKTFTDLLTETSRKRYGSTSAWIFFTETIFFTQNS

SEQ ID NO: 179111 - protein, 230 aa, Glycine max
  Coding DNA Sequence Number=SeqID_62333
  Gene Ontology: Mol. function=oxidoreductase activity; Cellular component=microsome; Biological process=aromatic compound metabolic process
  Homolog annotation: Hit_ID=Q2QWN2; Match level="QueryCoverage=87%, HitCoverage=52%, E-value=4e-60, Identity=53%"; Hit description =Flavin-containing monooxygenase, putative
  Pfam annotation: Domain name=Pyr_redox_2; Domain location=6-224; Score=-38.2; E_value=0.064; Accession=PF07992.4; Description =Pyridine nucleotide-disulphide oxidor
MEEKQRVIIVGAGPSGISAAACFTKQSIPYIILEREDCSASLWKKYSYERLHLHLRKQYCQLPHKPFPASFPPYVPKKQFLQYLDDYVSHFGITPLYRRTVELAEYDQGCHNWRVMALNGDSGQLEEYRGRFLVVATGETTDPFVPELQGLSGFPGKLIHSTGFRSGKDFKDQHVLVVGSGNSGMEIALDLVNHGAKTSILVRSPGDGEFGVVSVEIFVVEHRGLADGDA

SEQ ID NO: 179112 - protein, 63 aa, Glycine max
  Coding DNA Sequence Number=SeqID_62334
MAEARSQQAASMTEFLWLGPHISNIKCQNKGFHPERSTIERYKKAYSDHSSASTTTKINAQKN

SEQ ID NO: 179113 - protein, 207 aa, Glycine max
  Coding DNA Sequence Number=SeqID_62335
  Homolog annotation: Hit_ID=O64852; Match level="QueryCoverage=34%, HitCoverage=17%, E-value=2e-21, Identity=66%"; Hit description =Putative SF16 protein
  Subcellular localization annotation: CTP_CleavageSite=30; ConfidenceScore=5.60e-01
MTPRTLTPNPSRGSTRVSLLAPKAKCLFVSASLSQLSTLLCLLLTALPRLFPVDVTLSAAFCLRGLSLYADAFIPEGGHRLLNVTSSVGGSTQCDLDESKLRAFLARRALRALKAVALVRVQARVRASRVRMSIEGQAVQNLLNVRRSKHDLLKQAEEGWCDSRGTLEDVKTKIQMRQEGAFKRERAMAYSLAHKQCRATPSLFPHF

SEQ ID NO: 179114 - protein, 115 aa, Glycine max
  Coding DNA Sequence Number=SeqID_62336
  Homolog annotation: Hit_ID=Q9FUP6; Match level="QueryCoverage=52%, HitCoverage=67%, E-value=6e-13, Identity=55%"; Hit description =Suspensor-specific protein
MGDYWKNMMNGLPMSESIKDILVQDPHVSDAMKDLYITDFDIKPNVILYDTHVVPNKHKQKIQQAMAKKLEPKFQGTERHGEVHFTCNPSKSECSKKGRFEFDWGQKFDRLERAF

SEQ ID NO: 179115 - protein, 198 aa, Glycine max
  Coding DNA Sequence Number=SeqID_62337
  Gene Ontology: Mol. function=protein-tyrosine kinase activity; Cellular component=integral to membrane; Biological process=protein amino acid phosphorylation
  Homolog annotation: Hit_ID=Q9AWX9; Match level="QueryCoverage=46%, HitCoverage=13%, E-value=2e-25, Identity=66%"; Hit description=Extra sporogenous cells-like
  Pfam annotation: Domain name=LRR_1; Domain location=133-155; Score =7.2; E_value=13; Accession=PF00560.23; Description=Leucine Rich Repeat
  Pfam annotation: Domain name=LRR_1; Domain location=157-179; Score =8.4; E_value=7.5; Accession=PF00560.23; Description=Leucine Rich Repeat
  Pfam annotation: Domain name=LRR_1; Domain location=181-195; Score =3.4; E_value=65; Accession=PF00560.23; Description=Leucine Rich Repeat
  Pfam module annotation: Pfam domain module=LRR_1::LRR_1::LRR_1; Domain location=133-155::157-179::181-195
MVYQEGAELGLIQIALSGTSDAAGDVEEAVATLGDEGVGVEGEPAEAKGGGERDVDGEQPGERCEKEAEEGGELGERCGDEEAFSLWSEEAKVLASPLSVTNGSIHVMPVSVLQLCYKQLTGRIPTQLGDLKKLSVLALQSNLLGGAIPASLGDLGKLMRLDLKSNNIFGFIPIKLADLPSLQVLDVHNNTLSGNVHP

SEQ ID NO: 179116 - protein, 173 aa, Glycine max
  Coding DNA Sequence Number=SeqID_62338
MVEAVALEVVVDVATVVDVDDERSKAESQGSSSNGGVGAERQRPQLDGSEVAIDVGTVLPHANGEIDGVGIDSNNRTISLSSHGRRHEETIAATIAIVMGVVVALKEGTVAAAAAAPEKVTGSVGGRSGSESFAARLAMAASSRSRLASRGSVSAIEERQRRGQVEPIVTKRN

SEQ ID NO: 179117 - protein, 416 aa, Glycine max
  Coding DNA Sequence Number=SeqID_62339
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=40%, E-value=0.0, Identity=89%"; Hit description=DNA -directed RNA polymerase beta chain
  Pfam annotation: Domain name=RNA_pol_Rpb2_3; Domain location=42-111; Score=135.4; E_value=1.5e-37; Accession=PF04565.7; Description=RNA polymerase Rpb2, domain 3
  Pfam annotation: Domain name=RNA_pol_Rpb2_6; Domain location=175-407; Score=34.1; E_value=1.1e-15; Accession=PF00562.18; Description=RNA polymerase Rpb2, domain 6
  Pfam module annotation: Pfam domain module=RNA_pol_Rpb2_3::RNA_pol _Rpb2_6; Domain location=42-111::175-407
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGILWHLIEIFRRNRLFQPDTVKNSYDCMGTASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQ

SEQ ID NO: 179118 - protein, 244 aa, Glycine max
  Coding DNA Sequence Number=SeqID_62340
MSLICNKFEPLTIDEVETLLLRHEASLDKFHKKKSLVSVNLTEGVSLSNSPIVQIVQILNSLPNFPNSSNSNLNNRSIDAHLTCENNNNYSITIVEIDFLTLVVVVVLASIVVVLVVVMEVATIVVEEMAMAMNIMSLYSHGFPQLSLLPLIGINILHNHPMLHSFSTCLVMAPSPHLVPPMQPYHNPIYVQKVALVASIPSQAHIATVAPMQSSNWYLDSRTSHHVTNVSQNIQQLAPFEGDE

SEQ ID NO: 179119 - protein, 325 aa, Glycine max
  Coding DNA Sequence Number=SeqID_62341
  Gene Ontology: Mol. function=RNA-directed DNA polymerase activity; Cellular component=intracellular; Biological process=RNA-dependent DNA replication
MVEKCIEVFMENFSVFSPSFDYCLTNLELVLRCCVEANLVLNWEKCHFMLQEGIVLGLKISARGTEVDKEKIDVIEKLPLLVNVKGIRSFLGHAGFYRRFIKDFSKTARPLSNLLNKDVFHAIYYASKVLNDAQLNYTTIEKEMLAIVYALEKFRSYLVGSRVIIFTDHAAIKYRLTKEYSKPRLIRWVLLIQEFDIVIKDKKGFENVMVDHLSRLVNEEVTQEEQQIWDEFPNESLLYVNEKPWFLDMTNYKVVSIIPNDLNWNQRKKFLHDAHFYVWDDPHLFKIRADNLLRIRGKTTAKVLQAGFFWPSIFKDEHDHVLRYD

SEQ ID NO: 179120 - protein, 157 aa, Glycine max
  Coding DNA Sequence Number=SeqID_62342
  Gene Ontology: Mol. function=oxidoreductase activity; Cellular component=membrane; Biological process=electron transport
  Homolog annotation: Hit_ID=Q6D7F9; Match level="QueryCoverage=62%, HitCoverage=26%, E-value=5e-42, Identity=77%"; Hit description =Cytochrome D ubiquinol oxidase subunit II
MASSLVRAAKRAGCQMTHPASHSARISCASELVVLRTALFHMLDRQCRDHAKRTGQQVQGVRIALNVFFGDAAIHLVVTPAGVSQNNWHKDDGCHGHDLQRQQAGGRVPHGQAGARHGAGWHDEREQRNARRHNDARQRQRREDKRPCALLHARTQD

SEQ ID NO: 179121 - protein, 105 aa, Glycine max
  Coding DNA Sequence Number=SeqID_62343
  Gene Ontology: Mol. function=hydrolase activity
  Homolog annotation: Hit_ID=P0A8Z3; Match level="QueryCoverage=93%, HitCoverage=73%, E-value=4e-33, Identity=72%"; Hit description=Acyl -CoA thioester hydrolase ybgC
MRPGCRVSTTLFRWPVRVYYEDTDAGGVVYHASYLAFYERARTEMLRQHHFNQQAMLEEQVAFVVRRMTGGLYCRGTSRRHSGDPERSDSNDARNHDVLAAYREC

SEQ ID NO: 179122 - protein, 144 aa, Glycine max
  Coding DNA Sequence Number=SeqID_62344
  Homolog annotation: Hit_ID=Q1RYX7; Match level="QueryCoverage=40%, HitCoverage=14%, E-value=9e-17, Identity=68%"; Hit description =Adenine nucleotide translocator 1
  Pfam annotation: Domain name=Mito_carr; Domain location=75-143; Score= 3.1; E_value=0.0018; Accession=PF00153.17; Description=Mitochondrial carrier protein
MGRGRLQVQGVESGNDDVAICSSGIKLGRYSLESKVRPTSLFAGVGQAGFGFGISPNPPTATTRDSGTKPPLINSSTKYVLMPETVSRTSVAPLETIRTHLMVGSCGHSTIQVFQSIMENDGWKGWFRGNSMNIIGVAQARPLR

SEQ ID NO: 179123 - protein, 679 aa, Glycine max
  Coding DNA Sequence Number=SeqID_62345
  Gene Ontology: Mol. function=ATP-dependent helicase activity; Cellular component=cytoplasm; Biological process=translation
  Homolog annotation: Hit_ID=Q1RT70; Match level="QueryCoverage=80%, HitCoverage=83%, E-value=0.0, Identity=67%"; Hit description =Helicase, C-terminal
  Pfam annotation: Domain name=DEAD; Domain location=189-374; Score =223.8; E_value=3.7e-64; Accession=PF00270.19; Description=DEADDEAH box helicase
  Pfam annotation: Domain name=Helicase_C; Domain location=448-524; Score=130.1; E_value=6.2e-36; Accession=PF00271.21; Description =Helicase conserved C-terminal domain
  Pfam annotation: Domain name=ResIII; Domain location=185-369; Score= -19.7; E_value=0.0021; Accession=PF04851.6; Description=Type III restriction enzyme, res subunit
  Pfam module annotation: Pfam domain module=DEAD::Helicase_C::ResIII; Domain location=189-374::448-524::185-369
MSLMLLSYILRDPANNHFSSNPLSTPVHYGKDISRDAPLPRHHKVDPTPLPPPPPPPLSSFLHLTRRFQSHSHSYLYYNTLPHYTVFSSLLLTMPSSYASPCVPPRLRRGARPRGGGRGGFSRPRDPSSRLLPADEARNGDAINFEAYESVPVEASGKDVPAPVNTFNEADLDEGLKRNIERCKYVKPTPVQRHAIPIVSAGRDLMACAQTGSGKTAAFCFPIISGILKGRYRSGFSSIPSPGAAIAYPAALILSPTRELSCQIRDEANKFAYQTGVKVVVAYGGAPITQQLRLLKKGVDILVATPGRLVDIIERERVSLTKIKYLALDEADRMLDMGFEHQIRKIVEQMHMPPPGIRQTLLFSATFPNGIQKLASDFLSNYIFLSVGRVGSSTELIVQKIEPVQDMDKRDHLIKHLRRQSVHGFNGKHALTLVFVETKRGADVLEGWLLRSGFSAVAIHGDKVQMERERALRSFKSGVTPILVATDVASRGLDIPHVAHVINFDLPRDIDNYVHRIGRTGRAGKSGLATAFFSDKNSPIAKSLIGLLQEANQEVPSWLNQYAEGSSSGGGSQGYGAQRYSSGGSYGGRDFRNVIEAEVENNNCYSTNVNADHAVESYYTADDASYDIQNSNIDSSFDTLNIASAGSYNHTDFCELNGAGRVEEDGPLGYASIVATGWD

SEQ ID NO: 179124 - protein, 81 aa, Glycine max
  Coding DNA Sequence Number=SeqID_62346
  Gene Ontology: Mol. function=binding; Cellular component =mitochondrial inner membrane; Biological process=transport
  Homolog annotation: Hit_ID=Q1RYX7; Match level="QueryCoverage=86%, HitCoverage=21%, E-value=2e-12, Identity=65%"; Hit description =Adenine nucleotide translocator 1
  Pfam annotation: Domain name=Mito_carr; Domain location=2-71; Score= -5.1; E_value=0.01; Accession=PF00153.17; Description=Mitochondrial carrier protein
MTLLIGSAAGAISSSATFPLEVACEHMQAGALNGRQYRNLLHALRLVTKLLKIGSCCWDFFHVLRSLQEDFAFPCIFGHFN

SEQ ID NO: 179125 - protein, 88 aa, Glycine max
  Coding DNA Sequence Number=SeqID_62347
MEGSQQNTHYPKEKLPKFITHKWKFGNLLEAPNTLPMKGLFVTKLESNEALKVVGPFLLDSNSLRDGTNPPSNSLYDNPQTRKQRDKQ

SEQ ID NO: 179126 - protein, 97 aa, Glycine max
  Coding DNA Sequence Number=SeqID_62348
MGIKKMGNNKHLCVAIRHSIWNHLLLLVSNDQIFRLLFQFIPCLSRFSFALWPIWSFLTLPLLYNQKFTLFMACMVVIPCLIFGTLRPQYYDELRTD

SEQ ID NO: 179127 - protein, 76 aa, Glycine max
  Coding DNA Sequence Number=SeqID_62349
  Gene Ontology: Mol. function=chromatin binding; Cellular component =chromatin; Biological process=chromatin assembly or disassembly
MWAEWSYNIFIHSRTRLSPYNITFGKKPPNIPDYIAGTSHIDAMDDFLVDREAVFANLKKKLIKAQQTMKHFADNN

SEQ ID NO: 179128 - protein, 68 aa, Glycine max
  Coding DNA Sequence Number=SeqID_62350
MSGGTPRGGGGLMRQRHSQGYASSGDDLEDDACSRHRPFLAPSPPPRTWIEMLENFLWLASAAFILYF

SEQ ID NO: 179129 - protein, 112 aa, Glycine max
  Coding DNA Sequence Number=SeqID_62351
MKKMNYHETSVQCEATMNIRRATQESHYQNGKGECAEEMRRKWGGGILGCIMIRGIRWTKRSTIQFLTVHSGCFEVAKIDIKLGRNIERHKAQIVKYCNSVEITHERFNLFF

SEQ ID NO: 179130 - protein, 258 aa, Glycine max
  Coding DNA Sequence Number=SeqID_62352
  Gene Ontology: Mol. function=intramolecular transferase activity, phosphotransferases; Cellular component=cytosol; Biological process =metabolic process
  Homolog annotation: Hit_ID=Q6Z8J0; Match level="QueryCoverage=91%, HitCoverage=72%, E-value=1e-90, Identity=64%"; Hit description =Putative phosphoglycerate mutase
  Pfam annotation: Domain name=PGAM; Domain location=16-223; Score =77.2; E_value=5.3e-20; Accession=PF00300.12; Description =Phosphoglycerate mutase family
MSSNCYSVCSYSDEAALILIRYGESLWNEKNLFTGCVDVPLSKRGIDEAIEAGKRIRSIPVDLIFTSALIQAQMTAMLAMTQHPRKKAGEFNCYSHHNPEKNRKLTTDYAIYIADDVPIIMHNESEQAREWSQVFSEDTKKQSIPVIAAWQLNERMYGELQGLNKQETADRYGKEQVHEWRRSYDVPPPNGEGLEMCAERAVAYFRDQVISLELSTGIPMLYIFKEGRFIRRGSPIGPTETGVYAHTRMKWHLQSRNR

SEQ ID NO: 179131 - protein, 49 aa, Glycine max
  Coding DNA Sequence Number=SeqID_62353
MYKFLSSYFHVNSGRQKFISFLIANGRRAHGSNYSPSPYENNTGVENGS

SEQ ID NO: 179132 - protein, 133 aa, Glycine max
  Coding DNA Sequence Number=SeqID_62354
  Gene Ontology: Mol. function=transporter activity; Cellular component= intracellular; Biological process=transport
  Homolog annotation: Hit_ID=O22270; Match level="QueryCoverage=79%, HitCoverage=35%, E-value=3e-26, Identity=54%"; Hit description =Putative phosphoglyceride transfer protein
  Pfam annotation: Domain name=CRAL_TRIO_N; Domain location=4-82; Score= 39.8; E_value=9.4e-09; Accession=PF03765.5; Description=CRALTRIO, N -terminus
MSVDPKRSASNGQEKMLPSLEQQALINEVRRLIGPQSGKASIFCSDACISRYLRARNWNVKKAAKMLKLTLKWREEYKPEEIRWEDIAHEAETGKTYRTNYIDKHGRTVLVMRPSRQDMCWKAALVAVTPSLP

SEQ ID NO: 179133 - protein, 258 aa, Glycine max
  Coding DNA Sequence Number=SeqID_62355
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=1e-45, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=27; ConfidenceScore=5.17e-01
MSSPSKGVHFCTSRGLHVLTSRGLHVRTSRGLHVLTSRGLHILTFRGLHVLTFRGVHTLAFRGLHVLPFRGVHVLTIQGLHVLPFRGLHVLTFRGQHVLTFRGLHTVTFRGLHVLNSRGLHALTFRGLHVLAFRGLHALTFRGLHALAFRGLHVLPFRGVHFLTFRIIHVLAFRGLHVLTFRGLHVLAFKGLHFLAFRGVHALAIRGLHALTFRGLHALTFRGVHVLAFRGLHGLTFRRQHALTLRGLHGLTFKRLHT

SEQ ID NO: 179134 - protein, 167 aa, Glycine max
  Coding DNA Sequence Number=SeqID_62356
MEVNTATIVATSTATKVDPTHQFGLNQVNCPASDMVGQEGEALGNMGGPHFVQVLNKHSFLPYGLPPNYTSPNVAHAPNENVDNSAPKPLGANNPNLIMHILPPTVVEREKFDHIEKRLRAIEGDEDYAFANMVELCLVPDVNIPPKFKVPDFNKYKGTTYPKNHLK

SEQ ID NO: 179135 - protein, 34 aa, Glycine max
  Coding DNA Sequence Number=SeqID_62357
WAKCASTAKHSFSVLSTKENLAEHQHQSHALSAR

SEQ ID NO: 179136 - protein, 81 aa, Glycine max
  Coding DNA Sequence Number=SeqID_62358
MGERWRQFKSDFMSKWTLAVDKESGDDTICEKMCERRHRPSNHVLSRGGFVGGAGLTGFLCRPWTSGCIDCYHWVTRTPWS

SEQ ID NO: 179137 - protein, 138 aa, Glycine max
  Coding DNA Sequence Number=SeqID_62359
VSVHVAHLISDAIYQFAGIVPMRHLVDPKKSNRVLGFLALITGLYQFYGVPVAPNKVIRPPINKAFIEKYCTPRQAQGQAPQQLEEDQQLAANAPSPPQEEVPSLRSISDHLRRIELQMHRYMHHVTSQQATNHRGQV

SEQ ID NO: 179138 - protein, 32 aa, Glycine max
  Coding DNA Sequence Number=SeqID_62360
MMAHQGVEVLAIKISILANIGSNQAHAFKKRF

SEQ ID NO: 179139 - protein, 293 aa, Glycine max
  Coding DNA Sequence Number=SeqID_62361
  Gene Ontology: Mol. function=protein serine/threonine kinase activity; Biological process=methionine biosynthetic process
  Homolog annotation: Hit_ID=Q66E15; Match level="QueryCoverage=93%, HitCoverage=67%, E-value=1e-133, Identity=85%"; Hit description=5 -methylthioribose kinase
  Pfam annotation: Domain name=APH; Domain location=30-286; Score=-1.3; E_value=0.0069; Accession=PF01636.13; Description=Phosphotransferase enzyme family
MSLYRTFTAADAVEYARQYGQVADPQALVSADEIGDGNLNLVFKIRDREGVSRVIVKQALPYVRCVGVSWPLTLDRARIEAETLRVHGGFCPRHTVKVLHHDPELAVMVQEDLSDHRIWRSELVQGNYHPLAAGQLAEYLAQTLFHTSDFYQSAQQKKAEVRRFTNPELCQITEDLFFTDPYIDHERNQFEVALLPQVQALREDAPLKLAVAGLKHRFLSKAEALLHGDIHSGSIFVAEGRLKAIDAEFGFYGPIGFDIGTALGNLLLNYCGAAGAVSGPRDAAAGARAAPCR

SEQ ID NO: 179140 - protein, 135 aa, Glycine max
  Coding DNA Sequence Number=SeqID_62362
  Subcellular localization annotation: CTP_CleavageSite=18; ConfidenceScore=5.36e-01
MKKFAQTQTPQQQSFFVFAQTQHQQAPLFCIFFSREWSTGEGGFKNPKQRKSLLVLAILTNQNAIGAGDTLQLQTAVLEIASAGLNLGTVPYPQLASQTGESKLYNTPLKLATPWPAVASRTKAPIRAAICMIST

SEQ ID NO: 179141 - protein, 76 aa, Glycine max
  Coding DNA Sequence Number=SeqID_62363
MNEDKKHLKWQREVTWSVSEKEESQRGGEEQSCDEDDDAEAMRRRHKAAIETKIRYRRDFVSWIVDGLIEIISFDF

SEQ ID NO: 179142 - protein, 267 aa, Glycine max
  Coding DNA Sequence Number=SeqID_62364
  Gene Ontology: Mol. function=structural molecule activity; Cellular component=membrane
  Homolog annotation: Hit_ID=Q9LVU1; Match level="QueryCoverage=48%, HitCoverage=60%, E-value=2e-44, Identity=66%"; Hit description=VAMP (Vesicle-associated membrane protein)-associated protein-like
  Pfam annotation: Domain name=Motile_Sperm; Domain location=1-97; Score=78.4; E_value=2.2e-20; Accession=PF00635.16; Description=MSP (Major sperm protein) domain
MFMSTVELEKQTYCDLKVLNNTGNYVAFKVKTTSPKKYFVRPNTGVVHPWDSFTLQAQQEYPPDMQCKDKFLLQSTIVNPNTDVDDLPPDTFNKDGEKSIEDMKLRVVYISPTSPQGSTEGDTVKNSTQKPDTNSKQNALICWVQNGFGGVIKRTSLVSQYCSKNQTRFCSNQQVKEGNQGHRDYHGSEQLTPTSTLRETSVMITETVQEFSGFEPCSSSLAVTSLIMNHSITCMCYEAPSHDLYNCKLTLLSQLQRTSPINLLVTN

SEQ ID NO: 179143 - protein, 186 aa, Glycine max
  Coding DNA Sequence Number=SeqID_62365
MSKNVRVPKYWNLEWFSNQGSTFPICWKYMDCQSWKLPVCTWVESGSSMKRLMGIARCRPIGECFLTLIVYGLKLGIKMSWVLVIKDIMLKSHRLVDYEFPYVVFSSRFIVYFNIDVSNEIVYFTKAPCKITKRHLKKLGMRFVDHEWIMAREPATGNIDQMEEDVEAEALQEPAHQWIPFESLMI

SEQ ID NO: 179144 - protein, 70 aa, Glycine max
  Coding DNA Sequence Number=SeqID_62366
  Homolog annotation: Hit_ID=Q8RVX1; Match level="QueryCoverage=84%, HitCoverage=13%, E-value=2e-08, Identity=44%"; Hit description =Pectin methylesterase precursor
MGEEFEGTTQVIMKVELEKLISRVEQVINEALNKDFPLWVKSKDQILVKYMNEDIKVNVMVAQDGLHLYG

SEQ ID NO: 179145 - protein, 127 aa, Glycine max
  Coding DNA Sequence Number=SeqID_62367
MPPTRHRLDPDKSNRALGFPALITGLCQSFGVPVTPCKVRQQAANHRAQVQIHECLYQLSLSQQGQGFAPFACPTPDQFRTEVAWPGDWPEAQVKEAIAGAPDDAEEARMDEEMTDLLGFLGGSGAM

SEQ ID NO: 179146 - protein, 268 aa, Glycine max
  Coding DNA Sequence Number=SeqID_62368
  Homolog annotation: Hit_ID=Q84YF3; Match level="QueryCoverage=94%, HitCoverage=85%, E-value=4e-25, Identity=29%"; Hit description =Hypothetical protein 4B
  Pfam annotation: Domain name=DUF1191; Domain location=25-268; Score =171.1; E_value=2.8e-48; Accession=PF06697.3; Description=Protein of unknown function (DUF1191)
MGSKIDWDFIWVLLLTLCCCGSLVHSLDNTAAACESLNSLVQDFAFRSLVKHRPQTGALYDALLPRNLSGMDVSVVRLRSRRLWNKGANFSYFQIPPRTMSIPHVRRLAIVYQNLGNWSSHYFNLPGYSLISSVVGFMVFDASNVTDTSERNITLNTMGQPISVQFPNVTFMGRGSINTRVRCVAFNANGTFQLTEMSSPGVCNSRDQGHFSVVLPLEKKRGTWYLWVIGFVVGFFGLIIAGYAVFSSMRLLKTKRIQAMEKQAGEDQ

SEQ ID NO: 179147 - protein, 71 aa, Glycine max
  Coding DNA Sequence Number=SeqID_62369
MINAGMICPLRCHEEMHDAIKEQGRELSTTMHHQKRKTLDKASLLSSESETQHDHRSTSTPYGSHRPGYRA

SEQ ID NO: 179148 - protein, 130 aa, Glycine max
  Coding DNA Sequence Number=SeqID_62370
MSEIKEVQEHMKADMEAMKEQMTTMMEVIMSMRKMMEVNTATIVATSTATKVDPTHLSGFNQVNRPASDLVGQGGEALGSAGGPHFVQVQSKHSLPAYGLPPNYTAANVAHTPDENVDNSVPILIKSQQA

SEQ ID NO: 179149 - protein, 102 aa, Glycine max
  Coding DNA Sequence Number=SeqID_62371
MEPKLLVLVQWKSLPAEDTTWEDWEVLKEVYHLEDKMSFDGEGNARKQTPKLQHTTKGDHQRPRRKSQPLRHLVDYRLTIVEIEVWWWKARWHRRNNMQHVR

SEQ ID NO: 179150 - protein, 96 aa, Glycine max
  Coding DNA Sequence Number=SeqID_62372
MPKLGMSEKVSVENNDDENPETGQIQAKDPSGEGRRPNFSLGSLLNQSKTYQGNPCGVYPDLSSFTRSGAIQIFVACIKRSTPSQDHIIWYQSFDS

SEQ ID NO: 179151 - protein, 289 aa, Glycine max
  Coding DNA Sequence Number=SeqID_62373
  Gene Ontology: Mol. function=catalytic activity; Cellular component =integral to membrane; Biological process=cellular metabolic process
  Homolog annotation: Hit_ID=Q6TNI9; Match level="QueryCoverage=79%, HitCoverage=59%, E-value=1e-118, Identity=90%"; Hit description=UDP -D-apiose/UDP-D-xylose synthase
  Pfam annotation: Domain name=Epimerase; Domain location=1-190; Score =26.2; E_value=5.9e-08; Accession=PF01370.11; Description=NAD dependent epimerasedehydratase family
MIVNESKSMFYSYYTAINVSNSDGYSFSLFFLSFHSPQIKLKKGLLVHEGALSAILVLSDPAYYVLKEDDSPCIFGSIEKQRWSYACAKQLIERLVYAEGAENGLEFTIVRSFNWIGPRMDFIPGIDGPSEGVPRVLACFSNNLLRGEPLKLVDGDQSQRTFVYIKDAIEVVLLMIENPARANGHIFNVGNPNNEVIVRQLAEMMTQVYSKVSGEAPLEKPIIDVSSKEFYGEGYDDSDKRIPDMTIINRQLGWNPKTSLWDLLESTLTYQHRTYAEAVKKVIAKPMAS

SEQ ID NO: 179152 - protein, 140 aa, Glycine max
  Coding DNA Sequence Number=SeqID_62374
  Gene Ontology: Mol. function=hydrolase activity, acting on ester bonds; Cellular component=cellulose and pectin-containing cell wall; Biological process=lipid metabolic process
  Homolog annotation: Hit_ID=Q9LY84; Match level="QueryCoverage=56%, HitCoverage=20%, E-value=2e-10, Identity=42%"; Hit description=Early nodule-specific protein-like
MGLSLLLMVAQFNQFKARTGKFFKQEGRNSFREHFPRLEDFAKAIYIFDIGQNDIVAAIDRVGQEDFHAVISDIVDYFENQLQVKTPHQFLGLPHGAWFQDGGFEIAVIDLGLQTSKNSTPVDLNTKFRFGVLPTIFNEL

SEQ ID NO: 179153 - protein, 129 aa, Glycine max
  Coding DNA Sequence Number=SeqID_62375
MDRAKARDLYPAGASPGGAVVGADLGGSSKYSNENFEGRRGERFHGIGLKFLNRDVAADGNVRESGDVGGGPGKSYLFCLTACPPWKLLSRRTECLPRPVVLITASGLQGEQPLVDGTLSAMEVEQHGS

SEQ ID NO: 179154 - protein, 184 aa, Glycine max
  Coding DNA Sequence Number=SeqID_62376
  Homolog annotation: Hit_ID=Q6CQF2; Match level="QueryCoverage=40%, HitCoverage=92%, E-value=1e-18, Identity=64%"; Hit description =Kluyveromyces lactis strain NRRL Y-1140 chromosome D of strain NRRL Y- 1140 of Kluyveromyces lactis
MSTTGRGRHSVLRILKGRRGRTGHHATCGALPAAGPYLRLSSFQATAAPSYSSGLGPCPDGRSFAPIPKSDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQVPRHAKGARCHPQSR

SEQ ID NO: 179155 - protein, 138 aa, Glycine max
  Coding DNA Sequence Number=SeqID_62377
  Gene Ontology: Mol. function=lipid binding; Cellular component =anchored to membrane; Biological process=lipid transport
  Homolog annotation: Hit_ID=Q6Z387; Match level="QueryCoverage=73%, HitCoverage=51%, E-value=9e-20, Identity=42%"; Hit description=Lipid transfer protein-like
  Pfam annotation: Domain name=Tryp_alpha_amyl; Domain location=34-111; Score=14.9; E_value=0.0028; Accession=PF00234.12; Description =Protease inhibitorseed storageLTP f
MDSNACLPHLLVLAITLVLVSHAMGDSAQDKQRCAESLTGVATCLPYLGADAKAPTADCCSCLTQAMKTNKKCVCLILKDRDDPDLGLKTNMTIAVGLPSLCKTPDDLSQCSVEGSSHKEQMKRPQLRIVNLISGRDC

SEQ ID NO: 179156 - protein, 349 aa, Glycine max
  Coding DNA Sequence Number=SeqID_62378
  Gene Ontology: Mol. function=protein binding; Cellular component =integral to membrane; Biological process=defense response to fungus
  Homolog annotation: Hit_ID=Q1SWI6; Match level="QueryCoverage=53%, HitCoverage=87%, E-value=6e-46, Identity=50%"; Hit description =Leucine-rich repeat, plant specific
  Pfam annotation: Domain name=LRRNT_2; Domain location=27-67; Score =49.5; E_value=1.1e-11; Accession=PF08263.3; Description=Leucine rich repeat N-terminal domain
  Pfam annotation: Domain name=LRR_1; Domain location=114-137; Score =8.0; E_value=9.3; Accession=PF00560.23; Description=Leucine Rich Repeat
  Pfam annotation: Domain name=LRR_1; Domain location=139-161; Score =14.3; E_value=0.45; Accession=PF00560.23; Description=Leucine Rich Repeat
  Pfam annotation: Domain name=LRR_1; Domain location=163-184; Score =0.6; E_value=2.2e+02; Accession=PF00560.23; Description=Leucine Rich Repeat
  Pfam annotation: Domain name=LRR_1; Domain location=186-211; Score =11.7; E_value=1.9; Accession=PF00560.23; Description=Leucine Rich Repeat
  Pfam annotation: Domain name=LRR_1; Domain location=213-235; Score =12.2; E_value=1.5; Accession=PF00560.23; Description=Leucine Rich Repeat
  Pfam annotation: Domain name=LRR_1; Domain location=265-286; Score =11.7; E_value=1.8; Accession=PF00560.23; Description=Leucine Rich Repeat
  Pfam annotation: Domain name=LRR_1; Domain location=291-313; Score =3.6; E_value=61; Accession=PF00560.23; Description=Leucine Rich Repeat
  Pfam annotation: Domain name=LRR_1; Domain location=315-340; Score =3.4; E_value=67; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=27-67::114 -137::139-161::163-184::186-211::213-235::265-286::291-313::315-340
MENLEMDLMVWAMLWLLSLPCRESVCIPSERETLLKFKNNLIDPSNKLWSWNHNNTNCCHWYGVLCHNLTSHVLQLHLHTYDSAFDHSYGFDVNAYERSQIGGEISPCLADLKHLNYLDLSANEFLGTAIPSFLGTMTSLTHLDLSDSGFYGKIPPQIGNLSNLVYLDLREVANGRVPSQIGNLSKLRYLDLSDNYFLGEGMAIPSFLGTMSSLTQLDLSYTGFMGKIPSQIGNLSNLLYLGLGGHSSLEPLFVENVEWVSSMWKLEYLYLSNANLSKAFHWLHTLQSLPSLTHLYFSECTLPHYNEPSLLNFSSLQTLHLYNTSYSPAISFVPKWIFKLKKLVSLQLQ

SEQ ID NO: 179157 - protein, 282 aa, Glycine max
  Coding DNA Sequence Number=SeqID_62379
  Gene Ontology: Mol. function=transferase activity
  Homolog annotation: Hit_ID=Q4JZ46; Match level="QueryCoverage=99%, HitCoverage=95%, E-value=4e-45, Identity=36%"; Hit description =Putative glycosyl transferase
MLNILVKNISKRLPDAWHHQVKYALYFKKLPHLSKPTGFSEKIMRRKIYPRSIYTTLSDKFKVREFIAGLWGEEYLVELYAHGTELSYDMFRQLPNAFVLKANHGSGYNRLVFDKRQVSYAELYDLSNAWMRSNFYEQSREKHYLDIEPCIMVERMLLDGEQVPNDIKFHCFNDNHEIRMFIQVDYQRFGTHRRDIFDIDWNRTEIRISLPNADEPMPRPTRLDEMIRLARQTAQQFSYVRVDFYQVGEKVYFGELTFTPGAGLSKLMPKNIEQEWGSYFTE

SEQ ID NO: 179158 - protein, 441 aa, Glycine max
  Coding DNA Sequence Number=SeqID_62380
LGASAQGKVDTLVVTSQPQRLQVDSELLNAEGQVVHRSRDRYQVEGQRRIEYQPPTGLAQGEYRLRQQVTGQQSRPAPDSELSFRVGQPAAKVAIDSEGFTLRDGQRLFPLGIYANVATDEHLARIASAGFNTVLNYDYGEKKDPYAFFRNARKRGLLVIYSVKDQYRGSRFAPAVRGGDYAAMTAWYVQRLRSQPNLLAWYINDELGPEYLDKIEEKNLQIKRLDGDHPTFQVLNKTGELDAHFNSSDILATDPYPVGNDRDLTRTTRYTELTVQAARQARGAWVVMQIMDHAAYDARRKPHPPSEAEIRNQAWQALIGGAKGLLFYSYTDLFYKRKTGRFDQREFDATWRGVAAVSQQIAAFTPYLLTGKSTPLAGSNPQMPARMFVLGDRALLLVANPYYREGSTRLRLPAGWRQQEGGTEIQLALPAVGTATLWLQR

SEQ ID NO: 179159 - protein, 268 aa, Glycine max
  Coding DNA Sequence Number=SeqID_62381
  Gene Ontology: Mol. function=RNA-directed DNA polymerase activity; Cellular component=mitochondrion; Biological process=RNA-dependent DNA replication
FLAKLAEKAKTFYKMLKRTEPFSWDKTCEQVFLAFKKTIATSLVLSRPRLGAPLLLYLSIADKVVTLAFIQEEGKHQLPIYFMNRMIQDAEKRYQMIKKVALALITSARRLRPYFQSHQVVVKTNHPVKKSVELPEFDIQYEPHGPMKTQFMVDFLEEFGRNDTTTLDWWTLYVDGASNIRGSGVGIILEGPDNITLEQALKLNFRASNKKVEYEALITGLKLAREVGAKRLRCYTNLKLVQGQVVNTYQTMEEKQYWRRPKLANTKK

SEQ ID NO: 179160 - protein, 68 aa, Glycine max
  Coding DNA Sequence Number=SeqID_62382
MEYLALMVMEGSTIQKCVRGERIGNESSLNCFFALDGHSPAKRQSSLSEFYALSVNHQTSTPLSILCM

SEQ ID NO: 179161 - protein, 127 aa, Glycine max
  Coding DNA Sequence Number=SeqID_62383
MGDRKGDVRIYLISGLFLASTVGGGIFLCMTLVAVPWWFWFLIFLYRCCFKPKVGQQFDNRGKVGATKNCSLTAVVTNPSGKKSPDEFLDDGGRHVHFGAVVEMGSGIQDHQEVADKLQRESKEETT

SEQ ID NO: 179162 - protein, 92 aa, Glycine max
  Coding DNA Sequence Number=SeqID_62384
  Gene Ontology: Mol. function=oxidoreductase activity; Biological process=metabolic process
  Homolog annotation: Hit_ID=P93697; Match level="QueryCoverage=83%, HitCoverage=29%, E-value=5e-18, Identity=60%"; Hit description =CPRD12 protein
MDKAKTIEALISNQVIIVNLDEVFLGMKHAVRVMIPSQHGSIVAMASIYGCIGGVASQAYTSSKHNIVELVRNAVVELGPLRIRVNIVSPYE

SEQ ID NO: 179163 - protein, 131 aa, Glycine max
  Coding DNA Sequence Number=SeqID_62385
  Subcellular localization annotation: CTP_CleavageSite=24; ConfidenceScore=5.54e-01
MAFGTMAARPGKLVPSALSNLGASASLGEPGSRKLPKMTLLPLLSVSFASLTKISNDLSSCAVTGVEQHNSDFIENIVDVKANGNCGYHIIFTLLGMGEDSWSLVTMNKWMNIIDMGHVIASRYSNDNDAH

SEQ ID NO: 179164 - protein, 79 aa, Glycine max
  Coding DNA Sequence Number=SeqID_62386
  Gene Ontology: Mol. function=DNA binding; Biological process =regulation of transcription
  Homolog annotation: Hit_ID=Q9SQQ9; Match level="QueryCoverage=55%, HitCoverage=11%, E-value=6e-10, Identity=75%"; Hit description =Transfactor-like
MLNSGTERTLLTLALRVEVWQLQVLLLLSSVYLVFPEPSPTLPEEVWISVGSNIDGVGGGDEVYVMNLCDECAGEEGEV

SEQ ID NO: 179165 - protein, 121 aa, Glycine max
  Coding DNA Sequence Number=SeqID_62387
  Gene Ontology: Mol. function=protein prenyltransferase activity; Biological process=protein amino acid prenylation
MAKKKSLANALWLHRRFLSMWILDSGDASYHSKEAISMHHDFGTFLQNELCLLHSCSTFVDDFVDVQAQAAYSACYILWLKVQIAKPLESKLLEKIKDVDLKTLLDKSCPERSSLFNYFMN

SEQ ID NO: 179166 - protein, 48 aa, Glycine max
  Coding DNA Sequence Number=SeqID_62388
MSHDTQEFIVTSVRFDARGYVLSWRFELMYINRFTTFTLWVVSKFLLQ

SEQ ID NO: 179167 - protein, 89 aa, Glycine max
  Coding DNA Sequence Number=SeqID_62389
  Homolog annotation: Hit_ID=Q00M75; Match level="QueryCoverage=34%, HitCoverage=5%, E-value=5e-10, Identity=100%"; Hit description=PPR -repeat containing protein
MADHSISNINMRASPGAAVKLCLGDLLVMGSNPETASLHMQGRLLLKFMENQNSVEETVSYGHNADIVQALKVSKSHEFQMLKKFDTKH

SEQ ID NO: 179168 - protein, 992 aa, Glycine max
  Coding DNA Sequence Number=SeqID_62390
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9M4N3; Match level="QueryCoverage=96%, HitCoverage=100%, E-value=0.0, Identity=79%"; Hit description=H+ -ATPase
  Pfam annotation: Domain name=Cation_ATPase_N; Domain location=41-122; Score=101.5; E_value=2.5e-27; Accession=PF00690.16; Description =Cation transporterATPase, N-terminus
  Pfam annotation: Domain name=E1-E2_ATPase; Domain location=134-355; Score=301.6; E_value=1.5e-87; Accession=PF00122.10; Description=E1 -E2 ATPase
  Pfam annotation: Domain name=Hydrolase; Domain location=359-644; Score=76.9; E_value=6.5e-20; Accession=PF00702.16; Description =haloacid dehalogenase-like hydrolase
  Pfam module annotation: Pfam domain module=Cation_ATPase_N::E1-E2 _ATPase::Hydrolase; Domain location=41-122::134-355::359-644
MPYPPIEFESVLRIWRDYQTSEREQKIKQLQKMGEGSVELEAIVKEAVDLENIPIEEVFDNLKCTKEGLSSEQVQQRLDLFGYNKLEEKKESKILKFLGFMWNPLSWVMEAAAIMAIGMAHGGGEGGDYQDFAGIVLLLLINSTISFIEENNAGNAAAALMARLAPKAKVLRDGKWSEEDASVLVPGDIISIKLGDIIPADARLLEGDPLKIDQSALTGESLPVSKHPGEGVYSGSTCKQGEIEAVVIATGVHTFFGKAAHLVENTTHVGHFQKVLTSIGNFCICSIAVGMILEIIVIYGIHKKKYRNGIDNLLVLLIGGIPIAMPTVLSVTMAIGSHKLAQQGAITKRMTAIEEMAGMDVLCSDKTGTLTLNKLSVDKNIIEVFAKGVDSDMVVLMAARASRLENQDAIDCAIVSMLADPKEARTGIKEVHFLPFNPTDKRTALTYLDAAGKMHRVSKGAPEQILNLAHNKPEIQQRVHAIIDKFAERGLRSLAVARQEVPEGTKDSPGGPWEFVGLLPLFDPPRHDSAETIRRALDLGVSVKMITGDQLAIGKETGRRLGMGTNMYPSSSLLGENKDGLGAVAVDDLIENADGFAGVFPEHKYEIVKRLQARKHICGMTGDGVNDAPALKIADIGIAVADATDAARSASDIVLTEPGLSVIISAVLTSRAIFQRMKNYTIYAISITIRIVLGFMLLNSFWKFDFPPFMVLVIAILNDGTIMTISKDRVKPSPLPDSWKLSEIFTTGIVLGSYLALMTVIFFYIVVETNFFPDHFGVKHFHYNPDASIKDPTKRMLGSAVYLQVSTISQALIFVTRSRGWSYTERPGLLLVTAFIIAQAIATVVSATLSWRLAGIKSIGWGWTGVIWLYNIITYLFLDPLKFAVRYALSGRAWNTVINQRTAFTNKNDFGKEAREAAWATEQRTLHGLQSAESKGFTDKHTFREINTLAEEARRRAEIARLRELHTLKGRVESFAKLRGLDIDAMNGHYTV

SEQ ID NO: 179169 - protein, 268 aa, Glycine max
  Coding DNA Sequence Number=SeqID_62391
  Gene Ontology: Mol. function=RNA-directed DNA polymerase activity; Cellular component=chromatin; Biological process=chromatin assembly or disassembly
MKLDIPRFNGHDPLGNSGGRTNYGRLVLYGWPCTQLVPVDVQKRLHHLLAMIVVGPRKSFRTVVLRRSLWSLVQALLAWATALARLQEDKINDRRKGSQQTLFSVPPQHHAQSFSPTNFPKPKTQFAQRIAKDMAFRRQKGLCYNCDEKWSSSHRCKGRVLLFVAESDEPLGSEPTQSFSTPIESSSDPHPPDLSPINPHISLNALAGIPVTDTFRVYDFINQASLIVLVDSGSTHNFVQPQVAKFLNLPVVDIPPLRVMVGNGLVLE

SEQ ID NO: 179170 - protein, 158 aa, Glycine max
  Coding DNA Sequence Number=SeqID_62392
  Gene Ontology: Mol. function=protein prenyltransferase activity; Biological process=protein amino acid prenylation
MSEESHSNVEAMDLLRQFEDILEFDALIDELGFIHPSQFALLKEESYISSNLSDEAIHQSADGVVISEESSKQDNLYFWNRDHKLGISTHVLLPLYRAAKHVFMTTLKQYRMCDNQSDKVGICLPASSSSCDHLESMLLRHSKSLLLLSCDFLTAWNC

SEQ ID NO: 179171 - protein, 105 aa, Glycine max
  Coding DNA Sequence Number=SeqID_62393
MVVHATEYSSHNYYWDSSWMGVCYFTTKRLPEERVPPERDTWLDWTRRCDRGGRACLSGATCRAYLPGATSRADLPSATSSGGVPGTSLFPIKPFALRFIFTQKS

SEQ ID NO: 179172 - protein, 110 aa, Glycine max
  Coding DNA Sequence Number=SeqID_62394
MSPHVMQDGGSSQYSIIIVILQRILLSDRAVYAMMLVFPPEFSPLKTILFGNPSQDTIEPQMEALEEDYKDGNKINESRQFIGGVLDLEKRINRLYTLTQKLNITKFYHC

SEQ ID NO: 179173 - protein, 82 aa, Glycine max
  Coding DNA Sequence Number=SeqID_62395
MSDGSMICYEERTTMGYSGCGYDDGQRGKHCCYHGTRSKTVVVASTIYDEERSNMVCGGCGHDDVLSVFIILRKELGLKAAR

SEQ ID NO: 179174 - protein, 75 aa, Glycine max
  Coding DNA Sequence Number=SeqID_62396
MATSKRVGLRPQKETTPENLAFHGFKQKTQMRHEAETNVNESRRRSKNELVIRSRKRKFALRTRTVAREQKNVKT

SEQ ID NO: 179175 - protein, 79 aa, Glycine max
  Coding DNA Sequence Number=SeqID_62397
MHLLFGSLSHKNFIFKGAWLRLVMGWVTFWEVSHKAFIDLESNQNRLSKSQKKLPMKGSNWWRVPNNEELSEVSPCEVS

SEQ ID NO: 179176 - protein, 252 aa, Glycine max
  Coding DNA Sequence Number=SeqID_62398
  Pfam annotation: Domain name=DUF593; Domain location=206-252; Score= -11.8; E_value=0.0011; Accession=PF04576.6; Description=Protein of unknown function, DUF593
MRDKFPGSEGKGSFWPLSHVGYTEVTLNSNSESKFPFCNDDDDVSRVHDENIEVSNDPIAQVTSAPSSKCIPSSKSRVIKSDPVELISIEEVSPPPIVKKVPHRELESEDSKITSHFKDSLPSPLSEFMTLNGTYAHVGASSEKSANVAQPRDIGMETTSTDTHMVVCDSAPINPKEENSSNMNKSSVTTEEREETGFIKEKPTIEEVNNAVVEASSLNGVQELEEERNASPIATNEAMSMITRLQQEKATL

SEQ ID NO: 179177 - protein, 36 aa, Glycine max
  Coding DNA Sequence Number=SeqID_62399
MSFICRASTSNRSINFTQGDSTSNNSACGWAIYDYG

SEQ ID NO: 179178 - protein, 185 aa, Glycine max
  Coding DNA Sequence Number=SeqID_62400
MRISLVVTKEELKRMLRDRNENDSQQTSLELLPSNMVLRDKRAAGSIRGDALVVDTELLATLPRSPPHLAAPSKAMSRRSKQSTQLRRLTIRSLDQPQPMVNVNPTTGRGSIPYKETFHSYLGGNFDIPKGSNARKKEMSTVTTRWRQFKSSLTTKYVYADNEGQQKHDLFVKYGLEQETWDEFA

SEQ ID NO: 179179 - protein, 71 aa, Glycine max
  Coding DNA Sequence Number=SeqID_62401
  Gene Ontology: Mol. function=nucleic acid binding
  Pfam annotation: Domain name=zf-CCHC; Domain location=51-68; Score =22.6; E_value=0.00019; Accession=PF00098.13; Description=Zinc knuckle
MRLYLTVCKRKRDRSESVHLSSTSQNKKRRKTKGVVEGSFQQNKPNKDEEFTCYFCKKSGHMKKEYPKYTT

SEQ ID NO: 179180 - protein, 365 aa, Glycine max
  Coding DNA Sequence Number=SeqID_62402
MASKEDRDQKPEKEYSFQKGKKSPMDSGGSTGNSWNRVVSSQTLDTMQKETKNKRAFHETWRAMTIAAASWSNPAIKSYILDKRLDPLVSNSRGCFYQEHNTRSKITNRLEEVILRLTQTNHDMSLRLDTIQEQLHLLQLQHHTPPSPPPLPSPQSSPSSRHHLKLDIPRFDSTDAMGWIFKISQFFDYHHTPDEERISVASFYMDGPALSWYQWMFRNGFITSWTALLQALENRFAPTYFEDPKGALFKLTQTGSVNDYLHEFERLANRITGLPSSFLLSCFVSGLVPEIAPRGSGFPANKKLGKGRNIVVEKCIIPKLLLSLLQFENSNQIVLAMNADQKNQEITRLKMKPYLYTFRSSNPST

SEQ ID NO: 179181 - protein, 499 aa, Glycine max
  Coding DNA Sequence Number=SeqID_62403
  Gene Ontology: Mol. function=zinc ion binding; Cellular component =COPII vesicle coat; Biological process=ER to Golgi vesicle-mediated transport
  Homolog annotation: Hit_ID=Q6ZDG9; Match level="QueryCoverage=57%, HitCoverage=35%, E-value=1e-115, Identity=71%"; Hit description =Putative SEC23
  Pfam annotation: Domain name=Sec23_BS; Domain location=173-280; Score= 162.1; E_value=1.4e-45; Accession=PF08033.2; Description=Sec23Sec24 beta-sandwich domain
  Pfam annotation: Domain name=Sec23_trunk; Domain location=1-150; Score=76.7; E_value=7.5e-20; Accession=PF04811.5; Description =Sec23Sec24 trunk domain
  Pfam module annotation: Pfam domain module=Sec23_BS::Sec23_trunk; Domain location=173-280::1-150
VLEELQKDPWAVPADQRAARCTSTALSIAAGLLGACVPGSAARIMAFIGGPATEGPAPIVSKQLSEPIRSHKDLDKDSVPHYHKCVKFYDGLSKQLVHQGHVLDLFACALDQVGIAELKTAVERTGGLVVLAESFGHSVFKDSLKRIFQSASIDAPDCHVFLYISTFIDHLTSFRSGIFEINCSKDLKVQGIIGPCASLEKKGPLCSDVTIGQGGTSAWKMCGLDKSTSLCLFFDVVRKETPDATIQSTSNQFYFQFLTYYQNNGGQMRLRVTTLSRRWVAGPESIQPEPLGAISGTRPETKQLSKKDDGRPVILLARRSNSCKCKAILESLKKCSPRCDKAISKHPLIPAESWPIHVEGCNGDAFLIRRVVVIEELGDLEDPSHGVGAVKAGNIQLEVMAGGRVEVTAGCGVEVAGGGVAPGWYPSAETYRGWSGHLNELVGESLSLDEWTELGEWAESYHGGAYGWFDVSWDDFSTAAIVMARQVSFKMETEGSTYC

SEQ ID NO: 179182 - protein, 70 aa, Glycine max
  Coding DNA Sequence Number=SeqID_62404
MTTLCKSRRKRFLTIQTISPNEKFIFMGNGVKAPVETVETYCLKLDTRHRLNLLETPYVPSLFRNLVSFI

SEQ ID NO: 179183 - protein, 47 aa, Glycine max
  Coding DNA Sequence Number=SeqID_62405
ARFLLAKLNPSATYNTESYNPGGDIIFTDDSRGVGLKPVRKLADGFD

SEQ ID NO: 179184 - protein, 93 aa, Glycine max
  Coding DNA Sequence Number=SeqID_62406
MAKIQGPKEGKTYSNIYKEEWTQPWPMGSEIYPEVHENPRAFFSNSSPILLEPSIQYPWGIGLHHNNPYKQGFSHPFHTHSFSLNKGYSQSNM

SEQ ID NO: 179185 - protein, 195 aa, Glycine max
  Coding DNA Sequence Number=SeqID_62407
  Gene Ontology: Mol. function=transferase activity
  Homolog annotation: Hit_ID=Q1SE38; Match level="QueryCoverage=98%, HitCoverage=51%, E-value=2e-59, Identity=54%"; Hit description =Transferase
MCTTTRFVFGVESINSLKAEEKDRDYDESSKPLTRYKALAAFIWKHMTPACKMKSNNTRPAVVIHILDRRRRIGEPFSRYTINNILWPVMVFCEKHKVQKLLLHIWELFLRVKSDPNILGSTQCMDLTQGGLDFGFGKPLWVGVTRGDKETLPNEVIIMEINEAIQAWLTMEMQHIANLERDIEFLRLALPNPSV

SEQ ID NO: 179186 - protein, 109 aa, Glycine max
  Coding DNA Sequence Number=SeqID_62408
  Gene Ontology: Mol. function=protein disulfide isomerase activity; Cellular component=endoplasmic reticulum; Biological process=cell redox homeostasis
  Homolog annotation: Hit_ID=P29828; Match level="QueryCoverage=91%, HitCoverage=20%, E-value=3e-32, Identity=69%"; Hit description =Protein disulfide-isomerase precursor
MAGIVDYLKKQSGPASTEIKFADEPTAFVGENKVAIVSWSFSLEDFDNFSALAEKLRSDYDFGHPLNVKLLPRGESRVSGPIVRLSKPFNELFVDFQPLSVHATKAPYL

SEQ ID NO: 179187 - protein, 398 aa, Glycine max
  Coding DNA Sequence Number=SeqID_62409
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=91%, HitCoverage=57%, E-value=1e-128, Identity=63%"; Hit description=Wall- associated kinase, putative
  Pfam annotation: Domain name=Kdo; Domain location=55-243; Score= -85.4; E_value=0.066; Accession=PF06293.4; Description=Lipopolysacchar ide kinase (Kdo)
  Pfam annotation: Domain name=Pkinase; Domain location=59-331; Score =183.0; E_value=7.4e-52; Accession=PF00069.15; Description=Protein kinase domain
  Pfam annotation: Domain name=Pkinase_Tyr; Domain location=59-331; Score=142.1; E_value=1.5e-39; Accession=PF07714.7; Description =Protein tyrosine kinase
  Pfam module annotation: Pfam domain module=Kdo::Pkinase::Pkinase_Tyr; Domain location=55-243::59-331::59-331
  Subcellular localization annotation: CTP_CleavageSite=32; ConfidenceScore=5.28e-01
MIGLLLHCKRKHSSSSGQFQTRNTYSTPSSPNAEVESGSVYFGVPLFSYKELAEATNRFDLSKQIGDGGFGTVYYGKLKDGREVAVKHLYNHNYRRVEQFMNEIQILTRLRHRNLVSLYGCTSRQSRELLLVYEYIPNGTVASHLHGELAKPGLLTWSLRMKIAVETASALAYLHASKIIHRDIKTNNILLDNSFYVKVADFGLSRLFPNDMTHVSTAPQGTPGYVDPEYHQCYQLTSKSDVYSFGVVLIELISSMPAVDMNRHKDEINLSNLAIKKIQERALSELVDPYLGFDSDTEVKRMIIEATELAFQCLQQDRELRPSMDEVLEVLKRIESGKDELKHLEEAVHGSGVSHNNNVTTSTELDEAGLLKNRKPPSSPISVPDSRESKSTTPNASS

SEQ ID NO: 179188 - protein, 137 aa, Glycine max
  Coding DNA Sequence Number=SeqID_62410
  Homolog annotation: Hit_ID=Q2QMA7; Match level="QueryCoverage=43%, HitCoverage=34%, E-value=5e-09, Identity=50%"; Hit description =Expressed protein
MAGLLGYRSLPPKAKNLVVVGGLTTFVFGAYFYTMRAVGGTNELQVAIDKFEANKNKNVGDANMRSKAILDSTGSLAKFSCEVEIIELKVVGDFVSSVPGIKMSILLQRLNGYKIFSHQKEQVKERLFRRKILTTKS

SEQ ID NO: 179189 - protein, 160 aa, Glycine max
  Coding DNA Sequence Number=SeqID_62411
MGLNLELKSHSENVNALAFSRQRVLVPVKVNMGDDAFGVETVPIKQIPSSGGDEDVEVDIIGCSNLGKPFLMEDSCEDSPECSSSFGDSGSGAENASSFSDTEVESRKCADDPSSSKCDDWFESCQGSAADHWLRGYYRNSLLNKKPALAKGRETPVSSC

SEQ ID NO: 179190 - protein, 93 aa, Glycine max
  Coding DNA Sequence Number=SeqID_62412
VNSDRDDECLPPQETKKPNRKVAMQVDRSWSRNMTPPKYARSGPLVKVKAEHHRRTNSEGDVGPRLVRSSGMRREWSLEDLAGQQQDKGVRCY

SEQ ID NO: 179191 - protein, 267 aa, Glycine max
  Coding DNA Sequence Number=SeqID_62413
MEVRCGLRAVMACTATEAFGSLAGNVKEKKMKQLQSQARKYEKELAAYNHSKQLDLAHFTLEDSNIKSIPISDRMHRNKVMKRNKRKRVEEQCDIESYMSNHSLFSYYEKTDCTADTCLKDVCDVGIGGVNDSNQEFKLNDEWSSEEYGNVDKSLDDIIQKIEAIQSEVQQLKTRTDKVISESCGKFCSITQFSMRGRSDGFNHFDSTFTSNENTLPFSFPRSSSQLESEFHMGDLLMPGNASASREVMIPCIVTTDGPELDDPLKD

SEQ ID NO: 179192 - protein, 74 aa, Glycine max
  Coding DNA Sequence Number=SeqID_62414
MMPAPDSTLRCNVVRTNNNQISGNSLSMSTRHYYLGNYAEFVETTRLVPKTLEGQCTVPPTVIHNIQRMNVTKR

SEQ ID NO: 179193 - protein, 310 aa, Glycine max
  Coding DNA Sequence Number=SeqID_62415
  Gene Ontology: Mol. function=transcriptional activator activity; Cellular component=nucleus; Biological process=regulation of transcription, DNA-dependent
  Homolog annotation: Hit_ID=P46602; Match level="QueryCoverage=69%, HitCoverage=70%, E-value=2e-62, Identity=59%"; Hit description =Homeobox-leucine zipper protein HAT3
  Pfam annotation: Domain name=HALZ; Domain location=203-247; Score =84.6; E_value=3.1e-22; Accession=PF02183.8; Description=Homeobox associated leucine zipper
  Pfam annotation: Domain name=HD-ZIP_N; Domain location=1-114; Score =107.9; E_value=3e-29; Accession=PF04618.3; Description=HD-ZIP protein N terminus
  Pfam annotation: Domain name=Homeobox; Domain location=148-202; Score= 67.4; E_value=4.6e-17; Accession=PF00046.19; Description=Homeobox domain
  Pfam module annotation: Pfam domain module=HALZ::HD-ZIP_N::Homeobox; Domain location=203-247::1-114::148-202
MSEKDDGLGLGLSLKLGWGENDDDNNNNLNHHQQQQYPFYVHKPPQSVPNQRASFNNLFHFHDRSSETRSFLRGIDVNLPPPPPSAVVDDENAVSSPNSTISSISGKRSEREGNGDENERTSSSRGGGSDDDDGGACGGDGDGEASRKKLRLSKEQALVLEETFKEHNSLNPKQKQALAKQLNLMPRQVEVWFQNRRARTKLKQTEVDCEYLKNCCENLTEENRRLQKEVQELRALKLSPQLYMNMNPPTTLTMCPSCERVAVSSTSFSSSATMPSAPPPANLNPAGPTIQRPVPVNPWAAMLNQHRGRP

SEQ ID NO: 179194 - protein, 74 aa, Glycine max
  Coding DNA Sequence Number=SeqID_62416
MAEDLSLNDRKLSKEHKDLEALHELKGPMIRSKVKLLQEEMIKRIKNGLLIKGKEGKNYKKLNWSTLKIGKQLA

SEQ ID NO: 179195 - protein, 193 aa, Glycine max
  Coding DNA Sequence Number=SeqID_62417
  Gene Ontology: Mol. function=RNA-directed DNA polymerase activity; Cellular component=chromatin; Biological process=chromatin assembly or disassembly
MLDPTNIHTSRSRKLNDSYGITQFQFNATQSKPILLPSVTREKEGWNLTHAHLHHLEVVFQILLCGQFFLKRSKCLFGQRQLDYLSHVVSKNRVSPEPSKDLRAFLGLTGFYRKFVRGYANIASPLTTLLCKDAFRRTPALQDDFAKLKQAMTTTPILALPDFELPFVLETDVFGIVMGVVRPYATRLCHCLF

SEQ ID NO: 179196 - protein, 260 aa, Glycine max
  Coding DNA Sequence Number=SeqID_62418
  Gene Ontology: Mol. function=RNA-directed DNA polymerase activity; Biological process=RNA-dependent DNA replication
  Subcellular localization annotation: CTP_CleavageSite=40; ConfidenceScore=5.30e-01
MQTIVFLVFLTFSSNKRWCRLHTFSFPGRRTLGPHEGPFRAPARWQVATLPMMEREMITMIVDTLPVFYYEKMVGYMPSSFADLVFVSERIEVGLKRGKFNYASPTSTSNRRFGASGAKKERDAHAVTSTSTWDKPQQTHHNPTYQYYPHQPSFLANIGNTPNPAPVQQRLFAQPKRSPPQNSQSRPAGSSNPSISTNPGRNFPVTKLVEFTPIPMPYADLLPSLITIQMAVVNPKKIYQSPFPNVTCAYLGGVPGHSIE

SEQ ID NO: 179197 - protein, 71 aa, Glycine max
  Coding DNA Sequence Number=SeqID_62419
MEDINNVENIMGGNLFQPRQHHQIYNQGYHQTFATMDNNFASQGTFDGFHFKEIDDPFSMEDILNNFHMQF

SEQ ID NO: 179198 - protein, 308 aa, Glycine max
  Coding DNA Sequence Number=SeqID_62420
  Gene Ontology: Mol. function=ligase activity; Cellular component =intracellular; Biological process=chromatin assembly or disassembly
  Homolog annotation: Hit_ID=Q6K9R7; Match level="QueryCoverage=97%, HitCoverage=59%, E-value=2e-82, Identity=54%"; Hit description=DNA ligase-like
MEPDRLNSPTTFEMPLEVMGHELQFSQDPNSKHLGTTVWDASLVFVKFLGYDLKLRDPFEDELGHERNCRKGKFSPAKLKGKRVIELGAGCGVSGIDQKEVLPLLQRNVERNISRITQKNPESFGSIKVAELQWGDESHIKAVGPPFDYIIGTDVVYVEHLLEPLLQTILALSGPRTTIMLGYEIRSTSVHEKMLQKWKRNFDVKTVAKSKMDETFQHPSIQLFIMGFKQSAECTENPGQATVEKVDVETVVEDKSREGNVVVEGSGLVEENVEDHSKPISQNAKLSEWEARRYGAMAARILKDVKIS

SEQ ID NO: 179199 - protein, 120 aa, Glycine max
  Coding DNA Sequence Number=SeqID_62421
  Gene Ontology: Mol. function=structural molecule activity; Cellular component=protein complex; Biological process=microtubule-based movement
  Homolog annotation: Hit_ID=P11139; Match level="QueryCoverage=75%, HitCoverage=22%, E-value=8e-24, Identity=57%"; Hit description =Tubulin alpha-1 chain
MVNNIEDEEALETSTVVFEFSNGGIGVVAFGKVVGGIFLARDELFGVEDLIVGVAANFIKDGGKIDEDDVHNMLVRSSFAKEGVESVMGHTEGDVHAKITPVYSRSSQYHIKYESVDVWS

SEQ ID NO: 179200 - protein, 201 aa, Glycine max
  Coding DNA Sequence Number=SeqID_62422
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRAVAWLRETTGAVAKASLHRAIVTAYGPEPGSEPTDVEESADELWLGVKCHSNPELAGSPRNALRRSS

SEQ ID NO: 179201 - protein, 66 aa, Glycine max
  Coding DNA Sequence Number=SeqID_62423
  Gene Ontology: Biological process=protein transport
  Homolog annotation: Hit_ID=Q8GVS9; Match level="QueryCoverage=94%, HitCoverage=27%, E-value=4e-14, Identity=60%"; Hit description =Putative endosomal Vps protein complex subunit
MEKVKNILKPKPNPQQLLRDWQRRLRQGCRNIERQIRDIQREEKNVQKAIREAAKRNDMGSAKCHD

SEQ ID NO: 179202 - protein, 119 aa, Glycine max
  Coding DNA Sequence Number=SeqID_62424
  Gene Ontology: Mol. function=endonuclease activity; Biological process=sulfate assimilation
  Homolog annotation: Hit_ID=Q12HJ9; Match level="QueryCoverage=100%, HitCoverage=44%, E-value=5e-40, Identity=57%"; Hit description =Endonuclease/exonuclease/phosphatase
MWHDFAYGRNAVYPEGHHGNAILSRFPITEYQNRDISVAGSEKRGMLHCQISLPDRPEPIHTLCVHLGLKEKHRLAQMRMMCELIESLPPDAPLVVAGDFNDWQVRANRFLQRGAGLQE

SEQ ID NO: 179203 - protein, 439 aa, Glycine max
  Coding DNA Sequence Number=SeqID_62425
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=59%, HitCoverage=22%, E-value=6e-57, Identity=49%"; Hit description =Putative retroelement
MKLEVPRFDGSDPSGWTFKIRQFFEYHATLEPERLVIASFAMEGLALAWFQWLTRPLTFDTGPSSGSRETLGRETSRPTPWRPWWLLRPSSTQPLPSSPSVTTNPSVVAFPCEATTDPCLSLVARRDDHVPREGAQPTHPLWVVVTNDNELAWHQLCSGFAIHIQGQTFIVDLHVLPLCGSDLVLGVQWLKSLGPTYPQPNQRLPNTQKSPIYSTDSRPCSKHRRPSLTPIPPTTPSTYYPTQNPSMFILTAIPISESKRLKLKALNAVTIKDRFPIPTTDELLDELGGTFWFSKLDLLQGYHQILMKAEDVCKTTFHTHHGHYELCVMSFGLCNAPSSFQATMNSIFGPYLCRFIIVFFDDILIYSKTFTDHLDHLTKAFRVLLEGRFFLKLTKCTFAQLQDLKTELQHHSSYQELRRNIEDNPQAHSTYVVTKDSIL

SEQ ID NO: 179204 - protein, 125 aa, Glycine max
  Coding DNA Sequence Number=SeqID_62426
MASRKRKSIGTRPTAQYDTRRFHSFEAWTRYTNNVLGRHILPERKVEIYHTELDEFKVELQRRNFHKRLTNLVESSINLALVKEFYANLYSSEGPSPKQVKVRGHVVKIDADSLNTFLETTCGTS

SEQ ID NO: 179205 - protein, 60 aa, Glycine max
  Coding DNA Sequence Number=SeqID_62427
PCAKREPRAKRIFGHALSRESQALSAQPLLLRLICSAKLAKDELSQLQFNLNSAKLQLDR

SEQ ID NO: 179206 - protein, 274 aa, Glycine max
  Coding DNA Sequence Number=SeqID_62428
  Homolog annotation: Hit_ID=Q852H5; Match level="QueryCoverage=22%, HitCoverage=8%, E-value=9e-12, Identity=57%"; Hit description =Putative transposase
MGLTPFELTFGKKPPSIPQYLVGAFNIDVIDDFLKIGPVAYQLKLPPESRIHPVFRCSLLKPFHPSNTLTTHVADLPSQSEDNEPVVTPLVILNTKWVTSDTGPKLMVLSEEQRDVMNKQYTTQAREKCYQTEKRQTLTRESKRQSTRPQYLRYFITNSDKELDLEAVAEAVENSAEIISAACEGSSIEEPNVGMEFQSEEAAKNFYEEYARREGFVVRLDRCHRSEVDKQIISRRFSCNKQGFHVREHSHLLNASALPYNSLIVSLIFFSPRH

SEQ ID NO: 179207 - protein, 174 aa, Glycine max
  Coding DNA Sequence Number=SeqID_62429
  Gene Ontology: Mol. function=transferase activity, transferring hexosyl groups; Biological process=metabolic process
  Homolog annotation: Hit_ID=Q1RXK7; Match level="QueryCoverage=98%, HitCoverage=59%, E-value=5e-26, Identity=70%"; Hit description=UDP -glucuronosyl/UDP-glucosyltransferase
MENFRLKDLPDSIRTTNPNSFMVEFSFEVADNIHRASAIVLNTSDELESGVFSALSTMLPFVYRIGPFLSFLKSKSTEPLGIFRFQSLEGRYRVPTSCRYIWSEWGIGIEIDTNVKREEVEKLVNELMMMVRKGKGMRLKAMELKNKAEEDTRPGGRSYINLDRVINEVLLKIK

SEQ ID NO: 179208 - protein, 53 aa, Glycine max
  Coding DNA Sequence Number=SeqID_62430
MKNKEHHHTVDECDCQDTTSTCFPTLWSLKWPTKAENSQDPQQCLPHTQPSPL

SEQ ID NO: 179209 - protein, 204 aa, Glycine max
  Coding DNA Sequence Number=SeqID_62431
  Homolog annotation: Hit_ID=Q1SDS1; Match level="QueryCoverage=56%, HitCoverage=23%, E-value=1e-12, Identity=35%"; Hit description=IMP dehydrogenase/GMP reductase
SHLFRQEVRHACPLESRRSCTEKGGANWDQLLASKEGASVNWFPRWKEGRTEVLISCGGFPNVPLMGTRGCINYNPVLAIRQLGYPMRGAPLEDELTPIISRGFNKTNVETLQKVRKEWEVLQKKDKELRGSNNGPIGGYRKWLKAHVQGLDWLPSLRTAKREEVEAPEGDEEVQALRAELEQAQTVKERFKSAALKSERRIPN

SEQ ID NO: 179210 - protein, 236 aa, Glycine max
  Coding DNA Sequence Number=SeqID_62432
  Gene Ontology: Mol. function=glycerol-3-phosphate dehydrogenase [NAD(P)+] activity
  Homolog annotation: Hit_ID=UPI000038DB83; Match level="QueryCoverage =86%, HitCoverage=56%, E-value=7e-20, Identity=32%"; Hit description =COG2848: Uncharacterized conserved protein
MALIISASVPHCVVRQMPRFFRFPGMKVREGNMLLADFADQFILRLCARLREIDAFGHELASDSGLEYAGLDASLAPFPDGSISVGRLVENLGARPGGVQGSLFITSILTNAIKSAVAISGARATGFNGVMFSVLEDDALASTNNRRALSIDTLNAWSTVCGCGLDMLPVPGSTLPEDIAAIILDTAALAVRLTKPLGVRLLPIPGGEGKRYLISAPGSGSGLFAFSIRAQKKSPL

SEQ ID NO: 179211 - protein, 128 aa, Glycine max
  Coding DNA Sequence Number=SeqID_62433
  Gene Ontology: Mol. function=oxidoreductase activity
  Homolog annotation: Hit_ID=Q9SLN8; Match level="QueryCoverage=96%, HitCoverage=41%, E-value=1e-25, Identity=48%"; Hit description=Allyl alcohol dehydrogenase
MAQVRNKQVLLKDYVTGFPKESDMNIVENTITLKLPEGSNEVLLKNLYWSCDPFMRNLMNKPEGPPNSLAHTPGSHQKPEFMLVKEEYSLLPSAQILFKIEHTDVPLTYYTGMLAMYSMISIYIVYHG

SEQ ID NO: 179212 - protein, 52 aa, Glycine max
  Coding DNA Sequence Number=SeqID_62434
MVSDTETSRTLQTSSRRSQWSAGGKGVTHPVPVGVLGLWDLFAFSKCTGLRK

SEQ ID NO: 179213 - protein, 53 aa, Glycine max
  Coding DNA Sequence Number=SeqID_62435
METRNHDSVAFGGRKSRQRCCFTECVNVARVILSSNREGWSMRAVSEIDKFHI

SEQ ID NO: 179214 - protein, 696 aa, Glycine max
  Coding DNA Sequence Number=SeqID_62436
  Gene Ontology: Mol. function=RNA-directed DNA polymerase activity; Cellular component=chromatin; Biological process=chromatin assembly or disassembly
  Pfam annotation: Domain name=RVP_2; Domain location=54-167; Score= -33.4; E_value=0.0004; Accession=PF08284.2; Description=Retroviral aspartyl protease
  Pfam module annotation: Pfam domain module=RVP_2::RVT_1; Domain location=54-167::298-467
MKEGANGKHTHTYYEYLIYRPDAEHHDIPDQVTDDTYPHISLHALSGFPSSETFRLYGIINHARLTILIDSGSTHNFLQPRIAQFLRLPVKPTSPLRVLVGNGSVLDCNQLCSDTPLSLQGHHFNVSFHLLPISGADAVLGIEWLKQFGPVITDYTALIMKFHHLGQAIELHADVSNGLEPVSAPQVKRLIRTGSTSALFHLSLLSITRPKPPHHHLPQHHLPHPDPAIENLLRRYHQIFETPTTLPPPRNVTHHINLLPSSSPINVRPYRYPHFQKTEIEKQVSDLLSAGLIPTSTSPYSSPVLLVKKKDGTWRMCVDYRALNTVTIRDRFPIPTIDELLDELGQSSWFSKLDLRQGFHQILMHEPDIEKTAFRTHQGHYEYRVMPFGLSNASSMFQAAMNSLLTPFLRRCATVFFDDILVYSKSLSLHVHHLEMIFKALLDAQFYLKYTKCVFAQKQVDYLGHVVSGRGVEPEPSKIQAMLQWPTPTSVRELRGFLGLTGFYRKFIRDYASIASPLTTLLCKDAFEWSEVSQAAFDALKSAMTQAPVLALPNFFEPFIVETDASQTAMGAVLVQKDHPVAFFSKVFGPRLAHASTYIRELHTIVTAVRKWRQYLLGRSFTILTDHKSIQELMTQVIQTPKQHYYLSKLLGFDYTIRYKAGTSNIVADALSRAPPPSSQILLLSVPHLDFISDLR

SEQ ID NO: 179215 - protein, 682 aa, Glycine max
  Coding DNA Sequence Number=SeqID_62437
  Gene Ontology: Mol. function=protein-tyrosine kinase activity; Cellular component=integral to membrane; Biological process=protein amino acid phosphorylation
  Homolog annotation: Hit_ID=Q1SML3; Match level="QueryCoverage=92%, HitCoverage=63%, E-value=1e-173, Identity=49%"; Hit description =Tyrosine protein kinase, active site
  Pfam annotation: Domain name=LRRNT_2; Domain location=33-72; Score =49.9; E_value=8.8e-12; Accession=PF08263.3; Description=Leucine rich repeat N-terminal domain
  Pfam annotation: Domain name=LRR_1; Domain location=101-123; Score =13.9; E_value=0.6; Accession=PF00560.23; Description=Leucine Rich Repeat
  Pfam annotation: Domain name=LRR_1; Domain location=125-147; Score =14.0; E_value=0.54; Accession=PF00560.23; Description=Leucine Rich Repeat
  Pfam annotation: Domain name=LRR_1; Domain location=149-171; Score =14.3; E_value=0.45; Accession=PF00560.23; Description=Leucine Rich Repeat
  Pfam annotation: Domain name=LRR_1; Domain location=173-195; Score =16.2; E_value=0.12; Accession=PF00560.23; Description=Leucine Rich Repeat
  Pfam annotation: Domain name=LRR_1; Domain location=197-219; Score =11.2; E_value=2.3; Accession=PF00560.23; Description=Leucine Rich Repeat
  Pfam annotation: Domain name=LRR_1; Domain location=221-243; Score =13.9; E_value=0.59; Accession=PF00560.23; Description=Leucine Rich Repeat
  Pfam annotation: Domain name=LRR_1; Domain location=245-267; Score =6.4; E_value=18; Accession=PF00560.23; Description=Leucine Rich Repeat
  Pfam annotation: Domain name=LRR_1; Domain location=269-291; Score =15.6; E_value=0.18; Accession=PF00560.23; Description=Leucine Rich Repeat
  Pfam annotation: Domain name=LRR_1; Domain location=293-315; Score =10.5; E_value=3.1; Accession=PF00560.23; Description=Leucine Rich Repeat
  Pfam annotation: Domain name=LRR_1; Domain location=317-339; Score =14.0; E_value=0.56; Accession=PF00560.23; Description=Leucine Rich Repeat
  Pfam annotation: Domain name=LRR_1; Domain location=341-363; Score =2.0; E_value=1.2e+02; Accession=PF00560.23; Description=Leucine Rich Repeat
  Pfam annotation: Domain name=LRR_1; Domain location=365-384; Score =5.1; E_value=32; Accession=PF00560.23; Description=Leucine Rich Repeat
  Pfam annotation: Domain name=LRR_1; Domain location=389-411; Score =8.2; E_value=8.4; Accession=PF00560.23; Description=Leucine Rich Repeat
  Pfam annotation: Domain name=LRR_1; Domain location=413-435; Score =7.8; E_value=9.7; Accession=PF00560.23; Description=Leucine Rich Repeat
  Pfam annotation: Domain name=LRR_1; Domain location=437-459; Score =9.9; E_value=4; Accession=PF00560.23; Description=Leucine Rich Repeat
  Pfam annotation: Domain name=LRR_1; Domain location=461-483; Score =15.3; E_value=0.22; Accession=PF00560.23; Description=Leucine Rich Repeat
  Pfam annotation: Domain name=LRR_1; Domain location=485-507; Score =18.1; E_value=0.033; Accession=PF00560.23; Description=Leucine Rich Repeat
  Pfam annotation: Domain name=LRR_1; Domain location=508-530; Score =7.5; E_value=11; Accession=PF00560.23; Description=Leucine Rich Repeat
  Pfam annotation: Domain name=LRR_1; Domain location=532-554; Score =14.2; E_value=0.49; Accession=PF00560.23; Description=Leucine Rich Repeat
  Pfam annotation: Domain name=LRR_1; Domain location=556-578; Score =12.1; E_value=1.6; Accession=PF00560.23; Description=Leucine Rich Repeat
  Pfam annotation: Domain name=LRR_1; Domain location=580-602; Score =11.6; E_value=1.9; Accession=PF00560.23; Description=Leucine Rich Repeat
  Pfam annotation: Domain name=LRR_1; Domain location=604-625; Score =19.1; E_value=0.016; Accession=PF00560.23; Description=Leucine Rich Repeat
  Pfam annotation: Domain name=LRR_1; Domain location=627-648; Score =13.4; E_value=0.86; Accession=PF00560.23; Description=Leucine Rich Repeat
  Pfam annotation: Domain name=LRR_1; Domain location=76-99; Score=0.4; E_value=2.4e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1; ...
  Pfam module annotation: Pfam domain module=Domain location=33-72::101- 123::125-147::149-171::173-195::197-219::221-243::245-267::269 -291::293-315::317-339::341-363::365-384::389-411::413-435::437 -459::461-483::485-507::...
  Pfam module annotation: =508-530::532-554::556-578::580-602::604 -625::627-648::76-99
MVFIFPTLLSMKLQPLLLLLVMYFCAFAASSEIASEANALLKWKSSLDNQSHASLSSWSGNNPCNWFGIACDEFNSVSNINLTNVGLRGTLQSLNFSLLPNILTLNMSHNSLNGTIPPQIGSLSNLNTLDLSTNNLFGSIPNTIGNLSKLLFLNLSDNDLSGTIPFTIGNLSKLSVLSISFNELTGPIPASIGNLVNLDSMRLHENKLSGSIPFTIGNLSKLSVLYISLNELTGPIPTSIGNLVNLNFMLLDENKLFGSIPFTIGNLSKLSVLSISSNELSGAIPASIGNLVNLDSLFLDENKLSESIPFTIGNLSKLSVLSIYFNELTGSIPSTIGNLSNVRALLFFGNELGGNIPIEMSMLTALEGLHLDDNNFIGHLPQNICIGGTLKIFSASNNNFKGPISVSLKNCSSLIRVGLQQNQLTGDITNAFGVLPNLDYIELSDNHFYGQLSPNWGKFRSLTSLMISNNNLSGLIPPELAGATKLQRLHLSSNHLTGNIPHDLCKLPLFDLSLDNNNLTGNVPKEIASMQKLQILKLGSNKLSGLIPIQLGNLLNLLNMSLSQNNFQGNIPSELGKLKFLTSLDLGGNSLRGTIPSMFGELKSLETLNLSHNNLSGDLSSFDDMTSLTSIDISYNQFEGPLPNILAFHNAKIEALRNNKGLCGNVTGLEPCSTSSGNLIII

SEQ ID NO: 179216 - protein, 271 aa, Glycine max
  Coding DNA Sequence Number=SeqID_62438
  Gene Ontology: Mol. function=RNA-directed DNA polymerase activity; Biological process=RNA-dependent DNA replication
MVSKRTFIGGKQLLHSVFIANEVIDEAKRKKKKMLSLQGRFWKGIWFKVDFEKAYEGLTGLMREVSAKGFYKGFEVVDGSLVSGLKTRTTPFIYLGLPIGANHKRVETWQQFPKKVCKKLERIQSRFLWGGNDEVKKSGLAKVIGYLRKKGTWRLGGEIHGISDNTSHQWESLWWRDLKKVRGGLNDSKWFENAFSWKVGNGDKCRFWKDSWLEEQSLQQKFPRLFSVSVQKDSLICEGNVDSETHGVGTVIKKGSSLLAQHMISSRARDM

SEQ ID NO: 179217 - protein, 115 aa, Glycine max
  Coding DNA Sequence Number=SeqID_62439
MVLSTCKINPNGLSWMYIKRRKGWLLQGWLWVVCYGMAGSRGRGSHGRQVEVIENRVHLAGKFYADDGFFKAIGGRLSGSVVGHGNGGGGRSDQLLCDRGWGSAFVRGKAPPKKV

SEQ ID NO: 179218 - protein, 391 aa, Glycine max
  Coding DNA Sequence Number=SeqID_62440
  Homolog annotation: Hit_ID=Q9FG25; Match level="QueryCoverage=53%, HitCoverage=60%, E-value=1e-10, Identity=24%"; Hit description =Arabidopsis thaliana genomic DNA, chromosome 5, P1 clone:MPH15
MSLLRHVCTTSKLSAAAAASTATMAIPWKYKKFAISQGQKSLTDYLHATRSIPYAYANQIAKNSLTSLTTLITTLGTSSFSPLHFPHNLNKFLMYHPINEFEFFFESIGIHPSNFHSLLPQDKFFFSQDDTLLSAACVLYEFGFPWDRLGVLYVESGCFLNWGASELKDRVCGFKRYGLCNEQVVGVCMAFPFVFDGQKGDDEVEALFRDLGLLFGEFGLAECVEGKGNYSVDDWIRVCRKIRLFYDLNGGKSLVELIGRNNGGGVGVIVEHGEEELVQAAEYFCRFGAKKEDVARLIVDGPELLELDLEAWVVDVVKLLKYFGMRSDDVEDVRRDYAHVLGTVKMGNLPNVMRALGLREWFFDKIKDGNHQLLVSFVTSCPGEFQDEGYL

SEQ ID NO: 179219 - protein, 73 aa, Glycine max
  Coding DNA Sequence Number=SeqID_62441
MEKRRSVQARLYVGGRASEGLEVEVTRVGICWTMVVLPTLGLSVQSLRGLDLGKKMVQLGGGVVRRSCMTQSH

SEQ ID NO: 179220 - protein, 261 aa, Glycine max
  Coding DNA Sequence Number=SeqID_62442
IGSRPTAQYDTRRFSSLDAWTRYTDNVQGRNILPERKVEIYHSELDEFKAELERRNFHKRLTNLVDGSIDLALVKEFYANLYSYEDHPPKQSRVRGHLVKIDADSLNTFWETPVVLAEEETLPAYSKYRRKDMTTLAQVWSVLSYSKLAPTSHTSDLIVDRARLIFGLVSRLDMNIGAMISGHITSIAQSNTSRLGKNSWNPEDLTVSIRGARRARARPTELPSTFAAPTPAVPSVPAQTDSLRFEAMLQSIHRGQIILLQ

SEQ ID NO: 179221 - protein, 138 aa, Glycine max
  Coding DNA Sequence Number=SeqID_62443
  Subcellular localization annotation: CTP_CleavageSite=53; ConfidenceScore=5.15e-01
MAITEAQEVKAAAPSLHLHLHPYHWSSCSYTVAYMPAPQASSQTSGFTTTGCVASGSGEMSRYVKKSTMPELVLKGPLLGNLPGDYPFDVPPYLDRWKVGFKVDMFGFDFNNGPIYNIDDESFINAMLYYFKPSFSNR

SEQ ID NO: 179222 - protein, 434 aa, Glycine max
  Coding DNA Sequence Number=SeqID_62444
  Pfam annotation: Domain name=Transposase_23; Domain location=158-228; Score=-3.6; E_value=0.0028; Accession=PF03017.5; Description =TNP1ENSPM transposase
MAEKTKKRLEEVAQSRSTEGIIDPPSPIRRHVKWKMARTKKTGQMTSEAAKEIADRIESVIGIVRPPWTSGYPDCCHWATRAPWPCSCCWSRPRTTDPITEKVTRKMMASFRQMQYQFQSQMQSQGLALPSEPEVGPSGPRVSTKESCVAPSGNDPGTGHSAKYGLYIEENPSSLVALGRLYEGSTTVHNIPLLHGQVKVGVEEVKDAEALVPVPTDEVTLVGQALNTFLAWPTHLVKRLSEHAAVSPAKPLESPDEVVDDPLYLMTLIIPQLFLKPLQVMWDATIFGVFNQNFPLYIKHEDLSEIAHGGQCLSISVIQLWILHLIETSVRAGNSDVYEFLEPQSNQRSRQSQFESESYIKSWIQSSKRDVYLGAYLNGSDNYLKGIINSALKGLDDAPQPKSKAAARWIVVKTIGSREIQGVSHPVDTVLSKS

SEQ ID NO: 179223 - protein, 68 aa, Glycine max
  Coding DNA Sequence Number=SeqID_62445
MDLITILVMKKLVALKGSYSCGIVQFIAHKSMHTSQNMCYMGALGEEGVECDANNGGRLGGFDVELVF

SEQ ID NO: 179224 - protein, 252 aa, Glycine max
  Coding DNA Sequence Number=SeqID_62446
MANQCYLANVNRKAIAEKAIKKMGEAKAAKKVATIEEVIIESLKTSTREDELRNESDIEQVLDEVVLEVVKVVSEEELQKAELNARMHLALETVSLQVSDVATDLDTIEIDLGVIPLYHCTFITIDEVVVDALLAQPILEGDISRLENIYGATNMVKLWKEGVLGIDPFSCSSSKTLNPSPPNLNRIIFEHRPTDIKVYPLGATLWARIEVAYDEMPFYTPLDLQRLLGLMATFNASQIESSMIMAHRYVCA

SEQ ID NO: 179225 - protein, 223 aa, Glycine max
  Coding DNA Sequence Number=SeqID_62447
MLKPCLKQQDQMSVLELYIEKDVAGDDDDDYLVSNSYVEKSLDKDDSIDDISDTDDEVTDMIQPVRIVHPAQGVQGIQNQFWNDALHYNNINWSNPDEEDICGLEMPSSFNVGQELYVGMNFDSKDAVKNAVKQYVMKVHQSFKVVESKLNKYSALHYPCSHIIAACGFVSMNYYQYIDVVYTNEHILKAYSTQWWPLGNEAAIPPFDDAWTLIPDPTTIRAK

SEQ ID NO: 179226 - protein, 60 aa, Glycine max
  Coding DNA Sequence Number=SeqID_62448
MVRLVWVGKVQGFEEGEVMVVKVLLIVGSRKFDSDVPIFTKVASFSWVAPDDALSKKPPL

SEQ ID NO: 179227 - protein, 1649 aa, Glycine max
  Coding DNA Sequence Number=SeqID_62449
  Gene Ontology: Mol. function=ATP binding
  Homolog annotation: Hit_ID=Q2QQZ4; Match level="QueryCoverage=99%, HitCoverage=95%, E-value=0.0, Identity=38%"; Hit description =Expressed protein
MNAEDNKYAEGVSPSLEFIITSKDITATGASATLLIFNNEKGFSRENIESICSVGRSTKKGNRSSGYIGEKGIGFKSVFLLTAYPYIFSNGYQIRFSEKPCPHCDIGYIVPEWVEQKPTLHDIKQIYGAGAGSLPTTTIILPLKPDKVKPVKHQLSNIHPEVLLFLSKIRHLSVREDNEDPKLNSVNAVSISSEINFCTRKNMNAESYTLHLSAAENGGSEKECRYYMWKQKFPVRFENVVERREDVEELIVTLAFPNQERLHRGKSLPGVYAFLPTEMVTNFPFIIQADFVLASSRETILLDSKWNQGILECVPSAFMDAFKTLVLGSDQAPISCLPPVFRFLPIDSSPFEKLNYVREKIKEKMLGESIIPIETYGEQKHFYKPCEVSRLLPEFWDILAEAQAERVYLHNLSSHNGRKILSSSFDKIEYDDILSFLGIQQVNTDWYAKCIQSSNLVDGVSEVVYLNLLLFIATNWSSFKSSKVTDIPLIKYVDSDGNLSHFTLDQCSNRYGAKQVVLADPSQPSLCSWLIDWNSEFSCKTSRFFMPEVTQQAILHSLSRHTLLEWLENQVHVTTLDVNYFAQVLCSCIKKDSKLAIKYAHFLYQSFSKLYLSSREVHNLCSSMPLLDSYGHVIECTCRKGVLVPANVSKWADLIVFNPWRNEDYVELGKEYLHRSRNAGQYTGSGKLIEFLKNHVDASDIPHIYPPNAGFSAVDTPLTKDNAFLLLDWIRNLKYRGVNLPERFLKCIKEGSWLKVTVNGWRPPSKSFLIGSSLGRILQSGSVLVDIPLIDESFYGSRINQYKDELKTIGVMFSCEEACEFIGRELMSRAVSFTLSRNHILLMLEFIEYLRQNYLPLDQFVNSIKEGSWLRTSHGLRSPTGSVLYDSGWKVASKISVIPFIDKDYYGEDICKFKEVLELLGVIVGFNENYQVVIDHLKSSSELANLTADALLLTMKCIRFSQGSSELVDSLKITSCLKTNMGFKTPSECFFYDPVWGCILEVFSGLPVIDHKFYGKQIFTYKDELKQIGAVVDFEEAIEKIADLFKQKASQTLFNRHHVKSFLSCCRLLKGTEYQFPSSFSKIIHEQKWLQTGVGGYRCPRKCILDGPEWKPISSITSLPFIDDSENCYGKGIHEYKEELKSIGVVTEVKDGVKFVPECLNFPSDPSTISPESVFSLLECIRLLMHGVVPPIEDGFKKRLSQNWLKTHSGYRSPGKCLLFDSKWNKHLKPTDGPFIDEKFYGPEIASYKKELNAIGVTIDVGEGCLLVASHLDFLSDYDTIERIYRYLSEHHWKPEPDDKAARKIWIPGSAKWVYSEKCVIHDQDNLFGSKFYVLGDMYDKKILPFFSFAMEVRNKPSIDDYVNLWNDWESSVEQLSYDKCYKFWMFMLKHFSTETKKLSNCLVKLPATSGNNEIVLLDKNDVFIPDNLHLKKLFQQEKVFVWYPQNLAPLSRCELFDVYRKIGARNISESICMEEPSLLNGVELKQVDPGNICNVKVLAKLILSFLSSSSLKMEPNKRREAVQGLLNLSFFETKEAVNVSYSLSLSSGAIITKKADRMVRWQGQSSKFFTQTNWQSGNASLIKYATYFSEAISEGVLRENHDHVPALSELITLAFVLKFNNETIEFLMESKNLHCEDEEFLSSAFPSN

SEQ ID NO: 179228 - protein, 55 aa, Glycine max
  Coding DNA Sequence Number=SeqID_62450
GEYYGRYDETMQHLGPFAKFLQKHGICAQYKMPGHWIEDSKKIGPEMQEKALGFS

SEQ ID NO: 179229 - protein, 438 aa, Glycine max
  Coding DNA Sequence Number=SeqID_62451
  Gene Ontology: Mol. function=ATP binding
  Homolog annotation: Hit_ID=Q2QQZ4; Match level="QueryCoverage=95%, HitCoverage=35%, E-value=8e-54, Identity=42%"; Hit description =Expressed protein
MKRVSPPETLNIYAVLDCPQRKAKGAVVTRATKILFNEKPCPHCGIEYIVPKWVEERPTLQDIKQIYDAGDDLVPTTTIVFPLKPDKVNPVKQQLSNFHPEVLLFLAKIRHLSQKFPIRFENEVERRMDVEEWIVTLAFPNQERLHRGRSSPGIYAFLPTRMVTYFPFIIQADFVLVSSRETVILDDKWNHGILECVPSAFVDAFKTLVRGLLPEFWGISREAQTGVYLHNLSSHDGRKILSSSLDTRQYGILNFLGVQKVRFDWYAKCIESSNLVSRESEKVYLKLLLFVATIWGWIVYDCTKGAKRKHLVLADPDHHTLLGRLGNQVKVTTSNVYTFASVLCSSEIDTLCRSMPLLDNFGCVRKLRKGVLMLASVSKWASFIVSNPWRSEDYVELGKEYLHPSCYAGQSTDYEKLIKFLTDCDILYPNMHINGKNV

SEQ ID NO: 179230 - protein, 477 aa, Glycine max
  Coding DNA Sequence Number=SeqID_62452
  Gene Ontology: Mol. function=lipoxygenase activity; Cellular component=cytoplasm; Biological process=electron transport
  Homolog annotation: Hit_ID=Q93YI8; Match level="QueryCoverage=94%, HitCoverage=51%, E-value=1e-143, Identity=53%"; Hit description =Lipoxygenase
  Pfam annotation: Domain name=Lipoxygenase; Domain location=1-455; Score=510.3; E_value=2.2e-150; Accession=PF00305.9; Description =Lipoxygenase
MTFPPQNKFGIQSSIKQSIIEQKLEGWTLSQAMEHGRIFMLDHHDFLIPYLNRINANGVCAYASRTLLFLRSDGMLKPLTIELSLPGQSPHLEIHRVFLPAKQGTQAALWQLAKAHVLANDAVYHQLISHWLYTHAVVEPFIIATKRRLSVMHPIHRLLNPHFKDTMHINALARLILINSGGIFERILFPGEICMQISCDLYKEWRFNEQGLPADLLKRGMAVKDPDKNNPTRIQLLLLDYPYATDGLEIWVAIKEWVKDFCSFFYKDNEAIEGDVELQAWWSEIRTQGHGDKYNDIWWYQMTTLSNLVESLTTLIWIASAKHASLNYGQYAYNGFPPNRPMLCRKFVPLEGTVEFGEFLKDPDKFFLKMLPDRFEMSLAAALVDVLSRHTCDEVYLGCQQSPGWIDNEVIQNRFAEFKQELKEIQTRIMQRNRDPKLKNRRGPANIEYTLLYPDTSSSSASASGITGRGIPNSISI

SEQ ID NO: 179231 - protein, 287 aa, Glycine max
  Coding DNA Sequence Number=SeqID_62453
  Homolog annotation: Hit_ID=Q9LSV8; Match level="QueryCoverage=12%, HitCoverage=6%, E-value=5e-08, Identity=77%"; Hit description=Serine carboxypeptidase I
  Pfam annotation: Domain name=Transposase_23; Domain location=87-157; Score=-4.8; E_value=0.0039; Accession=PF03017.5; Description =TNP1ENSPM transposase
MTSEAAKEIATKIASQGSFVPHGRQDLLTTAIGRPEHLGCVRATEVGVTGPAGGVDYIKSDSATDVILHPDAILGSCVDPSVTDLDTGDSDKCGLYIKENPSRLVTLGRVYEGSTAVHNIPLLHGQVKVGVEEVEDVDAPVPVPTDEINLVGQTLNTFLAWSTHLVMWDAIVFGVFNQDFPLHIKHEDLSKIAHGGQCLNIFVIQLWILHLIETSMRAGNSNVYGFLEPHALKELDDTPQPKSKAGARWIVVEGYMVGNGVTDEQIDGNALVPFVHGMRLIPDELFE

SEQ ID NO: 179232 - protein, 91 aa, Glycine max
  Coding DNA Sequence Number=SeqID_62454
MAKATVVAGTSGKVQMVVRTSVARRELAKKEEEGSVLATDRKPYFARAVFFSIEGFSFSQLFFFIEVVIARLVWGAKFAVRLDSSQGLTTS

SEQ ID NO: 179233 - protein, 97 aa, Glycine max
  Coding DNA Sequence Number=SeqID_62455
  Gene Ontology: Mol. function=DNA binding; Cellular component=nucleus; Biological process=regulation of transcription
  Homolog annotation: Hit_ID=Q2HVT2; Match level="QueryCoverage=63%, HitCoverage=19%, E-value=1e-23, Identity=83%"; Hit description =Homeodomain-related
MDPTQKNMCKSEGMPASIMPAEPSTLEHGPGNWRVVPTKIGLSRCSKSYRLRSTNYLRPGIKRGNIIEQEEKMIIHLQDLLGNMYKSIFQAPTYFEF

SEQ ID NO: 179234 - protein, 470 aa, Glycine max
  Coding DNA Sequence Number=SeqID_62456
  Homolog annotation: Hit_ID=O22159; Match level="QueryCoverage=89%, HitCoverage=79%, E-value=3e-43, Identity=31%"; Hit description =Expressed protein
  Pfam annotation: Domain name=DUF247; Domain location=32-456; Score =318.3; E_value=1.3e-92; Accession=PF03140.6; Description=Plant protein of unknown function
MASSAASYTAVPETEPRIEHIININPKDIEPAWHDVCCIYKVPPNLKNLKVEAYAPLLISIGPFHHNKPELEPMHKQKQRYFLSFWERVTNKKALAKYKAFLNENIEATIRQRYSEPITSFSNDQFVEMILLDSVFILELFLRKSEKSKQEKDYMFTTPWIYKGIQRDLLLLENQLPIFVLDELHRRVCKQNGVSFLELAFNYFEDYYPYPHKSTTTSDYDQTKEMVKKNFKSCNHFTDLIRLFYLPERVHVKEWMPSKHFTPCGKNECVLKTAAKLNEAGVSFEKLHHHKCLLDIKFKMVPVLSWFLCLGCIPCSMCVKARLQIPQLKVLQTTECVLRNLIALEQCHYSDQPFICNYVSLIDSLIHTQEDVELLVDKEIIVHELGCHNELATMINGLCKHVVVNCNYYGKTSRKLNDHYNCCWKHYMGMLRSVYFRDPWRLSSTVVGVVIFLFAIVNFLRVTNLYHPKD

SEQ ID NO: 179235 - protein, 325 aa, Glycine max
  Coding DNA Sequence Number=SeqID_62457
  Gene Ontology: Mol. function=oxidoreductase activity; Cellular component=vacuole; Biological process=response to oxidative stress
  Homolog annotation: Hit_ID=Q9ZNZ6; Match level="QueryCoverage=99%, HitCoverage=92%, E-value=1e-118, Identity=66%"; Hit description =Peroxidase precursor
  Pfam annotation: Domain name=peroxidase; Domain location=41-288; Score=426.6; E_value=3.5e-125; Accession=PF00141.13; Description =Peroxidase
MESQSYFKALIIILIALIGSTQAQLQLGFYAKSCPKAEKIILKYVVEHIRNAPSLAAALIRMHFHDCFVNGCDGSVLVNSTQGNQAEKDSPPNLTLRGFGFIDTIKSVVEAECPGVVSCADILALTARDSVHSIGGPYWNVPTGRRDGVISKAEEALLSLPAPFHNLTTLLTLFGNVGLDVNDLVLLSGAQTIGVSHCSSIATRLYNFTGKGDTDPTLDNEYAKNLKTFKCKNINDNTTLIEMDPGSRNTFDLGYFKQVVKRRGLFQSDAALLESSTTRAIIARQLQSTQGFFAEFAKSMEKMGRINVKTGTEGEIRKQCARVNS

SEQ ID NO: 179236 - protein, 95 aa, Glycine max
  Coding DNA Sequence Number=SeqID_62458
  Gene Ontology: Mol. function=translation initiation factor activity; Cellular component=multi-eIF complex; Biological process=regulation of translation
  Homolog annotation: Hit_ID=P41568; Match level="QueryCoverage=73%, HitCoverage=62%, E-value=2e-32, Identity=92%"; Hit description =Protein translation factor SUI1 homolog 1
  Pfam annotation: Domain name=SUI1; Domain location=16-92; Score=78.9; E_value=1.6e-20; Accession=PF01253.13; Description=Translation initiation factor SUI1
MSIDPFADANAEDSGAGTKEYVHVRVQQRNGRKSLTTVQGLKKEYSYSKILKDLKKEFCCNGTVVQDPELGQEPEITCYRYLPFSELFCSPNTRE

SEQ ID NO: 179237 - protein, 108 aa, Glycine max
  Coding DNA Sequence Number=SeqID_62459
MTVEVVAQEETQADEVFCNENTISQTTTPNSSCNEAGVTSVNNVTATTFEFSKVQKLTNSLTRKRKKFWCEGVKVLRNLVSLRNSLTRKLAQEVFVQTHEKTSEETSI

SEQ ID NO: 179238 - protein, 506 aa, Glycine max
  Coding DNA Sequence Number=SeqID_62460
  Homolog annotation: Hit_ID=O22159; Match level="QueryCoverage=90%, HitCoverage=78%, E-value=3e-48, Identity=31%"; Hit description =Expressed protein
  Pfam annotation: Domain name=DUF247; Domain location=39-501; Score =326.6; E_value=4.4e-95; Accession=PF03140.6; Description=Plant protein of unknown function
MEPATNNNPSPSAHASLHETKYIERVKHALIDFGVPEELRLSDRSIYKVPCYLRKVKEDAYTPQCISIGPIHFKKEELKPMQEHKLRYYQFFGRRVGVSDEQMEAYKHYLETEEKQIRQCYAEKFLDITKDTFVDMMLLDAVFIMELMLRNCEFKSHKAKHEQNHKRTESFRIKNNNDLIMTHSWLSRNIAGDLILIENQIPFFVLQKLYDDVVPRESKKDEHTAGFVKLATEYFAFYDTQMSSSGETKKHCSCYILHCLKEPCKSKGKDRSEISKRPLGSNSEENPEGPKHFTDLIRWQFYLPTECEAGHAHQVLRTATKLQGSGISFEKGDVNKRLLEIAFKKTPILSSFLCFGCFPLSKLFKARLRIPQLKVDHTTERVFKNLVAFEQFHYPDKPYFCNYVSFIDSLIHTQLDVELLVEKEVIVHELGSDKEVATLVNGLCKHVVTNSTCYHHIINKLNDHYMNDWNHTIAALRLVYFRDLWRASGTVVGIAVLVFAVFQFLR

SEQ ID NO: 179239 - protein, 113 aa, Glycine max
  Coding DNA Sequence Number=SeqID_62461
MHYIVVRILLPRSSNLAQASEEDLILMWDFLTGHPIDLAHLIRYHMHKALQSNAPLPYPQLVTLFLHHFQIPLDNKPFVKVKCSFAIGVGVVTSFGYRKDMDGQWLKKDAQPP

SEQ ID NO: 179240 - protein, 150 aa, Glycine max
  Coding DNA Sequence Number=SeqID_62462
  Homolog annotation: Hit_ID=Q6S7A2; Match level="QueryCoverage=38%, HitCoverage=15%, E-value=1e-10, Identity=45%"; Hit description=TATA binding protein associated factor 6b isoform 1
  Pfam annotation: Domain name=DUF1546; Domain location=24-99; Score= -8.9; E_value=0.01; Accession=PF07571.4; Description=Protein of unknown function (DUF1546)
MALCFMAIEGVQLTIPENAPVEGIFPDLSAIKLNFLSSSAEFLPISFFPRVTKTFLHSFLDPTKALPQHYGSIKGIEALGSRLACRLLEMKRHEAWQVYGALLGIWLGMLGGTVMQTVILLWVTFRTDWTKEVPLSFDLAIENTRYGYPI

SEQ ID NO: 179241 - protein, 267 aa, Glycine max
  Coding DNA Sequence Number=SeqID_62463
  Homolog annotation: Hit_ID=Q1RZJ4; Match level="QueryCoverage=46%, HitCoverage=2%, E-value=2e-24, Identity=45%"; Hit description =Aldo/keto reductase; Sigma-54 factor, interaction region
RGPRLACVKDSASLSLTPRLAPILPCELSTKELEKILRGSLQSPIPGMGSKVFENLDASDLVRMMLKLELCYEQDPSDPYSLLLIPSILEEGRGKPWKWQLSMQDCVYAGCHLECDDSSHMFLTPGFFSGLQFDGHFTITRRKYEFGPSVNYRDGGNRSLRAKDDSTTNEPGDGNCDEGDAQDDETVTPDEIGDGENADELTLDKDATYSHCIGFKPDVLDQTSYTNMDLDVHKDATLMEDGELNEQVQLAQNRNEGNQHEETALLM

SEQ ID NO: 179242 - protein, 124 aa, Glycine max
  Coding DNA Sequence Number=SeqID_62464
  Homolog annotation: Hit_ID=Q1SMF0; Match level="QueryCoverage=60%, HitCoverage=14%, E-value=6e-08, Identity=41%"; Hit description =Tetratricopeptide-like helical
MVCRQVVVVGVAVKGGGKMDEDQWMYNNIMSEEVDMNEENEEEPVRHPYVGRLTKDEKIIVGDMTKSMVKPRNILLILKGHNVNSYTTIKQIYNARYAYRSSIRDSNTEMQQLMKLLKWDQYIH

SEQ ID NO: 179243 - protein, 158 aa, Glycine max
  Coding DNA Sequence Number=SeqID_62465
  Homolog annotation: Hit_ID=Q1SL15; Match level="QueryCoverage=64%, HitCoverage=12%, E-value=2e-10, Identity=33%"; Hit description =Ovarian tumour, otubain
MMDEDQWMYNSIMSEEVDMNDENEEEAGVNEEKHVDCSKAFNTSHEWSEYRSRKKGFVRRDTSRRKCGCPFKVHGKPVVRGQVGHPYAGQLTKDKKIIIADMTRSMVKPRNILLMLKEHNVNSCTTIKQIYNARSAYRSSIRGSDTEMQHLMKLLARD

SEQ ID NO: 179244 - protein, 323 aa, Glycine max
  Coding DNA Sequence Number=SeqID_62466
  Homolog annotation: Hit_ID=Q75LL9; Match level="QueryCoverage=70%, HitCoverage=21%, E-value=4e-50, Identity=38%"; Hit description =Expressed protein
MKIKTFKDEDTRISIWNLAGQHEFLSLHDLMFPGHGSASFFIIISSLFRKPSNKEPKSSTEIEGDLQYWLRFIVSNSKRAIQQCMLPSVAVVLAHFDKINQPSPNLQHIVDSIQRLRDKFQGYVEFYPIVFTVDARSSASVNWRSENYNKPAMKWKEFGELCQVKVPSLRIRSRNDNKERVEMKRRAIATCLHHIGEVVYFDELGFLILDCEWFCGEALGQLIKLNVRKRHLLRLWQVYQIALSSKPRKSEYRFHRDFIALYRILFNLQGISHSWPLRALQLGVKERMGRVFLLDYALSAWPSLSVRNGFCIFELNACTALRA

SEQ ID NO: 179245 - protein, 247 aa, Glycine max
  Coding DNA Sequence Number=SeqID_62467
  Homolog annotation: Hit_ID=Q69TB0; Match level="QueryCoverage=40%, HitCoverage=87%, E-value=1e-40, Identity=65%"; Hit description =Putative ubiquitin-conjugating enzyme family protein
MEYEISRTFGHLYYAWSLGNLNTLCWAIGSISGPMMEEQGYHGDTSATFYCGDVDDIAKKLVQEIERGEKGIGDGTVNYGMDDGDDIYMRSWTIGPHNAVHEGRIYQLKLFCDKDYPEKSPSVRFHSRINMTGVNHETEVEMAAPHNRKLVQPPEGTYFYHPRLYTRWIELQWPLLITGEVLGQREGLVFENKMSDPLGFVVRFAAASVANRACMCYPRLFSDGLGKSLSYGSGYELVFVLLDLGLS

SEQ ID NO: 179246 - protein, 165 aa, Glycine max
  Coding DNA Sequence Number=SeqID_62468
MDEDQWMYERIMPEEVDMDDENEEECGVNEPHVDCSDAFNTSQVFDSQEYVLRWARSVAYENGFVAMIVRKKGFVRRDTETRKCRCPFKLHGKPVVGGQGKAEKTLIADMTKSIVKPRSILLILKEHNVNSYSTYKTNRYRLPLLDFVGVTPTGMIFSVGFAYME

SEQ ID NO: 179247 - protein, 55 aa, Glycine max
  Coding DNA Sequence Number=SeqID_62469
MLRFNIAREFACEFTQESLLVAVEGVDDEAEKGFDFANRLKTVLKNLILVMNKKN

SEQ ID NO: 179248 - protein, 80 aa, Glycine max
  Coding DNA Sequence Number=SeqID_62470
  Subcellular localization annotation: CTP_CleavageSite=58; ConfidenceScore=5.04e-01
MTTGRINQQAPGQASSETTDFKEQCGGTRPPTFTACTASERTITTRVPQEAAYGWTTNVVHVWDFESSSVPNKEAWMEWV

SEQ ID NO: 179249 - protein, 246 aa, Glycine max
  Coding DNA Sequence Number=SeqID_62471
  Gene Ontology: Mol. function=protein kinase activity; Biological process=protein amino acid phosphorylation
  Homolog annotation: Hit_ID=Q1S3G1; Match level="QueryCoverage=85%, HitCoverage=72%, E-value=2e-44, Identity=41%"; Hit description=AAA ATPase
  Pfam annotation: Domain name=DUF889; Domain location=44-239; Score= -0.2; E_value=1.7e-11; Accession=PF05970.5; Description=Eukaryotic protein of unknown function (DUF889)
MAYDKEMLAEQYYTAYQLLTDEQKTIVNTIMSVVNTQSAAVYFLYGYGGTGKTFVWTTLSSGIRSNGGIVCTIASLLLPGGRIAHSKFAIPVPATENSTCNIHQGSELAELLKVTKLIVWDKAPMCHKFAFEALDKSLKDIMQNNLPFGGKIMVFGGDFKQILPIVPKGIPNHKLKLKVGTPIMLLRNLDQTDGLCNGTRLIITKLGSNVIEAEVITGSNSGNRTYIPRINMSPSESPWPFKLIRR

SEQ ID NO: 179250 - protein, 58 aa, Glycine max
  Coding DNA Sequence Number=SeqID_62472
MFGIQNVPRKVDSLGWMEMKICHVALPTSYINSLSQDGLLILARVWVALVLRRKPKCS

SEQ ID NO: 179251 - protein, 174 aa, Glycine max
  Coding DNA Sequence Number=SeqID_62473
MELVVTKGGFLQNSDDDLGEVLEVLDGVEAEGVGVVVVRDNSEYGELAEGEKDKGGRVEKPPMREKIESRENGERKKNRYKKMISRPRSICDQLLTVVALARLVLLLHDRIRQKLEIEREQHPEFHGGDQSGSQCFARMLQPYGINIGLKEHSNRVTPKAYTPKSPSGPLPPDS

SEQ ID NO: 179252 - protein, 116 aa, Glycine max
  Coding DNA Sequence Number=SeqID_62474
MMLLVLQISTMQMKNLLHQMHMLNLDEDVMPNVTQERQEAREYYELARISDKAMTMILELLRDAFEHVKILGKMKKGKHAEFVTHQNGKKPKAKAGMTEVSSEDNNVKKILAKVLQ

SEQ ID NO: 179253 - protein, 242 aa, Glycine max
  Coding DNA Sequence Number=SeqID_62475
  Gene Ontology: Mol. function=nucleic acid binding; Cellular component= integral to membrane; Biological process=DNA integration
  Homolog annotation: Hit_ID=Q1S9I4; Match level="QueryCoverage=81%, HitCoverage=21%, E-value=6e-20, Identity=27%"; Hit description =Integrase, catalytic region; Zinc finger, CCHC-type
  Pfam annotation: Domain name=zf-CCHC; Domain location=175-192; Score =14.3; E_value=0.0044; Accession=PF00098.13; Description=Zinc knuckle
MKAMWDLIQVTHEGTIEVRRSRKDSLIQEYETFRMQQGETIRDVQKRFTHIVNHLKGLRIVFEEEETWQPMVTIILESKDLIPIAHVELFGKLKEYEMDITRMVEEEAKEKKSKCLALESSIPSSDEENVEGFENENLTLLVRKFKRFLKKNNPKGRSFQQKHNFKKNDSTSPKFTCFEYGKPGHTKSKCSIYLKKQQGEEKKAMSQGNKKKEYIAWEENASNTTSDSSNEEEANICFMVDG

SEQ ID NO: 179254 - protein, 122 aa, Glycine max
  Coding DNA Sequence Number=SeqID_62476
  Gene Ontology: Mol. function=RNA-directed DNA polymerase activity; Biological process=RNA-dependent DNA replication
MVAFIRQYQYNYDMVPDRMQLQNMCKREHESFKDYAQRWRDLEAQVAPPMMEREMTTMIVDTSLVFYYEKMVGYMPSSFVDLVFAGERIEVGLRRGKFDYAASMNRKPEEMEKIRRREEPML

SEQ ID NO: 179255 - protein, 75 aa, Glycine max
  Coding DNA Sequence Number=SeqID_62477
MFHSKCDNGILLGYSETSKAYRVYNSRTLLVEETIHVRFNDNIRLEDTKNTSNKDEPNNDPTVYESNAMNQKRRK

SEQ ID NO: 179256 - protein, 285 aa, Glycine max
  Coding DNA Sequence Number=SeqID_62478
  Homolog annotation: Hit_ID=Q6Z3T8; Match level="QueryCoverage=52%, HitCoverage=46%, E-value=7e-69, Identity=78%"; Hit description=Auxin- regulated protein-like
  Pfam annotation: Domain name=OTU; Domain location=144-270; Score =127.2; E_value=4.5e-35; Accession=PF02338.9; Description=OTU-like cysteine protease
  Subcellular localization annotation: CTP_CleavageSite=64; ConfidenceScore=5.43e-01
MSICFSTSQSSINAVVLKGRTPLLMSSNIHGLWSQGISTSISSSLSPGKSEISHVGLSVCTKLSCSTVMGQTIRGGFLGSCCSKQRGNPRFFSSVVPRKSSEPAHAESHSENENRKDDCNEYESNVKVLHGKKVYTDYSVIGIPGDGRCLFRSVARGACLRSGKPPPNESIQRELADDLRARVADEFIKRKEETEWFVEGDFDTYVSQIRKPHVWGGEPELFIASHVLQMPITVYMYDKDAGGLISIAEYGQEYGKENPIRVLYHGFGHYDALEIPRRKGPKPRL

SEQ ID NO: 179257 - protein, 99 aa, Glycine max
  Coding DNA Sequence Number=SeqID_62479
MTKLQGSMPSSLVADWCRENEEMTKGSECVWVVAAQSYCELREVQMWRRRTILGGKSGGWEVDNGGRRPTVNMRPNREDDGSWTKSNMKGEIKHHEGRS

SEQ ID NO: 179258 - protein, 90 aa, Glycine max
  Coding DNA Sequence Number=SeqID_62480
MEDALFLAWSWLKAREKAPEVPCIFLSSSTPCTVKNLTWEATRGVNFRIGGMQKNDKGRDSNPKRETVEKQGEEEKQTQKKHLRIIDFFF

SEQ ID NO: 179259 - protein, 73 aa, Glycine max
  Coding DNA Sequence Number=SeqID_62481
MASVKEQSAMVQRIVKVPGSLLFYGKEDDGMVKEFALGQNVFWHYHQFWHQHLLPSEALCHSSRLRMQKKKKQ

SEQ ID NO: 179260 - protein, 92 aa, Glycine max
  Coding DNA Sequence Number=SeqID_62482
  Gene Ontology: Mol. function=RNA-directed DNA polymerase activity; Biological process=RNA-dependent DNA replication
MEIIKTYEHASGQAINLQKSNVFFSRNVQQLDRGEILEVLGVQEGNSNGKYLGLPAIIGRSLSNLFSCKFCRLKDWYMMEARWKKWKTFLEQ

SEQ ID NO: 179261 - protein, 113 aa, Glycine max
  Coding DNA Sequence Number=SeqID_62483
  Gene Ontology: Mol. function=nucleic acid binding
  Homolog annotation: Hit_ID=Q1T4Y5; Match level="QueryCoverage=77%, HitCoverage=30%, E-value=1e-24, Identity=58%"; Hit description=Zinc finger, CCHC-type
MSSDKYNVLIVRLNGKNYSAWAFQFEIVVTEKKLWGHIVGIDSALEKTRKDAHAKWEVKDTQVKAWILGSIDPHIILGLRPFTTTSKMTIVPSWMLVSMSYFMRNNISSLKRP

SEQ ID NO: 179262 - protein, 156 aa, Glycine max
  Coding DNA Sequence Number=SeqID_62484
KGLEPSKWANCIFGKGKGLGLGLVEPGGTKLVMFGVENAMVDIVVDEVIVKMGVVIGINKGRVREVEIGGVDERREVEASVTIMVETRVGLVWMAKEKDEQWAKNIACYNDNIEKVLAPIVVIAFAPTVEVLTPRWVQVPFPKGVLAPIIAATPAP

SEQ ID NO: 179263 - protein, 118 aa, Glycine max
  Coding DNA Sequence Number=SeqID_62485
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=29%, E-value=2e-36, Identity=57%"; Hit description =Integrase, catalytic region
  Pfam annotation: Domain name=rve; Domain location=1-118; Score=17.7; E_value=0.0002; Accession=PF00665.16; Description=Integrase core domain
MDFIMGLPAYKGNTCIFVVVDRFAKGLHLGMLPTHHTGHTVAMSFMEMVGQLHGMPRSIISDRDPLFINKFWRELFTLSGTRLCLSSAHHPQSDGQTEVANRIIEQYLRAFVHQKPSA

SEQ ID NO: 179264 - protein, 307 aa, Glycine max
  Coding DNA Sequence Number=SeqID_62486
  Gene Ontology: Mol. function=chromatin binding; Cellular component =chromatin; Biological process=chromatin assembly or disassembly
  Homolog annotation: Hit_ID=Q1SAV4; Match level="QueryCoverage=67%, HitCoverage=52%, E-value=2e-55, Identity=52%"; Hit description =Integrase, catalytic region
  Pfam annotation: Domain name=Chromo; Domain location=156-206; Score =25.4; E_value=0.0002; Accession=PF00385.14; Description='chromo' (CHRromatin Organisation MOdifier
MTPFEVTYGRKPPSFPQYIASTSKIDAVNDILNQQEAVFELLRRKLSKAQSQMKETTDKQCRDQEFEVGDWVLVKLIPHRQTSTTGSAYSKLAKRYYGPFQVMVCMGKVAYKLLLPDHSRIHPIFHSSLLKPYVASTDPRDIADLPPMAVDNHPVITPLAILASKIIPSETGPKRMVLVQWEGLAPEDTSWEEWSEFKSLHHLEDKVLFDGQGNVTKNIGGVPLAREQQETSNSEGVSLARPRRKKVVPTYLDDYVLNRYEDISEVYRYPTRCNTGTFPFLKYGHFIDVVERTVPKLCPEGSLDRFS

SEQ ID NO: 179265 - protein, 149 aa, Glycine max
  Coding DNA Sequence Number=SeqID_62487
MFPFRRKVSNAEWPDNACKLSYAGGGSGSRSFADDDGCGGVISDANSSSSATSRNNEGAHLCPREYLSSQWKHNPFSRWTANSSGVSLLKGMEGVKVHEGLLSLEAVVLAAGAHRGVSPPANAHKPLPELRRPVAKLALLDGSQGSTPR

SEQ ID NO: 179266 - protein, 293 aa, Glycine max
  Coding DNA Sequence Number=SeqID_62488
  Gene Ontology: Mol. function=RNA-directed DNA polymerase activity; Cellular component=chromatin; Biological process=chromatin assembly or disassembly
MKFITEGKLVELHGEREKVGEPVSLSQLHRLLHTSPSSTFFHIRVEADPQPASTAQTLPEIFALISKYSSLFQPHTNLPPSRPTDHSITLLPNATPVNAKPYKYPYYQKQEIEDQVAAMLAKGFIQPSSSPFSLLVLLVKKKDGFYRRFIRGYATLATPLTKLLSHGQFQWSSEANDAFQKLKDAITTSFVLTLPNFKAPFVVETNASGTGMGAVLSQGGHPIAFFSKQFCPRMANSSTYVRELAAITAAVKKWRQYLLGHQFIIMTDHRSLRELMNQAVQTPEQHRYLVRLL

SEQ ID NO: 179267 - protein, 186 aa, Glycine max
  Coding DNA Sequence Number=SeqID_62489
  Gene Ontology: Mol. function=chitin binding; Cellular component =extracellular region; Biological process=chitin metabolic process
  Homolog annotation: Hit_ID=UPI00006A17C9; Match level="QueryCoverage =84%, HitCoverage=100%, E-value=8e-20, Identity=40%"; Hit description= UPI00006A17C9 related cluster
MSKSCGFGMTSPLDESISCFLIRVDTWVLVPITFRGLHVLALRGLHVLTIRGLHALTSRGLHVLALRGLHALTLGLHVLALRGLHVLTIRGLHALTSRGLHVLALRGLHALTLGTSYPHRQRTIRPRLERTTRPHHQRAARPHLQRTTRPRLERTTRPHHQRAARPHLQRTTSPRLERATRPHLGY

SEQ ID NO: 179268 - protein, 150 aa, Glycine max
  Coding DNA Sequence Number=SeqID_62490
MDEFLSSIWNSDDNNQVNPPQPILDEAAKHKKRKHLSVVEQSLELGHEMRAFDDDDDDHHDASSSVKVIFEGRKSLHEDFLWHSLPVIYSGILTKFLLFFSHNFLGVYGGDLEHLLDDSLKGDIVRAFKDDSYPAPLHVGRTVNVEALPV

SEQ ID NO: 179269 - protein, 103 aa, Glycine max
  Coding DNA Sequence Number=SeqID_62491
  Gene Ontology: Mol. function=DNA binding; Biological process=DNA integration
MELPNILWAYHCSPQTTTNETPYRLTYGTDTMIPVEVKEPLTRRLLFQQQQNKENMRIELETTDEVQEMAIIKEEVTKLRASRRYNTKVQPQDFQPDNLVWRV

SEQ ID NO: 179270 - protein, 287 aa, Glycine max
  Coding DNA Sequence Number=SeqID_62492
  Gene Ontology: Mol. function=RNA-directed DNA polymerase activity; Cellular component=mitochondrion; Biological process=RNA-dependent DNA replication
MTCTSTRKNALLGSMEASSSPSFAEKAKPFYKLHKKTKPFLWDKTCKQAFLAFKKTIATSPVLSRPRLGVPLLLYLLVADEVVSSTLVQEEGKHQLLIYYTSCILHDARKHYQMIEKVTLELISSTRRLRPYFQSHQVVVKTNYPIKQVLQKPELAGRMSLYVDGASNVKGSRVGIILEGPDNVTLKKSPKLNFEASNNQAKYEALIAGLKVEMLQIPTIDTEEVMAEEEEELHWMIPNKNFLIWGVLPLDENDALCLERKASYYVILDGELFKRWLTTPLLKCLNR

SEQ ID NO: 179271 - protein, 247 aa, Glycine max
  Coding DNA Sequence Number=SeqID_62493
  Homolog annotation: Hit_ID=O04892; Match level="QueryCoverage=28%, HitCoverage=13%, E-value=3e-23, Identity=76%"; Hit description =Cytochrome P450 like_TBP
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSMRTLKAEEGKGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQN

SEQ ID NO: 179272 - protein, 277 aa, Glycine max
  Coding DNA Sequence Number=SeqID_62494
  Subcellular localization annotation: CTP_CleavageSite=40; ConfidenceScore=5.55e-01
TSTSPVAAPEAHQTQGSSLVSLTSLKARQTQGLPLVILTSSSNPRSILGESHISESSSNPRSVLGLSNPRYILGESCISKGSSNPRSPLVSLASPKAHQTQGPPLVSLASPKARQTQGPPLVSLTGSSNPRFVHGESRISKGSPNPRSVLGESRISKGLSNPRFALGESYRLVKPKVCPGESHISKGSSNPRSALGESHFFKGASNPRFTLGESRFSKSSSNLRSTLGESCFSKSSSNLRSSLGEPRHNSTGLLNSWSSLGEPRQNPGRTCFLSKAR

SEQ ID NO: 179273 - protein, 193 aa, Glycine max
  Coding DNA Sequence Number=SeqID_62495
  Subcellular localization annotation: CTP_CleavageSite=56; ConfidenceScore=5.10e-01
MDKSCLGSRVVTLTSEKVMGLLGLSSPSSLISVVRTTSFKLFGVDMLLVLQVISIGGSSEKETFHKASNNESFSLDKLRVSCRTGGGISRLHGRAHLSAASLVGEPVLVTMILSPYISGGARRSYGRSVRASPHVRCSHSVGFPSSLPVVASFEWVRDDILKYKSSITSVSSVLVLQCQVKLASPEDSYKIAV

SEQ ID NO: 179274 - protein, 92 aa, Glycine max
  Coding DNA Sequence Number=SeqID_62496
MVETLGPFSPRVPLCVSDRPEFCFTLRSKDEKRGWNLLLLKLVRNNDLYPVHAVPPKDQLVRFFPAYFGFEVFSVALVLLVEPLYCLENLFQ

SEQ ID NO: 179275 - protein, 109 aa, Glycine max
  Coding DNA Sequence Number=SeqID_62497
  Gene Ontology: Mol. function=transporter activity; Cellular component= membrane; Biological process=oligopeptide transport
  Homolog annotation: Hit_ID=Q9CAS0; Match level="QueryCoverage=84%, HitCoverage=14%, E-value=3e-19, Identity=45%"; Hit description =Putative peptide transporter; 37139-33250
MMFTLVGHIQFYNTESLDKMKSIGNSLQYLVVAFSIYVGTLLVNVVHQLTRKHGGIDWLNDDINAGRLDYYYFLMAGLALINLIYILFCVKHYRYKVNVEEKVVEKLEP

SEQ ID NO: 179276 - protein, 517 aa, Glycine max
  Coding DNA Sequence Number=SeqID_62498
  Gene Ontology: Mol. function=zinc ion binding; Cellular component =membrane
  Homolog annotation: Hit_ID=Q1SXA1; Match level="QueryCoverage=71%, HitCoverage=98%, E-value=3e-76, Identity=41%"; Hit description=Zinc finger, SWIM-type
  Pfam annotation: Domain name=SWIM; Domain location=387-419; Score =19.0; E_value=0.0033; Accession=PF04434.8; Description=SWIM zinc finger
MKFYTINPRRKMMRKKPSLVHQSHSYHHSLVHQSHSYHHATYHHICKILKNPIFKILNTVIACIVKKSNIQWGLFVKGCRASYIHASNRWEIRNFCEPHTCSNPSISQDHGKLLYFLIGKSIHNLIENDSSTSVLALIAYIKSTKGYTTTYREAWLEKQKVIGNIYGNWERLYHDLLRLLQAMQKFLPLIVVEKETLPMPPQKGQAVEGFIMFHRHFWSFRPYIDEFQYCKLIVQVDETWLYGKYKGILLVEVAQDGNNKILPIPFAVFKSESTGAWLFFLQNLKGMLSHNMVRRYKNNPIKKLIINMGVLVKSTYVRCNTLFNKRGREAVAMLASGQVCTKVLNKVIEDARRKKNAHNILEFDRRDSQFLVQETINPRKVQPVVDFTVKLDERWRDCGKFQKLHKPCSHVVTSCKHAHREYRNYIYLMYMLESVSNIYKGFFGELHNETYWSPCHESMICPDPKKKRSTKGHPIFSRIHTKMDIQEPSQPKRYFVCCIPGYSKKNCPHCVDLSQQR

SEQ ID NO: 179277 - protein, 72 aa, Glycine max
  Coding DNA Sequence Number=SeqID_62499
MARSACTAGLVHNTRLADSSRLSAGLAQRVGSAQRKKVHEEKAQCVLSAQKHAQCEVNVKIMYHLLPLTLEV

SEQ ID NO: 179278 - protein, 368 aa, Glycine max
  Coding DNA Sequence Number=SeqID_62500
  Gene Ontology: Mol. function=transcription regulator activity; Cellular component=nucleus; Biological process=regulation of transcription
  Homolog annotation: Hit_ID=Q1SJ81; Match level="QueryCoverage=63%, HitCoverage=71%, E-value=2e-51, Identity=49%"; Hit description =Aldehyde dehydrogenase; Helix-loop-helix DNA-binding
  Pfam annotation: Domain name=HLH; Domain location=293-341; Score =40.9; E_value=4.5e-09; Accession=PF00010.16; Description=Helix-loop -helix DNA-binding domain
  Subcellular localization annotation: CTP_CleavageSite=31; ConfidenceScore=5.40e-01
MDSHIHHHHHQGYQQHQNQPSSGLLRFRSAPSSLLSNLTPFVSEDFGSSSFRELQGNNNKGCSKDLSSMNSHKGVYGGGLPPHYPRHRGSSSSAATSSSAMEGSFGLVGSMGMNHETPQNGLGSSLLRHSTSPAGLFSNNNINFQNGFATMKGVGNYGGVNGSNGELSPCINGLKNQISEIGNEDIEATSPDDDTRHEGNDTQQYGPGFPYGSWNDTPQLSENLSGLKRGRSSNEKMFSDEIQNGELGNQVNMLSHHLSLPKTSAEMITMKKLLQFPDSVPCKIRAKRGCATHPRSIAERVRRTRISERMRKLQELVPNMDKQTNTADMLDLAVEYIKDLQKQFKTLSEKRAKCECTSMQKADTNQIA

SEQ ID NO: 179279 - protein, 277 aa, Glycine max
  Coding DNA Sequence Number=SeqID_62501
MKLPFYPELVKDFYSNLEIQEDSLISEVYGIKMIIDQSLFFDLTQLSSDGVSFEGSFDDEWKFDFSMSDSLQMFNVPLDSEPFVKVKRSFSIGANVVSSFGYRKERDGSWVKKDAPVQAAKDHSPSPYSQRDDSSSLMNNILERFNGLQTYVGERFDSLECQVDTRFEEMNSRIAKVEEDDCHHKKEGDCGSNNFQDYFDDAKESRVKQVPKNQESKSFKNQVSKNQDSRIIKFQDSIKFQESRFKNNQDQDSRLKIQESREDSIKISTKKAFQNIE

SEQ ID NO: 179280 - protein, 238 aa, Glycine max
  Coding DNA Sequence Number=SeqID_62502
MLSLLAEPTPQQLADYCRAYILELIGGVLMSNKSGNRVHMMYLSLLPNLDWAGWYNRGSAYRATEAYGFLESHAVMSWATDSLHNLDKVHHTNMRGHNDTKWVEEHQRWIAIWKERHKYVLIGQPILRKIKHMNWYQENSRIFLTGFATYLNVIATSRLAPNMEIEQHPPQESPPVVSSMHDEGMPPHVQSYEFMPQPYHHEQDYKYNPQFFSVSGEDFMSNLMGTDLRTLEYAYVYM

SEQ ID NO: 179281 - protein, 126 aa, Glycine max
  Coding DNA Sequence Number=SeqID_62503
MKEGEFVDDMFGRLQVLLNNLEALGKTDTKAQINLKVLDNFPKVWGPKTTTIKEPECPKPKKRRYSCNKKKKSLMVTWDDSDIEKSSNLDNEQANIFLMADTNDKVEISLVGKCQGLSWYLDSGYS

SEQ ID NO: 179282 - protein, 311 aa, Glycine max
  Coding DNA Sequence Number=SeqID_62504
MEFGLRHQETPSRVTFLEVEVSKWRATAPTVWRVDHPKVASATIAFAEIVRSNHQLSSKVGSVLANLLCTRLDDDELFKCCKDLQEEKKDLAGRVEDIATEKDELAKKVADLKAQLKESESRLEEFALRTAREREDGKELEEKLLIYMKKAIEQHEKGFNKAVRHTEFFVKDLDLGLFDPFKDVKDNVLLDKEEIVMKEEAFGEEQGAEEKQDLVDVEVLSPIWWGFLLLGGASPLMLLRSMFDLPLVEGLANQSEDRLLDLLSFSSDGYEDDLTYEAYPLMVMRNKYGIHLIEGHGDALGFVGVITNGGP

SEQ ID NO: 179283 - protein, 205 aa, Glycine max
  Coding DNA Sequence Number=SeqID_62505
MDALAILSLPSASDPLAALDEATREAGRSYEWDYVIVCCCSYCWRRGSTCRGHPNAPSSILAKRKKDNGVEPSGHKKSKAPMSLRTLRQAVGLTPSAGHPSIVQDMPLAPSTVKAHNVVVSTPEAALVTTEENAPATLAGSIMAPSSAIAAPLLSASVATTSAHVVPFSSTPMVPPSIALASISTSSHPHVSLNHIYTANDADSL

SEQ ID NO: 179284 - protein, 55 aa, Glycine max
  Coding DNA Sequence Number=SeqID_62506
MLLRWASELHMLASRGTFVKRTRGGTCKTKDFDPQPKSHWSNLHALVSCPVLRRA

SEQ ID NO: 179285 - protein, 101 aa, Glycine max
  Coding DNA Sequence Number=SeqID_62507
  Gene Ontology: Mol. function=RNA-directed DNA polymerase activity; Cellular component=mitochondrion; Biological process=RNA-dependent DNA replication
MDILGSLPKIPRVVKYLLVAIDYFTKYDLPYAIVMDNDTKLKSQTYEDLLTRLGIKHLVTSIKHPQTNGQAEVANRVILKAMRTRLDKAKGLWKNEFPSIL

SEQ ID NO: 179286 - protein, 61 aa, Glycine max
  Coding DNA Sequence Number=SeqID_62508
MECHHMEELRKLKADHGRTTDQHPFIDRIREADIPLGWKPLNLEQYDETIDPHEHPDAFLT

SEQ ID NO: 179287 - protein, 167 aa, Glycine max
  Coding DNA Sequence Number=SeqID_62509
  Gene Ontology: Mol. function=DNA binding; Biological process=DNA integration
MEIFRKSVWNVCKLLASPVPPGKVEGVCPEYWLVEASSHHFGGKGASSGVELHSRLVVVPPELGSSCRGHPAWFFLFSGHNFVNIYGESLERSLDDSLEMPNLLGAGQLGEQVCSGIALPKNIVHFEAFEIIDEGFGNVVVLKQHHLFGLLFIGNLSLDKLRVYVVL

SEQ ID NO: 179288 - protein, 193 aa, Glycine max
  Coding DNA Sequence Number=SeqID_62510
MHSKAEALEHIKKRDTGHQSVSLENKTGDSTVLKIGDSAEVVIKQDMKGRKHKYGFNNNKHEKPENIRVVDDETGDKHQLDEVLRMPSTYHGFSTCLPSSSSSSSCSFGRIGFAVYREADMQASRLRSLSTRPPGADPPVVHVDPATGKANGPHRKKLRIYLGIVVRDKVDVTYENRKEVPTAQKDLIWEDIK

SEQ ID NO: 179289 - protein, 83 aa, Glycine max
  Coding DNA Sequence Number=SeqID_62511
  Homolog annotation: Hit_ID=Q1SWI7; Match level="QueryCoverage=72%, HitCoverage=9%, E-value=4e-19, Identity=67%"; Hit description =Leucine-rich repeat
FIGNNLCGPPLPINCSSNGKTHSYEGSDGHGVNWFFVSMTIGFIVGFWIVIAPLLICRSWRGRVAERKEGKDRRCGGMELRIT

SEQ ID NO: 179290 - protein, 200 aa, Glycine max
  Coding DNA Sequence Number=SeqID_62512
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=2e-26, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=35; ConfidenceScore=5.46e-01
MSSPRLERAARSRFQRATRPRLQGTTCPHLQRATRARLQGTTRPRLQRAIRPRLQRAARPGLQRATRPRLQRAARLLLQRATRPHLERITRPHLTLRGLHALAFRGLHVLAFRRLRTLTFRGLRVLAFRELHVLTFRGLHVLAFKGPHALTFRGLHVVTFRGLHVFAFKGLHVLAFKGLHALTFKGLHVLAFRGLHALSI

SEQ ID NO: 179291 - protein, 123 aa, Glycine max
  Coding DNA Sequence Number=SeqID_62513
  Gene Ontology: Mol. function=cysteine-type peptidase activity; Cellular component=cytoplasm; Biological process=fucose metabolic process
MLPEENTLPKSYYQTKKILCPMGIEYQKIHACPNDCILYKHEFEEMHKCPRCGVSWYKVKDDDECSSHENSKMGPQRRCCEKNVYASVIGTLINIQGKTKDGLNTHQVLAEMDIRAQLHPRSD

SEQ ID NO: 179292 - protein, 117 aa, Glycine max
  Coding DNA Sequence Number=SeqID_62514
MSNSGASHIEMLEIEQWKLSRYSNGLDFSLGCPIQALHISRCTKLNNGSYEEFPIVDFSLGCPIQALHISRCTKLNNGSYEEFPIVLTFHSDVRFRRITYRDARNRTTEAPEIFKWS

SEQ ID NO: 179293 - protein, 97 aa, Glycine max
  Coding DNA Sequence Number=SeqID_62515
MYIKYGPKYIMKHSQQNKLSNETKTPHTYSQNNSKAPKFLKDMVISWFFHLRLVVSFKTRKGKQGSKGLSKELIQGRINKNQAKAIVQAINGAKHTK

SEQ ID NO: 179294 - protein, 356 aa, Glycine max
  Coding DNA Sequence Number=SeqID_62516
  Gene Ontology: Mol. function=RNA-directed DNA polymerase activity; Biological process=RNA-dependent DNA replication
  Homolog annotation: Hit_ID=Q1SBV5; Match level="QueryCoverage=98%, HitCoverage=63%, E-value=1e-35, Identity=28%"; Hit description=RNA -directed DNA polymerase homolog F21E10.5-Arabidopsis thaliana
MGSLTRSHVMHADDIMIFCKGTSRNVHNLINFFQLYKDSFGQVISKHKSKIFIGSIPGQRLRVISDLLQYFHSDIPFNYFGVPIFKGKPTRRHLYCVADKIKCKLASWKGSILSIMGRIQLVNSVIHGMLLYSFSVYAWQTHAFYFLLPMDDHLWDRRVTIVSMRSLCGKNCESYDHLMSRYSFADSLWNWRGSLLSCHIDTQSSFTILAFERSSWSPQMKDVFLASISFVVWCHLLVPFSSAISMISSKIKMTGNHTKAVMNSSISEFQIMKKLDINGHPRRADRIKEVMWYLPKENWVKCNSDESPLGCPGVAGWAGIFRNHIGSFLGYCTANLGKKIQLLLEFMDAILAIEKA

SEQ ID NO: 179295 - protein, 112 aa, Glycine max
  Coding DNA Sequence Number=SeqID_62517
MSNEAPDDEVAPQDKESASKQSTTLNETTSREKGEHDVVIICSIRSRPIPLNYASLTVVTKEQVQDMIGQAKDYFAKQQRQGNDQFELSIQNTITTQFSNLDVVLLQNLQQA

SEQ ID NO: 179296 - protein, 378 aa, Glycine max
  Coding DNA Sequence Number=SeqID_62518
MSKFLGTKVVLSRDSIAKATGCLHEGSTYQEGWEKNYKSHVARALYKENIDKAGEQKIIIYNLMCKRAKIWANILNKSVLHKAGSKTSLLDLHKFVLSHLMENLPFDLPHIIYINILSHLKGLSGLDDNYYVVLINNVLWDQGVYHVFDKMDSNSKHTIIPKEEILVPQRLKDPGETDDDEGLMQAVPTPKRTKVAKPAPVPKESVILSTIQRHIKTRATKANPKIGKKEWMISFTDNKENFASSSLDSESIDDTFVSPLHKHTLPTPKQHPPSCANKLVRAPDTYDARTFWNQIMWVNTLKASSSSHDGSDNVVQHDIIQVLCPIRKYHFDDAYVCFTKDAYIYSFIQHLQRLPTIQYEGTYDLFKMSEKKDNRSCA

SEQ ID NO: 179297 - protein, 63 aa, Glycine max
  Coding DNA Sequence Number=SeqID_62519
MVRDSNKKNFWSINFKEEEGEGISLSNGGGSTLRLGSLPVESMFHDHQRVNAKGHNNELGLQV

SEQ ID NO: 179298 - protein, 62 aa, Glycine max
  Coding DNA Sequence Number=SeqID_62520
MEEKDWNDDSLTMTIVSHHCFDNDSEAPSFSISIIEVLELPCLAWLQQNSVPVSLLPMTSLD

SEQ ID NO: 179299 - protein, 81 aa, Glycine max
  Coding DNA Sequence Number=SeqID_62521
MRVRDLVVPTVIEVIARVGLQEELDDDDRVDLVVHELTAKDAIGEAWEVLDEDAIGEAREVLDEIAIRKAGEVIDVVGHFI

SEQ ID NO: 179300 - protein, 179 aa, Glycine max
  Coding DNA Sequence Number=SeqID_62522
MDRINMMEFLLEHYDNDNDNEELDVDAEDSKGRTTIHMDDEKPDLGAWYFVIKVAKLGESGRKIHEALREKYGEEGYKKVDVNCFNINLPDRGTIFPRIISIGSKKQITKILEYVRQLYSSELEENANDASIGQTTQNVLVDWKLIILKLCNKKLELLLNLIKEVLDMIETQEDMKYKE

SEQ ID NO: 179301 - protein, 84 aa, Glycine max
  Coding DNA Sequence Number=SeqID_62523
MEACLAVKDLLQQMMDQGRLEVSNEGGEEQHIYMQSTDEECLRKPKPLVVYFTIDAAPQEPQFPSVVRPILFPYQNNHVVSWRN

SEQ ID NO: 179302 - protein, 74 aa, Glycine max
  Coding DNA Sequence Number=SeqID_62524
MARFTVFISMLSVVLLRKCIHMYNEYAHPFIDMAFVLVSWVRFSGSRRFRPTDEAVSGRIITPMMTSMMGRPDR

SEQ ID NO: 179303 - protein, 85 aa, Glycine max
  Coding DNA Sequence Number=SeqID_62525
MVMKGQDIYSSQDEVTTSPSSSESEEAKGEESSEEIDSQEERDLLMVRRLLGGQSCDLLGQFFGKCRLGLLWTTYAGDIFLLHVG

SEQ ID NO: 179304 - protein, 126 aa, Glycine max
  Coding DNA Sequence Number=SeqID_62526
MVVPVLDLLMHKLTFLKEIIVIPVIQTMVTMQTMTIDFLTLAEVVVAMEATMEKGNAGRGDSCGRMPCVQNVGIQATFTHSAHPQANIATASSTPSNRWYPDFGASHHATNVSQNIQQLTPFEGPY

SEQ ID NO: 179305 - protein, 132 aa, Glycine max
  Coding DNA Sequence Number=SeqID_62527
  Homolog annotation: Hit_ID=Q53K35; Match level="QueryCoverage=56%, HitCoverage=2%, E-value=4e-22, Identity=73%"; Hit description=HEAT repeat, putative
MVQNTILNWTSYKSNNFMAYCALHHLSRCLPKIVPKLTEYLKVLTDTHPKVQLAGQMALQHVGSVIKSPEISGLVPTLLKGLCHPKEHTKYSLNILLQVRLLILFSVVVSLAKQWAFEEPSVETITGENVLT

SEQ ID NO: 179306 - protein, 221 aa, Glycine max
  Coding DNA Sequence Number=SeqID_62528
  Gene Ontology: Mol. function=isomerase activity; Cellular component =chloroplast; Biological process=isoprenoid biosynthetic process
  Homolog annotation: Hit_ID=Q947C3; Match level="QueryCoverage=74%, HitCoverage=37%, E-value=2e-38, Identity=51%"; Hit description=1 -deoxy-D-xylulose-5-phosphate reductoisomerase
  Pfam annotation: Domain name=DXP_redisom_C; Domain location=54-132; Score=66.2; E_value=1e-16; Accession=PF08436.3; Description=1-deoxy -D-xylulose 5-phosphate reduct
  Pfam annotation: Domain name=DXP_reductoisom; Domain location=2-41; Score=-65.6; E_value=0.087; Accession=PF02670.7; Description=1-deoxy- D-xylulose 5-phosphate reductoisomerase
  Pfam module annotation: Pfam domain module=DXP_redisom_C::DXP _reductoisom; Domain location=54-132::2-41
MQLISVVTRIVGCAGLKPTVAMIKAWTDIALANKGTLIVGGPFVLPPQQHNIKLVTNDSEHYIIFQCIQGLPKGALMQIILTASGGAFGDWPIDKLKAVKVANAVKHSNCNMGNKIAVDFAILFNKRSRNFHIDSMNDVLTLPALEQWLVFSLVDTWEKWNDLPGLHNLEHKVAFNEGAMLLLKACHDHNLEGKFVVEEWSNVSAQDPNKLESLNLVGPNV

SEQ ID NO: 179307 - protein, 150 aa, Glycine max
  Coding DNA Sequence Number=SeqID_62529
MASCKRKAPASTSQARYDLSRFTSQEAWDRYSDIVIGRKILPKINVMIYHTKFDEFKAELERRNWHKELTNFMDRSIDVAIIKEFYANLYDPEDNSPKQTWSVLSFSNLAPTSHTSDITLDRARLIYDIIQKMDMNLGYYLKSYFYDCTT

SEQ ID NO: 179308 - protein, 192 aa, Glycine max
  Coding DNA Sequence Number=SeqID_62530
  Homolog annotation: Hit_ID=Q6CYX0; Match level="QueryCoverage=80%, HitCoverage=38%, E-value=2e-63, Identity=74%"; Hit description =Putative exported protein
MAPPISGGSRESKEAQGVLAVWALPFEPDSVNKSPAVAAQSWVLTSAEDGVEKGNWKISSEALKVKDKTFSIEQKVLHGGKQEGSKVVIIRSEDGLTITLSPTRGMNLLRAEGFGAKMGWDSPVKEVVNPAFINLESRNGLGWLEGFNEMMVRCGYEWTGHPVTEGGQIYTLHGKAGNTPASLVEVEVADTA

SEQ ID NO: 179309 - protein, 312 aa, Glycine max
  Coding DNA Sequence Number=SeqID_62531
  Gene Ontology: Mol. function=tricarboxylate carrier activity; Cellular component=integral to membrane; Biological process=transport
  Homolog annotation: Hit_ID=P16482; Match level="QueryCoverage=99%, HitCoverage=70%, E-value=1e-124, Identity=74%"; Hit description =Citrate-proton symporter
  Pfam annotation: Domain name=MFS_1; Domain location=1-289; Score= -4.2; E_value=0.0005; Accession=PF07690.6; Description=Major Facilitator Superfamily
  Pfam annotation: Domain name=Sugar_tr; Domain location=1-312; Score= -27.9; E_value=5.4e-06; Accession=PF00083.14; Description=Sugar (and other) transporter
  Pfam module annotation: Pfam domain module=MFS_1::Sugar_tr; Domain location=1-289::1-312
LIPSYQSIGLWAPLLVLCGRLLQGFSAGAELGGVSVYLAEIATPGRKGFYTSWQSGSQQVAIMVAAAMGFALNAALEESAIREWGWRLPFLFGCLIVPFIFLLRRKLEETQEFTARRHHLAMHDVFKTLLKNWPVVMAGMLMVAMTTTAFYLITVYAPTFGKKVLLLSASDSLLVTLLVAISNFIWLPIGGALSDRFGRKPVLVAMTLLALATAYPALSLLAAAPSFSMMLAVLLWLSFIYGLYNGAMIPALTEIMPTEVRVAGFSLAYSLATAVFGGFTPVISTALIEYTGDKASPGYWMSFAALCALLAT

SEQ ID NO: 179310 - protein, 261 aa, Glycine max
  Coding DNA Sequence Number=SeqID_62532
  Homolog annotation: Hit_ID=Q10KX9; Match level="QueryCoverage=75%, HitCoverage=49%, E-value=1e-73, Identity=68%"; Hit description =Expressed protein
  Subcellular localization annotation: CTP_CleavageSite=21; ConfidenceScore=5.26e-01
MAFHRASKAKPKSARSRILLLAAAVTAIALLFLFSSLLSTTVSKANLLQRRQQQPFEKYLYWGTRIDCPGKHCGSCEGLGHQESSLRCALEEALFLGRTFVMPSRMCINPIHNKKGILHHSTNASSEELWDASSCAMDSLYDTELMSDTVPVILDNSKEWYRVLSTSMKLGARGVAHVEGVSRFELKENSRYSDLLLINRTASPLSWFMECKDRNNRSAIMLPYSFLPSMAAGKLRDAAEKVNEEILLDNRAVRYPVNGKE

SEQ ID NO: 179311 - protein, 108 aa, Glycine max
  Coding DNA Sequence Number=SeqID_62533
MDPILLNGVDDSNEWLLEEMGRGDEDAEDELVFNDDTWTWGAVANATGIRELLTYTRQQTRSKKTAATAFSSRPSSSKGKGNEVIQEEECIDEDIGEEEEIYKCSCES

SEQ ID NO: 179312 - protein, 79 aa, Glycine max
  Coding DNA Sequence Number=SeqID_62534
MPTSPGKVQMTTLVTAYYRAFSLPIANETFSKSRAEDAYISREANETFLQSQPEDAYISKEGADDDASHCVLLGFESHG

SEQ ID NO: 179313 - protein, 101 aa, Glycine max
  Coding DNA Sequence Number=SeqID_62535
MTNVVICTFPGDHAVTNVVICTFPGDIGVFRSRLRKSDEDMTKSKGKDPLEGLGGPMTRARARKAKEALQQVLSILFEYKPKFQGEKSKVVSCIMAQMEED

SEQ ID NO: 179314 - protein, 96 aa, Glycine max
  Coding DNA Sequence Number=SeqID_62536
KNGFPLNYVSKGGRNNQSGSSRGSSSGRGSKICTHCGFINHPIDECYKKHGYPPGHKLYKPQGSNINNINVVKEKSDGLVLERNQEAQSDEVKRTS

SEQ ID NO: 179315 - protein, 205 aa, Glycine max
  Coding DNA Sequence Number=SeqID_62537
  Homolog annotation: Hit_ID=Q1SDN3; Match level="QueryCoverage=49%, HitCoverage=8%, E-value=4e-20, Identity=48%"; Hit description =Polynucleotidyl transferase, Ribonuclease H fold
MAHFLAGGIHPATLYCDNKYALHIFVNPIFHERTKHIEIDFHIVREKMMIGLVKLLHVSSAYQLADINTKALMPDAYNSMVTMKKKCECQALLAIEKASDRNLKRKNLLMAKEASIMLMMAYDGFSVSDICLHYLIASSNINDVMTMSKRSLIGFVFELKACDWVPKLEDVIKCLGLVLDENFSSLVLHPQFHEELRSMKDWLVV

SEQ ID NO: 179316 - protein, 71 aa, Glycine max
  Coding DNA Sequence Number=SeqID_62538
MTDWPLWLRNNLLIGREGHGVSWNLLFGIVLDTIWWKRNTTIFQGEKWSAKVVIKKACNMAHSYKDGLMRF

SEQ ID NO: 179317 - protein, 179 aa, Glycine max
  Coding DNA Sequence Number=SeqID_62539
  Gene Ontology: Mol. function=nucleic acid binding
  Homolog annotation: Hit_ID=Q1T2A4; Match level="QueryCoverage=44%, HitCoverage=21%, E-value=7e-16, Identity=47%"; Hit description=Zinc finger, CCHC-type
MTLLELPEVKDESSSSLVEPLIGWPISQTDAEIIDINKKFLTQLKAKLKNSNNLDKGEFISSLNSYLENIEGKLGIVIGVDSSRSGYTRILIDKLGVFIDSPFYRHPGENPATALVSPVLDSSNYNSWSRLMLTALSVKNKAEFVDDSIKRYALDHVLHTAWKRSNNMVVSWLVNSVTP

SEQ ID NO: 179318 - protein, 105 aa, Glycine max
  Coding DNA Sequence Number=SeqID_62540
MVHHSFPSIITVGNFEIMSDLREIPFASCSRFNSAQLHRWDLRDNIHGVRERNRTKTIQMEVSIPSSSLRRLGIPSEQSEEKLEKSQGIARDAAIAFGRHVSPLR

SEQ ID NO: 179319 - protein, 187 aa, Glycine max
  Coding DNA Sequence Number=SeqID_62541
  Gene Ontology: Mol. function=electron carrier activity; Cellular component=integral to thylakoid membrane; Biological process =electron transport
  Homolog annotation: Hit_ID=P49161; Match level="QueryCoverage=98%, HitCoverage=69%, E-value=5e-90, Identity=81%"; Hit description =Apocytochrome f precursor
  Pfam annotation: Domain name=Apocytochr_F_C; Domain location=69-187; Score=293.5; E_value=4e-85; Accession=PF01333.10; Description =Apocytochrome F, C-terminal
MVKREALNVRAVLILPEGFELAPPDRISPEIKEKIGNLSFQNYRPTKKKYSCGGNRGRGQIYLDGSKSNNNVYNATAAGMVKKIIRKEKGGYEITIVDALDGREVIDIIPPGPELLVSEGESIKLDQPLTSNPNVGGFGQGDAEIVLQDPLRVQGLLFFFASIILAQIFLVLKKKQFEKVQLSEMNF

SEQ ID NO: 179320 - protein, 519 aa, Glycine max
  Coding DNA Sequence Number=SeqID_62542
  Gene Ontology: Mol. function=nucleotide binding; Cellular component =chromosome; Biological process=chromosome organization and biogenesis
  Homolog annotation: Hit_ID=Q9FJL0; Match level="QueryCoverage=94%, HitCoverage=39%, E-value=1e-175, Identity=64%"; Hit description =Chromosome condensation protein
  Pfam annotation: Domain name=Tropomyosin; Domain location=106-300; Score=-118.9; E_value=0.081; Accession=PF00261.10; Description =Tropomyosin
EKQVDLLPKLKKNVNTPEGVPRLFDLVKVQDERMKLAFFAALRNTVVAKDLDQATRIAYGGNTEFRRVVTLDGALFENSGTMSGGGSKPRGGKMGTSIRATSMSAESVANAEKELSRLTNKLNDFRQRIMAAVQHYQASEKAVAALEMELAKSQKEVDSLKSQYNYIEKQLDSLEAASMPQEDELDRMKELKKIVSAEEREINRLTNGSKQLKEKALELQRNLENVGGEKLKSQKSKVQKIQSDIDKHSSGINRCKVQIETGQKMVKKLTKGIEDSKKEKDRLTEQKEKLTQAFKEIEQKAFVVQENYKKTQELIDKHTIVLEKAKSDYNKMKKVMDELRASEVDVDFKLKDMKKAYKELEMKRKGYKKRLDDLQTALRKHLEQIQADLVDQEKLQATLDDEHLNAACDLKKACEMVALLEAQLKEMNPNLDSISEYRKKVSSYNERVEELNAVTQERDDIKKQYDEWRKKRLDEFMEGFNAISLKLKEMYQVWESDLSLSAALHWQSWNCASLSSIMY

SEQ ID NO: 179321 - protein, 106 aa, Glycine max
  Coding DNA Sequence Number=SeqID_62543
  Gene Ontology: Mol. function=ATPase activity; Cellular component =chromosome; Biological process=DNA metabolic process
  Homolog annotation: Hit_ID=Q9FJL0; Match level="QueryCoverage=97%, HitCoverage=7%, E-value=2e-42, Identity=84%"; Hit description =Chromosome condensation protein
  Pfam annotation: Domain name=SMC_N; Domain location=1-91; Score= -70.1; E_value=1.6e-06; Accession=PF02463.9; Description=RecFRecNSMC N terminal domain
TLSSLALVFALHHYKPTPLYVMDEIDAALGLQYIKLVIYGLADFKNVSIVGHYVKDRTKDAQFIIISLRNNMFELADRLVGIYKTDNCTKSITINPGSFVICEKAA

SEQ ID NO: 179322 - protein, 53 aa, Glycine max
  Coding DNA Sequence Number=SeqID_62544
MKTEAALVQDQTVSNIEEEHIVKASSSHLTPNHSSALPRPFHLVIKHVQCGEH

SEQ ID NO: 179323 - protein, 140 aa, Glycine max
  Coding DNA Sequence Number=SeqID_62545
MVIHFLCLLETIKSIGMWRQSWSFAFSAFQRQSSLLACKDDAILPRKGPVTRAMSNRFQEDCTRAAEEGPRVLMNLRIGYPRNIGFFSPWNWKGGLVPYLKEFESRSKGPTTLRAIGLRSTPNRVNTKERIATTIEDFFF

SEQ ID NO: 179324 - protein, 67 aa, Glycine max
  Coding DNA Sequence Number=SeqID_62546
MSEFTSDYPQISASMYQLDLAPYASGSYNAQRNAPVLLQDKHLLCSSRILRKMEVFLADRVMSNEKR

SEQ ID NO: 179325 - protein, 231 aa, Glycine max
  Coding DNA Sequence Number=SeqID_62547
MMIWMIKFNYKHLYHQSTLTTLNIKENPPLIPTSLKKTLQAYGIEDLPPPTWKCLHPKISKPTSIAVLRKIYGHQAIPLTKDDIFNVGMILMQHCLTNQRPSYSSATKTITLKPDVEFNQNDVMLFYFKEMYKNSRLASTSEYDKEYTSNHMRMKEAEAKQQQEKLEFEELFNNQHAHLGPQVDVVKPPMVEVSSTPIPNDALTTISTSSMPREITPLNVVAPIGLSEERI

SEQ ID NO: 179326 - protein, 72 aa, Glycine max
  Coding DNA Sequence Number=SeqID_62548
MSIYRKEPRGAEKFAQASCSSPRRICDLVLKAPIRRGKFSTTSNSGSWWPLAVVGSGKEAVKVWVGIWRGGE

SEQ ID NO: 179327 - protein, 236 aa, Glycine max
  Coding DNA Sequence Number=SeqID_62549
  Gene Ontology: Mol. function=transferase activity, transferring glycosyl groups; Cellular component=chloroplast; Biological process =glucan biosynthetic process
  Homolog annotation: Hit_ID=Q75T41; Match level="QueryCoverage=91%, HitCoverage=26%, E-value=1e-60, Identity=60%"; Hit description =Starch synthase II-2
MANKYALLKLPGPKISERKKLVSSINSETTPEIGDSISYEHSDKSLSSDSNPQKGSARRGSAFENENGGVVSSNYVESIEKEIPDVSFVGIDLGLDKSEEEDDNLSPVEKASPRLYVDEQLNSKRYEIIKPDTLPSDIPCSTETFSRKIEILEALSESSTKEVANEADNVEGEGEKPPPLAGANVMNVILVAAECAPFVKTGGLGDVVGSLPKALARRGHRVMSITITYLGTELAP

SEQ ID NO: 179328 - protein, 509 aa, Glycine max
  Coding DNA Sequence Number=SeqID_62550
  Gene Ontology: Mol. function=transferase activity, transferring glycosyl groups; Cellular component=chloroplast; Biological process =glucan biosynthetic process
  Homolog annotation: Hit_ID=Q75T41; Match level="QueryCoverage=89%, HitCoverage=61%, E-value=0.0, Identity=87%"; Hit description=Starch synthase II-2
  Pfam annotation: Domain name=Glyco_transf_5; Domain location=48-262; Score=267.6; E_value=2.6e-77; Accession=PF08323.2; Description =Starch synthase catalytic domain
  Pfam annotation: Domain name=Glycos_transf_1; Domain location=311 -470; Score=26.1; E_value=3e-05; Accession=PF00534.10; Description =Glycosyl transferases group 1
  Pfam module annotation: Pfam domain module=Glyco_transf_5::Glycos _transf_1; Domain location=48-262::311-470
MAMKFNLVLKVEIGEMSCYSEPRENHTIKASYSSWRAFKKGSTSAWVPIIFRPENVVVPRYSHYAEAQDLGVRKRYKVDGQDMEVTYFHSYIDGVDFVFIDSPNFRHLQDNIYRGSREDILKRMVLFCKAAAEVPWHVPCGGVCYGDGNLAFIANDWHTALLPVYLKAYYRDHGIMKYTRSVLVIHNIAHQGRGPVDDFRYTDLPEHYIDLFKLYDPVGGEHFNIFAAGLKAADRIVTVSHGYAWEIKTSEGGWGLHGIIYENDWKLRGIVNGIDTKDWNPKFDVHLKSDGYTNYTLETLQSGKRRCKAALQKELGFPVREDVPLLGFIGRLDQQKGIDLIAESIPWIVSQDVQLVMLGTGRPDLEDMLRQFESQHRDKVRGWVGFSVKMAHRITAGADILLMPSRFEPCGLNQLYAMNYGTIPVVHAVGGLRDTVKPFNPFEESGLGWTFDSAETNKLINAIGNCLLTFRQYKQSWEGLQRRGMTQDLSWDNAAQQYEEVLVAAKYQW

SEQ ID NO: 179329 - protein, 171 aa, Glycine max
  Coding DNA Sequence Number=SeqID_62551
  Homolog annotation: Hit_ID=Q1SKJ3; Match level="QueryCoverage=56%, HitCoverage=13%, E-value=4e-08, Identity=41%"; Hit description=Zinc finger, CCHC-type; Endonuclease/exonuclease/phosphatase
MVFFLSYTKAKAENAQVRNGLGHGNVAHTPDIFSKIPTVRSWTRCYRRYLLAQTSCLLRDEVTSPARPDEFRPSLRRTCKNNMMRICIKRRCFGFKNPETNRIRNRITAQMIDSVWCSNDDILKRKAQKFYKNLFQLDEPSDPGSLTLSTIPRIGQPLFEALIKTVSLDEV

SEQ ID NO: 179330 - protein, 782 aa, Glycine max
  Coding DNA Sequence Number=SeqID_62552
  Gene Ontology: Mol. function=nucleoside-triphosphatase activity; Cellular component=integral to membrane; Biological process=transport
  Homolog annotation: Hit_ID=Q1SE23; Match level="QueryCoverage=97%, HitCoverage=66%, E-value=0.0, Identity=70%"; Hit description =Lipocalin; AAA ATPase
  Pfam annotation: Domain name=ABC2_membrane; Domain location=566-763; Score=-4.4; E_value=0.0031; Accession=PF01061.14; Description=ABC-2 type transporter
  Pfam annotation: Domain name=ABC_tran; Domain location=213-403; Score= 126.3; E_value=8.6e-35; Accession=PF00005.17; Description=ABC transporter
  Pfam module annotation: Pfam domain module=ABC2_membrane::ABC_tran; Domain location=566-763::213-403
MAKSREAAARSVRKTANARQRWKDAKDATKKGASGLQAQLSQTFSRKKDFVDPEEIKILNQPTTETDIELFSHSHPITSNMVGSSSAWPKEKGKEPNDLMQMIHETKNDPNIRNNIRVEIETRDKNVTARVPKEKQLHTHSQIFKYAYAQLEKEKAQQQENKNLTFSGVISMATRSEQRKRPLIEISFKDLTLTLKAYNKHILRSVTGKIKPGRITAVMGPSGAGKTTFLSAIAGKAFGCKVTGSIFINGKNESIHSYKKIIGFVPQDDIVHGNLTVEENFRFSALCRLSADLPKPDKVLIVERVIEFLGLQSVRNHLVGTVEKRGISGGQRKRVNVGLEMVMEPSLMILDEPTSGLDSASSQLLLRALRREALEGVNICMVVHQPRKFRARVAQKIKAIFQGCIIQVLGYALVQMFDDLILLAKGGLTVYHGSVKKVEKYFADLGINIPKRINPPDYFIDILEGIEVPSGSSGVSYKELPVRWMLHNGYPVPLDMQQNAAQFDMYATVNPAKETDPDSSGHEERSFVGELWDDVRNGMELKREKIRLNFLKSKDFSDRKTPGIFKQYKYFLIRVGKQRLREAKIQAIDYLILLLAGACLGALTKASDQTFGAAGYTYTVIAVSLLCKIAALRSFSLDKLHYWRESDSGMSSLAYFLSKDTIDHFNTVIKPVVYLSMFYFFTYPRSTFADNYIVLLCLVYCVTGVAYAFAILFEPGAAQLWSVLLPVVFTLIATQTKDSKFLKDIAYLCYSRWALEAFIIANAEREVSKVATSPWVRVYSAK

SEQ ID NO: 179331 - protein, 92 aa, Glycine max
  Coding DNA Sequence Number=SeqID_62553
MLFVNLKKCSLWKTEVEYLGHMILYKEVSMDCKKVEAILKWPISKTVKALRGLLGLAGADGSSSSHPTVETLPDRKKVHGLYRSEKVHGLYR

SEQ ID NO: 179332 - protein, 221 aa, Glycine max
  Coding DNA Sequence Number=SeqID_62554
  Gene Ontology: Mol. function=RNA-directed DNA polymerase activity; Cellular component=chromatin; Biological process=chromatin assembly or disassembly
MAAANKVANALSRMDEEKELQGLYYKGKLVLTANSEWIPKLLQEFHSSLSGGHSGVYLGAARCTPFEVVYGRAPPSLARFILGEVLAEAVAQDLMERDEALKQLKFHLGRAQDHMTKYANAHKVSSKIKVGGWVNLKIWPHTETSMPTRLHPKLATSCFSITTASIGQNSPGIYVSQLKLAIGEHSVEAELPTKLQGHSTKLQPYQVLGTRVIEQEGEQVQ

SEQ ID NO: 179333 - protein, 120 aa, Glycine max
  Coding DNA Sequence Number=SeqID_62555
  Homolog annotation: Hit_ID=Q9JKS4-3; Match level="QueryCoverage=42%, HitCoverage=8%, E-value=3e-07, Identity=48%"; Hit description =Isoform 3 of Q9JKS4
MAGTFFLLKKQNSLEIMSSEKEMTPNRVVNWPFRTLYAGRESHQRTGFWLAIKGKGPLQVVARASSPLKARTCSALKVRTCSPLKVRTCSPLMARACSPLKARACSLLKVRVLVPKGPPI

SEQ ID NO: 179334 - protein, 116 aa, Glycine max
  Coding DNA Sequence Number=SeqID_62556
  Gene Ontology: Mol. function=DNA binding; Cellular component =mitochondrion; Biological process=DNA integration
MESTKGWDLSMDNIIRDIENGVTTRHSLNLFSEHIAFVSQAESLSIEEAVKDEFWIMYMHEKLNQFKRNDVRELKPYSKNMNIVDIKWVFKYKLDGHGLITRNEARLLAKGYNQQL

SEQ ID NO: 179335 - protein, 176 aa, Glycine max
  Coding DNA Sequence Number=SeqID_62557
MEMKDTFYPNLVKVFYTTTHMDGEARMITNENGLKDVRVKFNRLSTYNNLMKNPSQAPKGKAKDRYGFGALKMEAMLLAYVNVVMDNILKNKRIGTIRCPYVVIISRILDHFKVDVTNETEDFVELEFELKHKPKEATAEDNEENPMSPFEIIMMAKTDKLMRVHKEDYGELKDCF

SEQ ID NO: 179336 - protein, 140 aa, Glycine max
  Coding DNA Sequence Number=SeqID_62558
MDMPRMAEEKAKDKKSIGLSLKSAIPTSDDSEEEDVEGSEAENLTLFKQQNGEKKSRSHNKKNTTYIAWEENASSTSSGSSDEEEANLCLMANEEVDSYVSAFDSESDENYDQLFDAFNEMHEEAQKLSIANNFLKGKLR

SEQ ID NO: 179337 - protein, 106 aa, Glycine max
  Coding DNA Sequence Number=SeqID_62559
MLVASPLVFSLGDEHFGLFILLLSSHREGVEVDLWSCWVSDSLDNSEASSRVFCFWGTECRNLPFGGRAKRGLTGASPMGGRCTELPPTLIRGKRQKNRKGVVYEL

SEQ ID NO: 179338 - protein, 234 aa, Glycine max
  Coding DNA Sequence Number=SeqID_62560
  Gene Ontology: Mol. function=structural constituent of ribosome; Cellular component=intracellular; Biological process=translation
  Homolog annotation: Hit_ID=Q5N757; Match level="QueryCoverage=71%, HitCoverage=72%, E-value=7e-28, Identity=42%"; Hit description =Pentatricopeptide (PPR) repeat-containing protein-like
  Subcellular localization annotation: CTP_CleavageSite=49; ConfidenceScore=5.85e-01
MANSICSADFGSKSRQINHLQKNRRTPSSSSSSSSSSNSLQIPPCDRSRSAMVDVVMFIAVVCACGFLFFPYVEFLVTKCYEVIKGVVFLIKEEVSVAPWIYISIGLSVVFAALATWAVVACTTRKCGNPSCKGLRKAAEFDIQLETEDCVKNLASASSNVAKDGGGGTKKGLFELPRDHHRELEAELKKMAPPNGRAVLVLRARCGCSVGRQTLLVEDVRNVTCGKGCSSSSI

SEQ ID NO: 179339 - protein, 119 aa, Glycine max
  Coding DNA Sequence Number=SeqID_62561
  Gene Ontology: Mol. function=nucleic acid binding
  Homolog annotation: Hit_ID=Q1T254; Match level="QueryCoverage=65%, HitCoverage=20%, E-value=2e-17, Identity=51%"; Hit description =Peptidase aspartic, catalytic
MAIQAEEKKVVEIDKKKGKSEANIEKKKEATPIECKEKLEITLPFGEALQQMPLYAKFFKDMLTKKNWYIHSDKIVVEGNCSVVIQRNFPPKHKDPGVVTIPCSISEVVVGKTCELVSI

SEQ ID NO: 179340 - protein, 291 aa, Glycine max
  Coding DNA Sequence Number=SeqID_62562
  Gene Ontology: Mol. function=ion channel activity; Cellular component= integral to membrane; Biological process=ion transport
  Homolog annotation: Hit_ID=P0C0S1; Match level="QueryCoverage=96%, HitCoverage=98%, E-value=3e-94, Identity=61%"; Hit description=Small- conductance mechanosensitive channel
  Pfam annotation: Domain name=MS_channel; Domain location=70-269; Score=284.3; E_value=2.3e-82; Accession=PF00924.9; Description =Mechanosensitive ion channel
  Pfam annotation: Domain name=TM_helix; Domain location=14-66; Score =63.6; E_value=6.5e-16; Accession=PF05552.2; Description=Conserved TM helix
  Pfam module annotation: Pfam domain module=MS_channel::TM_helix; Domain location=70-269::14-66
MEDLNVVDGINNAGGWLVRNQALILSYAVNIVAAIAIIIVGMIIARVVSNGVNRLLVARHIDATVADFLSALVRYGIIAFTIIAALGRVGVQTASVIAVLGAAGLAVGLALQGSLSNLAAGVLLVTFRPFRTGEFVDLGGVMGTVQNVQIFSTTLKTADGKIVVVPNGKIIAGNIVNFSREPIRRNEFIIGVAYDADVDQVIELLREVVEADERVLKDLGIQIGLNELAASSLNFVVRCWSKSGDLQNVYWDLMKNFKRTLDAHGIGIPYPQMDVHLHQVQSEAQQPARSE

SEQ ID NO: 179341 - protein, 79 aa, Glycine max
  Coding DNA Sequence Number=SeqID_62563
MACRSWTYYFAYLWLWTWSPIGRPWVNSRGDGGASVARCRPSPGCYGVSPCACLGTQYFLMKAGLVGGLMTLLGATGTP

SEQ ID NO: 179342 - protein, 44 aa, Glycine max
  Coding DNA Sequence Number=SeqID_62564
LTTVLNVLKNKDAVSNLQNCSYGDGGEATTEEVKKSYHVLRKIE

SEQ ID NO: 179343 - protein, 160 aa, Glycine max
  Coding DNA Sequence Number=SeqID_62565
MGNVVMQITLQSIGETLGGCRVTQFGYSIRLEKLMNFAEGVNFLLAYTCMWNYHKKLISQMAPPLHTFISSSDSEAENDVGALSSKNHVELLEDVIKPLSKSKVDADKEVDVSSGECKALGQSNIWPMLQYLFLACTVLGNSSSKGMFIDSCYAYCQTEM

SEQ ID NO: 179344 - protein, 254 aa, Glycine max
  Coding DNA Sequence Number=SeqID_62566
  Gene Ontology: Mol. function=translation initiation factor activity; Cellular component=chloroplast; Biological process=translational initiation
  Homolog annotation: Hit_ID=Q8W4A5; Match level="QueryCoverage=98%, HitCoverage=72%, E-value=3e-84, Identity=52%"; Hit description=APO protein 2, chloroplast precursor
  Pfam annotation: Domain name=DUF794; Domain location=1-254; Score =346.6; E_value=4e-101; Accession=PF05634.2; Description=Arabidopsis thaliana protein of unknown function (DUF794)
MSAPKNGLLVKSLIPTAYNVYNATRITLINNLKKLLKVVPVHACGWCSEIHLGSVGHSFKSSYHLFDRLGKRITHEERFSIPRIPAVVELRIQASVEIPEFPTKRRRKPIIRIWRKEFIDADERNSPSMERVRKGAKRLMRMYNVRVCGYCPEIHVGAQGLKAKNCEAHKHQQRNGQHGWQSAVLDDLIPPRFVWHVPDVNALLERELRNSYGQAHVEVEMCIQAGAALPEQYKSTMRLDVGIPSTLKEADMVV

SEQ ID NO: 179345 - protein, 109 aa, Glycine max
  Coding DNA Sequence Number=SeqID_62567
MCSDVWWLRLKTKVLPREEPSSARVEGEVGYCSGRRSSSAGSCRRKVKQFFRGFRRKKAKKVHLLDPAEEGSAGSSVELSLSLFGLTMHVGTTLPLCSRILYYKRPTVS

SEQ ID NO: 179346 - protein, 76 aa, Glycine max
  Coding DNA Sequence Number=SeqID_62568
MLIRTNAQKKNENAAINGDAKLTSAVEQQNGAAGPQCRQRTTQCVANEPPRKGNNAKRRRSSNVVAKTTKQRRKEK

SEQ ID NO: 179347 - protein, 81 aa, Glycine max
  Coding DNA Sequence Number=SeqID_62569
MVRTRGLGRALGMVIGRALGKEDHHHSNDVLQRRRPTTFARRQRKVAPIAGDAPDVTEDVHAHAKKVVDDAKRFQSSYGMA

SEQ ID NO: 179348 - protein, 152 aa, Glycine max
  Coding DNA Sequence Number=SeqID_62570
  Subcellular localization annotation: CTP_CleavageSite=65; ConfidenceScore=5.77e-01
MTPSLPMTPFSMALAFTVDKKNPSRNPPTAFSSSKISKFSSLHARHSHAQASKRHHTADSSSSCFASHGSQPFLPWLLARPRSRFYECSSQASFLWVIRVERTLVLQVTLIASSKGKEMPRGLKNGPHMALESEGRVANRSNLQATGKSRNG

SEQ ID NO: 179349 - protein, 776 aa, Glycine max
  Coding DNA Sequence Number=SeqID_62571
  Gene Ontology: Mol. function=protein serine/threonine kinase activity; Cellular component=cell surface; Biological process =protein amino acid phosphorylation
  Homolog annotation: Hit_ID=Q9FG33; Match level="QueryCoverage=83%, HitCoverage=97%, E-value=0.0, Identity=51%"; Hit description=Lectin -like protein kinase
  Pfam annotation: Domain name=Lectin_legB; Domain location=25-261; Score=208.2; E_value=1.9e-59; Accession=PF00139.10; Description =Legume lectin domain
  Pfam annotation: Domain name=Pkinase; Domain location=341-624; Score =168.8; E_value=1.4e-47; Accession=PF00069.15; Description=Protein kinase domain
  Pfam annotation: Domain name=Pkinase_Tyr; Domain location=341-624; Score=167.9; E_value=2.5e-47; Accession=PF07714.7; Description =Protein tyrosine kinase
  Pfam module annotation: Pfam domain module=Lectin_legB::Pkinase::Pkina se_Tyr; Domain location=25-261::341-624::341-624
MQLPLLVKYQLAAIIFIIISLTKVTCLSFNFSTFERKDEDHLLLNNNSKIFSSAIQVTPDTRAQSIHNYSGRAFYNKPYKLWSQKKNQTASFNTTFVLNIDPQTTPAGGEGLAFILTSDTNLPENSSGEWLGIVNATSNGTSQAGILAVEFDTRNSFSQDGPDNHVGININSINSIKQAPLINTRVNLSSGEHVKIHIQYFNDTLSVFGAMDGASEESMETLLVSPPLNLSNYLQEEVYLGFSASTSNYTQLNCVRSWEFSGVDIADDDNKSLLWVYITVPIVIVIIIIGGMVVFFLYWQRKRHMEMPEDAYPRIEDQIQYSSMAPKKFELRKITKATGEFSPQNKLGEGGFGTVYKGLLDNKEVAVKRVSKNSRQGKQEFVAEVTTIGSLHHRNLVKLTGWCYEKRELLLVYEFMPKGSLDKYLFGDKIFGNNTLEEGCSSTLTWETRHSVIHGVAQALDYLHNGCEKRVLHRDIKASNIMLDSDYNAKLGDFGLARTIQQRNETHHSTKEIAGTPGYMAPETFLTGRATVETDVYAFGVLVLEVVCGRRPGSVYAQDDYKNSIVYWVWDLYGKEKVVGAVDARLKKEEIKEEEVECVLVLGLACCHPNPHHRPSMRTVLQVLNGEAPPPEVPMERPVFMWPAMPPSFKEAEDNSLIQARNLFAFSLLLGSTLRSFTTHNFKIPKTLTLIHHLRSILLKSIPTIGKIVNNNQSAPYGTTSRALCRNLTSEMLHPSCVSSEFGLNALYDSVNGGGDVWINENCFRIVRQLGEGGFA

SEQ ID NO: 179350 - protein, 332 aa, Glycine max
  Coding DNA Sequence Number=SeqID_62572
  Gene Ontology: Mol. function=oxidoreductase activity; Cellular component=integral to membrane; Biological process=metabolic process
  Homolog annotation: Hit_ID=O22985; Match level="QueryCoverage=95%, HitCoverage=95%, E-value=1e-118, Identity=69%"; Hit description =Ribitol dehydrogenase isolog
  Pfam annotation: Domain name=KR; Domain location=37-174; Score=-83.0; E_value=0.015; Accession=PF08659.1; Description=KR domain
  Pfam annotation: Domain name=adh_short; Domain location=36-202; Score= 25.6; E_value=1.1e-07; Accession=PF00106.15; Description=short chain dehydrogenase
  Pfam module annotation: Pfam domain module=KR::adh_short; Domain location=37-174::36-202
MLETVKYLLGSAGPSGFGSKTTAEQVTENHADLRSITAIITGATSGIGTETARVLAKRGARLVLPARSMKAAEDAKARIVSECPDSEIIVMALDLSSLNSVTNFVAHFHSLGLPLHLLINNAGKFAHEHAISEDGVEMTFATNYLGHFVMTNLLVKKMVETAKETGVQGRIVNVSSSIHGWFSGDAISYLALISRNKRHYDATRAYALSKLANVFHTKELARRLQQMGANVTVNCVHPGIVRTRLTREREGLLTDLVFFLASKLLKTIPQAAATTCYVATHPRLLNVSGKYFADCNETSTSKLGSNSTEAASCTSISGDNTKLYEKVPLELL

SEQ ID NO: 179351 - protein, 83 aa, Glycine max
  Coding DNA Sequence Number=SeqID_62573
MKERQSLKNAFTQMTPLNNENKRNVLMGSLLYTNSHPIMRDKLKRKPLLGATKQALTEVVSSLLNPNNHFLTPWSNHRPYNCV

SEQ ID NO: 179352 - protein, 198 aa, Glycine max
  Coding DNA Sequence Number=SeqID_62574
  Homolog annotation: Hit_ID=Q8RY22; Match level="QueryCoverage=22%, HitCoverage=4%, E-value=2e-12, Identity=79%"; Hit description =Protease Do-like 7
MSNAKHMVQDLHSIMLDYFLQVSRAVIHPLSYQQARNFYFHCGLVYVAEPGLVYLYLYTLIGGKNKLKVDKCFSTPGMAPNLGKITQYLRKRRLMPDKKVSSSTFVAICFKYEHKWGLYLGNITIVISINSYSTFNIGADVSTNVEITYFYISAYVNTDVETHIYYIVQKKQWIDEHYETLPILEDNKLEATKMRYLL

SEQ ID NO: 179353 - protein, 184 aa, Glycine max
  Coding DNA Sequence Number=SeqID_62575
  Gene Ontology: Mol. function=translation initiation factor activity; Cellular component=cytoplasm; Biological process=multicellular organismal development
  Homolog annotation: Hit_ID=Q9XGW1; Match level="QueryCoverage=97%, HitCoverage=22%, E-value=4e-89, Identity=75%"; Hit description =Protein PINHEAD
  Pfam annotation: Domain name=PAZ; Domain location=1-57; Score=7.0; E _value=0.00036; Accession=PF02170.12; Description=PAZ domain
MYGFTIQYTHLPCLQVGNQKKANYLPMEACKIVEGQRYTKRLNEKQITALLKVTCQRPRDRENDILRTVQHNAYDQDPYAKEFGIKISEKLASVEARILPAPWLKYHESGKEKNCLPQVGQWNMMNKEFNPESVIPIYNAKPEQVEKALKHVYHVSGSKIKGKELELLLAILPDNNGSLYAQGQ

SEQ ID NO: 179354 - protein, 695 aa, Glycine max
  Coding DNA Sequence Number=SeqID_62576
  Gene Ontology: Mol. function=nucleic acid binding; Biological process= regulation of transcription
  Homolog annotation: Hit_ID=Q0GIK4; Match level="QueryCoverage=99%, HitCoverage=99%, E-value=1e-176, Identity=49%"; Hit description=Cys -3-His zinc finger protein
  Pfam annotation: Domain name=Ank; Domain location=109-144; Score =38.1; E_value=3.1e-08; Accession=PF00023.20; Description=Ankyrin repeat
  Pfam annotation: Domain name=Ank; Domain location=74-107; Score=15.4; E_value=0.18; Accession=PF00023.20; Description=Ankyrin repeat
  Pfam annotation: Domain name=zf-CCCH; Domain location=267-292; Score =25.4; E_value=0.0002; Accession=PF00642.15; Description=Zinc finger C-x8-C-x5-C-x3-H type (and similar)
  Pfam annotation: Domain name=zf-CCCH; Domain location=302-324; Score =1.6; E_value=0.8; Accession=PF00642.15; Description=Zinc finger C-x8- C-x5-C-x3-H type (and similar)
  Pfam module annotation: Pfam domain module=Ank::Ank::zf-CCCH::zf -CCCH; Domain location=109-144::74-107::267-292::302-324
MCGVSKGKPSQIDLIMEEKYAKEGMHHKISALLEFSATDDLIGFKDAVEKEGHDVDGVGFWYGRRVGSKKIGYEERTPLMVASMFGSLDVSTYILGMGCIDVNRASRSDGATALHCAVAGGSAASVEVVKLLLDASADVSAVDANGNRSIDLIVSVANSIFNQRSSVLQALLEGTSDADQACLSLPEVIDQLEEQRQDMTTPRVSKDYPIDLSLPDIKNGIYGTDEFRMYTFKVKPCSRAYSHDWTECPFVHPGENARRRDPRKYHYSCVPCPEFRKGSCSKGDACEYAHGIFECWLHPAQYRTRLCKDEGGCTRRVCFFAHKLEELRPLYASTGSAIPSPRSYSASASALEMGSVNPIALGSPSVLMPPTSTPPLTPSGASSPIAGSMWSQSNVSVPTLQLPKSRLKTASTVRDTDLDMELLGLETHWRRQQLMMDEISALSSPNWKNSMPNSPSFRVPLNDHTGELNRLSGVKPANLEDMFGSLDPSILSKYHGISLDVAGPQLQSPTGIQMRQNVNQQLGGYSSSLSTLNVIGSRSFRLDQSGEAASVALNPRVAAFAKRSQSFIERGVVNHHSELPSPKPSTFSNWGSPVGKLDWAVNGEELNKLRKSASFGFRGSDTPLTKTSTKMSANVDDEPDVSWVNSLVKDAPPESGESGEYSVEDQRKLLQCHNGTDAIPAWLEQLYLDQEQMVA

SEQ ID NO: 179355 - protein, 534 aa, Glycine max
  Coding DNA Sequence Number=SeqID_62577
  Gene Ontology: Mol. function=general RNA polymerase II transcription factor activity; Cellular component=transcription factor TFIID complex; Biological process=establishment and/or maintenance of chromatin architecture
  Homolog annotation: Hit_ID=Q10SP2; Match level="QueryCoverage=84%, HitCoverage=64%, E-value=4e-80, Identity=37%"; Hit description =Expressed protein
  Pfam annotation: Domain name=WD40; Domain location=338-375; Score =15.0; E_value=0.27; Accession=PF00400.22; Description=WD domain, G -beta repeat
  Pfam annotation: Domain name=WD40; Domain location=399-436; Score =39.3; E_value=1.4e-08; Accession=PF00400.22; Description=WD domain, G-beta repeat
  Pfam annotation: Domain name=WD40; Domain location=440-478; Score =38.2; E_value=2.7e-08; Accession=PF00400.22; Description=WD domain, G-beta repeat
  Pfam module annotation: Pfam domain module=WD40::WD40::WD40; Domain location=338-375::399-436::440-478
MAKKGGKHWEPMKVERKESDSSEMNVMFALTRKDSKYSCGCTVQTEQTNKAKIPMNIVSISGSSSNFEQDPEVGIGERWDMEEEEDQFYETREELCSVSDGGSDCSESDESSSGNNGHVTRYQVWAQNLESVHQRRLNFLRWMGLESDLNYSMKGEELGDQPCGIDRITATSGAVLRTSFAIEEGLPSTSNQIVLDSLSDEASGSQENRENLACMIRNLDDGTEYIVDKLGQDGAPSTLRVLGSNQLISLEEFQKNIGPSSFIRRHLQRDTENTRLLGVGKRKMKRGWLRKLDSIACFVHNHGFDETKCKDCDSVDRSGIQRVRVHSYRKRFKELSSLYTEQEFKAHKGVILTMKFSLDGKYLASGGEDGMKLVKTEKLRRSSEATCVIVPPKTFRISAKPLHEFQGHSSDIIDLAWSKRGFLLSSSVDKTVRLWHVGIDRCLRVFYHNNYVTCVNFNPVNDNFFISGSIDGKVRIWEVVHCRVSDYIDIREIVTAVCFRPDGKKNIFCFVPKVCLLILPGHNCGYHGRQLPFL

SEQ ID NO: 179356 - protein, 399 aa, Glycine max
  Coding DNA Sequence Number=SeqID_62578
  Gene Ontology: Mol. function=methyltransferase activity; Cellular component=cellulose and pectin-containing cell wall; Biological process=metabolic process
  Homolog annotation: Hit_ID=Q6EP94; Match level="QueryCoverage=94%, HitCoverage=60%, E-value=1e-136, Identity=58%"; Hit description =Dehydration-responsive family protein-like
  Pfam annotation: Domain name=DUF248; Domain location=107-399; Score =398.7; E_value=8.8e-117; Accession=PF03141.7; Description=Putative methyltransferase
  Pfam annotation: Domain name=Methyltransf_11; Domain location=224 -319; Score=17.8; E_value=0.00095; Accession=PF08241.2; Description =Methyltransferase domain
  Pfam module annotation: Pfam domain module=DUF248::Methyltransf_11; Domain location=107-399::224-319
MGKDGSPKHYSQFDSKRNRMTWILGVSGLCILSYIMGAWKNTPSPNSQSEIFSKVDCNIGSTSAGMSSSSATESSSTNLNFDSHHQIDINNSGGAQEFPSCDMSFSEYTPCQDPVRGRKFDRNMLKYRERHCPAKNELLNCLIPAPPKYKTPFKWPQSRDYAWYDNIPHKELSIEKAIQNWIQVEGDRFRFPGGGTMFPRGADAYIDDINELIPLTSGTIRTAIDTGCGVASWGAYLLRRDILAMSFAPRDTHEAQVQFALERGVPAMIGIMASQRIPYPARAFDMAHCSRCLIPWHKLDGLYLIEVDRVLRPGGYWILSGPPIRWKKYWRGWERTEEDLKQEQDAIEEVAKRICWTKVVEKDDLSIWQKPKNHVGCAQTKQIYKTPHMCQSDNPDMAW

SEQ ID NO: 179357 - protein, 162 aa, Glycine max
  Coding DNA Sequence Number=SeqID_62579
  Gene Ontology: Mol. function=protein serine/threonine kinase activity; Cellular component=membrane; Biological process=protein amino acid phosphorylation
  Homolog annotation: Hit_ID=Q0Z839; Match level="QueryCoverage=63%, HitCoverage=25%, E-value=1e-46, Identity=86%"; Hit description=DSK2
  Pfam annotation: Domain name=Pkinase_Tyr; Domain location=3-122; Score=-117.9; E_value=3.1e-05; Accession=PF07714.7; Description =Protein tyrosine kinase
MAWKSCGKNWNLFIFLTLLTFWWILGVPSGFIGVKGKEMIQHRPYTQKVDVYSFGIVLWELITGMLPFQNMTAVQAAFAVVNKNVRPIIPNDCLPVLRDIMTRCWDPNPDVRPPFAEIVGMLENAENEIMTTVRKARFSCTTTTPGIDILPGLVQLGLKFSK

SEQ ID NO: 179358 - protein, 76 aa, Glycine max
  Coding DNA Sequence Number=SeqID_62580
MPTTFSQLNTFRYQLYIVPEVLWWTYFPFEPQQACFFLLYQWVYKTDNSTHETTSGYTIIFENKNYCPHIDVALKR

SEQ ID NO: 179359 - protein, 49 aa, Glycine max
  Coding DNA Sequence Number=SeqID_62581
MKERRAVNGTGTPSGPRRHLIILTWGNRSSTAMSIHGHGTILSSFAIIQ

SEQ ID NO: 179360 - protein, 279 aa, Glycine max
  Coding DNA Sequence Number=SeqID_62582
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=P48625; Match level="QueryCoverage=99%, HitCoverage=65%, E-value=1e-141, Identity=89%"; Hit description =Omega-3 fatty acid desaturase, endoplasmic reticulum
  Pfam annotation: Domain name=FA_desaturase; Domain location=4-200; Score=121.5; E_value=2.4e-33; Accession=PF00487.14; Description =Fatty acid desaturase
MDGELATELTIKTMDTLRRMSHGFQYLTEKIYKNLDSMTRLIRFTVPFPLFVYPIYLFSRSPGKEGSHFNPYSNLFPPSERKGIAISTLCWATMFSLLIYLSFITSPLLVLKLYGIPYWIFVMWLDFVTYLHHHGHHQKLPWYRGKEWSYLRGGLTTVDRDYGWINNIHHDIGTHVIHHLFPQIPHYHLVEALTILYWELGGERGSQPSFLGVHALILLTQAAKPVLGDYYREPERSAPLPFHLIKYLIQSMRQDHFVSDTGDVVYYQTDSLLLHSQRD

SEQ ID NO: 179361 - protein, 110 aa, Glycine max
  Coding DNA Sequence Number=SeqID_62583
  Subcellular localization annotation: CTP_CleavageSite=65; ConfidenceScore=5.02e-01
MPLCKSTQTKTSLKHNHFPRERLQKLTTIKAKSSIRSHRPTRYTCLAHQTQKQAKFKEKSSKTARSETETPTRHKRTPELKKEKEKKLKIEIPKPLKPASQSNLKRIFTN

SEQ ID NO: 179362 - protein, 547 aa, Glycine max
  Coding DNA Sequence Number=SeqID_62584
  Homolog annotation: Hit_ID=Q10NM0; Match level="QueryCoverage=70%, HitCoverage=37%, E-value=1e-154, Identity=71%"; Hit description=SH3 domain containing protein, expressed
  Subcellular localization annotation: CTP_CleavageSite=47; ConfidenceScore=5.59e-01
MTDSSGTTLMDLITADPTPAPSSSSTASASSAPTPPASLPSAFGKPPAEKKSKRAALMQIQNDTISAAKAALHPVRTNIMPQRQKKKPVSYSQLARSIHELAATSDQKSSQRQLVHHVFPKLAVYNSVDPSLAPSLLMLNQQCEDRSVLRYVYYYLARILSDTGPQGLSTGGGIPTPNWDALADIDAVGGVTRADVVPRIVEQLTAAATNAETEFHARRLQSLKALTYAPSSNSDVLSRLFEIVFGILEKVGDAEQKRKKGIFGAKGGDKDSIIRSNLQYAALSALRRLPLDPGNPAFLHYAVQGISFADPVAVRHALEIVSEIATRDPYAVAMALGKHVQPGGALQDVLHLHDVLARVSLAKLCCTISRARALDERSDIRSQFNSVLYQLLLDPSERVCFEAILCVLGKYDNTERTEERAAGWYRLTREILKLPDASSKESSKDKQKNKRPQLLIKLVMRRLESSFRSFSRPVLHAAARVVQEMGKSRAAAFALGIQDVEEGAHVNTFAEATDYNDSDESTHPESNAYFMCLMVHACHNIFRKIDP

SEQ ID NO: 179363 - protein, 545 aa, Glycine max
  Coding DNA Sequence Number=SeqID_62585
  Gene Ontology: Mol. function=calcium ion binding; Cellular component =nucleus; Biological process=protein amino acid phosphorylation
  Homolog annotation: Hit_ID=Q10BR5; Match level="QueryCoverage=77%, HitCoverage=52%, E-value=1e-106, Identity=36%"; Hit description =Calreticulin family protein, expressed
  Pfam annotation: Domain name=PPR; Domain location=150-184; Score =42.1; E_value=1.9e-09; Accession=PF01535.11; Description=PPR repeat
  Pfam annotation: Domain name=PPR; Domain location=251-285; Score =43.4; E_value=7.6e-10; Accession=PF01535.11; Description=PPR repeat
  Pfam annotation: Domain name=PPR; Domain location=286-320; Score =45.8; E_value=1.5e-10; Accession=PF01535.11; Description=PPR repeat
  Pfam annotation: Domain name=PPR; Domain location=321-355; Score =47.7; E_value=4e-11; Accession=PF01535.11; Description=PPR repeat
  Pfam annotation: Domain name=PPR; Domain location=422-456; Score =43.9; E_value=5.5e-10; Accession=PF01535.11; Description=PPR repeat
  Pfam annotation: Domain name=PPR; Domain location=457-491; Score =30.4; E_value=6.5e-06; Accession=PF01535.11; Description=PPR repeat
  Pfam annotation: Domain name=PPR; Domain location=493-527; Score =36.7; E_value=8.1e-08; Accession=PF01535.11; Description=PPR repeat
  Pfam module annotation: Pfam domain module=PPR::PPR::PPR::PPR::PPR::PP R::PPR; Domain location=150-184::251-285::286-320::321-355::422 -456::457-491::493-527
MEKNLMILPSKPWPPLFIPSHCSIQLEWHGSTRVLANSNSVSITQRSNPKLIDTQLNQLCANGPLSEAVAILDSLAQQGSKVRPITFMNLLQACIDKDCILVGRELHARIGLVGKVNPFVETKLVSMYAKCGHLDEAWKVFDEMRERNLFTWSAMIGACSRDLKWEEVVKLFYDMMQHGVLPDEFLLPKVLKACGKCRDIETGRLIHSVAIRGGMCSSLHVNNSILAVYAKCGEMSCAEKFFRRMDERNCISWNVIITGYCQRGEIEQAQKYFDAMREEGMKPGLVTWNILIASYSQLGHCDIAMDLIRKMESFGITPDVYTWTSMISGFSQKGRINEAFDLLRDMLIVGVEPNSITIASAASACASVKSLSMGSEIHSIAVKTSLVGDILIANSLIDMYAKGGNLEAAQSIFDVMLQRDVYSWNSIIGGYCQAGFCGKAHELFMKMQESDSPPNVVTWNVMITGFMQNGDEDEALNLFQRIENDGKIKPNVASWNSLISGFLQNRQKDKALQIFRRMQFSNMAPNLVTVLTILPACTNLVAAKK

SEQ ID NO: 179364 - protein, 480 aa, Glycine max
  Coding DNA Sequence Number=SeqID_62586
  Homolog annotation: Hit_ID=Q10NM0; Match level="QueryCoverage=95%, HitCoverage=48%, E-value=1e-174, Identity=64%"; Hit description=SH3 domain containing protein, expressed
MVIKALIWMQGPFDSFDELEFIIASELSDPAWPAALLNDVLLTLHARFKASPDMAVTLLEIARIFATKVPGKVDADVLQLLWKTCLVGAGPDGKHKALEAVTIVLDLPPPQPGSMLGLTSVDRVSASDPKSALALQRLVQAAVWFLGENANYAASEYAWESATPPGTALMMLDADKMVAAASSRNPTLAGALTRLQRCAFNGSWEIRIIAAQALTTMAIRSGEPFRLQIYEFLHTLAQGGIQSQFSDMHLSNGEDQGASGTGLGVLLSPMIKVLDEMYRAQDDLINAKLIDIYRTRHNISSSTGLSDPAVATGISDLVYESQPPPAEPDTLDDDLVNAWAANLGDDGLWGNNAPAMNRVNEFLAGAGTDAPEVDEENMISRPSVSYDDMWAKTLLESSELEEDDAKSLGSSSPDSTGSVETSISSHFGGMSYPSLGSFSIEQVTKHNTFQMVDAELNPSHSLVSTSHVGSHACQRFCHQC

SEQ ID NO: 179365 - protein, 341 aa, Glycine max
  Coding DNA Sequence Number=SeqID_62587
  Gene Ontology: Mol. function=oxidoreductase activity; Cellular component=mitochondrion; Biological process=electron transport
  Homolog annotation: Hit_ID=O80874; Match level="QueryCoverage=97%, HitCoverage=66%, E-value=1e-146, Identity=74%"; Hit description =Putative NADH dehydrogenase
  Pfam annotation: Domain name=Pyr_redox; Domain location=76-176; Score= 35.2; E_value=2.3e-07; Accession=PF00070.17; Description=Pyridine nucleotide-disulphide oxidor
  Pfam annotation: Domain name=Pyr_redox_2; Domain location=76-230; Score=-27.3; E_value=0.013; Accession=PF07992.4; Description =Pyridine nucleotide-disulphide oxidor
  Pfam module annotation: Pfam domain module=Pyr_redox::Pyr_redox_2; Domain location=76-176::76-230
MWQMAPDPWRFTVSYDKLVIALGAQPTTFGIHGVYEHAIFLREVYHAQEIRRKLLLNLMMSDVPGIEEEEKQRLLHCVVVGGGPTGVEFSGELSDFIVRDVRQRYAHVKDYIHVTLIEANEILSSFDVRLRQYATNQLTKSGVRLVRGIVKDVEEKKIILNDGTEVPYGLLVWSTGVGPSAIIRSLDLPKAPGGSKFLKFLMHRIGIDEWLRVPTVEDIFSIGDCSGFVESTGKTPLPALAQVAERQGKANGGRANSAKDVDFGDQFVYKHMGSMASIGSYKALVDLRQNKEGKGLSLAGFVSWFIWRSAYLTRVISWRNRFYVAINWATTLVFGRDISRI

SEQ ID NO: 179366 - protein, 87 aa, Glycine max
  Coding DNA Sequence Number=SeqID_62588
ATPEQVKNWFQSNPEFLKPADPETSLFLNQKSQLAAFLASSKSKKSLAQNLKEVLQLLQQEEEEEEPPKKEAESSENNDDQEDDPFY

SEQ ID NO: 179367 - protein, 586 aa, Glycine max
  Coding DNA Sequence Number=SeqID_62589
  Gene Ontology: Mol. function=pyridoxal phosphate binding; Biological process=biosynthetic process
  Homolog annotation: Hit_ID=Q1SKS5; Match level="QueryCoverage=99%, HitCoverage=53%, E-value=0.0, Identity=88%"; Hit description=SAM (And some other nucleotide) binding motif
  Pfam annotation: Domain name=Aminotran_1_2; Domain location=191-577; Score=-61.9; E_value=0.00028; Accession=PF00155.11; Description =Aminotransferase class I and II
MMVIEAPRQSDLMVELIKKLKPKVVVTGIAHFEAVTSSAFVHLLDATRDIGSRLFLDISDHFELSSLPGSNGVLKYLSGTRLPSHAAIICGLVKNKVYPDLEVAFVISEEESLFNALSKTVELLEDNTALISQYYYGCIFHELLAFQLAGRHAPAKRNCENVKSVGMIGFARSASSVLNTAELSIDGVENESLIHMDVDQIFLPVPSPVKAAIFESFARQNMSESETDVTASIKGFVKSNYGFPTDSSTEFIYADNSKALFNKLVLCCIKEGGTLCFPAGSNGNYVSSARFLKADIVTVPTNVNVGFKFTEKTLTGVLGTVKNPWVYISGPTVNPTGLIYSNNEMVEILSTCARFGARVIIDTASSGLEFDCEGWGGWDIEGCLSKLNSSIKPSFCVTLLGGLSLKMLNGVLRFGFLILNQPVLVDTFYSYPGLSKPHTTVRYATKKLLELKEQKPSNLSDAIVEQTQILKTRSRCLKEVLEKSGWDVLESCAGVSVVAKPSAYLNKTIKLKISPEGERSHGNATKEIKLDDSNIRTVILKATGLCINSGSWTGIPGYCRFSIALEENDFKKALDCIIKFKEVALG

SEQ ID NO: 179368 - protein, 462 aa, Glycine max
  Coding DNA Sequence Number=SeqID_62590
  Gene Ontology: Mol. function=pyridoxal phosphate binding; Biological process=biosynthetic process
  Homolog annotation: Hit_ID=Q1SKS5; Match level="QueryCoverage=95%, HitCoverage=33%, E-value=1e-112, Identity=87%"; Hit description=SAM (And some other nucleotide) binding motif
  Pfam annotation: Domain name=MTS; Domain location=13-142; Score= -88.6; E_value=0.038; Accession=PF05175.4; Description=Methyltransfera se small domain
  Pfam annotation: Domain name=Methyltransf_11; Domain location=34-129; Score=4.7; E_value=0.019; Accession=PF08241.2; Description =Methyltransferase domain
  Pfam module annotation: Pfam domain module=MTS::Methyltransf_11; Domain location=13-142::34-129
MVIPSIFLPEDWSFTFYEGINRHPDSIFKERTVAELGCGNGWISIAIAEKWLPSKVYGLDINPRAVKVSWINLYLNALDENGQLIYDEEKKTLLDRVEFHESDLLSYCREKDIQLERIVGCIPQGSMWVGLSKRKSKVRVLRMSKGGCFPNGAGGEVYVRYELQHYQTTSSWRRRRNAKFYGVECSFVTAECGSVVWSVDLSRRHDSEILNPNPDAMSKMITENASEEFLHSLSNYCSLQDQFGLGLIARAVEEGIAVIKPTGIMIFNMGGRPGQGVCKRLFERRGFRITKLWQTKIIQAGDTDIAALVEIEKNSPHRFEFFMGLSGDQPICARTAWAYGKSGGSITHALSVYSCQLRHPNQVKVIFDFLKHGFQEISSSLDLSFEDDSVADEKIPFLAYLASRLKNNSDFPYEPPAGSKHFRNLIAGFLKTYHHIPLTSDAKFNTLMNEHDSSCDVEAIEK

SEQ ID NO: 179369 - protein, 54 aa, Glycine max
  Coding DNA Sequence Number=SeqID_62591
  Subcellular localization annotation: CTP_CleavageSite=26; ConfidenceScore=5.48e-01
SVSESSSDSEAISAQVFLASFGTLVRPMSSKARRVLSGSMTLQAFLSRLMTQSE

SEQ ID NO: 179370 - protein, 149 aa, Glycine max
  Coding DNA Sequence Number=SeqID_62592
MKIDPQEFDARLYIPGRGFVLNTEGHPRKLLRKDLSTLAKTWSVLFYSNLTLTSHTSDLNMDRARLVYGLVTGMDMNIGALISALITALCGARGVTFDSLTYESLSPAINLAFIKKNCWNMDDLTVNFRGAKKVRAQPVDVPSSSTMSC

SEQ ID NO: 179371 - protein, 111 aa, Glycine max
  Coding DNA Sequence Number=SeqID_62593
LYQVTQVPREFDTQFLSFYTNCVIRCTCRVQTLTPPEPFYFDTDAHMAQEEGTSTDQIPEPSSAPVPEETQPSTPVTELEHPIQDSSAAPGLEWSDNCFDQACSHQKRMSM

SEQ ID NO: 179372 - protein, 60 aa, Glycine max
  Coding DNA Sequence Number=SeqID_62594
MQQDVEESRAWKCEFIIIRHAEKWTKEMTTSFTVVETIILAIIFAATEEAEKREVASSTI

SEQ ID NO: 179373 - protein, 248 aa, Glycine max
  Coding DNA Sequence Number=SeqID_62595
  Gene Ontology: Mol. function=chitin binding; Cellular component =extracellular region; Biological process=chitin metabolic process
  Homolog annotation: Hit_ID=UPI000044A8F0; Match level="QueryCoverage =82%, HitCoverage=99%, E-value=4e-34, Identity=34%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ITIKGPIEAQRSSLHRCPTSKLLSLHVLAIRGLHALAIRGLHALAFRGLHVLAIRGLHALAIRGLHTLAFRGLHVLAFRGLHTLTLRGLHALTFRGLHVLAIRGLHALAIRGLHALAFRGLHVLTFIGLHAFTLRGLHVLAFRGLHVLAIRGLHALAIKGLHALASEGYTSSPSEDYTSSPSEGYTPSPSEDYMSSPSEDYMSSPSEDYTSSPSEDYTSSPSKGETSSLSEGSTFAPLENSRSSALNA

SEQ ID NO: 179374 - protein, 491 aa, Glycine max
  Coding DNA Sequence Number=SeqID_62596
  Gene Ontology: Mol. function=oxidoreductase activity; Cellular component=membrane; Biological process=electron transport
  Homolog annotation: Hit_ID=Q2MJ20; Match level="QueryCoverage=83%, HitCoverage=87%, E-value=0.0, Identity=76%"; Hit description =Cytochrome P450 monooxygenase CYP716A12
  Pfam annotation: Domain name=p450; Domain location=39-466; Score =97.3; E_value=4.5e-26; Accession=PF00067.12; Description=Cytochrome P450
MEDNNLHLSLLLLFVSIVTLSLFVLFYKHRSAFAAPNLPPGATGYPVIGESLEFLSTGWKGHPEKFIFDRMIRYSSQLFKTSILGEPAVIFCGATCNKFLFSNENKLVAAWWPNSVNKVFPTTLLSNSKQESKKMRKLLPQFLKPEALQRYVGIMDTIARNHFASLWDNKTELTVYPLAKSIEDVNHVAKFENPFHLLASGIISVPIDLPGTPFNKAIKAANAIRKELLKIIRQRKVDLAEGKASPTQDILSHMLLTCDEKGQFMNELDIADKILGLLIGGHDTASAAITFIVKYLAELPHIYDRVYQEQMEIAKLKSPGELLNWDDVNRMQYSWNVACEVMRIAPPLQGGFREAINDFIFDGFSIPKGWKLYWSANSTHKSPEYFPEPEKFDPTRFEGQGPAPYTFVPFGGGPRMCPGKEYARLEILVFMHNLVKRGVCSCMDVARKIGDIAIPSLQMARTMLSWRVYVGAATEDEMHDDPPMQLARSAE

SEQ ID NO: 179375 - protein, 361 aa, Glycine max
  Coding DNA Sequence Number=SeqID_62597
  Gene Ontology: Mol. function=nucleic acid binding; Cellular component= beta-galactosidase complex; Biological process=DNA integration
  Homolog annotation: Hit_ID=Q1S0A6; Match level="QueryCoverage=99%, HitCoverage=26%, E-value=1e-141, Identity=64%"; Hit description=Zinc finger, CCHC-type; Peptidase aspartic, catalytic; Polynucleotidyl transferase, Ribonuclease H fold
LHEEVFMNMPPDFSASQPDMVCKLRKSLYGLIQAPRCWFAKLSTTLKSYGFQQSYLDYSLFTLHRKDTQLVVLVYIDDLIIVGNTPTAIKHFKLYLSTCFHMKDLGVLKYFMGIKVAKNSTGIFLCQRKYALDIISEASLLGVKPVATPLEQNHHLSLAAGQLLSDPEQYGCLVGHLIYLCFTRPELSYSVHILSQFMQQPRIEHWEAALRVVRFLKGNPRQGIFFARECDLQLYGWCDSDWASCPLTRRSVTGWLAEYRSMATTTCVLKWLKGILSNLGVVHDKPMTIRCDSQAALHIAKNPVFHERTKHIKVDCHFVWDEILKDNIRPSYVPTIAQLANIFTKALGEMQFETFLGKLGI

SEQ ID NO: 179376 - protein, 140 aa, Glycine max
  Coding DNA Sequence Number=SeqID_62598
MARLKESIDISSMWRELCDFKEVYPLNFGANFLFHHTEIASTSSISIIDEANLENQIDDRPANQNESLVEQILDDKGGTDTTEVVVTDTTVFPEPPDIQIPNTHNENEPLGRGCRVKYPSTQLQDYVIHTIQKLSPYIRS

SEQ ID NO: 179377 - protein, 208 aa, Glycine max
  Coding DNA Sequence Number=SeqID_62599
  Gene Ontology: Mol. function=nucleic acid binding; Cellular component= beta-galactosidase complex; Biological process=DNA integration
  Homolog annotation: Hit_ID=Q1S0A6; Match level="QueryCoverage=99%, HitCoverage=14%, E-value=6e-67, Identity=58%"; Hit description=Zinc finger, CCHC-type; Peptidase aspartic, catalytic; Polynucleotidyl transferase, Ribonuclease H fold
MTGTLQHLCDVRKVPGCLIGLPNGHTATSTKEGTIRLVGGLRLENVLYVPQLNCNLIFISQLSDESNCNVQFTTNLCVIQDRTLKMLIRAGERRDVLYFFREIPKVKACKVEGITQLEVWHKRLRHPSWQTTQLISDGSRNRVSESHNKVCDTCQKAKQTRETFPLNNNQASNTFDLIHCDLWGPYRTPSSCGASYFLTIVDDCSRAV

SEQ ID NO: 179378 - protein, 379 aa, Glycine max
  Coding DNA Sequence Number=SeqID_62600
  Gene Ontology: Mol. function=DNA binding
  Homolog annotation: Hit_ID=Q1S0F5; Match level="QueryCoverage=51%, HitCoverage=40%, E-value=8e-18, Identity=31%"; Hit description=IMP dehydrogenase/GMP reductase
MGSNQGPLLKKRFYQVKIKSLEVASLQELGQLMDQLQHQAFRKAYEKIWDLAMIEVSVEAIASLTQYYNQPLRCFTFRDFQLVPIVEEFEEILGCPLGGRKPYLFSGLYPSKARIAKVVRIWAQELDRVKQNRNGIVEIPRKHLEEKPKALADQGEWASFIDVLALLVFGFVLFTNVDGIVDLAAIDAFLAYHHSMESPIIAILADAYDTFDRRCEKSGARIVCCTPALYVWLVLHFFRHEGRPVCPIQGHRLCAEKGKENWEQLLASVTTWLPHERSTVGGKHHTFHRTGFQGPNGRILQGVRKAWGIVKRKDNELRESSNGIIGGYHKWLKAQTQGLDWLPKLKTSSEEEAETPEESEEVQALKVELGHKQSRKSSR

SEQ ID NO: 179379 - protein, 407 aa, Glycine max
  Coding DNA Sequence Number=SeqID_62601
  Homolog annotation: Hit_ID=Q9S7L2; Match level="QueryCoverage=34%, HitCoverage=32%, E-value=4e-45, Identity=58%"; Hit description =Transcription factor MYB98
  Pfam annotation: Domain name=Myb_DNA-binding; Domain location=169 -215; Score=48.0; E_value=3.2e-11; Accession=PF00249.21; Description =Myb-like DNA-binding domain
  Pfam annotation: Domain name=Myb_DNA-binding; Domain location=221 -266; Score=53.6; E_value=6.7e-13; Accession=PF00249.21; Description =Myb-like DNA-binding domain
  Pfam module annotation: Pfam domain module=Myb_DNA-binding::Myb_DNA -binding; Domain location=169-215::221-266
MEFDPIFPAEKIHYLSSIFSGIKPEIPAFIPMSQENNNNTTFCMYQNNFKNHDNHHPTANFFSEGFNSSILTPLFSLSSSSGDSSYPNECLKGSFANDNNFYHPIMPYAQNNTQNEPMHGPNRAIWDFSQKIPLRCSSAGAGATSQPHQQMQRRSNGEIQHKNMTNIIKGQWSAEEDRVLVQLVKRFGLKKWSHIARLLNGRVGKQCRERWHNHLRPNIRKESWNEEEDRILIEAHKGIGNRWAEIARRMPGRTENTIKNHWNATKRRLNAKRLRNKRRSSKGPTLLESYIRQVTAEEDAEKELIKNSMNNMNLKGERSSNTTNTKTKYPRLFRVRYDSSEGGFSSEEDEVGRGVQQLHGGGGAYVPTMVNAAVEDGTMGYDVAMEMAPEVQMKKEMDLMEMIYRKA

SEQ ID NO: 179380 - protein, 317 aa, Glycine max
  Coding DNA Sequence Number=SeqID_62602
  Gene Ontology: Cellular component=cytosol; Biological process=cell adhesion
  Homolog annotation: Hit_ID=Q1S3L7; Match level="QueryCoverage=99%, HitCoverage=100%, E-value=1e-115, Identity=70%"; Hit description =Adhesion regulating molecule
  Pfam annotation: Domain name=ARM_1; Domain location=14-293; Score =278.4; E_value=1.4e-80; Accession=PF04683.4; Description=Adhesion regulating molecule conserved region
MSSSSADVFPAILEVMLEFRAGKMFLEEKRVVPDTRKGLVRIARGEEGLVHFQWLDRTQNIVEDVSFVFSGLVNQTSGRVYILKFNSDDRKFFFWMQESNADDDSQLCSSVNDYINRPLELLGEEEPDGSLPLQVSEDMAEDDISSRAANLGIPNLGVEATSDVTSSGPVKLEDLQRILSNIGPADSIVDPDGGLGLGDILKPDLIMPLMDTLPLEQRLAPYLPEGEWSPEEILELLQSPPFRQQVDSFTYVLRTGQIDLSQFGIDPSKSDKFTVLSFLEALEDSVSKSVESEEARQDDRDLRSQSCNRHDPMDESQ

SEQ ID NO: 179381 - protein, 53 aa, Glycine max
  Coding DNA Sequence Number=SeqID_62603
  Gene Ontology: Mol. function=oxidoreductase activity, acting on NADH or NADPH; Cellular component=mitochondrial inner membrane; Biological process=electron transport
  Homolog annotation: Hit_ID=Q9FLX7; Match level="QueryCoverage=83%, HitCoverage=30%, E-value=5e-12, Identity=64%"; Hit description =Probable NADH dehydrogenase [ubiquinone] 1 alpha subcomplex subunit 5, mitochondrial precursor
MHSDTSTLVVGGIDEWDPWGVPDDYRCEVIENDAPVPKHVPLLIEFDKTLEAL

SEQ ID NO: 179382 - protein, 358 aa, Glycine max
  Coding DNA Sequence Number=SeqID_62604
  Gene Ontology: Mol. function=helicase activity; Biological process =viral genome replication
  Homolog annotation: Hit_ID=Q1SRJ5; Match level="QueryCoverage=98%, HitCoverage=42%, E-value=1e-107, Identity=51%"; Hit description =Probable helicase [imported]-Arabidopsis thaliana-related
MYTVEFQKRGLPHVHLFLFLHANNKYPSPNDIDHIISAEIPSQKDDPELYKLVQNHMVHGPCGILRPASLCMKEGKCSRFYPKKFQPTTLVDGDGYPVYCRRNTGQTITKNGIIIDNRCIVPYNPKLLKKYQAHINIEWCNQSTSIKYLFKYINKGYDRVTAIMVHDDNGTVPHANTPNDEIKEYLDCRYISPCESTWRIFGFPIHGRKPFVERLQFHLPGQHSILYQDHDDIDDLLSNPSISESKFIAWMNTNQDFVEGQSLTYSEFATKFVYNQKQRCWQLRKKGYTIGRLQWVPPTIWELFYLRMMLIVYRGPTSFEDIRIVDGVEYSTYREACFAMGFLQDDREFVAAIQEVKD

SEQ ID NO: 179383 - protein, 661 aa, Glycine max
  Coding DNA Sequence Number=SeqID_62605
  Gene Ontology: Mol. function=protein kinase activity; Cellular component=integral to membrane; Biological process=protein amino acid phosphorylation
  Homolog annotation: Hit_ID=Q1S3M0; Match level="QueryCoverage=86%, HitCoverage=97%, E-value=0.0, Identity=65%"; Hit description=Protein kinase
  Pfam annotation: Domain name=LRRNT_2; Domain location=88-132; Score =32.1; E_value=1.9e-06; Accession=PF08263.3; Description=Leucine rich repeat N-terminal domain
  Pfam annotation: Domain name=LRR_1; Domain location=160-181; Score =3.7; E_value=59; Accession=PF00560.23; Description=Leucine Rich Repeat
  Pfam annotation: Domain name=LRR_1; Domain location=183-206; Score =17.5; E_value=0.047; Accession=PF00560.23; Description=Leucine Rich Repeat
  Pfam annotation: Domain name=LRR_1; Domain location=208-230; Score =5.2; E_value=30; Accession=PF00560.23; Description=Leucine Rich Repeat
  Pfam annotation: Domain name=LRR_1; Domain location=232-253; Score =9.3; E_value=5.2; Accession=PF00560.23; Description=Leucine Rich Repeat
  Pfam annotation: Domain name=LRR_1; Domain location=255-277; Score =11.3; E_value=2.2; Accession=PF00560.23; Description=Leucine Rich Repeat
  Pfam annotation: Domain name=Pkinase; Domain location=363-634; Score =3.7; E_value=8.8e-09; Accession=PF00069.15; Description=Protein kinase domain
  Pfam annotation: Domain name=Pkinase_Tyr; Domain location=362-634; Score=-26.6; E_value=7.7e-11; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=88-132::160 -181::183-206::208-230::232-253::255-277::363-634::362-634
MVRVLVATSIREAAAGAEDDALIKLMDATCRRATAPPAPPDGLCLVDGAHAAPSAYSSSLAMALSGWHSWIILFIYLSPHLIVLPSFGASDSELLLNVKQNLQTNNQQLSSWNASVPPCSGGHSNWRGVLCYEGKVWGIKLENMGLKGLIDVDSLKGLPYLRTLSFMNNDFEGAWPEIQHLIGLKSIYLSNNKFSGEIPSRTFEGLQWLKKVHLSNNHFTGAVPTSLVLLPRLIELRLEGNKFNGPIPYFSSHNKLKSFSVANNELSGQIPASLGAMPVSSFSVIMIAAVVLFSLHRRRKNQVSVENPASGFGGNKGRVRELGSESMRSTRSISSNHSRRGDQMKLSFLRDDRQRFDMQELLRASAEILGSGCFSSSYKAALLNGPTIVVKRFKQMNNVGKEEFQEHMRRIGRLTHPNLLPPVAYYYRKEEKLVVTDYVQNGSLAVRLHGHQSIGEPSLDWPIRLKIVKGIAKGLENLYKDMPSLIAPHGNLKSSNVLLTESFEPLLTDYGLVPVINQDLAQDIMVIYKSPEYLQQGRITKKTDVWCLGILILEILTGKFPANFLQKGKGSEVSLASWVHSVVPEQWTNDVFDQEMGATMNSEGEMGKLLKIALNCVEGDVDKRWDLKEAVEKILEIKQRDNDQEDFFTSYASEADMKSST

SEQ ID NO: 179384 - protein, 246 aa, Glycine max
  Coding DNA Sequence Number=SeqID_62606
  Gene Ontology: Mol. function=helicase activity; Biological process =protein amino acid phosphorylation
  Homolog annotation: Hit_ID=Q1SN45; Match level="QueryCoverage=98%, HitCoverage=14%, E-value=2e-53, Identity=44%"; Hit description=AAA ATPase
MNKPEQVWEKTWHWLSDDIVYSHCRSLNTPGLHIDDSNLMNLVLLEVEQLLQANQRSLKDYPSMSYPENANLLTHADNDLILSELNFNNEELRSEFLNLFSQMTDQQAKIYNQIIQAVNKNEGGMFFLYGYGGTGKTFIWKTLAASLRADNKIVIMVASSNIASLLLPGGKTTHSKLKILVPIFEDSTCNIHQGTQLAELLNETSLIIWDEAPMAHKFCFEALDQSLRDVIKAKSSSDKIFGGKVM

SEQ ID NO: 179385 - protein, 789 aa, Glycine max
  Coding DNA Sequence Number=SeqID_62607
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=94%, HitCoverage=95%, E-value=0.0, Identity=74%"; Hit description=Protein kinase; UspA
  Pfam annotation: Domain name=Pkinase; Domain location=459-696; Score =103.9; E_value=4.6e-28; Accession=PF00069.15; Description=Protein kinase domain
  Pfam annotation: Domain name=Pkinase_Tyr; Domain location=459-722; Score=69.9; E_value=8.1e-18; Accession=PF07714.7; Description =Protein tyrosine kinase
  Pfam annotation: Domain name=Usp; Domain location=13-165; Score=37.3; E_value=5.4e-08; Accession=PF00582.16; Description=Universal stress protein family
  Pfam module annotation: Pfam domain module=Pkinase::Pkinase_Tyr::Usp; Domain location=459-696::459-722::13-165
MSRLIQEKKLGAGRVVAVAIENNKTSQYAAKWAVDNLLPKDQALLLVHVRQKASSIPTPTGNLVSLDGNDDVTRAYMQQMDNESKELFASFRVFCNRKSIQCKEILLEDMDISKGLIEGISKYSVELLVLGAASRSGLVRRFRISDIPSAVSKGAPPFCTVYIIAKGKISSVKTSTAPLTAKPSTRNNTMQPLQSFQTPERMDTQITRNPIPPRSSTEKPSYIVRQLPSNEDEIISPFTRPGRGNCRYESTIPDSDISFVSSGRPSVDRLFPSMYDDMDSGMNTRLSTGSDFDVRSFGSSFSGAKSIDHGDYSFSSQDSGTSMSSSMFSASEEVEAEVRRLKLELKQTMEMYSSVCKEATTAKQKALELQRWKVEEQRKLEDTRLAEGTALAMAEREKVKCMAAMKSAETSRKIAELEAQKRISVESEHKKKNVDILSHSPVRYRKYTIEEIEEATKFFSNSLKIGEGGYGPVYRSELDHTPVAIKVLKPDAAQGRSQFQQEVEVLSCIRHPNMVLLLGACPEFGCLVYEYMANGSLDDCLFRRGNKPALPWQLRFRIAAEIATGLLFLHQTKPEPLVHRDLKPGNILLDRNYVSKISDVGLARLVPPKVADTVTQYRMTSTAGTFCYIDPEYQQTGMLGIKSDVYSLGIMLLQMITAKPPMGLTHHVGRSIENGTFADMLDPAVEDWPVEHALHFAKLSLACAEMRRKDRPDLGKVVLPELNKLRDFADENMPMMMLFGMPTGFTPRNNYNYSNSSFSSVQDSMSESQSMSGMSGYESHSSSSSVGRM

SEQ ID NO: 179386 - protein, 67 aa, Glycine max
  Coding DNA Sequence Number=SeqID_62608
MWLQSWKRSPICDKDELKQKEKQEERPGSTLSGTLSFPSFLRPAKSRKRRPVCDKNELRQKEKEEER

SEQ ID NO: 179387 - protein, 1113 aa, Glycine max
  Coding DNA Sequence Number=SeqID_62609
  Gene Ontology: Mol. function=protein dimerization activity; Cellular component=nucleus; Biological process=regulation of transcription, DNA-dependent
  Homolog annotation: Hit_ID=Q1SM92; Match level="QueryCoverage=99%, HitCoverage=98%, E-value=0.0, Identity=63%"; Hit description =Transcriptional factor B3; Auxin response factor; Aux/IAA_ARF _dimerisation
  Pfam annotation: Domain name=Auxin_resp; Domain location=258-341; Score=179.1; E_value=1.1e-50; Accession=PF06507.4; Description=Auxin response factor
  Pfam annotation: Domain name=B3; Domain location=131-236; Score =106.8; E_value=6.3e-29; Accession=PF02362.12; Description=B3 DNA binding domain
  Pfam module annotation: Pfam domain module=Auxin_resp::B3; Domain location=258-341::131-236
MITQPPDAAPAVAPNSGEGGEKKSINAELWQACAGPLLNLPSPGTHVVYFPQGHSEQVAASLKKDVDAQVPNYTNLPSKIPCLLHNVTLHADPDTDEVYAQMALRPVPSFDTDALLRSDISLKLSKPQPEFFCKQLTASDTSTHGGFSVPRRAAEKIFPPLDYSLQSPVQELVARDLHDNVWRFRHIYRGKPKRHLLTTGWSLFISGKRLLAGDSVLFVRDEKQQLLLGIRRANRQPSNLSSSVLSSDSMHIGVLAAAAQAVANNSPFTVFYNPRASPSEFVIPLAKYYKAVYSHHISPGMHFRMTFETEDSGTRRYMGTIIGVSDLDSVRWKNSLWRNLQVGWDESTAEDRRSRVSVWEIEPVTTPYFICPPPFFRSKRPRLLGMPDDEPDFNNLFKSTVPWLGDDMCIKDPQALPGLSLVQWMNMQQNPALASSLQPNCVPSMSGLVLQNLPGADIANQLGFSTSQTSQSNNVSVNAQNILQTSQQLDHIQKLPCPSSALGAVTQLPQQLADITQQPRNLTNQTLPQNEAHTQLLNSQRVVQTNNILQQQQSSIQNHQLLRSLSQNPPQKDQQTTFGQNERQNVFQSPMPDHFNQQLQMSDNQVRFQLLQKLQQQQQTLLAQQSALQQPALIQVQDQQRQLLDVTNNSSSLISGQVLENPPTLQNSLPEANSVTHQITMPSSQKNFHYSHLSQQPALLSEMSGHAGLLPTVTTNPLSASGGSILTGAGQSVITDDVPSCSTSPSTNNRASALPPVVSSQIHRSTTIGDDMAQSAVTISGPSTLETLSSNANMVKDVRPKYEVKPSSNISKNQNHGNVARQMYLNGVVQTDYLDSSSSTTSLYHFQSDTHMHQNNNPFSYNPQLIYCRDNSQNVEVQADARSNVPFVNDINGQMGMPSNLDSLLTNGTVGLGKDLSNNFSSGGLLGDLENNKGVQPELSSSMVSQTFEVPDMSFNSIDSTIDGSSFLNRGPWDLPPPPPPPPPPPPPPPPQQQQQIQRIRTYTKVYKRGAVGRSIDITRYSGYEELKQDLALKFGIEGQLEDRERIGWKLVYVDHENDVLLVGDDPWEEFVNCVRCIKILSPQEVQQMSLDGDFGNGGLPYPAGSSSGGGNA

SEQ ID NO: 179388 - protein, 348 aa, Glycine max
  Coding DNA Sequence Number=SeqID_62610
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=4e-41, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GCTPSPTKRLHVVTFRGLHVLAFRGQHALAFRGLHILAFRGLHVLAFRGLHALAIRGLRVLAFRGQRALAFVGIHVLTIRGLHVLAFRGQHVLALGTSTPTFNGLHALAYKRLHVVTFRGLHILAFRGQHALAFRGLHILAFRGLHVLAFRGLHALAIRGLRVLAFRGQCALAFVGIHVLTFRGLHVLAFRGQHVLALGTSTPTFNGLHALAYKRLHVLTFRGLHVLAFRGQHALAFRGLHILVFKGLHVLAFRGLHAIAIRGLRVLAFRGLRALAFVGLHALTFRGLRVPAFRGLHTLDIRGLHVLAFGGQHFLAFRGLHALAFREPHVLAIRGLHVLSFKGLHALA

SEQ ID NO: 179389 - protein, 118 aa, Glycine max
  Coding DNA Sequence Number=SeqID_62611
MPLTRHPLDPDKSNRALGFPALITGLFQWFGVPVTPSKALDAPLPPHQADPAGSFDKERYLRLLVLQQAANHRGQVQTHECLYQLNLSLQSQGFTPFACPTPDQFRADVTWPGEWSKA

SEQ ID NO: 179390 - protein, 61 aa, Glycine max
  Coding DNA Sequence Number=SeqID_62612
MAMSHGLLYQQRMKNAFDKKGQNHLRPWSDAGNKLKAETNQGKMVTRPQFAAQCRFLLSGT

SEQ ID NO: 179391 - protein, 110 aa, Glycine max
  Coding DNA Sequence Number=SeqID_62613
MDTSKPYTGAMRGIVHEPQANLGADLKFPTSNEFGMTGPLNESISCFLIRVDAWVLEPVSFRGLHVLTFQGLHALAIRGLHALTLRGLRVLAFRGLHALAFSRLHIRTLK

SEQ ID NO: 179392 - protein, 55 aa, Glycine max
  Coding DNA Sequence Number=SeqID_62614
MAHLPQKVHLDWMVNGGDGQQQRWRRMIPFASLMILPFDEVLVNFNRWNLKRSEK

SEQ ID NO: 179393 - protein, 349 aa, Glycine max
  Coding DNA Sequence Number=SeqID_62615
  Gene Ontology: Mol. function=zinc ion binding
  Homolog annotation: Hit_ID=Q2QXC7; Match level="QueryCoverage=60%, HitCoverage=24%, E-value=1e-21, Identity=33%"; Hit description =Expressed protein
  Pfam annotation: Domain name=PHD; Domain location=10-59; Score=24.4; E_value=0.00021; Accession=PF00628.19; Description=PHD-finger
MEHEMGQEAVCLHCGDRGFPETLVFCSQCKAYALHRYCLKGPVIFTDAVTWFCEDCATKLWVPPALDQSTPISSVTRKNCVLGVKKHNKQQKKKVKKKQKEGKANSVLVAETKVVLSGSHSSPGPEHPQCSNRGEEYEVKNDCGPAPRDVANFVVGEEESVARDLANSDEGFKSVPVSQGANNSDSGCVELDGYVYAQPTINPIWRGSMYFCNETNGTVNGLLAHMSDLACSKVVEETGHFPEVLHAELLPRDKVWPESFKSRRPTDQDIALFIFPDGEGSEKDFDKVVEDIMIHEHAIKIVAKKAELLIFHSIELPIKYWRFEAKYYLWGVFRRKQISEETNDAVCRD

SEQ ID NO: 179394 - protein, 205 aa, Glycine max
  Coding DNA Sequence Number=SeqID_62616
  Gene Ontology: Mol. function=nucleic acid binding
  Homolog annotation: Hit_ID=Q8H0P8; Match level="QueryCoverage=91%, HitCoverage=78%, E-value=7e-60, Identity=61%"; Hit description=RNA -binding protein
MSPSGLTGGNEMHNYIARNDDHTGHRMLKDTKTLGSAYDRYLQSAGLTSFNSGEASAIGGVGLGRGVGGLPRHSLTDPAVMGHPGGGHDLARNGRNVNYGGQLTVDAASMPGPETVPLPPDASNIFRPFVGYREVRLVSKESKHRGGDPLILCFVDFANPACAATALSALQGYKVDELNPESSHLRLQFSRFPGPRSGPGPRGKR

SEQ ID NO: 179395 - protein, 99 aa, Glycine max
  Coding DNA Sequence Number=SeqID_62617
MYSFECSSSFSEIECSFKHSNLYTSMPCHLICHMVPIIGHEAHYLEAAVVDQIVSEVMEIGQVVNAQFIVNCQKLGHDPMTCDHLFDHTLDPFPKSLLI

SEQ ID NO: 179396 - protein, 138 aa, Glycine max
  Coding DNA Sequence Number=SeqID_62618
  Gene Ontology: Mol. function=protein serine/threonine kinase activity; Biological process=protein amino acid phosphorylation
  Homolog annotation: Hit_ID=Q9FHX3; Match level="QueryCoverage=98%, HitCoverage=24%, E-value=5e-18, Identity=37%"; Hit description =Receptor lectin kinase-like protein
MCMTTVLARGMLLYQQGQWGILPLNMFILVLEVATGRKPVEDGGTVVADFVWGLWEKRKLIEAADPRLMGKFDELEMESCYWWGFFVCSLTMRRGQDKPRVRSRPICPDDDTSDAQSVVADLPSTDEAPYLTPRNQFY

SEQ ID NO: 179397 - protein, 341 aa, Glycine max
  Coding DNA Sequence Number=SeqID_62619
  Gene Ontology: Mol. function=nucleoside-triphosphatase activity; Cellular component=membrane; Biological process=peptide transport
  Homolog annotation: Hit_ID=Q8UAG2; Match level="QueryCoverage=100%, HitCoverage=95%, E-value=1e-171, Identity=64%"; Hit description=ABC transporter, nucleotide binding/ATPase protein
  Pfam annotation: Domain name=AAA; Domain location=37-249; Score= -31.1; E_value=0.048; Accession=PF00004.19; Description=ATPase family associated with various cellular activities (AAA)
  Pfam annotation: Domain name=ABC_tran; Domain location=35-232; Score =172.9; E_value=7.8e-49; Accession=PF00005.17; Description=ABC transporter
  Pfam annotation: Domain name=oligo_HPY; Domain location=235-302; Score=4.1; E_value=0.00033; Accession=PF08352.2; Description =Oligopeptidedipeptide transporter, C-
  Pfam module annotation: Pfam domain module=AAA::ABC_tran::oligo_HPY; Domain location=37-249::35-232::235-302
MNNLVEIRGLKVEATTDSGRRIDIIKGVDIDIADAEIVALIGESGSGKTTIALTLMGYARPGCRISGGSVKVAGQDMVQLSETERERVRGTQVTYVPQSAAAAFNPAQKIIDQVIEVTRIHHLMPPQEARARAVELFKALSLPNPETIGDRYPHQVSGGQLQRLSAAMALIGNPKLVIFDEPTTALDVTTQIEVLRAFKSAMRKGGIGGVYVSHDLAVVAQIADRIVVLKGGEVQETGTTRDILENAQHPYTKELLTAFHDKVRTVAPPTQERAAPLLDIENLIAGYGTKGDNRMPLVRAVDSVSLSVYPGRNLGIIGESGCGKSTLARAIAGILPAAGGH

SEQ ID NO: 179398 - protein, 111 aa, Glycine max
  Coding DNA Sequence Number=SeqID_62620
  Gene Ontology: Mol. function=transmembrane receptor activity; Cellular component=membrane; Biological process=defense response
  Homolog annotation: Hit_ID=Q1SI46; Match level="QueryCoverage=97%, HitCoverage=10%, E-value=2e-25, Identity=55%"; Hit description =Leucine Rich Repeat, putative
MAYSSSGASQIKYVVHLLCDLLLISGLTGEISVQISDNIPQIKYDVFVSFRGEDIRHGFLGYLTEAFRQKQIHAFIDDKLEKGDEIWSSLVGAIQGSLISLTIFSENYSSS

SEQ ID NO: 179399 - protein, 93 aa, Glycine max
  Coding DNA Sequence Number=SeqID_62621
  Homolog annotation: Hit_ID=Q1EP21; Match level="QueryCoverage=41%, HitCoverage=16%, E-value=4e-10, Identity=71%"; Hit description =Translocase of outer membrane 7 (TOM7) family protein
DKSCDVYDIAAIIRVYGIDQIDRFGGRERKKGNFNGVKGFSEGEGEEFKGIEGCGRSIRERVPEGVDDMGDAKSEGHHSLRFHPFGHRHRYEL

SEQ ID NO: 179400 - protein, 111 aa, Glycine max
  Coding DNA Sequence Number=SeqID_62622
  Subcellular localization annotation: CTP_CleavageSite=31; ConfidenceScore=5.34e-01
MSNLIKIVKEISNQNRTKKLFNQTFKLNVTRCEFVLGSFSNNVPAPRVFPMGMAMLTNVDEAFQRELDKEEIKREITTNQARPNVAHYNGKCKAITSTTDDNESFHNKVKQ

SEQ ID NO: 179401 - protein, 170 aa, Glycine max
  Coding DNA Sequence Number=SeqID_62623
  Gene Ontology: Mol. function=calcium-dependent phospholipid binding; Cellular component=cellular_component; Biological process=regulation of cell shape
  Homolog annotation: Hit_ID=Q6H450; Match level="QueryCoverage=97%, HitCoverage=95%, E-value=5e-60, Identity=51%"; Hit description =Putative annexin
  Pfam annotation: Domain name=Annexin; Domain location=100-165; Score =111.4; E_value=2.7e-30; Accession=PF00191.10; Description=Annexin
  Pfam annotation: Domain name=Annexin; Domain location=24-90; Score =92.6; E_value=1.2e-24; Accession=PF00191.10; Description=Annexin
  Pfam module annotation: Pfam domain module=Annexin::Annexin; Domain location=100-165::24-90
MLLLAYVSIPRYEGLELDHIIVQEDAKQLYKSGEKRIGTDEKMFIKIFSEKSGAHLAAVNSTYIASYGHSLEKAIKKETSGNFESALLTILRCATDPAMYFAKILRKSMKGVGTDDSRLIRVIVTRTEIDMQFIKIAYYKKYGKPLTHAVKSDTSGHYKDLLLNLLGSDY

SEQ ID NO: 179402 - protein, 823 aa, Glycine max
  Coding DNA Sequence Number=SeqID_62624
  Gene Ontology: Mol. function=sequence-specific DNA binding; Cellular component=nucleus; Biological process=regulation of transcription, DNA-dependent
  Homolog annotation: Hit_ID=Q1SM96; Match level="QueryCoverage=90%, HitCoverage=65%, E-value=0.0, Identity=81%"; Hit description=DDT
  Pfam annotation: Domain name=DDT; Domain location=55-107; Score=25.9; E_value=0.00014; Accession=PF02791.7; Description=DDT domain
MPGNFYAGEHQTHHWKRFCSPPVIVLASALYETMTSSPLLNPSYHYCFNSTYLRLEVFHFIYTYAIIVDICPFTLDEFVQAFHDKDSMLLGKIHVALLTLLVSDIEVELTNGFSPHLNKSCNFLALLHSVESQEYSLDFWRRSLNSLTWIEILHQVLVASGFGSKQGSLRGEVLNKELNLLVNYGLCPGTLKSELFNILSERGNIGCKVAELAKSMQIAELNLASTPEELESLICSTLSSDITLFEKISSTAYRLRMSTVMKDGDESHSDTEDFGSVDDELNDTDTCSSGDDFESDPINSSIRKLKRASSHKNNMLKVYTEIDESHPGEAWLLGLMESEYSDLNIEEKLNALAALTDLVSSGSSIRMKDSTKVAADCNSSIQLQGSGAKIKRSAVKKPGPLWNQKLHLNSDPCTVDSSSLISRLHSREASFEKGKGSSISHPIQSVFLGSDRRYNRYWLFLGPCNVDDPGHRRIYFESSEDGHWEVIDTEEALCALLSVLDDRGNREALLIESLERRQASLCRSMSRINVNSTGKGSMSHSDQSELDMVTDDSYSPASDVDNLNLTETAKDSLPSAGAVVIKAGKKGEEQIKKWIRVQEYDTWIWNSFYSDLNVVKYGKRSYLDSLARCKSCHDLYWRDERHCKICHMTFELDFDLEERYAIHIATCREKEDSNTFPNHKVLPSQIQSLKAAVYAIESVMPEDALVGAWRKSAHKLWVKRLRRTSTLVELLQVLADFVGAINKDWLFQCKFPHGLVEEIIASFASMPHTSSALALWLVKLDAIIAPYLDRVHLQKKQGTMIRTVVVSLEILSEKRKLKNAGGM

SEQ ID NO: 179403 - protein, 76 aa, Glycine max
  Coding DNA Sequence Number=SeqID_62625
MECNISGVKIKSDGPAERGARSGICRGTEKEEGIGASDAEVEVFSFSKKPLEKASQRSHEEAYGGSLLMKLLEKAT

SEQ ID NO: 179404 - protein, 769 aa, Glycine max
  Coding DNA Sequence Number=SeqID_62626
  Gene Ontology: Mol. function=hydrolase activity, hydrolyzing O -glycosyl compounds; Cellular component=cell outer membrane; Biological process=carbohydrate metabolic process
  Homolog annotation: Hit_ID=Q1SMA7; Match level="QueryCoverage=94%, HitCoverage=96%, E-value=0.0, Identity=78%"; Hit description=Alpha amylase, catalytic region; Alpha-1,6-glucosidases, pullulanase- type
  Pfam annotation: Domain name=Alpha-amylase; Domain location=234-662; Score=22.8; E_value=1.7e-07; Accession=PF00128.14; Description=Alpha amylase, catalytic domain
  Pfam annotation: Domain name=Isoamylase_N; Domain location=88-182; Score=78.4; E_value=2.3e-20; Accession=PF02922.8; Description =Isoamylase N-terminal domain
  Pfam module annotation: Pfam domain module=Alpha-amylase::Isoamylase _N; Domain location=234-662::88-182
  Subcellular localization annotation: CTP_CleavageSite=32; ConfidenceScore=5.35e-01
MACFSILSPPHPTLTLTLLPPSHSQCGGFTVRVSVALTERLSQHHKTNSIIPSTRAAANGGGFETETAVVEKPQLKTLFQASRGYPSPFGATVRDGGVNFAISSLNALSATLCFFTLSDFQNNRVTEYVPLDPLINRTGGVWHVFLKGDFRDMLYGYKFDGKFSPLEGHYFDSSHILLDPYAKAVISRGEFGALGPDGNCWPQMAGTVPSEDDEFDWEGDLPLKYPQKDLVIYEMHVRGFTKHESSNTKFPGTYLGVVEKLDHLKELGVNCLELMPCHEFNELEYYGHNSAQGDYRVNFWGYSTINYFSPMIRYSSAGIRNCGQDGINEIKFLIKEAHKRGIEVIMDVVFNHTAEGNENGPIISFRGVDNSMYYMLAPKGEFYNYSGCGNTFNCNHPVVRQFIVDCLRYWVTEMHVDGFRFDLASIMTRSSSLWDGANVFGAPIEGDLLTTGTPLSSPPLIDLISNDPILCGVKLIAEAWDAGGLYQVGTFPHWGIWSEWNGKYRDTVRLFIKGTDGFAGAFAECLCGSPNLYQGGGRKPWHSINFVCAHDGFTLADLVTYNNKNNLSNGEDNNDGENHNNSWNCGQEGEFVSTSVKKLRKRQMRNFFLSLMVSQHNYFQWDKKEESSSDFFRFCRLMTKFRQECESLGLADFPTSERLQWHGHFPGKPDWSETSRFVACTMVDSVKGEIYIAFNMSHLPFTVTLPERPGYKWEPLVDTSKPTPYDFLTPDLPGRDIAIQQYAQFLDANMYPMLSYSSIILLRIPDENL

SEQ ID NO: 179405 - protein, 113 aa, Glycine max
  Coding DNA Sequence Number=SeqID_62627
MQQPSLQPMPLLLLLFMGIRIRLAPVLTLTPEMVQQMIVSTFSALGLSVGQLVDNDCRNVPFRGRARARLTGALSKEGKMRGVATNVYLWKTLGKLKETGQNENSKFGSCIYA

SEQ ID NO: 179406 - protein, 154 aa, Glycine max
  Coding DNA Sequence Number=SeqID_62628
  Homolog annotation: Hit_ID=Q1SMA9; Match level="QueryCoverage=99%, HitCoverage=100%, E-value=7e-46, Identity=65%"; Hit description =Auxin responsive SAUR protein
  Pfam annotation: Domain name=Auxin_inducible; Domain location=18-108; Score=64.6; E_value=3.3e-16; Accession=PF02519.5; Description=Auxin responsive protein
MAGAMNMKVDKIRQIVRLKQLMTRWKHISLRRRSDDEPSAARRPPPGFIFVYVGTERTRFAIPARFLNLALFDGLLKQTEEEFGLRGNGGLVLPCQVALFTNVVKYLHKDEHKYGKLSLEDFVSMVSDDTDVAASDSCKENVVVFAPLLQKAEV

SEQ ID NO: 179407 - protein, 121 aa, Glycine max
  Coding DNA Sequence Number=SeqID_62629
MTYMLDGYGLRSNMLCLLTKEKKKKDKKWCKNEIFLGLSPTAIKGHTNTRKVGRGVTYGLSVVKNERKSARNKLRVFIPPDKMVAVGPEIADFVIEISIVVQKLAPFNIDKWKQVLEATKE

SEQ ID NO: 179408 - protein, 79 aa, Glycine max
  Coding DNA Sequence Number=SeqID_62630
MGAKRSSTCSFGSVFKACFSSGGSYDEYWEGSGSGRRIFASDEDRGRWVAEPGIDRKASDFIARYYASRVTDSERQFAS

SEQ ID NO: 179409 - protein, 149 aa, Glycine max
  Coding DNA Sequence Number=SeqID_62631
MSTFEQHATNASIHFPEPEPYSTTNTFTSMMNAIKSVSWVLAISSKYVHKFPSSFCTWPRPILEYQAWLKRVLATYKDEWKDWGIYDMIMLCFVLPKAMVGPTLLDVVAILSLPIYGEELLSLYGNHYSTTPNTHGIKFSKDDLDIPNS

SEQ ID NO: 179410 - protein, 66 aa, Glycine max
  Coding DNA Sequence Number=SeqID_62632
  Subcellular localization annotation: CTP_CleavageSite=15; ConfidenceScore=5.11e-01
MFPLHPFHIFVQGLLAQASSARPGETLNMLPPLTATSSACPAPGKGRRSVGRDPILHLHPSLSTCK

SEQ ID NO: 179411 - protein, 317 aa, Glycine max
  Coding DNA Sequence Number=SeqID_62633
  Gene Ontology: Mol. function=chitin binding; Cellular component =extracellular region; Biological process=chitin metabolic process
  Homolog annotation: Hit_ID=UPI0000E478AA; Match level="QueryCoverage =85%, HitCoverage=26%, E-value=7e-33, Identity=30%"; Hit description =PREDICTED: similar to cortical granule protein with LDL-receptor -like repeats
LDPWVLVPIAFRGLHILDFRGLHVLTFRGLPVLTFRVLHVLAFRGLLHVLAIRGIHALTFRGLHIFAFKGLHVLDFRGLHILTFRGLHALAVRGLHVLALRGLHTLTVRGLHALAFRGLHVLACKGLHVLTIKGLGLHILTFRGMYVLAFRGLHVLTFKGFHVLPFRDYRGMHVLAYRGLHVLAFRGQYVLAFRGLHVLTFRGLHVLAFRGLHILTFRGLYVLAFRGLHVLAFRGLHILTFRGLYVLAFTGLHVLGFRGLYVLTFKGLHALAFRGLHILIFRGLHVLAFRDYRGLYVLAFRGLHVLAFRGLYVFAFK

SEQ ID NO: 179412 - protein, 66 aa, Glycine max
  Coding DNA Sequence Number=SeqID_62634
MEGKGQKDHDSSIWLWRSKWCLSLELLALKRHKQEVDKEEKHLALKRQFPALKRQSGSNKFDFHGT

SEQ ID NO: 179413 - protein, 54 aa, Glycine max
  Coding DNA Sequence Number=SeqID_62635
MVQGKFVPNLGEALGMEAKCLRKKGKYGEGMNEKVKVILWMNALLEPKLLNPRN

SEQ ID NO: 179414 - protein, 64 aa, Glycine max
  Coding DNA Sequence Number=SeqID_62636
IAEGGGALVNLSHGMADLVSYRNADRDIDQVIIALSTALEWGDLKGEDRACLSVFEWNGLMGLE

SEQ ID NO: 179415 - protein, 670 aa, Glycine max
  Coding DNA Sequence Number=SeqID_62637
  Gene Ontology: Mol. function=zinc ion binding; Cellular component =membrane; Biological process=defense response
  Homolog annotation: Hit_ID=Q9FHX1; Match level="QueryCoverage=98%, HitCoverage=61%, E-value=0.0, Identity=75%"; Hit description=TMV resistance protein-like
  Pfam annotation: Domain name=FYVE; Domain location=555-623; Score =51.7; E_value=2.5e-12; Accession=PF01363.12; Description=FYVE zinc finger
  Pfam annotation: Domain name=RCC1; Domain location=229-278; Score =11.9; E_value=0.036; Accession=PF00415.9; Description=Regulator of chromosome condensation (RCC1)
  Pfam annotation: Domain name=RCC1; Domain location=281-333; Score =24.0; E_value=0.00052; Accession=PF00415.9; Description=Regulator of chromosome condensation (RCC1)
  Pfam annotation: Domain name=RCC1; Domain location=336-385; Score =22.3; E_value=0.0017; Accession=PF00415.9; Description=Regulator of chromosome condensation (RCC1)
  Pfam annotation: Domain name=RCC1; Domain location=399-448; Score =16.5; E_value=0.011; Accession=PF00415.9; Description=Regulator of chromosome condensation (RCC1)
  Pfam annotation: Domain name=RCC1; Domain location=451-500; Score =20.5; E_value=0.0043; Accession=PF00415.9; Description=Regulator of chromosome condensation (RCC1)
  Pfam annotation: Domain name=RCC1; Domain location=505-552; Score =18.3; E_value=0.0074; Accession=PF00415.9; Description=Regulator of chromosome condensation (RCC1)
  Pfam module annotation: Pfam domain module=FYVE::RCC1::RCC1::RCC1::RCC 1::RCC1::RCC1; Domain location=555-623::229-278::281-333::336 -385::399-448::451-500::505-552
MGSRDYGAVFQRYLRPEKDYLSFSLIYNNGKRSLDLICKDKVEVEVWIAGLKALISSGQGGRSKIDGWSDGGLHLDDSRDLTSNSPSESSVSASRDLSSPDVYVSLANTSPHSFHSENTLNFERSHAPSNPSNMQVKGSSSDVFRVSVSSAPSTSSHGSAPDDYDALGDVYIWGEVICENVVKVGAEKSASYFSPRTDILLPRPLESNVVLDVLQIACGVKHAALVTRQGELFTWGEESGGRLGHGVGKNVVQPRLVEAMASTTVDFVACGEFHTCAVTMAGELYTWGDGTHNAGLLGHGTDVSHWIPKRIAGPLEGLQVALVTCGPWHTALITSTGQLFTFGDGTFGVLGHGDRENVSYPREVESLSGLRTIAVACGVWHTAAIIEVIVTQSSASVSSGKLFTWGDGDKNRLGHGDKDARLEPTCVPSLIEDNFHRIACGHSLTVGLTTSGRVFTMGSTVYGQLGNPQSDGKLPCLVEDKFAGESVEEIACGAYHVAVLTSKNEVFTWGKGANGRLGHGDVEDRKSPTLVEALKDRHVKYIACGSNYSSAICLHKWVSGAEQSQCSACRQAFGFTRKRHNCYNCGLVHCHSCSSRKALRAALAPNPGKPYRVCDSCFVKLNKVAELGNNNRRNAMPRLSGENKDRLEKPELRLTKTAVPSNMDLIKQLD

SEQ ID NO: 179416 - protein, 319 aa, Glycine max
  Coding DNA Sequence Number=SeqID_62638
  Gene Ontology: Mol. function=zinc ion binding
  Homolog annotation: Hit_ID=Q5EWZ0; Match level="QueryCoverage=88%, HitCoverage=31%, E-value=2e-45, Identity=39%"; Hit description =Putative chromosome condensation factor
  Pfam annotation: Domain name=DZC; Domain location=282-317; Score =88.0; E_value=2.9e-23; Accession=PF08381.1; Description=Disease resistancezinc fingerchromo
  Subcellular localization annotation: CTP_CleavageSite=45; ConfidenceScore=5.79e-01
APRPVLTSSGVSSRSVSPFSRRPSPPRSATPIPTTSGLSFSKSITDSLKKTNELLNQEVLKLRGQVETLRQRCELQELELQRSTKKAQEAMAVAAEESAKSKAAKEVIKSLTAQLKNLSERLPPGAYDAENIRPAYLPNGLEPNGIRYPDLNGEHHTRAESISGSSLASIGLESSLMNRTDGTLPGSYGANHYQQNRGSVTSNGTDDYPNVKLPNGSGMIQPSSSTVSDTVDGGRDSGDFQDDESGLRSRNAIVPANSNQVEAEWIEQYEPGVYITLVALRDGTRDLKRVRFSRRRFGEHQAETWWSENRDRVYKRYNV

SEQ ID NO: 179417 - protein, 125 aa, Glycine max
  Coding DNA Sequence Number=SeqID_62639
MGDQEEVQEQMKADMSALKEQMASMMDVMLGMRQLMENNAATAVAVSLAAEADPSLPATTHHPIPNVVGRERSTLGHINNPDLGYNRVAYPYGLLPDYTPPVMHDDAGHVPPLILEGEPSRQMDE

SEQ ID NO: 179418 - protein, 82 aa, Glycine max
  Coding DNA Sequence Number=SeqID_62640
MANKTYYQKHQHWNQVECEEWLVCEAYVKEWKWYYQYYNIERRRCVRKHGGSKCYVMFFKIWLLGVIFVLGFWWLVAINETT

SEQ ID NO: 179419 - protein, 196 aa, Glycine max
  Coding DNA Sequence Number=SeqID_62641
  Gene Ontology: Mol. function=nucleic acid binding
  Homolog annotation: Hit_ID=Q8H0P8; Match level="QueryCoverage=79%, HitCoverage=62%, E-value=7e-48, Identity=60%"; Hit description=RNA -binding protein
MGWSGTILRDLLLSIKWRDISPSGLTSGGNEMHNYIGRNDDHTGHRILKDTKTLGSAFDRYLQSAGLTSFNSGEASAIGSVGLERGVGGLPRHSLTDPAVMGHPGGGHDLARGGRNVNYGDQLPVDAASMPGPETVPLPPDASSTLYVEGLPSDNIFRPFVGYREVRLVSKESKHSSNRKLGILTAQGLLDGGSEN

SEQ ID NO: 179420 - protein, 155 aa, Glycine max
  Coding DNA Sequence Number=SeqID_62642
  Gene Ontology: Mol. function=protein dimerization activity; Cellular component=nucleus; Biological process=regulation of transcription, DNA-dependent
  Homolog annotation: Hit_ID=Q0GPD7; Match level="QueryCoverage=98%, HitCoverage=98%, E-value=2e-39, Identity=54%"; Hit description=BZIP transcription factor bZIP72
MSEVVLLLVHVVHAAGEKGSLGAEPFVFGSEAVQVVQEELQPVTEFPVFDPALVQLVPKILQVSLFPHPGPAGRFPVRYHAAPFPLVHHHRGRGAYVFGWVRFGFIVRGGARSRDRFGGEEGVGIVVVIPRREAGGEGGEGREGVGRSEGGEHGG

SEQ ID NO: 179421 - protein, 137 aa, Glycine max
  Coding DNA Sequence Number=SeqID_62643
  Homolog annotation: Hit_ID=Q6L463; Match level="QueryCoverage=21%, HitCoverage=15%, E-value=4e-10, Identity=90%"; Hit description=LOB domain protein 1, putative
MVNLRGSVGGKYGANTHFSTHLRRRILQAAQGLTTTGGRGGGGDGGAAEGEPREGEGKGVGDCEGGEEDEDGGEFDSIVGTWIGIGGEGVDVVVFTLYSIVSLCKTGFVLLLIIARSSNGQRTYRVCQFLGAGGMSG

SEQ ID NO: 179422 - protein, 246 aa, Glycine max
  Coding DNA Sequence Number=SeqID_62644
  Gene Ontology: Mol. function=oxidoreductase activity; Cellular component=mitochondrion; Biological process=negative regulation of transcription
  Homolog annotation: Hit_ID=Q8LB59; Match level="QueryCoverage=98%, HitCoverage=99%, E-value=1e-85, Identity=63%"; Hit description=Minor allergen
  Pfam annotation: Domain name=FMN_red; Domain location=53-229; Score= -27.7; E_value=0.0041; Accession=PF03358.6; Description=NADPH -dependent FMN reductase
  Pfam annotation: Domain name=Flavodoxin_1; Domain location=57-181; Score=49.6; E_value=1e-11; Accession=PF00258.15; Description =Flavodoxin
  Pfam module annotation: Pfam domain module=FMN_red::Flavodoxin_1; Domain location=53-229::57-181
MGKGGGCFPSKTKAPISGAQKDPVSVESLIPRDDPSNTSQEVPAPAPEAVKKLKVFIVFYSTYGHVESLARSLKKGVDSIEGVEGVLYRVLETLPKEVLELMKAPEKDETVPLISADKLLEADGLLFGFPTRYGSMAAQMKAFFDSTGQLWTEQKLAGVPAGFFVSTGTQGGAITQLVHHGMLYVPIGYTFGTGMFEMDSVRGGSPYGAGVLAGDGSRQASETELALAEYQGRYMATIVKKLGQKS

SEQ ID NO: 179423 - protein, 428 aa, Glycine max
  Coding DNA Sequence Number=SeqID_62645
  Gene Ontology: Mol. function=dolichyl-diphosphooligosaccharide -protein glycotransferase activity; Cellular component=endoplasmic reticulum membrane; Biological process=protein amino acid N-linked glycosylation via asparagine
  Homolog annotation: Hit_ID=Q9LVR2; Match level="QueryCoverage=84%, HitCoverage=88%, E-value=1e-148, Identity=67%"; Hit description =Dolichyl-di-phosphooligosaccharide-protein glycotransferase (Oligosaccharyltransferase)-like
  Pfam annotation: Domain name=DDOST_48kD; Domain location=1-385; Score= 288.7; E_value=1.1e-83; Accession=PF03345.5; Description=Dolichyl -diphosphooligosaccharide-protein glycosyltransferase 48kD subunit
MSKLIFVFLALIPLLCTSFSPEKPSDRRILVLLDDFAIKSSHSLFFNSLKSRGFDLQFHLADDPKIALQRYGQYLYDALILFSPTIEQMGLEGFGGSIDAAAILDFVDSGHDLIVAADSNASDLIREIATECGVDFDEDPAAVVVDHSAYAVSATEGDHTLIASDDFIKSDAPVLFQGIGHSLNPTNSLVLKVLSASPSAFSANPKSKARNNARILISGSLSLFSNRSGVQKAGSPTKHEKSGNEQFLNELSKWIFHERGHLKAVNVQHHKVGEANEPAIYRINDNLEYSVEVYEWSGTAWEPYVADDVQVQFYMMSPYVLKTLSTDGKGRYFTSFKVPDVYGVFQFKVEYEKLGYTSLSLSKQLYWTKDTDADALVLRIKKKDKQESSASTSSTTPIRSNSAEMRLSSMPYPVAAKSHAGGRHHRTF

SEQ ID NO: 179424 - protein, 136 aa, Glycine max
  Coding DNA Sequence Number=SeqID_62646
MRDVAKGGEEHVEVRVCEGVVDDLGFKLLLLSDWGWLSQRRGQLGRRWCSRFWDRRRRRKIRERQEEGKKEKGKKEKGGLAQAAHGSISRGHANIVNGAGVQGSLVCVREEVFRRGKVVRIRSGGGGGGRVGARPD

SEQ ID NO: 179425 - protein, 100 aa, Glycine max
  Coding DNA Sequence Number=SeqID_62647
MESGDMRGYRMVIRTFRQPGANEPIDAQRLTSSSAPFVILNHGVRDSELGGRHRYLMAIRTFRQPRGMNSTVFTLLVRRHSSPTTHEILLCWAGTIKFDG

SEQ ID NO: 179426 - protein, 236 aa, Glycine max
  Coding DNA Sequence Number=SeqID_62648
  Homolog annotation: Hit_ID=Q0KIN0; Match level="QueryCoverage=62%, HitCoverage=8%, E-value=5e-12, Identity=30%"; Hit description =Integrase core domain containing protein
  Pfam annotation: Domain name=zf-CCHC; Domain location=126-143; Score =10.9; E_value=0.016; Accession=PF00098.13; Description=Zinc knuckle
MKVTALKQTSHDMIAHIGKARAAVEELKRFLVAESLEEVNRKLDKFYMVLILRSLHSDFDHVRDQVLAGDQVPSMDSLITRLLRVPHALKEENPADVVETSAMAAPRGRGGGRNSRGGRGGRGGRPQCTYCKRMGHTQETCYSLHGFPDKVAQLKSEKSSSQTSSSSVPCYSTACISQSIDGLSPWILDSGASDHISGNKSSFTSISFPKIPILLLWLMVPKLQLKGVVTCLYLPH

SEQ ID NO: 179427 - protein, 498 aa, Glycine max
  Coding DNA Sequence Number=SeqID_62649
  Gene Ontology: Mol. function=hydrolase activity; Cellular component =integral to membrane; Biological process=nucleotide metabolic process
  Homolog annotation: Hit_ID=Q1SMB3; Match level="QueryCoverage=99%, HitCoverage=100%, E-value=0.0, Identity=71%"; Hit description=Type I phosphodiesterase/nucleotide pyrophosphatase
  Pfam annotation: Domain name=Phosphodiest; Domain location=108-437; Score=439.0; E_value=6.1e-129; Accession=PF01663.12; Description =Type I phosphodiesterase  nucleotide pyrophosphatase
  Pfam annotation: Domain name=Sulfatase; Domain location=106-480; Score=-47.0; E_value=0.0096; Accession=PF00884.13; Description =Sulfatase
  Pfam module annotation: Pfam domain module=Phosphodiest::Sulfatase; Domain location=108-437::106-480
  Subcellular localization annotation: CTP_CleavageSite=91; ConfidenceScore=5.33e-01
MGSNPLSALTSTMPAPISTQDHDDQEDSPSSKALLSFSTDSSSSFSSSSSSSHKPLFITLILITFIALSTSFAFAFLYFSSKPPLSPSPSSLSLFSSKARPLSKLKRPVVLLVSSDGFRFGYQFKAPTPHISRLIANGTEAESGLIPVFPSLTFPNHYSIATGLYPAYHGIINNHFTDPLSGEPFYMGNSHDPKWWLGEPLWETVLKNGLKAATYFWPGSEVNKGPWTCPFNFCIRYNASVSFEDRVDAVLGYFDLPSDQIPDFMTLYFEDPDHQGHKVGADDPLITEAVARIDRMVGRLIRGLEERGVFEDVSIIMVGDHGMVGTCDKKLIFLDDLAPWIDVPKDWVVTHTPVLAIRPPSGNDPADVVAKMNEGLSSGKVDNGKFLRVYLKEDLPSRLHYAASDRIAPIIGLIEEGFKVEQKRTKRQECGGSHGYDNAVFSMRTIFIGHGPRFARGRKIPSFENVEIYNLITSILKIKGAPNNGSASFAESVLLSAA

SEQ ID NO: 179428 - protein, 146 aa, Glycine max
  Coding DNA Sequence Number=SeqID_62650
  Gene Ontology: Mol. function=phospholipase A2 activity; Cellular component=vacuole; Biological process=lipid catabolic process
  Homolog annotation: Hit_ID=Q1SMB2; Match level="QueryCoverage=83%, HitCoverage=85%, E-value=2e-47, Identity=64%"; Hit description =Phospholipase A2
  Subcellular localization annotation: CTP_CleavageSite=43; ConfidenceScore=5.09e-01
MVPSQLSKYGLLFISCTFFLINFLTIPISSLNIGVETTGITVSVSKECSRTCESSFCSVPPLLRYGKYCGLLYSGCPGEKPCDGLDACYDYLSQECSQTFINCMQKFKNSRAPTFKGNACQVDDVIEVINVVMEAALLAGRVLHKP

SEQ ID NO: 179429 - protein, 164 aa, Glycine max
  Coding DNA Sequence Number=SeqID_62651
  Gene Ontology: Mol. function=phosphotransferase activity, alcohol group as acceptor; Cellular component=cytoplasm; Biological process =carbohydrate phosphorylation
  Homolog annotation: Hit_ID=Q1SMB1; Match level="QueryCoverage=99%, HitCoverage=25%, E-value=3e-40, Identity=55%"; Hit description =Mevalonate and galactokinase
MALQYANDLVISPTELIEYDREGFEPTTPPSSLQPPSQSPWANKKGNIFLPISASHTLVTPLGKLLLTYDGKLIENEYLGLKNGIMDQSAILLSSHGCLMCMNCKTKDYKLIYQPKVLEYNESGQPKATRILLALSGLKQALTNNPGYNKRVVECREAAQILLE

SEQ ID NO: 179430 - protein, 164 aa, Glycine max
  Coding DNA Sequence Number=SeqID_62652
  Gene Ontology: Mol. function=phosphotransferase activity, alcohol group as acceptor; Cellular component=cytoplasm; Biological process =carbohydrate phosphorylation
  Homolog annotation: Hit_ID=Q1SMB1; Match level="QueryCoverage=80%, HitCoverage=31%, E-value=4e-51, Identity=69%"; Hit description =Mevalonate and galactokinase
MASRCWPSDAELNELRERVSKIGDLNKEEVRVVVSPYRICPLGAHIDHQGGIVSAMTINMGVLLGFAPSGSNQVVIRSGQFEGEVKFRVDEIQKPKDKNLDKDSSELQEQCNWGRYARGAVYALKSSGNILSKVRYNAGGSPFCSSLDYAEFVLYVYQMDSSSI

SEQ ID NO: 179431 - protein, 109 aa, Glycine max
  Coding DNA Sequence Number=SeqID_62653
  Homolog annotation: Hit_ID=Q1RYJ5; Match level="QueryCoverage=99%, HitCoverage=32%, E-value=3e-13, Identity=61%"; Hit description=WD40 -like
MEKMQHTEELVREFLVFHGFTNTLESYEAELRTDIGKGFETLFYASRSPMPSSATTTTKSSTSSRFTTSNCCRGHKIGLTGSEWYQALHLSYRNFFCKVFNATHILHRV

SEQ ID NO: 179432 - protein, 275 aa, Glycine max
  Coding DNA Sequence Number=SeqID_62654
  Gene Ontology: Mol. function=RNA-directed DNA polymerase activity; Biological process=RNA-dependent DNA replication
EGNEPVLSDGSINPFLELEDFEIHGLLLDDTLIPMVVVGILLVAFASKFGRLPNAEKRITKLYKPLAKQARHLKPLYMKAMINGKSISQAFLDIGSFLNVMSFSIVKKDWLHSNFCVPSTLHQVLIFCVDDKVEVMSDDHQPFSKDEASIEAIFYSPCMQPIMDIAAVQEFYEVEVNLMKRIDKDFFESMVGEVQEKGLGRKPPQKIEQTAIKKLIPPLKAWDPLLEVNLGSADDTRLTKINYPEMPGLSRELVEHQLPLKEGFLPLSPNLDTND

SEQ ID NO: 179433 - protein, 188 aa, Glycine max
  Coding DNA Sequence Number=SeqID_62655
MYFPMFEAKQPKSTKALDHHAKDPTLSESLQIKGIRLPIWKLKYYNRQTGVASRPLETCFMESRLLPVWHHSTPSHGLSDHDLTYFLSSIVCRRVNDHVQSHPIAKTPSQPQPSPHLDCILAKKKKCSSIGITINPSLARQTAKHQIETIDLENMEEDTSPDSAPLTFKKITRFTATQKSTIPEPHSA

SEQ ID NO: 179434 - protein, 67 aa, Glycine max
  Coding DNA Sequence Number=SeqID_62656
MGACFSSGNRYDDYWEGSGNGRRIFASDEDRAHWVAEPGIDRKASDFIAKYYATRVTDSQRQYVNTL

SEQ ID NO: 179435 - protein, 104 aa, Glycine max
  Coding DNA Sequence Number=SeqID_62657
  Gene Ontology: Mol. function=RNA-directed DNA polymerase activity; Biological process=RNA-dependent DNA replication
MEETEVDKKIAITFDHPTLEMIKHLKPIYVRAQINGKTLLRVFVDEGAILNIMPLTILKKMTNFTRGATPTLGVLVAKITVGPKTMYHAFFIEDAKPAYSVLLK

SEQ ID NO: 179436 - protein, 249 aa, Glycine max
  Coding DNA Sequence Number=SeqID_62658
MAMNMTEGNKPRLKRRMRWTAVMLSGAGNGTGCCGMSAGCGSEVGMVMGAVSVGDRVGWSSKVSGRGSSVVGIGTTGGGDCRGKEDGEECGRRVGVAGSRRQFSKKCIQLGVEVALSHINFGQGGLKAVIGNERKFEVVWRLLWVVVEGGLAAMEAPFGSREAMEGSHGSSIWRVVWVVVVKGGLAAMEALYGEWCGWCHGRQPWTLNKSTKLLRAAKMVAGFEGPAPPEEEEEKKIALGIRGPSCLLK

SEQ ID NO: 179437 - protein, 56 aa, Glycine max
  Coding DNA Sequence Number=SeqID_62659
MTVDEVDLGQFGKKTMEQPAKKSSSHRTYTIAGVTQANTLVMSTATTTAHPGRLHR

SEQ ID NO: 179438 - protein, 67 aa, Glycine max
  Coding DNA Sequence Number=SeqID_62660
MAVNKMKQKLAMIANMKARGKGEISMSQVAIALDQLSIGYSLLEAWLNDDDFLGVEIYAISLIPKEF

SEQ ID NO: 179439 - protein, 111 aa, Glycine max
  Coding DNA Sequence Number=SeqID_62661
  Gene Ontology: Cellular component=integral to membrane; Biological process=autophagy
  Homolog annotation: Hit_ID=Q9ZUN5; Match level="QueryCoverage=91%, HitCoverage=37%, E-value=1e-40, Identity=70%"; Hit description =Putative senescence-associated protein 5
MGPDLWHHYGCCKPPTACGYNYVNPILWTNPVNPMADSDCYLWNNDQNQLCYNCNACKAGLLGNLRKEWRKANIILIVAVVVLIWVYVIACSAFRNAQTENLFDRYKQGWV

SEQ ID NO: 179440 - protein, 234 aa, Glycine max
  Coding DNA Sequence Number=SeqID_62662
  Gene Ontology: Mol. function=cytidine deaminase activity; Biological process=cytidine metabolic process
  Homolog annotation: Hit_ID=Q1SMB5; Match level="QueryCoverage=89%, HitCoverage=74%, E-value=1e-69, Identity=61%"; Hit description =CMP/dCMP deaminase, zinc-binding
  Pfam annotation: Domain name=dCMP_cyt_deam_1; Domain location=7-94; Score=14.9; E_value=2.1e-05; Accession=PF00383.13; Description =Cytidine and deoxycytidylate deaminas
  Pfam annotation: Domain name=dCMP_cyt_deam_2; Domain location=105 -234; Score=204.8; E_value=2e-58; Accession=PF08211.2; Description =Cytidine and deoxycytidylate deaminas
  Pfam module annotation: Pfam domain module=dCMP_cyt_deam_1::dCMP_cyt _deam_2; Domain location=7-94::105-234
MAESAAVTLPELLPTLVPTAQPLAPSGRILVGVNLEFPGLPLHHSVHAEQFLITNLSLNAEPHLVSLAVSAAPCGHCRQFLQELRAAADVQILVTSEATAEFGPLSDLLPQRFCPHDLLPLEAPLLLEPHHNTLTLTLHHQHLPNYKLKTAALEAANKSHAPYSGSPSGVALLDCHGNVFKGSYMESAAFNPSLGPVQAALVAFVSGGGGDYDQIVGAVLVEKEYAVVKQESTA

SEQ ID NO: 179441 - protein, 160 aa, Glycine max
  Coding DNA Sequence Number=SeqID_62663
MALRNIKQEGYNYSSQVTPSNKLSLLCSKYLNLEQKEICQSWLPSEVWEREIRWWCMVVWSCGAICGSGEEREKEKRKVVRKCFPWWCVMIGGQGGEEKKINKMSLPKITSDDSARWSAAEVTVLIVSTGFLVHSMSESEKWVGVADEVRAKSEKTIKVK

SEQ ID NO: 179442 - protein, 208 aa, Glycine max
  Coding DNA Sequence Number=SeqID_62664
  Gene Ontology: Mol. function=carbon-carbon lyase activity; Cellular component=mitochondrion; Biological process=aromatic compound metabolic process
  Homolog annotation: Hit_ID=Q69NF8; Match level="QueryCoverage=88%, HitCoverage=63%, E-value=5e-53, Identity=51%"; Hit description =Putative 2,4-dihydroxydec-2-ene-1,10-dioic acid aldolase
  Pfam annotation: Domain name=HpcH_HpaI; Domain location=1-176; Score =96.6; E_value=7.3e-26; Accession=PF03328.5; Description=HpcHHpaI aldolase family
MEHGPGGIRDALPCLHALAAANTAAILRVPESTAAWAKKALDLGPQGLMFPMIESPLSAQDAVSYCRFPPTGLRGAAHPIVRASKYGLDDEYLGNYLDELLIMCQVESEEGVANTGAIAAVDGDAENKVLESRNDDVEIGAYLAGFATVYDGARDLRSRGYHMVSGAVDVGLFRSAAVEDVTRFKMGGDGSESDEGEEKEGDEKYWSE

SEQ ID NO: 179443 - protein, 596 aa, Glycine max
  Coding DNA Sequence Number=SeqID_62665
  Gene Ontology: Mol. function=solute:hydrogen antiporter activity; Cellular component=integral to membrane; Biological process =regulation of pH
  Homolog annotation: Hit_ID=Q9ZUN3; Match level="QueryCoverage=91%, HitCoverage=92%, E-value=0.0, Identity=70%"; Hit description =Putative potassium/proton antiporter
  Pfam annotation: Domain name=Na_H_Exchanger; Domain location=168-534; Score=258.6; E_value=1.3e-74; Accession=PF00999.11; Description =Sodiumhydrogen exchanger family
MKLTSPALLSLLILCDLLLCLPSFTFSLLAADADLDTELLLAGDNATALLNASLARSDDGSFANMIDRALEREFPDNEQNEGTDPRGFNNSVAEQQAVLETVARVKPKKNESKEEKSFQFHDVFNLDNENRAEDMPTLIDRKDNVFIISNPKSKYPVLQLDLRLISDLVVVIVSATCGGIAFACAGQPVMTGYLLAGSIIGPGGLSFVSEMVQVETVAQFGVIFLLFALGLEFSTTKLRVVRAVAILGGLLQIFLFMCLCGITASLCGGKSSEGIFVGAFLSMSSTAVVLKFLMERNSVNGLHGQVTIGTLILQDCAVGLLFALIPVLGGTSGVLQGVVSMTKSLVILIAFLAILTILSRTCVPWLLKLMISLSSQTNELYQLASVAFCLLVAWCSDKLGLSLELGSFAAGVMISTTDLGQHTLEQVEPIRNFFAALFLASIGMLIHVHFLWNHVDILLAAVILVIIIKTIVTASVVKGFGYNNKTSLLIRIMVIRLSISTMKCLQVALAPSFMGNLDVLSIKCSIFLEILKLTQTEIVQVTTPLLFKLIPAVVHLGALLRWFPPDSPGEIAFKGDSFRADSAKRIPLMVQGSHDS

SEQ ID NO: 179444 - protein, 267 aa, Glycine max
  Coding DNA Sequence Number=SeqID_62666
  Gene Ontology: Mol. function=nucleic acid binding; Cellular component= nucleus; Biological process=regulation of transcription
  Homolog annotation: Hit_ID=Q0PJI8; Match level="QueryCoverage=99%, HitCoverage=100%, E-value=1e-138, Identity=93%"; Hit description=MYB transcription factor MYB127
  Pfam annotation: Domain name=Myb_DNA-binding; Domain location=96-143; Score=50.4; E_value=5.9e-12; Accession=PF00249.21; Description=Myb -like DNA-binding domain
  Pfam annotation: Domain name=zf-CCHC; Domain location=3-20; Score =18.3; E_value=0.00094; Accession=PF00098.13; Description=Zinc knuckle
  Pfam module annotation: Pfam domain module=Myb_DNA-binding::zf-CCHC; Domain location=96-143::3-20
  Subcellular localization annotation: CTP_CleavageSite=89; ConfidenceScore=5.65e-01
MGRKCSHCGTIGHNSRTCTSLRGATTSFVGLRLFGVQLDSTNCVSIKKSFSMDSLPSSSSSSFSSSRLTIDENSDRTSFGYLSDGLLARAQERKKGVPWTEEEHRIFLVGLEKLGKGDWRGISRNFVTTRTPTQVASHAQKYFLRLATIDKKKRRSSLFDLVGSNKAGSNSVSAHQKDESKCEVKNNDAATLSLLGRITYFQQENKSSEYKQETFDNCSYQSQPGEEHQVAVLNLDLTLAAPKAKTLQEQNKSSPSAPFLLGPISVT

SEQ ID NO: 179445 - protein, 148 aa, Glycine max
  Coding DNA Sequence Number=SeqID_62667
  Gene Ontology: Mol. function=two-component response regulator activity; Cellular component=nucleus; Biological process=two -component signal transduction system (phosphorelay)
  Homolog annotation: Hit_ID=O49397; Match level="QueryCoverage=61%, HitCoverage=16%, E-value=7e-09, Identity=32%"; Hit description=Two -component response regulator ARR10
MIWRHEGKFKLVMAKANMPDIDTLYFLEVALEKDIPVIFIYSGQFDDVSWKALATGLCYFLQEPIRLNDLKYVWQHVYHLKSYSAQKTKIAYFQDMVRHAKGLQSTKMKQVLEANGERNHEDNEGKLKGKRTIDDLTMADSLTTTQCQ

SEQ ID NO: 179446 - protein, 154 aa, Glycine max
  Coding DNA Sequence Number=SeqID_62668
  Subcellular localization annotation: CTP_CleavageSite=68; ConfidenceScore=5.01e-01
MQHKLKVVRTYLDTKKHRSRLKHKENAHNTNLPSLSTSSSLSHKAKFPLPPKESTSGAKEHKRAFDPSVSTPKASFNENHNQNQFFVNNIGIEESNILPVDQNQPAIEYNDLIKKFVEDCDNFDLFENETNPDDVDQYSEMLRTILDGSSSSPW

SEQ ID NO: 179447 - protein, 240 aa, Glycine max
  Coding DNA Sequence Number=SeqID_62669
  Gene Ontology: Mol. function=protein serine/threonine kinase activity; Cellular component=membrane; Biological process=protein amino acid phosphorylation
  Homolog annotation: Hit_ID=Q17U57; Match level="QueryCoverage=83%, HitCoverage=60%, E-value=4e-56, Identity=53%"; Hit description =Receptor protein kinase, putative
  Pfam annotation: Domain name=Pkinase; Domain location=68-238; Score =18.9; E_value=1.1e-09; Accession=PF00069.15; Description=Protein kinase domain
  Pfam annotation: Domain name=Pkinase_Tyr; Domain location=68-238; Score=4.1; E_value=1e-12; Accession=PF07714.7; Description=Protein tyrosine kinase
  Pfam module annotation: Pfam domain module=Pkinase::Pkinase_Tyr; Domain location=68-238::68-238
MAKVKMGHPPERHDAMTKPNTFFHNLIKPFKFSSSKEGQTEENEIQNLAAQEQKIFPYETLVAATNKFHILNKLGEGGFGPVYKGKLNDGREIAVKKLSHRSNQGKTQFVNEAKLLARVQHRNVVNLFGYCTHGSEKLLVYEYVRRESLDKLLFKSQKKEQLDWKRRFDIITGVARGLLYLHEDSHNCIIHRDIKASNILLDEKWVPKIADFGLARLFPEDQTHVNTRVAGTKFEEKFPA

SEQ ID NO: 179448 - protein, 145 aa, Glycine max
  Coding DNA Sequence Number=SeqID_62670
MAKPNPSALSELSVRLTLSSNSLTCAKRENGAKRDVEIRKPFLSLICTELGGSQENGSLLRGLKNVNFREHRAEQGAKFSSFREISEFLRDCEFPRGEGDIPTPFFYLCLLYACLWLDHPFVCAVRDFSIGKCTVSLELDRAGTE

SEQ ID NO: 179449 - protein, 189 aa, Glycine max
  Coding DNA Sequence Number=SeqID_62671
  Homolog annotation: Hit_ID=Q1SKJ3; Match level="QueryCoverage=40%, HitCoverage=7%, E-value=6e-08, Identity=38%"; Hit description=Zinc finger, CCHC-type; Endonuclease/exonuclease/phosphatase
  Subcellular localization annotation: CTP_CleavageSite=27; ConfidenceScore=5.11e-01
MTSAMPSRVSSGGTPTISDSNDRSRKKAKMETTPTENVQPIQSINDTVVSETPMPGAHPIGNTNCVSYEDIFIGVNGADKENDPTDHMDWIFDSDFDEEDSIEEEPVGMDPIEYYDKKILWTIGDTLGRTLKVDANTSRRANEELGDVFVTERTKFARLCIDVDLNKILRSQFELNNKTYSVEYEGLQL

SEQ ID NO: 179450 - protein, 118 aa, Glycine max
  Coding DNA Sequence Number=SeqID_62672
  Homolog annotation: Hit_ID=Q5JKI7; Match level="QueryCoverage=37%, HitCoverage=8%, E-value=3e-15, Identity=82%"; Hit description =Putative GABA-specific permease
MTAVHIIQNATSMSKFLQTLINHIGFCVKGRECNIGGMSVGIVKRLGGIVISSKDMKGESSAFTMIVALSMAEICSSYPTSGGLYYWSAKLAGPRWAPFASWITGCMTKKIIRKMNYK

SEQ ID NO: 179451 - protein, 69 aa, Glycine max
  Coding DNA Sequence Number=SeqID_62673
MAHLVDKDAIKDKHQKFEESPMKVDTDLFQNQVTFVEPVQIMMVDIIEDVNSRHIRTLIAEENANKDLD

SEQ ID NO: 179452 - protein, 121 aa, Glycine max
  Coding DNA Sequence Number=SeqID_62674
  Subcellular localization annotation: CTP_CleavageSite=64; ConfidenceScore=5.61e-01
MAKPSSPANLASAIICFFASKKFPHRLKASPGRFARQNPSPHPSVMVHVHGFFKAVLSFAEVLLADSRFTRPDMGFHPTKLNFVPSDADEAPLDVSICLHAFGIVGCGSFSGVKSCEREGA

SEQ ID NO: 179453 - protein, 161 aa, Glycine max
  Coding DNA Sequence Number=SeqID_62675
MGHEVEKEVESMEDVNPPQETPIKLDQVRQLFKFRKSPRIPSYYSARVLTPACPNQLRTKFLNKQMLIFDGLLTLNLLKLILIYLVTLNRILNPRKKGLKLLLNPIQKLESDLIEASRTLALSINEQIKKKEKAKRDLIAITPKMAKLLVDHTTIQKAHFS

SEQ ID NO: 179454 - protein, 145 aa, Glycine max
  Coding DNA Sequence Number=SeqID_62676
  Gene Ontology: Mol. function=oxidoreductase activity; Cellular component=vacuole; Biological process=response to oxidative stress
  Homolog annotation: Hit_ID=O22443; Match level="QueryCoverage=95%, HitCoverage=39%, E-value=9e-52, Identity=72%"; Hit description=Seed coat peroxidase precursor
  Pfam annotation: Domain name=peroxidase; Domain location=1-108; Score= -58.9; E_value=0.00014; Accession=PF00141.13; Description=Peroxidase
  Subcellular localization annotation: CTP_CleavageSite=16; ConfidenceScore=5.11e-01
MYNYTTCSGHTFGRARCSTFINRLYNFNNTGNPGPTLNTTYLELLRARCPQNATENNLTSLDLTTPDQFDNRYYSNLQQLNGLLQSDQELFSTPGADTIPIVNSFISNQNTFFANFRVSMIKMGNIGVLTGDEGEIRSQCNFVNY

SEQ ID NO: 179455 - protein, 373 aa, Glycine max
  Coding DNA Sequence Number=SeqID_62677
  Gene Ontology: Cellular component=plasma membrane
  Homolog annotation: Hit_ID=Q10QE9; Match level="QueryCoverage=98%, HitCoverage=97%, E-value=1e-101, Identity=53%"; Hit description =Expressed protein
  Pfam annotation: Domain name=DUF677; Domain location=41-367; Score =628.5; E_value=5.6e-186; Accession=PF05055.3; Description=Protein of unknown function (DUF677)
  Pfam annotation: Domain name=DUF793; Domain location=36-367; Score= -225.3; E_value=0.024; Accession=PF05633.2; Description=Protein of unknown function (DUF793)
  Pfam module annotation: Pfam domain module=DUF677::DUF793; Domain location=41-367::36-367
MGSHMSKRIPETSSSIGLSTELHYKTELSSYEAACKLDSDLQFFDTTLQARANQVINTLAVGVEVRALSFDSLKQITECLLEMNQEVVKVILDCKKDIWKSQELFELVEEYFENSLKTLDFCTVLEKCLKRARDSQLLIHVAVQQFEEESGSGDNRYARTLQEFKNFKAAGDPFTEEFFQIFQSVYKHQILMLEKLQLRKNKLDKKLKYIHSWRKVSSMIFVATFAAVLICSVVAAAIAAPPVAAAIAAATSIPIGSMGKWIDSLWRNYENALKGQKEVISSMQAGTYVAIKDLDNIRILIDRLEIEIESLLHNVDFAIEEEAVKVAIEEIKKKLGVFMKNVEDLAVQADMCSRDIRRARTVVLQRIIKHPHN

SEQ ID NO: 179456 - protein, 65 aa, Glycine max
  Coding DNA Sequence Number=SeqID_62678
MSISEMKHAQMEILEKSKPLKAIEDEESGTRTMKSDGAKGCFQRPPENTMYESTGTKVSTNLYST

SEQ ID NO: 179457 - protein, 458 aa, Glycine max
  Coding DNA Sequence Number=SeqID_62679
  Gene Ontology: Mol. function=phospholipase A2 activator activity; Cellular component=cytoplasm; Biological process=ubiquitin cycle
  Homolog annotation: Hit_ID=UPI000051A68D; Match level="QueryCoverage =86%, HitCoverage=49%, E-value=8e-45, Identity=31%"; Hit description =PREDICTED: similar to phospholipase A2, activating protein
  Pfam annotation: Domain name=PFU; Domain location=63-176; Score =227.3; E_value=3.3e-65; Accession=PF09070.1; Description=PFU (PLAA family ubiquitin binding)
  Pfam annotation: Domain name=PUL; Domain location=219-450; Score =93.1; E_value=8.3e-25; Accession=PF08324.1; Description=PUL domain
  Pfam module annotation: Pfam domain module=PFU::PUL; Domain location =63-176::219-450
MENGDIVTACSDGVVRIWTIDQDNVADQLELELYTSQLSEYKSSRKRVGGLKLEELPGLEALKIPGTTDGQTKVVREGDNGVAYGWNMKEQKWDKIGEVVDGPEESNRQFFDGIQYDYVFDVDIGDGMPTRKLPYNRSDNPYDVADKWLLKENLPLSFREQIVQFILQNTGQNNITFDASFRDPFTGSHAYVPGQPSRMSDISAKPTFKHIPKLMPSSYFCCQKGMLVFDAAQFDGILKKITEFNNALQSDQEKQNLSLTELNVSRLGAIVKILKDTSHYHSSKFADSDIALLLNLLRSWPIAMIFPVIDIVRMLVLHPDGAVLLHKHFEAENDILMEVIKKVTVNPTIPANLLTSIRVVTNLFRNLCYYNWLQKHRSEILDAFSSCSSSPNKNLQLSYSTLYSSLFKTLFEALSLSLSFGCVNSKFQIEDTVSLLRCRNAPVLSGFLLLSLPLPHLK

SEQ ID NO: 179458 - protein, 253 aa, Glycine max
  Coding DNA Sequence Number=SeqID_62680
  Gene Ontology: Mol. function=acyltransferase activity; Cellular component=integral to membrane; Biological process=metabolic process
  Homolog annotation: Hit_ID=Q60EI7; Match level="QueryCoverage=69%, HitCoverage=44%, E-value=2e-75, Identity=72%"; Hit description =Putative 1-acylglycerol-3-phosphate acyltransferase
  Pfam annotation: Domain name=Acyltransferase; Domain location=103 -230; Score=48.7; E_value=2e-11; Accession=PF01553.11; Description =Acyltransferase
  Subcellular localization annotation: CTP_CleavageSite=25; ConfidenceScore=5.01e-01
MTLDILQGKDMISSTFSQSPAVLCLHQYKKPGGQSNFFMKSVIAFDIIAYGCSYTRKFLLWSKVSGSSTIENFKGVSYSRRATSFIFGAWLALWPFLFEKINKTKVVFSGDIVPSRERILLIANHRTEVDWMYLWDLALRKGCLGYIKYILKSSLMRLPVFGWAFHILEFIPVKRKWEADESIMRHMLSTFKDPQDPLWLALFPEGTDFTEQKCLRSQKYAAEHKLPVLKNVLLPRTKGFCACLQELRSSLTA

SEQ ID NO: 179459 - protein, 293 aa, Glycine max
  Coding DNA Sequence Number=SeqID_62681
  Gene Ontology: Cellular component=chloroplast; Biological process =pigment biosynthetic process
  Homolog annotation: Hit_ID=Q9XIA4; Match level="QueryCoverage=99%, HitCoverage=52%, E-value=1e-108, Identity=64%"; Hit description =Similar to CCS1
  Pfam annotation: Domain name=ResB; Domain location=1-293; Score=22.9; E_value=8.3e-11; Accession=PF05140.4; Description=ResB-like family
MACTYTTQLPLIKVSRRPKLFHRWSFLHSAEAIRKQEFSESLPRPSIQDVSTILMGAGYEVFLKGPSLYAFQGLAGRLAPVGVHIALLLIMAGGTLSACGSFRGSVTVPQGLNFVVYDVLAPSGFLSSPTDAFNTEIHVNKFYMDYYESGESLQIAIEFCCVFTTFQPEKVSQFHTDLSLRNMDGKETDWSISALQILKDNEGPYNLAMAPLQINGDKQLFGTYLPAGDINSPDVKGISMLARDLQSIVLYDKEGKFAGVTWPNSKLPINIDGSEIVIVDAIGSSGLDLKVPP

SEQ ID NO: 179460 - protein, 104 aa, Glycine max
  Coding DNA Sequence Number=SeqID_62682
  Subcellular localization annotation: CTP_CleavageSite=74; ConfidenceScore=5.10e-01
MSQTHSVLGKKGTNNVADSQRAPGCGGGSGARRCRRGHILAGVLQPRRCEEQQHARLQCSGTKIRSRSRATLPRSAVIAAAPTVMLNHAATSIPVADGSRDARN

SEQ ID NO: 179461 - protein, 182 aa, Glycine max
  Coding DNA Sequence Number=SeqID_62683
  Gene Ontology: Mol. function=catalytic activity; Cellular component =chloroplast; Biological process=cellular metabolic process
  Homolog annotation: Hit_ID=Q8SKU2; Match level="QueryCoverage=99%, HitCoverage=41%, E-value=1e-43, Identity=51%"; Hit description=Tic62 protein precursor
MAVRAKNRDLSYCKIVEVIAETNAPLSPMEELLAKIPSQRPYISSPKEPDIAAVSVPDPSANVVAAEPSVATQKETAQPKPVANQPLSPYTVYDDLKATIISSISAWWWETNKDQYPDLKPPTSPSPNAPTISVSTSAEEGVPEIATVSSNGPAPAQLSIADEPKEEHLPEPKSRPLSPYTM

SEQ ID NO: 179462 - protein, 498 aa, Glycine max
  Coding DNA Sequence Number=SeqID_62684
  Gene Ontology: Mol. function=metal ion binding; Cellular component =ribonucleoprotein complex; Biological process=ubiquitin cycle
  Homolog annotation: Hit_ID=Q84RR2; Match level="QueryCoverage=99%, HitCoverage=75%, E-value=1e-177, Identity=68%"; Hit description =ARIADNE-like protein ARI2
  Pfam annotation: Domain name=IBR; Domain location=243-305; Score =95.0; E_value=2.2e-25; Accession=PF01485.11; Description=IBR domain
MDDYASSDEDYHYDSDQEDSVEAYENDENYALLSSKGPTTKVYDTPFWGYSNFYSSSSSSYVKNPHLLNFLLAMIYVRVCLCDYKGITAGCTGFSEITTHIFLQKEDLRRVMDMLSVREQHARTLLIFHRWDVENLFEVYVDKGKSFLFAEAGVSVDEHRDSDSPVPPDFMCNICMDEVPSSKTTRMDCGHCFCNGCWIEHFIVKINEGQSKRIRCMEHKCNSICDEAVVRTLLSREHSHMAEKYERFLLESYIEDNKRVKWCPSTPHCGNAIRVEDDELCEVECSCGVQFCFSCLSEAHSPCSCLMWELWAKKCRDESETVNWITVHTKPCPKCHKPVEKNGGCNLVSCICGQAFCWLCGGATGREHTWSSIAGHSCGRYKEQEKTAERAKRDLYRYMHYHNRYKAHTDSFKIESKLKETIQGKISISEEKDSTLRDYSWVNNGLSRLFRSRRVLSYSYAFAFYMFGDELFKDEMTDAQREIKQNLFEDQQQQLEAN

SEQ ID NO: 179463 - protein, 574 aa, Glycine max
  Coding DNA Sequence Number=SeqID_62685
  Gene Ontology: Mol. function=catalytic activity; Cellular component =chloroplast; Biological process=cellular metabolic process
  Homolog annotation: Hit_ID=Q8SKU2; Match level="QueryCoverage=72%, HitCoverage=83%, E-value=1e-159, Identity=68%"; Hit description =Tic62 protein precursor
  Pfam annotation: Domain name=3Beta_HSD; Domain location=25-248; Score= -144.4; E_value=0.026; Accession=PF01073.9; Description=3-beta hydroxysteroid dehydrogenaseisomerase family
  Pfam annotation: Domain name=Epimerase; Domain location=24-216; Score= -59.5; E_value=0.03; Accession=PF01370.11; Description=NAD dependent epimerasedehydratase family
  Pfam annotation: Domain name=NAD_binding_4; Domain location=26-194; Score=-105.8; E_value=0.089; Accession=PF07993.2; Description=Male sterility protein
  Pfam annotation: Domain name=NmrA; Domain location=24-253; Score= -71.0; E_value=0.00046; Accession=PF05368.3; Description=NmrA-like family
  Pfam module annotation: Pfam domain module=3Beta_HSD::Epimerase::NAD _binding_4::NmrA; Domain location=25-248::24-216::26-194::24-253
STKSSTGSAEGISEKTDSKDDNLVFVAGATGRVGSRTVRELIKLGFRVRAGVRSAQRAGALVQSVEQLKLDGASGGGQAVEKLEIVECDLEKPETIGSALGDASTVICSIGASEKEVFDITGPFRIDYQATKNLIDAVLVWKRKAEEALLASGLPYTIVRPGGMERPTDAFKETHNITLSTEDTLFGGLVSNLQIAELLAVMAKNRDLSYCKIVEAIAETTAPLTPMEELLAKIPSQRPYISSPKKPDIAAVSVPDPPANVVTVEPKVATQQETAQPKPVAKQPLSPYIVYDDLKPPSSPSPSQPGGGKPTKISETVPKPSASDTPSSVPGVDGISQTTSSSKVEKPLSPYVAYPDLKPPTSPSPNAPTVSVSTPAAAGVPEIDTISSNGPAQLSAADEPKEEHLPEPKSRPLSPYTMNYGRFGNTFNCFGLPQSFLLGRKVLEGGAIRVVLGLFLFSPLDSTPSGTMDVLFVDSGNPWNPKPETISKVMATLKGVHGVLKAGGTFISVTFGQPHFRRPIFNAPDFSWSVEWTTFGETFHYFVYVLKKGQRSSHDDIPPVKRFEARLLIYFMKS

SEQ ID NO: 179464 - protein, 173 aa, Glycine max
  Coding DNA Sequence Number=SeqID_62686
  Gene Ontology: Mol. function=protein binding
  Homolog annotation: Hit_ID=Q9FMK1; Match level="QueryCoverage=78%, HitCoverage=54%, E-value=2e-42, Identity=52%"; Hit description =Arabidopsis thaliana genomic DNA, chromosome 5, P1 clone:MDC12
  Pfam annotation: Domain name=DUF410; Domain location=1-168; Score= -75.5; E_value=0.00082; Accession=PF04190.4; Description=Protein of unknown function (DUF410)
MASETMLLIERVLVRARDDEIIGCFPTVTFCVIDMAKVTHHFVRGNNPKKFASTLCYPGEDDLAIARAVLRYLSSGNLKDANILMEEIKKQTESAEVAFPKTELMQFIAYLLQTLERDALPLFSMLRANFKPSIEREPAFNEMLDDIAERFFGVQRRNPMGMFGDIFKLMGAE

SEQ ID NO: 179465 - protein, 116 aa, Glycine max
  Coding DNA Sequence Number=SeqID_62687
  Gene Ontology: Mol. function=glutamyl-tRNA(Gln) amidotransferase activity; Biological process=regulation of translational fidelity
  Homolog annotation: Hit_ID=Q1RV01; Match level="QueryCoverage=61%, HitCoverage=53%, E-value=4e-15, Identity=59%"; Hit description =Glutamyl-tRNA(Gln) and/or aspartyl-tRNA(Asn) amidotransferase, C subunit, putative
  Subcellular localization annotation: CTP_CleavageSite=57; ConfidenceScore=5.72e-01
MSSKGLLRGASLTANAVWHRSSFFPKVTVSVHRKLVKFRSFSLTTTCSSLLPPDLPRLAKTAQISLTPNEVEEIAPKIQQVIEWFGQLQGVDLESVEPSIRAGSLRTYIITFIIYQ

SEQ ID NO: 179466 - protein, 72 aa, Glycine max
  Coding DNA Sequence Number=SeqID_62688
  Homolog annotation: Hit_ID=Q2XN58; Match level="QueryCoverage=56%, HitCoverage=100%, E-value=5e-15, Identity=97%"; Hit description =Auxin down-regulated protein
MEWSGVKWVLSSRIFHPDFLTCLPNSKLICKMAKEKAQINIVVVGHVDPEEATTINELKKPVVEKEAPGHAI

SEQ ID NO: 179467 - protein, 68 aa, Glycine max
  Coding DNA Sequence Number=SeqID_62689
MSKEESNKVASKDKHGFKINTRLLQQTKPCFKINSRSSLALKQSAFKTFKALIIDYQPIPLKLLRPQG

SEQ ID NO: 179468 - protein, 128 aa, Glycine max
  Coding DNA Sequence Number=SeqID_62690
MALQIGHQIDWAHLVRYHMHKALRVNAPLPYPHLVTLILQHFSIPLANEPFVKVKCSFAIGATAVESFGYRKDLDGQWVRKQDLPTNAPNECIPSPPPRDPSSSLLNDVLSELWDLHAFVGERFDSMD

SEQ ID NO: 179469 - protein, 76 aa, Glycine max
  Coding DNA Sequence Number=SeqID_62691
MVVTIDDNGGGNDNHGGVALVVVVVAATVMKVMAVDNGGGDVNTNATNVKVKAMMRDHGRSTIVGNQFFTFRYSRC

SEQ ID NO: 179470 - protein, 406 aa, Glycine max
  Coding DNA Sequence Number=SeqID_62692
  Gene Ontology: Mol. function=voltage-gated potassium channel activity; Cellular component=membrane; Biological process=potassium ion transport
  Homolog annotation: Hit_ID=Q1RWG4; Match level="QueryCoverage=92%, HitCoverage=47%, E-value=1e-162, Identity=78%"; Hit description =Cation channel family protein, putative
  Pfam annotation: Domain name=IQ; Domain location=316-336; Score=18.1; E_value=0.033; Accession=PF00612.17; Description=IQ calmodulin -binding motif
  Pfam annotation: Domain name=cNMP_binding; Domain location=197-297; Score=37.2; E_value=5.6e-08; Accession=PF00027.19; Description =Cyclic nucleotide-binding domain
  Pfam module annotation: Pfam domain module=IQ::cNMP_binding; Domain location=316-336::197-297
MSTRQLHHTIFECHWQLGGSKEGDDRGSGGGKESRGTLGQGLETSTYTGEVVFSIALAIAGLILFALLIGNMQLASKVLRVITSLFVRAARGDISSDTYLQSLTIRLEEMRVKRRDSEQWMHHRLLPQELRERVRRYDQYKWLATRGVDEESLVQSLPKDLRRDIKRHLCLALVRRVPLFESMDERLLDAICERLKPCLFTESTYIVREGDPVDEMLFIIRGRLESVTTDGGRSGFFNRGFLKEADFCGEELLTWALDPKSGSNLPSSTRTVKALTEVEAFALTAEELKFVASQFRRLHSRQVQHTFRFYSQQWRTWAACFIQAAWRRYSKRKTMELSQKDEPEESEGTRGNASGSSYSLGATFLASRFAANALRGVHRNREAKSARELVKLQKPPEPDFTADDAD

SEQ ID NO: 179471 - protein, 134 aa, Glycine max
  Coding DNA Sequence Number=SeqID_62693
MSENLSIAVVNVSDKFRLSLNCKISINIQAGRRLKMKGQNRTALLVTSNLKSAIDEWIAQKKANHQGRGRVLNAKVPSGHEPRRWSRPQRQRWCGGDQSDLLCLHDERERGFCVSETKLVRAGGEPSGWVLIYL

SEQ ID NO: 179472 - protein, 287 aa, Glycine max
  Coding DNA Sequence Number=SeqID_62694
MTNANCPQESLHSISNGNLRKIDNISARAKGQEDEDNLWTLCSGKRHISFESSLNSHKLKHLYNELGSCDSHNKHKTHRTENGNDSGKVVGNSVQSVDINNELSLQHVKFDQFKRQKSGSGNADGENFSQQEEEENVDGGEMHKKKKKKKQEVESLHDIHSTVKFGVREADGNHVSSRNPTIEKCSSMLDNLVGSLDLHKINQISSLVQLNWVTGLTIDCSGQIGTHMANLLNQTSDSESNWSVTTTTIMAAVVVTTDDNGGGNDNHGGGCNGSHGGGSDVDEGDGG

SEQ ID NO: 179473 - protein, 188 aa, Glycine max
  Coding DNA Sequence Number=SeqID_62695
MEDAPLARTRGLFAPTPEGSLRNWADNAFLVLNGVEGECDDLWVERVVVIELYGDILSKKTTKLRMVEKVQVRMGPKALSHWTLNTTFASLRGRRCNVAQKGMEADLGQSGVWVIGRLRGIGLRDGNFKGVGSSDGLGVGEEIAELQGIGVGRVWVTIGEGAPTPPPEPPSRVGDLGLPDVSPGTFSR

SEQ ID NO: 179474 - protein, 397 aa, Glycine max
  Coding DNA Sequence Number=SeqID_62696
  Gene Ontology: Mol. function=chitin binding; Cellular component =extracellular region; Biological process=chitin metabolic process
  Homolog annotation: Hit_ID=UPI000044A8F0; Match level="QueryCoverage =59%, HitCoverage=99%, E-value=3e-33, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ATRPRLQRTTVLDFRGLHVLASRGLYVFDFRGLHVLDFRGPHVLASRGLYVLAFRGLQVLSFKGLHVLAFRGLYVLAFRGLHVLAFRGLHILNFRGLHVLTFRELCILAFRGLHVVASRGGLHVLAFRGLYVLAFGRLHVLAFRGLHVLAFRGLHVLAFRGLHVLDFRGLHVLDFRGLHVLASRGLYVLTFRGLYVLAFRGLYVLAFRGLHVLASKGLDVLAFRGLHVLAFRGLHVLAFRGLHVLAFRKLKFLGHPPNLGGGPTVRAQPEEEVIAQLLCISGQDFAQTADCAHKTLSGPGEVQQGPGVSSSNYEPLSVLWSARHPNKVIRPSTNRAFIKKYCAPRQAQDEAPQRPGDGQQWATNTPPPPLEPLSSSTKAVALPKTRGRPVGDQVQSQ

SEQ ID NO: 179475 - protein, 158 aa, Glycine max
  Coding DNA Sequence Number=SeqID_62697
  Gene Ontology: Mol. function=catalytic activity; Cellular component =peroxisome; Biological process=metabolic process
  Homolog annotation: Hit_ID=Q5N6Y8; Match level="QueryCoverage=69%, HitCoverage=20%, E-value=8e-35, Identity=63%"; Hit description =Putative 4-coumarate:coenzyme A ligase
MLKIKGYGLTESAVTRTTPEEANQVGATGKLIPNIEAKIVNPETGEAMFPGEQGELWIRGPYVMKGYSGDPKATSATLVDGWLRTGDLCYFDSKGFLYVVDRLKELIKYKGYQIRIRVRVKENGINKTSILMAESRCSGRARRVTPISFRDNDAAVIP

SEQ ID NO: 179476 - protein, 132 aa, Glycine max
  Coding DNA Sequence Number=SeqID_62698
MYPPLFSLNLVDVSSTRTDPQEMYPLLFSVKPKEWDDSKEFSDCVILNSLTREKGDTKEFRRLILCSFGKGRRETQKQFRRLVLGEFFLAKGEENEKMNSTSFQGLENQKTSESFWYKEEEEVQRDSRLVKD

SEQ ID NO: 179477 - protein, 48 aa, Glycine max
  Coding DNA Sequence Number=SeqID_62699
MVNRVRECCEERDELGGAGESSEAPCRHWPAVAVEEDEPFLFFDDSVI

SEQ ID NO: 179478 - protein, 63 aa, Glycine max
  Coding DNA Sequence Number=SeqID_62700
MATSDHIDTIVAAKCGGGQRASAHNGVDMFVGSAFEKPNLYWNMKCNSVLNAVNLCPGYASCV

SEQ ID NO: 179479 - protein, 84 aa, Glycine max
  Coding DNA Sequence Number=SeqID_62701
MFLKALHLVICSPEHKVQDHHRIQTQTTHRESLSLSKIIGRPVRVTMFCENVPTIWDQHRLKGALKPSDSQGLHFEESIRASPS

SEQ ID NO: 179480 - protein, 66 aa, Glycine max
  Coding DNA Sequence Number=SeqID_62702
MEKHSTLKEGKPEASGSKKRKTREEIRSKAYLRGEGNECGNGGACGNKKEKTQNGRRGIFLVSILK

SEQ ID NO: 179481 - protein, 62 aa, Glycine max
  Coding DNA Sequence Number=SeqID_62703
MGAKYLEVVKRGSHPNNGWSLTYCRQAQFLTAITKVDKAKRQSWKLSEIHCGNFSAKREPLS

SEQ ID NO: 179482 - protein, 98 aa, Glycine max
  Coding DNA Sequence Number=SeqID_62704
MGIHENKLVLVTCGGTIGVKAEDEFALAIVDIEAITVEEEGCFEHCDVGDAVDTEGVEHVESFLVDLDVVGVYGRDIGAKSDAQAHPRCSTSCYVREQ

SEQ ID NO: 179483 - protein, 102 aa, Glycine max
  Coding DNA Sequence Number=SeqID_62705
MKRSSIIGRSRTSVAMEVYDSPSVEYLIEGCFPQWCCKVFNAAKELVAEIHRKVDPTTSVMLGKEVFWLCIKPAFDAASEKLSCVIFVNVHNNWSYDESMML

SEQ ID NO: 179484 - protein, 403 aa, Glycine max
  Coding DNA Sequence Number=SeqID_62706
  Homolog annotation: Hit_ID=Q9LI95; Match level="QueryCoverage=60%, HitCoverage=47%, E-value=4e-95, Identity=67%"; Hit description =Arabidopsis thaliana genomic DNA, chromosome 3, P1 clone:MUO22
  Pfam annotation: Domain name=DUF1336; Domain location=158-387; Score =427.8; E_value=1.4e-125; Accession=PF07059.3; Description=Protein of unknown function (DUF1336)
MVGCASNPNRKSNVQKRENKKFRKHASLADMPKKRHSNAGSRVGDYPVGDFINLDFEKGASAKGRKSDVSNMKLCLAQLQHHNHSKKDANGKTHEDAWFDSVSIIESESDDDFISVLGDGFPFVTNNALGSVPNTQLLQHENASCLVDSGCKYDRLCDSYFKADKQKCPAPDFSPYIPIGVDLFACPRKVNHIAQHLELPSVKEHEKVPSLLIVNIQLPTYAASMFPGDADGEGMSLVLYFKLSENFDKDTSPHFQESIKRLVDDEMEIVKGLTRESLVPFSERLKFLVGVVNPEDLQLKSAERKLISAYNGKPVLSRPQHKFFKGPNYFEIDLDIHRFSYISRKALDSLRDRTKNVVLNMGITIQAQKQEELPEHVLCCLRLNKIDFANNGQIPTIVALDDN

SEQ ID NO: 179485 - protein, 160 aa, Glycine max
  Coding DNA Sequence Number=SeqID_62707
  Gene Ontology: Mol. function=hydrolase activity, acting on glycosyl bonds; Cellular component=membrane; Biological process=metabolic process
  Homolog annotation: Hit_ID=Q1WLP5; Match level="QueryCoverage=78%, HitCoverage=23%, E-value=2e-48, Identity=75%"; Hit description =Neutral/alkaline invertase
MDGHMGMRKISSHCSIPDLDDSDLLRLLEKPKLNIERQRSFDERSLSELSIGLARAGLDNYDTYSPGGRSGFNTPASSTRNSFEPHPMVADAWESLRKSLVYFRGQPVGTIAAVDHQSEEVLNYDQVNSSNYTEMSYSNFRGVYNFFEKCNVWKLNGLEL

SEQ ID NO: 179486 - protein, 57 aa, Glycine max
  Coding DNA Sequence Number=SeqID_62708
MEEGGKRSGCNSASNGILGGRSTKLETIVEEKFEGLGARVRSEIDDHARESQFEGGK

SEQ ID NO: 179487 - protein, 88 aa, Glycine max
  Coding DNA Sequence Number=SeqID_62709
  Homolog annotation: Hit_ID=Q5NA00; Match level="QueryCoverage=35%, HitCoverage=5%, E-value=1e-07, Identity=71%"; Hit description =Putative lung alpha/beta hydrolase protein 1
MRAGEPGRGEVGAVENPAFGNHGVVELGSGMVALGRGDSRGCRWWWWWWKNTTNPNPWKKRSKENLDCVVYERCERESLIRDLSATST

SEQ ID NO: 179488 - protein, 489 aa, Glycine max
  Coding DNA Sequence Number=SeqID_62710
  Gene Ontology: Mol. function=transcription factor activity; Cellular component=nucleus; Biological process=regulation of transcription
  Homolog annotation: Hit_ID=Q2R3Q8; Match level="QueryCoverage=78%, HitCoverage=48%, E-value=6e-54, Identity=34%"; Hit description=GRAS family transcription factor containing protein
  Pfam annotation: Domain name=GRAS; Domain location=83-381; Score =270.8; E_value=2.7e-78; Accession=PF03514.5; Description=GRAS family transcription factor
MKGNLLGQYLLEGKLCKDNSFKDDMEDSEEDELLNLSLSVAANRERKKKGKTTIREHHVSMTTTTTTRNSYESYHEGKIFRLLQMREQMLRQDHRRKGVVEDGNGLPLIHLLLSTATSVDDNNMDSSLENLTDLYQTVSVTGDSVQRVVAYFVDGLAARLLTKKSPFYDMLMEEPTTEEEFLAFTDLYRVSPYFQFAHFTANQAILEAFEKEEERNNRALHVIDFDVSYGFQWPSLIQSLSEKATSGNRISLRITGFGKSLKELQETESRLVSFSKGFGSLVFEFQGLLRGSRVINLRKKKNETVAVNLVSYLNTLSCFMKISDTLGFVHSLNPSIVVVVEQEGSRSPRSFLSRFTDSLHYFAAMFDSLDDCLPLESAERLRIEKKLLGKEIKSMLNNDVDGGVDCPKYERMEAWKARMENHGFVATKISSKSMIQAKLLLKMRTHFCPLQFEEEGGGGFRVSERDEGRAISLGWQNRFLLTVSAWQSV

SEQ ID NO: 179489 - protein, 408 aa, Glycine max
  Coding DNA Sequence Number=SeqID_62711
  Gene Ontology: Mol. function=hydrolase activity; Cellular component =integral to membrane; Biological process=medium-chain fatty acid metabolic process
  Homolog annotation: Hit_ID=Q5NA00; Match level="QueryCoverage=79%, HitCoverage=57%, E-value=1e-127, Identity=66%"; Hit description =Putative lung alpha/beta hydrolase protein 1
  Pfam annotation: Domain name=Abhydrolase_1; Domain location=77-302; Score=28.9; E_value=1.8e-05; Accession=PF00561.10; Description =alphabeta hydrolase fold
MAIRLETSSLSTNTIPRLIFRTYVSNHGTVSAGAIHMEDVVSTDESTPIVVVIPGLTSDSSSAYLKHLAYHTAKCGWKVVVSNHRGLGGVSITSDCFYNAGWTEDVRTVVNYLHKENPRAPLFVVGTSIGANILIKYLGEDGENIPVAGAVAVCSPWDLLIGDRFITRRHVQKFYDKALAIGLQGYAKLHQPHFSRLANWEGIEKSISIRDFDHHATRIVGKYETVDTYYRRCSSSTYVQSVSIPLLCISALDDPVCTREAIPWDECRANKNIVLATVKHGGHLAFFEGITASGLWWVRAVNEFLGELRASHFMHVQKKITKPTIPLDSSIDQGPYVNVKEDGMDTDNDGLEMIPEEKVVKQDELETNAKIRGSPGIAQACVHDAAVHMYKNIHTSFLCPAIGGNLHF

SEQ ID NO: 179490 - protein, 146 aa, Glycine max
  Coding DNA Sequence Number=SeqID_62712
  Homolog annotation: Hit_ID=Q53P84; Match level="QueryCoverage=79%, HitCoverage=11%, E-value=2e-21, Identity=40%"; Hit description=FHA domain, putative
  Pfam annotation: Domain name=FHA; Domain location=43-111; Score=62.3; E_value=1.6e-15; Accession=PF00498.16; Description=FHA domain
MAEKKNPEQEEQHRFPVLTVLKNNAILKNIFIVLDEHDEDQTVLIGRHPNCNIVLTHPSVSRFHLRIRSNPSSRTLSLVDLASVQGTWVRGRKLEPGVSVELKEGDTFTVGISTRIYRLSWAPLTQLGVVVPQQHQKEDEQENIIK

SEQ ID NO: 179491 - protein, 63 aa, Glycine max
  Coding DNA Sequence Number=SeqID_62713
  Subcellular localization annotation: CTP_CleavageSite=35; ConfidenceScore=5.47e-01
MRQSQLVKVKSLLPPTTLLFRLILLPKSFLSLPTFAAMATTCKVGSFGVWWLATTVASWVWLS

SEQ ID NO: 179492 - protein, 472 aa, Glycine max
  Coding DNA Sequence Number=SeqID_62714
  Gene Ontology: Mol. function=diacylglycerol kinase activity; Cellular component=intracellular; Biological process=protein kinase C activation
  Homolog annotation: Hit_ID=Q94I34; Match level="QueryCoverage=97%, HitCoverage=80%, E-value=8e-77, Identity=30%"; Hit description =Putative selenium-binding protein-like
  Pfam annotation: Domain name=PPR; Domain location=170-204; Score =28.1; E_value=3.2e-05; Accession=PF01535.11; Description=PPR repeat
  Pfam annotation: Domain name=PPR; Domain location=258-292; Score =46.4; E_value=9.6e-11; Accession=PF01535.11; Description=PPR repeat
  Pfam annotation: Domain name=PPR; Domain location=329-363; Score=2.7; E_value=3.5; Accession=PF01535.11; Description=PPR repeat
  Pfam annotation: Domain name=PPR; Domain location=399-433; Score=0.2; E_value=7.1; Accession=PF01535.11; Description=PPR repeat
  Pfam annotation: Domain name=PPR; Domain location=49-83; Score=13.2; E_value=0.2; Accession=PF01535.11; Description=PPR repeat
  Pfam module annotation: Pfam domain module=PPR::PPR::PPR::PPR::PPR; Domain location=170-204::258-292::329-363::399-433::49-83
MPMPKYSPLGLDTNTLALSRLLGFCSHPHQGSLTYACRVFERIHHPTLCICNTIIKTFLLNGNFYGTFHVFTKILQGGLSPDNYTIPYVLKACAALRDCSLGEMVHGYSSKLGLVFDIFVGNSLMAMHVFDEIPRLSAVSWSVMISGYAKVGDVDSARLFFDEAPEKDRGTWGAMISGYVQNSCFKEGLHLFRLLQLAHVVPDDSIFVSILSAYTYLNRKTVPLSLRLSTSLLDIYAKCRNLELTKRLFNSMPERNIVFWNAMISGLAMHGDGASALKLFSDMEKAGIRPDNIAFIAVFTACRYSGMAHEGLQLLHKMCSVYKIEPKSEQYGCLVDLLTRAGLFEEAMVMMRRITSNSWNGSEETLAWRAFLSACCNHGHAQLAQCAAERLLRLENHSGVYVLLSSLYGASGKHSNSRRVRDMMRNKGVDKAPGCSTVESDGVVNEFIAGEETHSQMEEIHPILEKLHMQLD

SEQ ID NO: 179493 - protein, 1203 aa, Glycine max
  Coding DNA Sequence Number=SeqID_62715
  Homolog annotation: Hit_ID=Q53P84; Match level="QueryCoverage=57%, HitCoverage=55%, E-value=2e-48, Identity=25%"; Hit description=FHA domain, putative
DENLEHTAEQDIPMSEDIVSVCCDEERKIHSEDEALGVPNGTETSCFPTNSCVENIICDCQLSPPYIQSPPCAQPVDELDNTKKIEARLEVEMPGETNLLCTLREYLKHNICLPVVEAVQGTKMQQFQAPHDTFTGQPPSLEMHWSSFQINIDPSSFDEKHAAAVPVIPTESEFGCTHGDIDKVEGILTTAPRSFNSENTCLIVDEDIPDSEFHKMEVVEEVSVDSVPDGEKQDEMHGSSSPTNLDPAFLDEKHVAAVAIIPTESEFGCTYGDNDKVEDILTTGSRTFNSENTCLIVDKDIPDSEFHQMEVVEEISVDSVPDEKHVAAVAVIPTESEFGCTYGDNDKVEDILTTGSRTFNSENTCLIVDKDIPDSEFHQMEVVEEISVDSVPDEEKQDECDEENLNGKSCREEGYSLDEVVEDNGNKCIKNIDPASFDGKGLTAVTVIPTEFEFGCTLGDNERIEDILEMESRTINSENTSLLDEKAIAVTKFQLVNIVEEGGYSLDEVVEDNGNKCIKNIDPASFDGKGLAAVTVIPSESEFGCTLGDNERIEDILEMESRTINSENTSLLDENAIAVTKFQVVNIVEEVAMDSISDGNKCIKNIDPASFDGKGLAAVTVIPSESEFGCTLGDNERIEDILEMESRTINSENTSLLDENAIIAVTKFQVVNIVEEVAMDSISDGEKEDKCGKELESKLPASLNAKSCHEQGKSVAEIAEDTGKKCASSISSTSFQVESPNSSMPREQTPQSLTAVTRCSGGEFLENHVKPTEKSSAFGSIWSRCKPASAPLVQARKSRFMSTAKVGTEVKRSNEKNVVINKLMPKDLSAVFDEEKEAFILNKENLSPNTYHLQFMRKKDKPEEIKHSISQRSPNLSYFSPRIYLDKRISSVSNKVNQTPKVAQEWKSQRKPLQCHINLVHEQDMMELKKNRVEKVASFPSLMNSGGNHKSVTVSAAKSIDDVPICGQISNKCTKTSHTSREQKRSWDMVVDTASLLNKESRKALQLLQGLKGTRLIIPSLVIRELGSMKQKFRIFRTTSEASLALEWIEECLEKTRWWIHIQSSMEEFRLTALTHHASPQTRFIEESWAFPGLNTLKKCASPKVEDHILDSALQYGRKENVGQLVLLSSDVSLKIKSMAKGLLCETVQQFRQSLVNPFSERFMWPKSSPRGLTWSCQDDLVLREKYCGLPSKAGLKLITFHD

SEQ ID NO: 179494 - protein, 188 aa, Glycine max
  Coding DNA Sequence Number=SeqID_62716
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-25, Identity=33%"; Hit description= UPI00006A17C9 related cluster
GLHTLTFKGLHVLTGKGLHALTFIGLHAITFRGLHALASRGLHVLTFKGLHVLTFKGLHVLTFKGLHVLTFKGLHVLTFRGLHVLTFRGGLHVLTFRRLHVFTFKGLHVLTFRGLHVLTLRGLHALTFRGLHVLAFRRLHGFAFRVLHVLNFRGLHVLNFRGLHVLAFSGLHALIIKGDGILSRKGIG

SEQ ID NO: 179495 - protein, 307 aa, Glycine max
  Coding DNA Sequence Number=SeqID_62717
  Gene Ontology: Mol. function=mannose-6-phosphate isomerase activity; Cellular component=cytosol; Biological process=carbohydrate metabolic process
  Homolog annotation: Hit_ID=Q5BMC5; Match level="QueryCoverage=87%, HitCoverage=63%, E-value=1e-101, Identity=69%"; Hit description =Phosphomannose isomerase
  Pfam annotation: Domain name=DnaG_DnaB_bind; Domain location=101-222; Score=-28.5; E_value=0.031; Accession=PF08278.2; Description=DNA primase DnaG DnaB-binding
  Pfam annotation: Domain name=PMI_typeI; Domain location=1-307; Score =192.9; E_value=7.8e-55; Accession=PF01238.11; Description =Phosphomannose isomerase type I
  Pfam module annotation: Pfam domain module=DnaG_DnaB_bind::PMI_typeI; Domain location=101-222::1-307
MELASPNSNHHHENNNDNKLDDEEEDQPYAEFWMGSHVSGPSFIVLDGSEQRVTLKSWLLENPNVLGPKVVEKWGGDLPFLFKVLSVDKALSIQAHPDKNLARTLLKLHPDVYKDGNHKPEMALAGTEFKVLCGLVTLKELKAVLTVPEVVELVGVENVNLVLQITDEDGEEKVKAILQSLFTDVMSESKESVTGAVDKLRNRLHKESQLTDKEQLVLWLEKQYPSDVGVIAAFFLNHVKLAPDEALFLGANEPHAYIYGECIACKATSDNVVRAGLTPKHRDVQTLCSMLTYKQVNDKGQNLNEVP

SEQ ID NO: 179496 - protein, 224 aa, Glycine max
  Coding DNA Sequence Number=SeqID_62718
  Gene Ontology: Mol. function=two-component response regulator activity; Cellular component=nucleus; Biological process=two -component signal transduction system (phosphorelay)
  Homolog annotation: Hit_ID=Q71BZ1; Match level="QueryCoverage=73%, HitCoverage=27%, E-value=3e-31, Identity=41%"; Hit description=Type -B response regulator
  Pfam annotation: Domain name=Myb_DNA-binding; Domain location=91-141; Score=25.8; E_value=0.00015; Accession=PF00249.21; Description=Myb -like DNA-binding domain
MSVDGSTSAVRKAITHGACDYWTKPFSENQFKIMWKHVAMKAWNEKKLQKKDFSEFASSVLDANLKDQKEISSNSKESDVDDCDAQPKKPRIAWKGELHCQFVKAVMHIGLDKAQPKKILEVMNIPGLTKDHVASHLQKYRFDLKKSNEVAVQQNEMQLPNSIQSTEPIDWFNPEGWTSQPDESILESVSVQSQNQQQGGGSLHVLPPPLDGFRIQTDWCNMNF

SEQ ID NO: 179497 - protein, 165 aa, Glycine max
  Coding DNA Sequence Number=SeqID_62719
MNEDPVLHDPLPRVQDHLGAVHLHQHALDLPLHLLHPHKPVVEDLDRDHHLRHRIALAVMLPVEVVIVEIEVVVVGVESMGLKWTVRKGIGVVIVEALDFSAALHDGFRRGGGVGALRGDGCGKVKRDRREDRWVLDVLHLHWTDINNISLDLSKLNLGNKSHTL

SEQ ID NO: 179498 - protein, 105 aa, Glycine max
  Coding DNA Sequence Number=SeqID_62720
  Homolog annotation: Hit_ID=Q1S7C5; Match level="QueryCoverage=33%, HitCoverage=3%, E-value=2e-07, Identity=57%"; Hit description =Integrase, catalytic region
MKTDVETQMKKTMTEITEYLVKEKWKGGISGNCRWVWKKLGKSQLIKNDIFRDEELSSRGITKKKAFMGPEIEFVMQILYESSPITFSELAEELQLLQLEETYFL

SEQ ID NO: 179499 - protein, 72 aa, Glycine max
  Coding DNA Sequence Number=SeqID_62721
  Subcellular localization annotation: CTP_CleavageSite=56; ConfidenceScore=5.57e-01
MAVLSFAKNKFPKFLSLSNTATLSAPVQNQSLITVQHCSQQNTNLKQSLNQSLKIVAKQGMQLKCKTERYTK

SEQ ID NO: 179500 - protein, 84 aa, Glycine max
  Coding DNA Sequence Number=SeqID_62722
MAIAEVLNGQMLEEDEDVVSLLVQSKDNNPKEDAHDSYQLSYPNFVRGPSVVGMRPSFDHFELKGSVSAQSVKFRNIPKGKKGM

SEQ ID NO: 179501 - protein, 86 aa, Glycine max
  Coding DNA Sequence Number=SeqID_62723
MRGREWRDRERNRRGRERNKIGDPRHIYNGKWYNWGACLHGDGRGKNSREGVKHWRDAPDIQSFYFTRFPEEMGEEMWMQFNKWGD

SEQ ID NO: 179502 - protein, 73 aa, Glycine max
  Coding DNA Sequence Number=SeqID_62724
MLHPAATINEGGEAYLNGKSGGDVSTEAANARKMNQQVAEMSSNAHAQEEKKPTGQRRKEEKEAVQGGAGRTH

SEQ ID NO: 179503 - protein, 128 aa, Glycine max
  Coding DNA Sequence Number=SeqID_62725
MEKGKEPIVSHKDLLALVVEDSDTEQESQCYEDLLGMVVEDSLESEHVLPFYLNHSNAPSSSSAAKMVEGSSVASSSSAAKMIEGSSATSSSSASSLVSNEVLLFDLNKFPEEECEDDTKEEKKKLVE

SEQ ID NO: 179504 - protein, 132 aa, Glycine max
  Coding DNA Sequence Number=SeqID_62726
MHPKFPDEDIMALFEEDRDKWVVWFNDASNALGHGIGTMLRGKLDGRCPCHSVIHVQSESTQRFSIHRNQCRVELEHCCLIEASHSPGRVDTFNPKHATCLHAGEEKKRSSSLKNVEEKEEEEKWSRVATEL

SEQ ID NO: 179505 - protein, 186 aa, Glycine max
  Coding DNA Sequence Number=SeqID_62727
  Homolog annotation: Hit_ID=Q49KC7; Match level="QueryCoverage=34%, HitCoverage=19%, E-value=3e-11, Identity=52%"; Hit description =Transposase
MVALKCLDSIEEKRGILLFINTMNNEGVNLDFYLNVVPETKNKNEGPLLNSDANNVQSKSSNSIDLNIVSMSGDGANSQQPISGEGNQSQLLDLNDLPSVEMDFDMSVDKEEDGMDDDTKDASLHGVQQRTLPHCTAFQEGSYNVYGVNLGKPEKHCTRRPKFVEGRGLDWILKEFVRFLFQSGLL

SEQ ID NO: 179506 - protein, 148 aa, Glycine max
  Coding DNA Sequence Number=SeqID_62728
MEETSSKEEDDEESNICLMGDTDSENSEKEQDEDEAFQKNTQGACKYLENIGCRSLWLTDHCAEHKTTKRNDKGSDPRYQLAQASGLLRDSQASCMLRVEGINSPRRVACFYQTTMFKLNTTLISMYGKSLCGLTLNMDDRVARASAI

SEQ ID NO: 179507 - protein, 342 aa, Glycine max
  Coding DNA Sequence Number=SeqID_62729
  Gene Ontology: Mol. function=nucleic acid binding; Cellular component= chromatin; Biological process=DNA integration
  Homolog annotation: Hit_ID=Q1SRN1; Match level="QueryCoverage=94%, HitCoverage=25%, E-value=1e-30, Identity=26%"; Hit description =Integrase, catalytic region
  Pfam annotation: Domain name=zf-CCHC; Domain location=246-263; Score =8.4; E_value=0.041; Accession=PF00098.13; Description=Zinc knuckle
MASASMVFAPQTFSSAISCMLTDDNFLTWMQLAESTIKGHRLKQHIVGDHTIPSQFLTKDEATDSVNPAYENFEQQDNLLKSWLLESMDNQFRVRVVVRIKQLRIQLRNTKKQGSISEYLVQIKQIVETLGAISSPLTDKEHIYAIFYGLPEEYDGLITSCLMRSEPFTVPQIEASLMHQEKRLEHHKQRGTTPIQAHTVHSQTQSRRGLSNPSRGHGPGRSGTRGRGSGGRSTSISSTQGCGPKLQCQLCGRVGHSAFHCWYRFDENLIEPTPHATHSPNDNSTNHSAQAMLATASNQADDSWYPDTSATHHLTHDLGNLMIKNEYNGGNPAGSSSRSSQG

SEQ ID NO: 179508 - protein, 370 aa, Glycine max
  Coding DNA Sequence Number=SeqID_62730
  Gene Ontology: Mol. function=nucleic acid binding; Cellular component= chromatin; Biological process=DNA integration
  Homolog annotation: Hit_ID=Q1T1K8; Match level="QueryCoverage=99%, HitCoverage=20%, E-value=7e-70, Identity=38%"; Hit description =Integrase, catalytic region; Zinc finger, CCHC-type
  Pfam annotation: Domain name=rve; Domain location=1-103; Score=9.5; E_ value=0.00096; Accession=PF00665.16; Description=Integrase core domain
  Pfam module annotation: Pfam domain module=RVT_2::rve; Domain location=281-370::1-103
MVELQFNKKIKALQTDGGKEYLVLTKYLADHGIRHRISCPHTHEQNGAPERKHCHLTETGLTLLAASCLPSKFWAEAFSIATFIINHIPSPVIHYKSPFEVLFHKTPDYSIFKPFGCLCYPYLRPYTKTKLEFQSTSCIFLGYNTKYKGYKCITNSGREYTVRHIIFDETQYPMIANPSFFTPNTIVSPTQPTLPPSIATINPINPPAPTPAVPITPIPDPIPPTSITPVTEHSTPPNPATNTHPMTTRAKSGIFKPKALLTEMTPRCTKDALQNPQWLAAMKAEYMALMQNNTWDLVLLPPHRKAIGSKWIYRLKYNVDGSIARHKARMVAQGFSQRPGLDYNEIFSPVIKPAIIRTVLSIAVTRKWDI

SEQ ID NO: 179509 - protein, 86 aa, Glycine max
  Coding DNA Sequence Number=SeqID_62731
MGAKYLEVVKRGSHPNNGWSPDEIMAQNDHNLSLRVFGRDRAWATRRRMTIICLCVPPDTIASRWRKGVRNDHNLSSPTSRLTVPE

SEQ ID NO: 179510 - protein, 115 aa, Glycine max
  Coding DNA Sequence Number=SeqID_62732
MPESLYTRVRLSLQVEIINEENFEAPEEDEEVRALKTELGKARLAKEKFKLVATDVQKECAGLREENAATARALERETKRARKEEKNAITKRAPRHPYRTRSKSRMMGYQEEIQE

SEQ ID NO: 179511 - protein, 184 aa, Glycine max
  Coding DNA Sequence Number=SeqID_62733
  Gene Ontology: Mol. function=DNA binding; Biological process=DNA integration
  Homolog annotation: Hit_ID=Q1SIT1; Match level="QueryCoverage=60%, HitCoverage=39%, E-value=3e-31, Identity=51%"; Hit description =Integrase, catalytic region
LDDALWAHRTAYKAPIGMSPYQAREERKLQLSELDEIRLEAYENSKFYKEKTKKFHDTLIAKKDFVVGQKVLLYNSRLELMSGKLRSKWIGPFVVTNVFPYGTVEIKSESTDKSFKGTSFVVQVEVTSTWVVVTENKRGYISCGSVLVEGTSTRLFKENKGGYIPCGSLLVKDFTRLKRNLKDR

SEQ ID NO: 179512 - protein, 440 aa, Glycine max
  Coding DNA Sequence Number=SeqID_62734
ELERRKWDEELTSFDEGSIDVAIVKEFYANLYDPKDKSPKQVRVRGHLVKFDEDTLNTFLKTPVIIEEGETLAAYSRFALLRPDPQELAANLCIPGRGFELNVDGQPLKILKKNMTTLGQTWSILSYSNLIPTSYTSDITLNDAKLIYGIIMKMDMNLGYLISHQISIIAQHDSSRLGFPTLIIALCKARGVTSYSRSLESLSPAINLAYIKKNSWNLDDPTVTFRGPRKARGNRSEAPLTSTTPNAPAPSSSIVPDPTTTAFVSSTPATPAHIPTQFLASSAPASNFVFTLEILHSMMQSLHRGQVIIMQSLQSSGLPSIMSTDEFLTQVAWPGVQPSPSGGGRTFAAQESMPGEEPMPDAEDEPVPLEPFIFETDPVAHEEAATQELTSPVHTSPAPIPEDSQPSALASEPEQPTIQDPSAAPVLDLNEHAEDHPQED

SEQ ID NO: 179513 - protein, 36 aa, Glycine max
  Coding DNA Sequence Number=SeqID_62735
MAPTDAEKREELEPKNGMQTERKWALLAPLKWRHVA

SEQ ID NO: 179514 - protein, 165 aa, Glycine max
  Coding DNA Sequence Number=SeqID_62736
DSVVPCSVFEVLLVVVLPILSEALRPIPEEVLPENTSGSTYSGMGVVNFWMWLYDNLNVLVYDAYVLKMDEDQWRYDFAMSQEVHMDYDYDNQEECGVNESHVDCLNAFNTSQVFATRDDVLQWARIVAHENGFVAVIMRSDTETGSRKCGCPFRLRGKPVRGGE

SEQ ID NO: 179515 - protein, 416 aa, Glycine max
  Coding DNA Sequence Number=SeqID_62737
  Gene Ontology: Mol. function=transporter activity; Cellular component= membrane; Biological process=transport
  Homolog annotation: Hit_ID=Q9FGR5; Match level="QueryCoverage=86%, HitCoverage=61%, E-value=1e-87, Identity=47%"; Hit description =Transmembrane transport protein-like
  Pfam annotation: Domain name=Sulfate_transp; Domain location=22-362; Score=-153.8; E_value=0.059; Accession=PF00916.10; Description =Sulfate transporter family
  Pfam annotation: Domain name=Xan_ur_permease; Domain location=1-349; Score=-87.4; E_value=7.5e-05; Accession=PF00860.11; Description =Permease family
  Pfam module annotation: Pfam domain module=Sulfate_transp::Xan_ur _permease; Domain location=22-362::1-349
ALAAVFIEGTIFLLVSAIGLRAKLAKLVPKPVRISSSAGIGFFLAFIGLQNNQGIGLIGYSPSTLVTLGACPSSSRASLSPVLTAANGTVSLLPGGSVSGDILCLKDRMESPTLWLGLVGFVIIAYCLAKNIKGAMIYGIVFVTVVSWFRGTKVTAFPNTDAGNSAHEYLKKVVDVHTIKTTAGALSFKNIGKGYFWEAVVTFLYVDILDTTGTLYSMARFAGFTDEKGDFEGQYFAFMSDATSIVVGSLLGTSPVTAFIESSTGIREGGRTGITALTVAAYFFLAFFFTPLLASIPAWAVGPPLILVGVLMMRSVVEIDWEDMREAIPAFVTLILMPLTYSIAYGLIGGIGTYIVLNLWDWGWEGLGHFGLGKKTTTAAAMASDEDSHHHHGVNGILQNQHSPQNPTAKALQLEP

SEQ ID NO: 179516 - protein, 282 aa, Glycine max
  Coding DNA Sequence Number=SeqID_62738
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q6I8E6; Match level="QueryCoverage=67%, HitCoverage=58%, E-value=1e-102, Identity=100%"; Hit description =Pseudo-atpA
  Pfam annotation: Domain name=ATP-synt_ab; Domain location=46-272; Score=-5.0; E_value=1.8e-07; Accession=PF00006.15; Description=ATP synthase alphabeta family, nucleotide-binding domain
MLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVALRYGLQFLLFFAVFYLISTNINMASVDTFESLVRRLAFYLGNQALSRLLLQRGCSVGLTVAIAVLFGDTPSVGNNMMDPSGSSGSSGGGGSESSWTGALLSSETLSGTGSVNQPAEGMPVPPANPVVEQAGPANPEDTTEIIGGDSIDSIRNRLLQSYGNPSAEQISRA

SEQ ID NO: 179517 - protein, 285 aa, Glycine max
  Coding DNA Sequence Number=SeqID_62739
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=82%, HitCoverage=42%, E-value=3e-78, Identity=51%"; Hit description =Photosystem I P700 chlorophyll a apoprotein A2
  Pfam annotation: Domain name=PsaA_PsaB; Domain location=46-285; Score= -121.7; E_value=0.00017; Accession=PF00223.9; Description=Photosystem I psaApsaB protein
HPSGRGYWQELIESIVWAHNKLKVAPATQPRALSIVQGRAVGVTHYLLGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHK

SEQ ID NO: 179518 - protein, 143 aa, Glycine max
  Coding DNA Sequence Number=SeqID_62740
  Gene Ontology: Mol. function=DNA binding; Cellular component =chromatin; Biological process=DNA integration
  Homolog annotation: Hit_ID=Q1SJY5; Match level="QueryCoverage=58%, HitCoverage=8%, E-value=4e-29, Identity=72%"; Hit description =Integrase, catalytic region
LVAKGYNKEEGIDYDETYALVARLEAIRLLLAFACIMNFRLFQMDVKSAFLNGRIEEEVYVDQPPGFVDHEHPDYVYKLTKALYGGLASHSHERFYTSGANMDGRRALKLGVSLPSASYSFYRPKHDVHAKHDLGLSRGPSLC

SEQ ID NO: 179519 - protein, 191 aa, Glycine max
  Coding DNA Sequence Number=SeqID_62741
  Homolog annotation: Hit_ID=Q6DTM5; Match level="QueryCoverage=40%, HitCoverage=9%, E-value=1e-18, Identity=60%"; Hit description=MSH4
MAYMLRTLLNARNKSAAAECYTRTEKKITELMDDIRENVSVLTLLAEVLCLLDMTVNSFAHMISTKPVDRYTRPEFTENGPLAIDSEQAINHIKRKYELENMEIVNKEKEKVRYDFLADKAIAEIEAKCGQKIEEFKEEQRQQLMRIEDEHTLLYLLEMQYKAIHVSLPSSLSFLDSLLMTWYGILYDYVV

SEQ ID NO: 179520 - protein, 52 aa, Glycine max
  Coding DNA Sequence Number=SeqID_62742
MKYLKRGETTLRERGGLQASRTQQVEKWGIFTETERRVQSKSVAMIGPDPRE

SEQ ID NO: 179521 - protein, 162 aa, Glycine max
  Coding DNA Sequence Number=SeqID_62743
MVIMRLLSSRGGKPNDMWRQIMVIPHLFAIRRRSCPMARRDKLWSFCAFCHPETVSPMTWGDKSWSFCIISPSGDDHVRWNAEINYGHFRLLSSRGGEPNDMRLQIMVIPHLFAIRRRSCPMERNLSMAAEWRGSNDDWRCYFKEKMSQEQAHQHRKPWIRA

SEQ ID NO: 179522 - protein, 89 aa, Glycine max
  Coding DNA Sequence Number=SeqID_62744
MDSYLAHGSKIYPKAHENPRAFSCISGPIFLESSIQCPWGVGLHQLSWDATVFGVCNDNSPLYIKHQDLSGIAHGGQFLSISVIQLWIL

SEQ ID NO: 179523 - protein, 111 aa, Glycine max
  Coding DNA Sequence Number=SeqID_62745
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=9e-14, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MALALKGLHVLAFRGLGLHVLAFRGLHVLAFRGLHALAFRGLHFLAFRGLHVLAFRGLHILTFRGLHVFTFRGLHALAFRGLHVLAFRGLHILAFRGLHICTFRGLKVLCP

SEQ ID NO: 179524 - protein, 115 aa, Glycine max
  Coding DNA Sequence Number=SeqID_62746
MLESFKQQQEMSVLELYIEKDVAGGSMFHSTNSLTSCGNYLSNDETQPPTNMNNLHIDEDDDHDDDVYLVSNSYVKESLDEDDSVDGISDTDNEVPDMIPPVMDICRCSTLPPWI

SEQ ID NO: 179525 - protein, 62 aa, Glycine max
  Coding DNA Sequence Number=SeqID_62747
MDTSKPYTGAMKGTMHKPQVNLGADQKFSPNRFPATRKKGDKPWEFNGLIKRLHCHHSKIVM

SEQ ID NO: 179526 - protein, 208 aa, Glycine max
  Coding DNA Sequence Number=SeqID_62748
  Homolog annotation: Hit_ID=Q2PEZ3; Match level="QueryCoverage=33%, HitCoverage=13%, E-value=4e-26, Identity=84%"; Hit description =Putative importin alpha
  Pfam annotation: Domain name=IBB; Domain location=103-197; Score =66.8; E_value=6.8e-17; Accession=PF01749.10; Description=Importin beta binding domain
MLVATPVRFPFLEDAPLSLVSSSRRRLDCEVIVIEKGRVEIRETKLLASRERAIEPHFCPQFNKHSLSKLPNNKTPKPSSLRCHLKPESKSKSKSNTKSYRPSANARTEVRRNRYKVVVDADEGHRRQEDTMVEIRKNRREESLQKKRCEGLQSQQIPSSLHSTVIEKKRVLGIRTTDKIMIEGSDLDVAGLYGNWQEGMELNLYIFD

SEQ ID NO: 179527 - protein, 59 aa, Glycine max
  Coding DNA Sequence Number=SeqID_62749
  Homolog annotation: Hit_ID=Q1T098; Match level="QueryCoverage=65%, HitCoverage=6%, E-value=1e-10, Identity=79%"; Hit description =Forkhead-associated
MMLFFGLLVKCLPHRTCFLLQNPNVLICTPNFTIGSSRSCNFVLKYQTISANLCKIKHT

SEQ ID NO: 179528 - protein, 159 aa, Glycine max
  Coding DNA Sequence Number=SeqID_62750
MVIPLKFKAPKFDKYVGTACPENHLKRCYRKMGAYAKDEKLLMHFFQESHTGAAVTWYTNLEPSRVHSWKGLMVAFIRQYPYNSDMAPDKMQLQSMCMRGHESFKEYAPKVEGPGNSSSTSNDKERDDHIDRGHITKKTGANGENEIEGGTRAAITVPT

SEQ ID NO: 179529 - protein, 146 aa, Glycine max
  Coding DNA Sequence Number=SeqID_62751
MKKILGLQAPMQLTSLRKLASGHPTFRALIWDRELTSLTLLLLTGFDTMLSELGAWGSMSRGPTSTTKNFQVSITLRTSMPLQAWRSSHREWVWPCEERQGQGFTQAVAENGGILLGRSHIDKLLINDYINITYLGYPLVGPLNEM

SEQ ID NO: 179530 - protein, 89 aa, Glycine max
  Coding DNA Sequence Number=SeqID_62752
MGLCQFYGVPVTSSKGIRPPTNRAFIKKYCVPRQAQGETPQQPGDGQQRATDALPSPLEFTSAHPQKAQDVKEALLGGNLVPFKSLLVI

SEQ ID NO: 179531 - protein, 55 aa, Glycine max
  Coding DNA Sequence Number=SeqID_62753
MDRLSSVMYATAHCSLTCINNHINANLNNSHRLSARYEKNNVKPKKQIEDIKLLA

SEQ ID NO: 179532 - protein, 176 aa, Glycine max
  Coding DNA Sequence Number=SeqID_62754
  Gene Ontology: Mol. function=sugar binding; Cellular component =cellular_component; Biological process=defense response
  Homolog annotation: Hit_ID=Q2XV15; Match level="QueryCoverage=88%, HitCoverage=76%, E-value=2e-54, Identity=71%"; Hit description=Lectin
  Pfam annotation: Domain name=Lectin_legB; Domain location=28-175; Score=52.1; E_value=6.1e-14; Accession=PF00139.10; Description =Legume lectin domain
  Subcellular localization annotation: CTP_CleavageSite=59; ConfidenceScore=5.71e-01
MATSNFSIVLSLSLALFLMLLTKANSTNTVSFTTSKFSPRQQNLILQGDAAISPSGVLRLTKVDSYGVPTSRSLGRALYAAPIQIWDSETGKVASWATSFKFNVFSPDKTADGLAFFLAPVGSKPQYKAGFLGLFNSDSKNMSLQTVAVEFDTYYNHGRFQGPATLRNCPGSGPKT

SEQ ID NO: 179533 - protein, 81 aa, Glycine max
  Coding DNA Sequence Number=SeqID_62755
  Gene Ontology: Cellular component=mitochondrion
  Subcellular localization annotation: CTP_CleavageSite=36; ConfidenceScore=5.17e-01
MDKLLFLGTHIRYHKKDNDIPSTQHRSSKGSRRPTNARKPGSFRKWIPIRRVHNRMDKLTLTRQFGIQFGSLGGIGKDFGM

SEQ ID NO: 179534 - protein, 97 aa, Glycine max
  Coding DNA Sequence Number=SeqID_62756
MRFFIVIHLIIYSQEYRVRDHHRIQTQIAQGERYATDTLRLNPICNVGDQSGSRCFARMLQPYGINIGLNEHSNRVYLPPRPTLQRVSQGLSLLIQV

SEQ ID NO: 179535 - protein, 70 aa, Glycine max
  Coding DNA Sequence Number=SeqID_62757
MVGQFCSDWRHVTAGDWTCPRLGVTYHALHAGALLTDALTSAAAVDRSASGRAQTQTLPGALKVWSPPAP

SEQ ID NO: 179536 - protein, 89 aa, Glycine max
  Coding DNA Sequence Number=SeqID_62758
MLGAPYPRQLPASVTQCLIHCGDHMTILRRFGPPLQWNVVGLDKDIGDKYVSLPWYKFLQEGDFNHGDELSFYYRRVEKIWELIGMIVI

SEQ ID NO: 179537 - protein, 237 aa, Glycine max
  Coding DNA Sequence Number=SeqID_62759
  Gene Ontology: Mol. function=RNA-directed DNA polymerase activity; Cellular component=extracellular region; Biological process=RNA -dependent DNA replication
  Homolog annotation: Hit_ID=Q1STT2; Match level="QueryCoverage=75%, HitCoverage=35%, E-value=4e-25, Identity=34%"; Hit description =Lipocalin
MHQSLIGEVSFQSWCINKRNKLLAQFGQAFHKEGVWSKVGKQDWNFINNPNTTNSKTLKAKYFSNIRYLDAKLRHKPSYASHSIFASHILVKDGILWRIDGSSINIWSQPWVQASTSSYITSSTPLGLEDLKVSPLIKHQQQCWHQVVIRQISNDNDQRNVASHPLLNSEVDDKIIWRLTANGEYNIKSSYHNVMETMMQSYPARALDRRLQEDWARDAREGPRVLMNLRVDFGPIG

SEQ ID NO: 179538 - protein, 92 aa, Glycine max
  Coding DNA Sequence Number=SeqID_62760
  Homolog annotation: Hit_ID=Q1SBC2; Match level="QueryCoverage=64%, HitCoverage=8%, E-value=3e-08, Identity=40%"; Hit description=Zinc finger, RanBP2-type
MFSDLTVLLPSLTQLVVLHSVQQPILELAHPWPEWVQLMKCLLDKGYFCREEGKMLCNAGMGMKDFNVIRTVCLNFGRDHFHLLRFGRDLEL

SEQ ID NO: 179539 - protein, 41 aa, Glycine max
  Coding DNA Sequence Number=SeqID_62761
MQRRWKNTLKLRFLSQNFMGSEKVEKHIKVAIFISKTSWVQ

SEQ ID NO: 179540 - protein, 158 aa, Glycine max
  Coding DNA Sequence Number=SeqID_62762
  Homolog annotation: Hit_ID=Q1T493; Match level="QueryCoverage=70%, HitCoverage=20%, E-value=2e-09, Identity=26%"; Hit description =Nucleic acid-binding, OB-fold, subgroup
MLTSEIHEFRQSLSVPFYSGGMINDKDGSQSQSSQSNVVEKFLQNAQVVSIGEINNLRQDCYCLTVGTVDEIIIDAPWSYDSCPNCTTTFDPLKGGSACRSCHTSVVDTVPRYKLNVKMEHNGDKGNFLLWDATCIKLFGKTAGECRDELIAVGDDIK

SEQ ID NO: 179541 - protein, 395 aa, Glycine max
  Coding DNA Sequence Number=SeqID_62763
  Homolog annotation: Hit_ID=Q6CQF2; Match level="QueryCoverage=18%, HitCoverage=91%, E-value=3e-17, Identity=63%"; Hit description =Kluyveromyces lactis strain NRRL Y-1140 chromosome D of strain NRRL Y- 1140 of Kluyveromyces lactis
SFAPIPKSDERFARQYRCGPPPEFPLASPRSGIVHHLSGPDRYALTRTLHRRSGSVAGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGPGTTGLSPSLAPPSRDLGPSATETLLQTTIRTPRATDFHGGLFPRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGIDNDPSAGSPTETLLRLLLPLNDKVQWTSHNVAGSEPLTSPQSEHFTGPFN

SEQ ID NO: 179542 - protein, 102 aa, Glycine max
  Coding DNA Sequence Number=SeqID_62764
  Subcellular localization annotation: CTP_CleavageSite=62; ConfidenceScore=5.19e-01
MKVRDHHRHQSHGTKIAKPKCVHMTLSLRKTRQQVSGSPCRAQETPSPMAINLSLKDQPESQGSSKPSDMPPSTSIFPHEKLQMSRKFSKNFSSKFAVIDSQ

SEQ ID NO: 179543 - protein, 89 aa, Glycine max
  Coding DNA Sequence Number=SeqID_62765
MQHRYHRLQLNVSIFMITQLEWMWEGMVILIIPTTKQDLCPSLQLFTLKELYRDSIHVELGANQQQQGMAKVKKHPYFAGCEVIVTRPK

SEQ ID NO: 179544 - protein, 49 aa, Glycine max
  Coding DNA Sequence Number=SeqID_62766
  Homolog annotation: Hit_ID=Q8RVH8; Match level="QueryCoverage=62%, HitCoverage=8%, E-value=4e-09, Identity=93%"; Hit description =Aux/IAA protein
MFVSLQTNSNNVLTRCRMFIETCKRLRIMKSSDAIGLAPRAVEKCKSRT

SEQ ID NO: 179545 - protein, 126 aa, Glycine max
  Coding DNA Sequence Number=SeqID_62767
MEACLWGFYGGWTFELQWGPLMVIFHHGDAAEDKGKELGDDASMEEKKERRGEHEIEGIKEGEKWNFENPKAFFINSSPILLEPLAHGSGNWSFPREDCITMFIKCCNHGYKGLEDFGDLQSTITY

SEQ ID NO: 179546 - protein, 232 aa, Glycine max
  Coding DNA Sequence Number=SeqID_62768
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=86%, HitCoverage=8%, E-value=1e-70, Identity=60%"; Hit description=RNase H, putative
MRAYQEETEIVNLGVGEEKKEVKVGTGMTTLVRDELVVLLRNYQDIFAWSYQDMPSLNPDIVQHRLPLNPSCSPVKEKLRRMKPEMSLKIKEEVKKQFDAGFLAAARYLEWVANIVPVPKKDGNIRMCVEYQDLKRASPKDNFPLPHIDVLVDNTSHFALFSFKDRFSGYNQIKMALEDMEKTTFVTLWGTFCYKAMSYGLQTKRDLSSCRKHSREKHWCLPAWTMKSYLRL

SEQ ID NO: 179547 - protein, 493 aa, Glycine max
  Coding DNA Sequence Number=SeqID_62769
  Gene Ontology: Mol. function=RNA-directed DNA polymerase activity; Cellular component=chromatin; Biological process=chromatin assembly or disassembly
  Pfam annotation: Domain name=RnaseH; Domain location=272-390; Score= -33.0; E_value=0.069; Accession=PF00075.14; Description=RNase H
  Pfam module annotation: Pfam domain module=RVT_1::RnaseH; Domain location=12-181::272-390
MLDSGLIQPSHSPFSSPILLVKKKDGTWRCCVDYRALNALTVKDRFPMPTIDELLDDLGHASCFSKLDLRQGFHQIRMADSDIHKTAFRTHQGHYEFRVMPFGLCNAPSTFQAAMNDTLRPFLRKFVAVFFDDILVFNPDLATHVTHLDTVLATLSARKFLLRHSKCEFAKSQLNYLGHVISAQGVAPDPAKIQAMLAWPVPTSPTALRGFLGLTGFYRKFIKGYATVASPLTALLHKDNFQWSQAVDLAFQTLKNLMTQAPVLSTLDFSIPFTLETDASASAIGAVLLQQGHPIAYYIKTLCPRLQHSSAYVRELHAITSAVRKWRHYLLGNSFIILTDHKSLKDLMSQVIQTPEQQNYLVKLLGYDYEIKYKPGSTNIVADALSRISDGVCLSFLVPHLDFLDKLRHTLTQDPQYIELLQAIQSRPTEHPSLSVHKDLIFRHGRIWIPFPNPFTSILLAEFHSSPLGGHTGVAKTVHRVRQNFDWPNLRAD

SEQ ID NO: 179548 - protein, 311 aa, Glycine max
  Coding DNA Sequence Number=SeqID_62770
MVGIGKRSLTVRAFKALIGEENGLWLGWIRPESSMEGEGEYGVGWYGEEEGEGGSGWVATGVMWNKADRLWVCAKRVATTEHPVLGRHRKGEDGVNLGDLGRNGVTLQGVAVPNHHAERFGRGRGKGKEASHPRLDEVMRTVAIHEDDELLMVNRTKQSKGLRGKGGGGVCICDQGTTCHHSGNITLGHGGGQAGELEWSGNCNDGQAVCPPEGGQAPPLGAEKLVAGPEPRGGVRGSDQKRNNSTNFKARDGGGWPGEMVEGEGAVIVASRSKRDSIWDPPPTYPWLPVVCDAPASEKEGRSDQLIENCK

SEQ ID NO: 179549 - protein, 133 aa, Glycine max
  Coding DNA Sequence Number=SeqID_62771
MVKVDVEEFQDVDPIVTEEVPKGPKKLVDRPKPDDDPIYQMTLMIMQLFLKPMQVSWDVTMLGVYNDNIPLYIKHEDLGEIAHGGQCLNIIVIQLWIIYRIYKDVYLGAFLNGDTMINTKVNSRQTLNGFQLK

SEQ ID NO: 179550 - protein, 118 aa, Glycine max
  Coding DNA Sequence Number=SeqID_62772
  Gene Ontology: Mol. function=adenylate cyclase activity; Biological process=cAMP biosynthetic process
MVECAKMSSEPDVQISRRFKSYLEIILERLPAIERTSGGIHSQQSARLLEIVEFIQSQGCSSASDSSSSRVVSPIEGVIEEMQSKIRRLERWLAINTVLWTFLMSALVGYSLYQRKRQ

SEQ ID NO: 179551 - protein, 281 aa, Glycine max
  Coding DNA Sequence Number=SeqID_62773
  Subcellular localization annotation: CTP_CleavageSite=41; ConfidenceScore=5.65e-01
MAESSKKRKGSFFTTTTTGHRRQGTSGNPPAPVPPSLSSLRSSTLFSLDDQRQRYYSQFCNRVILDPKYLDLEFFDEETFDCYQDGILYSEGTLVDDWKFDYSSHDARRIVCNDRHITYWDLILVWAFQTGRQIEWVHLVRYQMHKALRANAPLPYPHLVTLFLHHFNVPLDDEPFLKVKRSFSIGAGAVTSFGYRKDVDGQWVRKHDLPPPIPDERTPSPPPQQGDSTSLLTKVLTELRGLRAFVGERFNAMDTRFDAMDTHFDGIDTRITQLKDDKSFI

SEQ ID NO: 179552 - protein, 65 aa, Glycine max
  Coding DNA Sequence Number=SeqID_62774
MRTLSPMKDKAEDVERMLSPMEDKGEDFESYGNIKARMLSPTKDKGEDIEFYGSIKAWALSPLKA

SEQ ID NO: 179553 - protein, 180 aa, Glycine max
  Coding DNA Sequence Number=SeqID_62775
  Homolog annotation: Hit_ID=Q2HRX8; Match level="QueryCoverage=78%, HitCoverage=19%, E-value=2e-10, Identity=30%"; Hit description=IMP dehydrogenase/GMP reductase
MARTRGIGRAIGRLVGRDRLDDQDAADVPERRRPTALAHRQRVHQMTADARDMTDDVPDVAAEAPEMRADVEGADRAEGSDADDATERFPGGPRDPSVLTSFADHVAHAVWSGQERPDLKLVSHGRKLTLIGRPVPEIEGLVGATGLSPLIDCSVTTGDPRLISAFVERWHGETSTFHLP

SEQ ID NO: 179554 - protein, 41 aa, Glycine max
  Coding DNA Sequence Number=SeqID_62776
VDIVHGTINKEIIAACSYKDAASKDSADEFVMSPAQTGRDT

SEQ ID NO: 179555 - protein, 34 aa, Glycine max
  Coding DNA Sequence Number=SeqID_62777
EGGVADSGAATTEEDQSALQEEDDNHHPQLRLAT

SEQ ID NO: 179556 - protein, 176 aa, Glycine max
  Coding DNA Sequence Number=SeqID_62778
MSQKTPGTLLSQIEVKPKNEEVNVVSTRIGKSMVESKKKEKKLPHKLNDPGSFSVPCVIGNLSFDISLFDLGGAFIDVKERKLTWRLSDKEEVFRVFGTAKSPFSPSSCNFGQTTNKMEVTMAKPHPSVGKKDPPRNKVIPKDLGWNKKKGDAMSIQALGYGLDDCTKGSVKHTIF

SEQ ID NO: 179557 - protein, 57 aa, Glycine max
  Coding DNA Sequence Number=SeqID_62779
MDIERGLNEYGGDQALSVRFVLNAPLGFFVGFLPVKLELVTKRGGALGLSCALIKKQ

SEQ ID NO: 179558 - protein, 62 aa, Glycine max
  Coding DNA Sequence Number=SeqID_62780
MASTMTLKRFRYRTPVVKRDFERNLKVEAIKIVRVEVDEEGRVVTYKNATALLRISIFVELS

SEQ ID NO: 179559 - protein, 114 aa, Glycine max
  Coding DNA Sequence Number=SeqID_62781
  Gene Ontology: Mol. function=nucleic acid binding; Cellular component= nucleus
  Homolog annotation: Hit_ID=Q9SQU4; Match level="QueryCoverage=43%, HitCoverage=12%, E-value=9e-12, Identity=58%"; Hit description=Zinc finger CCCH domain-containing protein ZFN-like 2
  Pfam annotation: Domain name=zf-CCCH; Domain location=46-72; Score =21.4; E_value=0.0019; Accession=PF00642.15; Description=Zinc finger C-x8-C-x5-C-x3-H type (and similar)
MEKYNQSNEGVLGECEVGSILIVENAKPMWQLGMCGVGEESYPQRLNEVDCTYYLRIGLCGFGSHYQFNHPRDHAAVTILLLALKGCWSIKDRRAVSRTSRLAYVLSVVYGSAK

SEQ ID NO: 179560 - protein, 63 aa, Glycine max
  Coding DNA Sequence Number=SeqID_62782
NENVPSIMVEVKRAANGNAPSTTLEVKRNVGEKPPPWMQTGRQDNDDKQGMLDSTFGCTEKMT

SEQ ID NO: 179561 - protein, 99 aa, Glycine max
  Coding DNA Sequence Number=SeqID_62783
  Gene Ontology: Mol. function=nucleic acid binding; Biological process= DNA integration
MVLEDIYEDHQELSHMEGQEHKNEVFKVFEEWKILVETQTGRKVKKLRTDNGLEFCDDRFKTLCKQNGIAIHLTVRGTPQQNGLVERSTKPYFKELGVC

SEQ ID NO: 179562 - protein, 85 aa, Glycine max
  Coding DNA Sequence Number=SeqID_62784
MWMFNCSTAFFFYILASERERANENVPSIMVEVKRAANGNAPSTTLEVKRNVGEKPPPWMQTGRQDNDDKQGMLDSTFGCAEKMT

SEQ ID NO: 179563 - protein, 87 aa, Glycine max
  Coding DNA Sequence Number=SeqID_62785
MDGQYGGDTKVETQGTIEEERYGEIALNCLFQCVLFYGYFRRLNVTALMQSYPARALDRRPQVEWAKDAREGPRVLMSLRVDFGPMG

SEQ ID NO: 179564 - protein, 69 aa, Glycine max
  Coding DNA Sequence Number=SeqID_62786
MFPVIVTRGKGGGTGLGSAGLPGATSCAGLPDTSFHASYKTPPPPSFHLHYEIIEVVYVQMSLTPCCCA

SEQ ID NO: 179565 - protein, 251 aa, Glycine max
  Coding DNA Sequence Number=SeqID_62787
  Homolog annotation: Hit_ID=Q1SM20; Match level="QueryCoverage=33%, HitCoverage=21%, E-value=6e-09, Identity=40%"; Hit description =Nucleic acid-binding, OB-fold
MSRKENIIFELHTKKGTWKIVVRINDMWHVNKHNGRKAIEMVFMDQMGAKIGATFSRELFVEFESRLHCGSAYVIQNIKVVENHSEYKEAEHPEILPGVYVITSFTDIIVEGAPRDTLVVIKCKTINPTYKVIVKLRDNSYDSCANCTTTFDPLKLGSTCRSCHNQVTYTVPSGDEVKVFPPCVDELLRKTWALRFKYSVQIRQSFVLDVTEDEDIIHTIRSTISLQDEPSIEKGKDVVAETSSLDFHPTL

SEQ ID NO: 179566 - protein, 134 aa, Glycine max
  Coding DNA Sequence Number=SeqID_62788
  Gene Ontology: Mol. function=protein binding; Biological process =defense response
  Homolog annotation: Hit_ID=Q109S4; Match level="QueryCoverage=97%, HitCoverage=11%, E-value=4e-09, Identity=25%"; Hit description=NB -ARC domain containing protein, expressed
MAWFSATVSSGVPLVFVNIQTEQIPSTEETHFLKREIATSKQKINNANQIMHGIRLWFLPGLAEILVVLIPQPGEARFGMEIKRTEEGFVYIYSVMRGSPADRAGVREMYEELSANEFLLVISRLQCKSIMPMN

SEQ ID NO: 179567 - protein, 335 aa, Glycine max
  Coding DNA Sequence Number=SeqID_62789
  Homolog annotation: Hit_ID=Q9ZVF7; Match level="QueryCoverage=57%, HitCoverage=35%, E-value=8e-70, Identity=66%"; Hit description =Similar to axi 1 protein from Nicotiana tabacum
  Pfam annotation: Domain name=DUF246; Domain location=229-335; Score= -159.5; E_value=2.3e-05; Accession=PF03138.5; Description=Plant protein family
GDNGEGVAGGTAGEGDQEAGEWGGGAWGDRVIYKAMDAPGPTARPKALDLRVRVNTQSVTQRACREKTQPTRKRCRFSERFLERKREKERKERERELCCGDAETLIPNAPVQPATKQRALDAVAAAVAAPLAEAPPRREVQGRAGVFLFAPLIYISGMLLYMGTASFDVVPVIKHRPAPGSVYRSPQLFAKLRLDMDSDNSSADAACKFPPFRYLQYGSIPIEVVSGNHANGGLNQQRTSVCNAVAVAGYLNATLVFPNFHYHSIWKDPSKFQDIYDEEFFVNTLKNDVRVVDKIPEYLMERFGSNMTNVHNFRIKAWSSIQYYRDVVLPKLLEE

SEQ ID NO: 179568 - protein, 106 aa, Glycine max
  Coding DNA Sequence Number=SeqID_62790
  Pfam annotation: Domain name=zf-CCHC; Domain location=37-54; Score =15.6; E_value=0.0026; Accession=PF00098.13; Description=Zinc knuckle
  Pfam annotation: Domain name=zf-CCHC; Domain location=57-74; Score =0.5; E_value=0.81; Accession=PF00098.13; Description=Zinc knuckle
  Pfam module annotation: Pfam domain module=zf-CCHC::zf-CCHC; Domain location=37-54::57-74
MATTLGDRRPAKDFTQLVGVPASGGGGGAPAIVSTPLRCGKCGRLGHIACECTDREVTFFNCLGKGHLTTSCPYSRKKKRSGSLNNKSGQSRTTGSVFSLNGVDAA

SEQ ID NO: 179569 - protein, 73 aa, Glycine max
  Coding DNA Sequence Number=SeqID_62791
MGTPLSYKLEMRKCGRVRLPSFIVDHIVVPGDMSRGSGDLGDIRRTPGSQQIKGTKTTKQGGLCGDWPTVNLV

SEQ ID NO: 179570 - protein, 36 aa, Glycine max
  Coding DNA Sequence Number=SeqID_62792
MVRRLVEEETVVANWSANQLARAQQSGLNNGGTTMP

SEQ ID NO: 179571 - protein, 296 aa, Glycine max
  Coding DNA Sequence Number=SeqID_62793
  Gene Ontology: Mol. function=ubiquitin-protein ligase activity; Cellular component=SCF ubiquitin ligase complex; Biological process =cell cycle
  Homolog annotation: Hit_ID=Q1SBK0; Match level="QueryCoverage=99%, HitCoverage=56%, E-value=1e-110, Identity=58%"; Hit description =Cullin family
  Pfam annotation: Domain name=Cullin; Domain location=1-243; Score =119.0; E_value=1.3e-32; Accession=PF00888.12; Description=Cullin family
MLCDDKYEDLGRMYNLFCRVTDGRAKIREVMTSHIRESGKQLDTYPERLKDPKSLNSSFEYFINLNPRSPEFISLFVDNKLWKGLKGVSVEITLGKVMMLFWYLHEKDLFEKHENLSRNIAELLYANHPELSNGPTLAVQVLTTGRLSWQTNMGTADLKATFGKGQKHELNVSTYQMCVLMLFNKADRLSYKEIELATEILASYLKRCLQSLDLVKGRNVLRKEPKSKDVGENDAFFVNDELYRIKIGTITAQKESEPEILETRQRVEQDRKSQIEAAIVRIMESRKQLDHNNLMT

SEQ ID NO: 179572 - protein, 134 aa, Glycine max
  Coding DNA Sequence Number=SeqID_62794
MGGAEYNFKGCYGGSVDWHIWFIEVTYQIWKARNEWVFLDIAWSHSNILNEAKVIFLQHKLVDPSLDIIQPKETHRRVLVECDSKLASILRTYSARELVLDSNDEFILANTDCKGVMDKISDPKANFSELGSIV

SEQ ID NO: 179573 - protein, 297 aa, Glycine max
  Coding DNA Sequence Number=SeqID_62795
  Gene Ontology: Mol. function=RNA-directed DNA polymerase activity; Biological process=RNA-dependent DNA replication
  Homolog annotation: Hit_ID=Q1SKJ3; Match level="QueryCoverage=41%, HitCoverage=14%, E-value=6e-14, Identity=35%"; Hit description=Zinc finger, CCHC-type; Endonuclease/exonuclease/phosphatase
NDRRPRRRWLRRVQGRSPSFWDQARWTRLLMNPLGRGWWFKDPLEVGEDANEVGQKRPNKNIPVGTGYNSKNSRAATRNRGVVINDVGLLAMLEPRVSGVRADNIISKAGLNASFKVDVIGFSGGILLMWNKDVYDVKVLESDIQYIHCDVRDNNGASFLFTVVYGSPNMAMRDKLWVSLCRIDASVRGPWLVSGDGSITVDFDEIKMLAVDFFKDLYSKEGPCGCFPQISEVIATRLKSYMSDLVDQCQCSFVPGRHGLDNIVIAQEIFHLMANMKGTKGGWMAIKVDLESLCLTP

SEQ ID NO: 179574 - protein, 248 aa, Glycine max
  Coding DNA Sequence Number=SeqID_62796
  Gene Ontology: Mol. function=RNA-directed DNA polymerase activity; Cellular component=extracellular region; Biological process=RNA -dependent DNA replication
MAQGFLTCFSLTTFSFVAKANIEKMDIILNCLDTFSKTSGENSLWVSKNVNQRVEETLSEISGFSLTSDLERYLGVPLLHRRNKIERYNIILDYTQKRLSDWRAYSLSFSSRVTLVKAVISVLQTYTMQSVLLPIHDDLIPIVSKNLIDTEGNWKVDLLRPFLPNMILDEIMVCFHPSSALGMDKFVWALMSDGRFSTKSAYDLLTCPNVQSDPSLRNCLWKIPGRPRARDLPKNKYRHIRGMAEHND

SEQ ID NO: 179575 - protein, 185 aa, Glycine max
  Coding DNA Sequence Number=SeqID_62797
  Gene Ontology: Mol. function=metalloexopeptidase activity; Biological process=proteolysis
  Homolog annotation: Hit_ID=Q8L780; Match level="QueryCoverage=98%, HitCoverage=38%, E-value=8e-51, Identity=56%"; Hit description=X-Pro dipeptidase-like protein
  Pfam annotation: Domain name=Peptidase_M24; Domain location=2-182; Score=-52.5; E_value=0.00017; Accession=PF00557.14; Description =metallopeptidase family M24
MALFDMGAEYHFYGFDITCSLPVNGKFTSDQSLIYSAVLDAHNVVISAMKPGINWISRKSDSGVTEEGTHFIGSLGSFKKLHICGFWCSDVDDMMAAHWVLLLCHMVWGISLGLERRKEPGLKSLWTIRDLREGMVITVEPGCYFIDALLLPAMNSPETSEFLNQEAINRFKCFGGVRIESDVIT

SEQ ID NO: 179576 - protein, 97 aa, Glycine max
  Coding DNA Sequence Number=SeqID_62798
  Gene Ontology: Mol. function=amino acid transporter activity; Cellular component=membrane; Biological process=amino acid transport
  Homolog annotation: Hit_ID=Q5JKI7; Match level="QueryCoverage=46%, HitCoverage=8%, E-value=1e-10, Identity=77%"; Hit description =Putative GABA-specific permease
MDSATDENMTPPSHVVAITNGDARLLELGNKQELKRHFSLAFTMLVALSMAEICSSIQLLEVSIIGVPNLLALDGHPLLPGLLAGIVKLNSLTHDEN

SEQ ID NO: 179577 - protein, 49 aa, Glycine max
  Coding DNA Sequence Number=SeqID_62799
MSMQDKNRKENRKEKPGALSATPPRSARVDRALSAHVAGLARTSVGSWA

SEQ ID NO: 179578 - protein, 440 aa, Glycine max
  Coding DNA Sequence Number=SeqID_62800
  Gene Ontology: Mol. function=transferase activity, transferring nitrogenous groups; Cellular component=cytoplasm; Biological process= biosynthetic process
  Homolog annotation: Hit_ID=Q1HAW0; Match level="QueryCoverage=99%, HitCoverage=99%, E-value=0.0, Identity=80%"; Hit description=1 -aminocyclopropane-1-carboxylic acid synthase 3c
  Pfam annotation: Domain name=Aminotran_1_2; Domain location=50-430; Score=432.1; E_value=7.3e-127; Accession=PF00155.11; Description =Aminotransferase class I and II
  Pfam annotation: Domain name=Beta_elim_lyase; Domain location=99-344; Score=-130.1; E_value=0.061; Accession=PF01212.11; Description=Beta -eliminating lyase
  Pfam module annotation: Pfam domain module=Aminotran_1_2::Beta_elim _lyase; Domain location=50-430::99-344
MGIKIEQEQPCVELSRVAVSETHGEDSPYFAGWKAYDENPYDELTNSSGVIQMGLAENQVSFDLLEKYLEEHSEASTWGKGAPGFRENALFQDYHGLKSFRTAMASFMEQIRGGRAKFDPDRVVLTAGATAANELLTFILANPGDALLVPTPYYPGFDRDLRWRTGVNIVPIHCDSSNNFQITLQALEAAYKEAEAKNTRVRGVLITNPSNPLGATIQRSVLEELLDFVTRKNIHLVSDEIYSGSVFSSSEFVSVAEILEARQYKNAERVHIVYSLSKDLGLPGFRVGTIYSYNDKVVTTARRMSSFTLISSQTQHLLASMLSDKKFTENYIETNRQRLKKRYQMIIEGLRRVGIECLKGNAGLFCWMNLSPLLEKPTREGELELWNAILHEVKLNISPGSSCHCSEPGWFRVCFANMSEQTLGVALERLRNFMERMKKD

SEQ ID NO: 179579 - protein, 79 aa, Glycine max
  Coding DNA Sequence Number=SeqID_62801
  Gene Ontology: Mol. function=hydrogen ion transporting ATP synthase activity, rotational mechanism; Cellular component=proton -transporting two-sector ATPase complex; Biological process=ATP synthesis coupled proton transport
  Pfam annotation: Domain name=ATP-synt_G; Domain location=8-76; Score=- 13.2; E_value=0.093; Accession=PF04718.5; Description=Mitochondrial ATP synthase g subunit
MASKLQKLQSAACQASQFVSSRGTNYYRQLLEQNKQHIQEPPTVEKCNLLAKQLFYTRLARLGMKSWKVRLQGFNLLCF

SEQ ID NO: 179580 - protein, 760 aa, Glycine max
  Coding DNA Sequence Number=SeqID_62802
  Gene Ontology: Mol. function=metalloendopeptidase activity; Cellular component=periplasmic space; Biological process=proteolysis
  Homolog annotation: Hit_ID=Q5JKR1; Match level="QueryCoverage=99%, HitCoverage=75%, E-value=0.0, Identity=71%"; Hit description =Chloroplast processing enzyme-like protein
  Pfam annotation: Domain name=Peptidase_M16; Domain location=50-199; Score=70.3; E_value=6.3e-18; Accession=PF00675.10; Description =Insulinase (Peptidase family M16)
  Pfam annotation: Domain name=Peptidase_M16_C; Domain location=209 -392; Score=47.9; E_value=3.4e-11; Accession=PF05193.11; Description =Peptidase M16 inactive domain
  Pfam module annotation: Pfam domain module=Peptidase_M16::Peptidase _M16_C; Domain location=50-199::209-392
MELLPASAPPISKKQGFRSLKLVNADMDQLLSDQPVGVDYGTLDNGLRYYVRCNSKPRMRAALALAVWAGSVLEEEDERGVAHIVEHLAFSATKKYTNHDIIKFLESIGAEFGACQNAVTSADDTVYELLVPVDKPELLSQAISVLAEFSSEIRVSKDDLEKERGAVMEEYRGSRNATGRLQDAHWMLMMEGSKYAERLPIGLERVIRTVSSETVKHFYKKWYHLCNMAVIAVGDFSDAQDVVELIKTHFGQKIPDPDPPLIPTIQVPSHDEPRFSCFVESEAAGSAVMISYKMPADELKTVKDYRNLLAESMFLYALNQRFFKIARRNDPPYFSCSAAADVLVRPLKANIMTSSCKRKGTIEALESMLIEVARARLHGFSEREISVVRALLMSEIESAYLERDQIQSTSLRDEYLQHFLHNEPVVGIEYEAQLQKTLLPHISTLEISKCSEKLRTSCSCVIKTIEPQPFAVLDDLKNVVKKVNLLEEEGRISPWDDEHVPEEIVTTKPNMGHVVQELEYSNIGATELILSNGMRICYKRTDFLDDQVIFTGYSYGGLSELPENEYFSCSMGPTIAGEIGVFGYRPSVLMDMLAGKRAEVGTKIGAYMRTFYGDCSPSDLETALQLVYQLFTTNLTPGEEDVKIVMQMAEEAVSAQDRDPYTAFTNRVKELNYGNSYFFRPIRKSDLQKVDPRKACEFFSTCFKDPSTFTIVIVGNIDPTIAMPLILQYLGGIPKPPEPIMHFNRDELKGLPFTFPTSIH

SEQ ID NO: 179581 - protein, 98 aa, Glycine max
  Coding DNA Sequence Number=SeqID_62803
  Subcellular localization annotation: CTP_CleavageSite=56; ConfidenceScore=5.01e-01
MAQRQPMKACNDNGDYGVLSWLHTWTVSQSLVMTMGTIHPLDCGSAKPQRNRNKMRPNSVTKLPNKFCRRRRSTTGRLPKMAHDYEIGDSGFAGEKHF

SEQ ID NO: 179582 - protein, 93 aa, Glycine max
  Coding DNA Sequence Number=SeqID_62804
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1EP47; Match level="QueryCoverage=65%, HitCoverage=50%, E-value=4e-24, Identity=80%"; Hit description =Mitochondrial ATP synthase g subunit family protein
  Pfam annotation: Domain name=ATP-synt_G; Domain location=4-93; Score =58.6; E_value=2.1e-14; Accession=PF04718.5; Description =Mitochondrial ATP synthase g subunit
MPQQHAACSFYVEAHFCLVFLAATYNSRIFCSIPGRNESFWKELDYVKNLWKNRKELKVEDAGIAALFGLECFAWYCGGEIVGRGFTFTGYYV

SEQ ID NO: 179583 - protein, 100 aa, Glycine max
  Coding DNA Sequence Number=SeqID_62805
  Gene Ontology: Mol. function=nucleic acid binding
  Homolog annotation: Hit_ID=Q1SDY9; Match level="QueryCoverage=78%, HitCoverage=14%, E-value=1e-23, Identity=62%"; Hit description =Peptidase S8 and S53, subtilisin, kexin, sedolisin; Zinc finger, CCHC- type
MASSSGSFPPSPMFAGEHYDLWKIVKNGSNPAPLPDNPTAMQIRFHIDEVVEEGRALVIIQTALHDNVFIKIVSLETTKEAWDKLNEKFQGSERTRRIRC

SEQ ID NO: 179584 - protein, 377 aa, Glycine max
  Coding DNA Sequence Number=SeqID_62806
  Gene Ontology: Mol. function=amidase activity
  Homolog annotation: Hit_ID=Q1RW31; Match level="QueryCoverage=60%, HitCoverage=34%, E-value=4e-38, Identity=42%"; Hit description =Amidase
  Pfam annotation: Domain name=Amidase; Domain location=2-377; Score= -45.2; E_value=9.4e-10; Accession=PF01425.11; Description=Amidase
MSIIELNQFVSECGFEDRGVSLLLNVAEIRVERGEPIYVLDGVPISVKDEINCLPYPTTGSDDAYCVKRLRLFGAIIVRKTNMHELGSRTSGINSHDGPTRNPYDTNKIAGGSSSGSASLVSVGLCPIALGVDWGGSVTMSAALCGVVGLNNETLMIWVPTNPRGAERLPPRIVIWREKGSSIDNVKSFTQSSNHNPSYMDLTFKPKYLVTFTVGYEQKKNIVVAVKKAKINLPRLSLTKSISDIKLAKYRKLKKSREVADAIVKNNQDLVLRYKAVINDGLKLDLGHTLSLEKTRENHNANDFLRSDFSNSNHAVQSLEHVTIVMEQMLRLLHTCALPLEDVDFINYDGKTMNKLLLEVSVFDLVVQGGDSVWEGL

SEQ ID NO: 179585 - protein, 118 aa, Glycine max
  Coding DNA Sequence Number=SeqID_62807
MSQFSHFCQIGDHDVKIQPCPHITILTPSSHSLNDFSLKPSHSEEDPRLTMCNLNLENSTVSKRYFYSMRRTRQRAKVDGVRLDVNGVKLVEDALDEGVCLRSRRCRCENTAGTPCFV

SEQ ID NO: 179586 - protein, 272 aa, Glycine max
  Coding DNA Sequence Number=SeqID_62808
  Gene Ontology: Mol. function=DNA binding; Cellular component=nucleus; Biological process=regulation of transcription
  Homolog annotation: Hit_ID=Q09GS3; Match level="QueryCoverage=75%, HitCoverage=98%, E-value=2e-37, Identity=42%"; Hit description =Transcription factor MYBJ6
  Pfam annotation: Domain name=Myb_DNA-binding; Domain location=108 -154; Score=16.7; E_value=0.085; Accession=PF00249.21; Description =Myb-like DNA-binding domain
  Subcellular localization annotation: CTP_CleavageSite=63; ConfidenceScore=5.37e-01
TGGIGSWAGLIPSSLFAMSVQNATCSVGPSLSVPALPHFHVEQRTELSKTKSQRKLKELNQTNVMGRAPCCDKANVKRGRWSREEDETLKKLSQQTCHATKSRPHIKHGDFTRQEDQLICTLYATIGTMHVSLIAAQLPGRTDNDGKNHWNTKLNKTFLAANTNAIASTVFSTSTSQPQLEDYSVFDDHENSAEYLVLGLEQTPLPLGSDVFGLGSSCSVRLSNEAVSASLVKKENENETQWFAEDESFLLDFVYEDNGFVSQENSSEVPPL

SEQ ID NO: 179587 - protein, 309 aa, Glycine max
  Coding DNA Sequence Number=SeqID_62809
  Gene Ontology: Mol. function=ribonuclease H activity; Biological process=RNA-dependent DNA replication
  Homolog annotation: Hit_ID=Q1S4N4; Match level="QueryCoverage=58%, HitCoverage=51%, E-value=8e-28, Identity=36%"; Hit description =Ribonuclease H
MDINFTLLHSMNQCITFSLKKANAIWAGSTIYASPIPTVPELLWDHLVHISTQVTSPWVVMGDLNEITHPLEVRGRVFHQMGENHFYGTLTQFGLIDLEMIGGGLLGGGTFRGGGYIDKKLDRTYRFPKGCSYPWSSIMKALSALRSGFSIQIGDGSSSPWFEPWLYGDTLYNGVEDIHDRNFHLRVYDVYLDGEWHLDVLTTSILDDILDKLPILFLEYTMSDTITWSHSSFGEYDTKSAYVWLNRELAGHFTSAEYWSWLWKTKLLENIKHFLWPTYKGSLLTNFFRFTQHISFDSSCFRCGAATKT

SEQ ID NO: 179588 - protein, 122 aa, Glycine max
  Coding DNA Sequence Number=SeqID_62810
MIKNEDEINRTWKSGGCQVARHNPGVQNANKRVARCTYTIWCESRYATEYAEFNIKYRVKINNPGKGKKKTRVCNHSLIFSVYLVHTDFSVKEYLYPLPRPGEEKNTCVTQGEDPWIIILGY

SEQ ID NO: 179589 - protein, 826 aa, Glycine max
  Coding DNA Sequence Number=SeqID_62811
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=99%, HitCoverage=93%, E-value=0.0, Identity=48%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=69-181; Score =148.2; E_value=2.2e-41; Accession=PF01453.15; Description=D-mannose binding lectin
  Pfam annotation: Domain name=PAN_2; Domain location=347-416; Score =101.6; E_value=2.3e-27; Accession=PF08276.2; Description=PAN-like domain
  Pfam annotation: Domain name=Pkinase; Domain location=509-780; Score =160.4; E_value=4.8e-45; Accession=PF00069.15; Description=Protein kinase domain
  Pfam annotation: Domain name=Pkinase_Tyr; Domain location=509-780; Score=146.2; E_value=8.8e-41; Accession=PF07714.7; Description =Protein tyrosine kinase
  Pfam annotation: Domain name=S_locus_glycop; Domain location=195-329; Score=128.9; E_value=1.4e-35; Accession=PF00954.11; Description=S -locus glycoprotein family
  Pfam module annotation: Pfam domain module=B_lectin::PAN _2::Pkinase::Pkinase_Tyr::S_locus_glycop; Domain location=69-181::347- 416::509-780::509-780::195-329
MEIFSVVIFIVSYMLVPSLKISAATLDVSQYVTDGETLVSNSGVFELGFFSPGKSTKRYLGIWYKNITSDRAVWVANRENPINDSSGILTFSTTGNLELRQNDSVVWSTNYKKQAQNPVAELLDTGNFVVRNEGDTDPETYSWQSFDYPSDTLLPGMKLGWDLRTGLERKLTSWKSPDDPSAGDFSWGLMLHNYPEFYLMIGTHKYYRTGPWNGLHFSGSSNRTLNPLYEFKYVTTNDLIYASNKVEMFYSFSLKNSSIVMIVNINETLSQIQTQVWSEDGQIWVIYETTPGDYCDVYAVCGPNANCRITEPPVCQCLKGFKPKPPQEWIPSMDWSQGCVRPKPLSCEEIDYMDHFVKYVGLKVPDTTYTWLDENINLEECRIKCFNNCSCMAFSNSDIRGGGSGCVLWFGDLIDIRQYPTGEQDLYIRMPAMESINQQEHGHNSVKIIIATTIAGISGILSFCIFVIYRVRRSIADKFKTKENIERQLKDLDLPLFDLLTITTATYNFSSNSKIGHGAFGPVYKGKLADGQEIAVKRLSSSSGQGITEFVTEVKLIAKLQHRNLVKLLGFCIKRQEKILVYEYMVNGSLDSFIFDKIKGKFLDWPRRFHIIFGIARGLLYLHQDSRLRIIHRDLKASNVLLDEKLNPKISDFGMARAFGGDQTEGNTNRVVGTYGYMAPEYAVDGLFSIKSDVFSFGIMLLEIICGNKNRALCHGNQTLNLVGYAWTLWKEQNVLLLIDSSIKDSCVIPEVLRCIHVSLLCVQQYPEDRPSMTFVIQMLGSETELMEPKEPGFFPRRISDEGNLSTIPNHMSSNEELTITSLNGR

SEQ ID NO: 179590 - protein, 358 aa, Glycine max
  Coding DNA Sequence Number=SeqID_62812
  Gene Ontology: Mol. function=RNA-directed DNA polymerase activity; Cellular component=chromatin; Biological process=chromatin assembly or disassembly
MAEATRSKTSMERWEDAFAKLSVSMTSKFDELLSRMNQLETSHANSHAPPSFVAASTAATSNAAYRLKLEVPRFDGSDPEGWIFKVAQFFEYHAMPEHDHLTIASFYMEGPTLAWFQWMYRSDQLSLWSSFLHAIHARFSSSAYEDPTGVLCKLTQRSTAVSFARLHEEKLLDSRRQGSKPPSSSTLGMNTTRPSPPLNGPLQESSLLPSASRPRSASIPFKRLTPAELALRREQGLCFNCDEKYSRGHKCASSLFLFVIGEDDDNRQGAPETLRLTSLIHDHRVQILIDGGIGNGGELQCNQVCTNISVKIQKHEFQVDFHVLPIRGADVVLGVQWLKALGPVLTDYTALTMKFIYN

SEQ ID NO: 179591 - protein, 148 aa, Glycine max
  Coding DNA Sequence Number=SeqID_62813
MQSQIQSQELAQPLEAEVSYSATRVSTKESCVNPSGHDPKMGDSDKCELYVNGSPPRLIALGRVYEGSMTAHNVPLGDDQVKVSWDSSVFGDYNDNFPLYIKHEEFFEKAHNGQCLSIFVTQLGIIAHWQMVSFWLRTMLSSVLFLAE

SEQ ID NO: 179592 - protein, 399 aa, Glycine max
  Coding DNA Sequence Number=SeqID_62814
  Gene Ontology: Mol. function=binding; Cellular component=membrane; Biological process=photosynthesis
  Homolog annotation: Hit_ID=Q337M8; Match level="QueryCoverage=60%, HitCoverage=51%, E-value=7e-65, Identity=59%"; Hit description =Tetratricopeptide repeat, putative, expressed
  Pfam annotation: Domain name=TPR_1; Domain location=303-336; Score =23.3; E_value=0.00087; Accession=PF00515.18; Description =Tetratricopeptide repeat
  Pfam annotation: Domain name=TPR_1; Domain location=337-370; Score =39.0; E_value=1.6e-08; Accession=PF00515.18; Description =Tetratricopeptide repeat
  Pfam annotation: Domain name=TPR_2; Domain location=265-298; Score =5.5; E_value=7.5; Accession=PF07719.7; Description=Tetratricopeptide repeat
  Pfam annotation: Domain name=TPR_2; Domain location=303-336; Score =27.1; E_value=6.4e-05; Accession=PF07719.7; Description =Tetratricopeptide repeat
  Pfam annotation: Domain name=TPR_2; Domain location=337-370; Score =34.5; E_value=3.8e-07; Accession=PF07719.7; Description =Tetratricopeptide repeat
  Pfam module annotation: Pfam domain module=TPR_1::TPR_1::TPR_2::TPR _2::TPR_2; Domain location=303-336::337-370::265-298::303-336::337-370
  Subcellular localization annotation: CTP_CleavageSite=42; ConfidenceScore=5.87e-01
MGGSVFTHFLVLPSSSTPSLSTLFPSKFPTRPINESFPFTLTCNQFPSKLTTSRPSQFSAPPSYSCSVKKIKASGSQQTGSIRHGDNLDAMNSRSLLQLTFKLLNESTIHDTSWIANQLERPVGLGRERSSKWVSAFLFGQTISVISPDVSCASSSARINEIYEVGELFDLSIQLIYLILLLGLLGSGTFFVIRQVLVRRELDLSAKELQTYEVFSLVWYHNRAYTQAQLDKPVGTSCFMILCQFVLTHFLPLSQEQVRSGDAGATELFELGAVMLRRKFYPAATKFLLQAIEKWDGDNPDLAQVYNALGVSYVRDGKVDKGIAQFETAVKLQPGYVTAWNNLGDAFESKKDYKSALKAFEEVLLFDPNNKVARPRRDSLKGLVDATKGVTVIKSTEKK

SEQ ID NO: 179593 - protein, 493 aa, Glycine max
  Coding DNA Sequence Number=SeqID_62815
  Gene Ontology: Mol. function=acyltransferase activity; Cellular component=chloroplast stroma; Biological process=metabolic process
  Homolog annotation: Hit_ID=Q9SQI8; Match level="QueryCoverage=97%, HitCoverage=93%, E-value=1e-114, Identity=50%"; Hit description =Dihydrolipoamide S-acetyltransferase
  Pfam annotation: Domain name=2-oxoacid_dh; Domain location=243-493; Score=253.6; E_value=4.1e-73; Accession=PF00198.13; Description=2 -oxoacid dehydrogenases acyltransferase (catalytic domain)
  Pfam annotation: Domain name=Biotin_lipoyl; Domain location=39-112; Score=70.3; E_value=6.1e-18; Accession=PF00364.12; Description =Biotin-requiring enzyme
  Pfam module annotation: Pfam domain module=2-oxoacid_dh::Biotin _lipoyl; Domain location=243-493::39-112
  Subcellular localization annotation: CTP_CleavageSite=35; ConfidenceScore=5.53e-01
MAQLLHTPFIPSSSSALRRAATIPHRKTTSRLVVRAKIREIFMPALSSTMTEGKIVSWTKSEGDKLSKGDSVVVVESDKADMDVETFYDGYLAAIVVEEGGVAAVGSPIAFLAETEDEIPQAKSKASSSSSSSSAPAPAPAPAPAPAQAPPVESQPEKVAAPVAAAVSAPVIASSHPASEGGKRTVASPYAKKLAKELKENFFKSWRGEVGFNLYDKFNLFCLLIFFSPAAPAPGKSAAPAGMELGSVVPFTTMQSAVSRNMLESLAVPTFRVGYTITTDALDALYKKIKSKGVTMTALLAKATALALVKHPVMNSSCRDGNSFTYNSSINIAVAVAIDGGLITPVLQGADKIDVYSLSRKWKELVDKARAKQLQPHEYNTGIASILTPAGSKLVREPKNTEFRTFRSTFTLSNLGMFGVDRFDAILPPGTGAIMAVGASEPTVVATKDGRIGMKNQMQVNVTADHRVIYGADLASFLQTLTQIIEDPKDLTF

SEQ ID NO: 179594 - protein, 117 aa, Glycine max
  Coding DNA Sequence Number=SeqID_62816
  Homolog annotation: Hit_ID=Q2XP03; Match level="QueryCoverage=47%, HitCoverage=27%, E-value=2e-16, Identity=59%"; Hit description =SF21D2 splice variant protein
MSPFHVEALHMTSKLDRQLSALVEVQACGSMVTEEQPHAIPLSPSCISPELYSPESIANTVSKHNADTMQCYTLFYTGPRVRHPNLVPLLGFYTGPRGEKLLLHPFYRHGSLTQFIR

SEQ ID NO: 179595 - protein, 47 aa, Glycine max
  Coding DNA Sequence Number=SeqID_62817
MESVEFGDMGIKEETLIKKQIVFELTLLARTIAAEHRIVWAEPDCNF

SEQ ID NO: 179596 - protein, 370 aa, Glycine max
  Coding DNA Sequence Number=SeqID_62818
  Gene Ontology: Mol. function=O-methyltransferase activity; Cellular component=cellular_component; Biological process=lignin biosynthetic process
  Homolog annotation: Hit_ID=Q96424; Match level="QueryCoverage=99%, HitCoverage=100%, E-value=1e-175, Identity=83%"; Hit description=O -methyltransferase
  Pfam annotation: Domain name=Dimerisation; Domain location=38-90; Score=87.0; E_value=5.6e-23; Accession=PF08100.2; Description =Dimerisation domain
  Pfam annotation: Domain name=Methyltransf_11; Domain location=211 -302; Score=1.5; E_value=0.039; Accession=PF08241.2; Description =Methyltransferase domain
  Pfam annotation: Domain name=Methyltransf_12; Domain location=211 -300; Score=15.5; E_value=0.019; Accession=PF08242.2; Description =Methyltransferase domain
  Pfam annotation: Domain name=Methyltransf_2; Domain location=104-346; Score=371.5; E_value=1.3e-108; Accession=PF00891.8; Description=O -methyltransferase
  Pfam module annotation: Pfam domain module=Dimerisation::Methyltransf_ 11::Methyltransf_12::Methyltransf_2; Domain location=38-90::211 -302::211-300::104-346
MGDSNVTKNHLFATSPQQTEDDACLSAMLLCTNLVYPAVLNAAIELNLFEIIAKATPAGTFISSHEIASKLPTQHPDLPNRLDRMLRLLASYSVLTTSTRTTQHAASETVYGLSQVGQYFVPNGSSGYLASFTAFVCYPPLLQVWLNFKEAVVDADIDLFKKLHGVTKYQYMEKDPKMNQIFNKSMADVCATEMTRILEIYTGFEGISTLVDVGGGNGQNLKMILSKYPLIKGINFDLPQVIENAPPLPGIEHVGGDMFVRVPQGDAIILKVAVCHNWLDEKCLEFLSNCHKALSPNGKVIVVEFILPEEPEPTEASRLVSTLDNLMFITVGGRERTQKQYENLCKLSGFSKFQVACRAFSSLGVMEFYK

SEQ ID NO: 179597 - protein, 189 aa, Glycine max
  Coding DNA Sequence Number=SeqID_62819
MDTEDFSFPKNGGTCAYSIDSPPLWNISPKDPSNPNQVPREGSKADEKDYFEAKVVSKGHKKSFSCVEDRKKITRLTDEAAPMDLLWEAFNEDLSSAVKFSSSSSREMVEFRCATTALTVVKTNKALLQTKNRPGMVVIVKVLKKFFSLNNSHLVCGNMVLKKLLSIKCSKKLIHLLSEEMGSAPNLKG

SEQ ID NO: 179598 - protein, 136 aa, Glycine max
  Coding DNA Sequence Number=SeqID_62820
  Subcellular localization annotation: CTP_CleavageSite=27; ConfidenceScore=5.30e-01
MQADIAAASSSIPLPNIRFSSRFSPSVATATWTSNLPPKQWILHSTAQIEDIITNYMRSLNLSDNDLSKLLKKFPEVLGCNLEEELKGNVKILEEQWSIKGNSLRKLLLRNPKVLGYNIDCKGDYIAPCTRCWARF

SEQ ID NO: 179599 - protein, 83 aa, Glycine max
  Coding DNA Sequence Number=SeqID_62821
MEGELLPKSLWWKDLKKICGGNGRARWFDEGIDWKMLLVIWGCGGRIGGIGSLIGEGYKGMDWILGFGKAAPRGVYHKIGIQV

SEQ ID NO: 179600 - protein, 96 aa, Glycine max
  Coding DNA Sequence Number=SeqID_62822
  Homolog annotation: Hit_ID=P46688; Match level="QueryCoverage=98%, HitCoverage=100%, E-value=2e-17, Identity=47%"; Hit description =Gibberellin-regulated protein 2 precursor
  Pfam annotation: Domain name=GASA; Domain location=3-96; Score=133.3; E_value=6.5e-37; Accession=PF02704.5; Description=Gibberellin regulated protein
MALTRSTVVLALLCFILIQELGIYGGDSHRVASNKIDCVGKCNYRCSKAGRNVMCLRACNACCQRCNCVPPGTSGNRDLCPCYARLTTHGGHLKCP

SEQ ID NO: 179601 - protein, 189 aa, Glycine max
  Coding DNA Sequence Number=SeqID_62823
  Gene Ontology: Mol. function=protein binding; Cellular component =nucleus; Biological process=actin cytoskeleton organization and biogenesis
  Homolog annotation: Hit_ID=Q6K699; Match level="QueryCoverage=93%, HitCoverage=55%, E-value=1e-63, Identity=61%"; Hit description =Putative Arp2/3 complex 41kD subunit
ILLATTSTDGKCRVFSTFIKGVDARDSKKGTSPDSKFGEQIVQLDLSSSWTFGVKWSPSGNTLAYVLFVSERKVIGVGFDCNPMVFAADERGIWSFVRYLAERKAVSSGSRYGSQFSEAFGKFYGQSKHGVSNDTVETSRTRGTVHENCINCIMPLGDHGTLLRRFSTSGLDGRIVVWDLENEQDLLEL

SEQ ID NO: 179602 - protein, 146 aa, Glycine max
  Coding DNA Sequence Number=SeqID_62824
  Gene Ontology: Mol. function=RNA-directed DNA polymerase activity; Cellular component=extracellular region; Biological process=RNA -dependent DNA replication
MYKILTKILPRGLMKVLPRIIDPKQSVFLEGRNILHSMLIANEAVEKAYDLVSWNFYYSLNGSPLEEFVPQRGLRQGNLLATFLFTIIAKGLSGMMRETISKKLFEGFHIGKDKVEPNLLQYADDSFHWEGNKEECGGYQKHAKIL

SEQ ID NO: 179603 - protein, 126 aa, Glycine max
  Coding DNA Sequence Number=SeqID_62825
  Gene Ontology: Mol. function=structural constituent of cytoskeleton; Cellular component=nucleus; Biological process=cell motility
  Homolog annotation: Hit_ID=Q6K699; Match level="QueryCoverage=85%, HitCoverage=29%, E-value=8e-50, Identity=77%"; Hit description =Putative Arp2/3 complex 41kD subunit
  Pfam annotation: Domain name=WD40; Domain location=1-38; Score=1.2; E_ value=27; Accession=PF00400.22; Description=WD domain, G-beta repeat
  Pfam annotation: Domain name=WD40; Domain location=44-82; Score=31.9; E_value=2.3e-06; Accession=PF00400.22; Description=WD domain, G-beta repeat
  Pfam module annotation: Pfam domain module=WD40::WD40; Domain location=1-38::44-82
MAVMAVHQFAQCITCHAWSPDQSMVALCPNNNEVHIYRLVEDKWEKLYVLQKHDQVISGIDWSARSNRIVTASHDRNSYVWNLEGSEWVPTLVILRLNRAALCVQWSPKGLKHVAMFQFLYASLLK

SEQ ID NO: 179604 - protein, 471 aa, Glycine max
  Coding DNA Sequence Number=SeqID_62826
  Gene Ontology: Mol. function=hydrolase activity, hydrolyzing O -glycosyl compounds; Cellular component=endoplasmic reticulum; Biological process=carbohydrate metabolic process
  Homolog annotation: Hit_ID=Q8RU06; Match level="QueryCoverage=99%, HitCoverage=66%, E-value=4e-95, Identity=60%"; Hit description =Putative Glucan 1,3-beta-glucosidase
  Pfam annotation: Domain name=Cellulase; Domain location=41-461; Score= -56.5; E_value=0.00077; Accession=PF00150.8; Description=Cellulase (glycosyl hydrolase family 5
MDLKAKTEELVIADVSNANGWGDDDPTIFEMTIVATLQGEFQLTNGYGPNKAPEIMKEHWNTFIVEDDFKFMKSHGLDAARIPVGWWIASDPYPPPPYVGGSLHALDNAFKWAQKHGLKIIIDLHAAPGSQNGFDSSSTRDGSLEWGKTYENIKQTVYVIDFLTARYAKNPSLYAVELLNEPLFPNVTLESLTKYYNDAYNAVRRHSSTAYVVLSNRLDLSSQLEIPNTKELFPLATGLRRCVIDVHYYNLYYDIFEDMNAQENIDFIYKVRSSQLDNITTVDGPLTFVVVDDSGNSDGNIGGGGGNGKGDISGGDNNGDGGGCGSDDEGDIVGGDGDSNVVVMMMVVITMPVVIMMSMVTMVVMITVLVVSPSGSDCFDDDVGGNGDNDIDSCGGSNAGGDDNISGDSGGSSGEWTAEWKVEGATKKDYQRFVKAELDVFGRATFGWCYWTLKNVNNHWSLEWMIKNGYI

SEQ ID NO: 179605 - protein, 58 aa, Glycine max
  Coding DNA Sequence Number=SeqID_62827
MSSRRTNLSLRRSSGAMDEDMQELLQAGPKYCLIVTLALAAWTRPGYSSRPMAAASIF

SEQ ID NO: 179606 - protein, 280 aa, Glycine max
  Coding DNA Sequence Number=SeqID_62828
  Gene Ontology: Mol. function=helicase activity; Biological process =viral genome replication
  Homolog annotation: Hit_ID=Q1SRJ5; Match level="QueryCoverage=99%, HitCoverage=33%, E-value=2e-84, Identity=51%"; Hit description =Probable helicase [imported]-Arabidopsis thaliana-related
MVHGPCGSLNPGSPCMKEGKCSRFYPKMFQPHTVLDADGFPVYRRRNNGNAIEKNGVIIDNMYIVPYNPRLLRKYQAHINIEWCNENTSIKYLFKYINKGYDRVTAVLIDEDNGQTENGGTHNDEIKEYLDCRYICPCESTWRIFGFPIHGKKPAVERLHFHLLGQHSVLYEDHDDIHDVLSKPSIFDSKFISWMNTNQNSVEGRNLTYAEFVSKFVYNQKKRCWHLRKKGYTIGRLLWVPPITGELFYLRMMLTVCKGPTSFEDLRTVDNVQYSTYKEA

SEQ ID NO: 179607 - protein, 182 aa, Glycine max
  Coding DNA Sequence Number=SeqID_62829
  Gene Ontology: Mol. function=sequence-specific DNA binding
  Homolog annotation: Hit_ID=Q2DPV8; Match level="QueryCoverage=96%, HitCoverage=45%, E-value=7e-27, Identity=35%"; Hit description=Helix- turn-helix motif
  Pfam annotation: Domain name=DUF955; Domain location=56-180; Score =28.8; E_value=2e-05; Accession=PF06114.4; Description=Domain of unknown function (DUF955)
MADLVWITKAQKISRNNKCEMWDKEKLKSLIPELRKTTNEPDIKKFIPHLKEVLATAGVSLVVLPTPSGCRASGATCFFEPERATLIVSFRYLTDDHFWFTFFHEIGHLVLHDAVSVRLEGDVKLTAVEEKEADQFATNTLIPEIFQKEIKNFGVKNWKDMVRVSRKIGVSKGIVLGYLQHI

SEQ ID NO: 179608 - protein, 112 aa, Glycine max
  Coding DNA Sequence Number=SeqID_62830
MSSRLTATTTCEGVSSVSATREWTMYEHDNQIMPWWHNQCREKKVWRCNARNKGLFRLGFELPVIGTIHGLNRLICESKPVYPPLLRGRVHQRWRRSRGGGTNIKDKCIMEM

SEQ ID NO: 179609 - protein, 298 aa, Glycine max
  Coding DNA Sequence Number=SeqID_62831
  Gene Ontology: Mol. function=hydrolase activity; Cellular component =integral to membrane; Biological process=cell redox homeostasis
  Homolog annotation: Hit_ID=Q75IA4; Match level="QueryCoverage=75%, HitCoverage=83%, E-value=1e-77, Identity=63%"; Hit description =Expressed protein
  Pfam annotation: Domain name=SNARE_assoc; Domain location=111-232; Score=85.8; E_value=1.3e-22; Accession=PF09335.1; Description=SNARE associated Golgi protein
MAAPRNVTATRDEEKGEEDDSPSAKKPKSERFPLNTWEFAVAVAVFFVFSTGLFCVYLSLPSAAYTNLKLPRTLSDLRLLKEHLSAYASNHPAQFILGYCSTYIFMQTFMIPGTIFMSLLAGALFGVVRGILLVVFNATAGASSCFFLSKLIGRPLVSWLWPEKLRFFQAEIAKRRDRLLNYMLFLRITPTLPNLFINLASPIVDVPFHIFFSATLIGLVPASYITVRSVVVAYRLLQGCEDHDFAPRIAPFYCFSCFSMLEPMQDCHLHWTRIDGETCKPPVIWSPKTDWVRFCHPV

SEQ ID NO: 179610 - protein, 199 aa, Glycine max
  Coding DNA Sequence Number=SeqID_62832
  Gene Ontology: Mol. function=structural constituent of ribosome; Cellular component=ribonucleoprotein complex; Biological process =translation
  Homolog annotation: Hit_ID=P51412; Match level="QueryCoverage=91%, HitCoverage=86%, E-value=3e-33, Identity=46%"; Hit description=50S ribosomal protein L21, chloroplast precursor
  Pfam annotation: Domain name=Ribosomal_L21p; Domain location=91-187; Score=149.7; E_value=7.9e-42; Accession=PF00829.11; Description =Ribosomal prokaryotic L21 protein
  Subcellular localization annotation: CTP_CleavageSite=60; ConfidenceScore=5.66e-01
MATATVSISTLCATFGTHCAISHDPKPLFSQPFSLNRFPSTSYKLTLSPRSPISTLPKVSESAVAETETGSSEPEPDQIVPAQPPSWEPGLFAVVMIGGRQYIVHPGRHLTVQRLKGANVNDKIALHKVLLVGTDTSCYIGKPIVTNAVVYATVEEQGLDPKVIVFKYKKKKHYRRNIGHRQAFGTINLGTRYLIPWQS

SEQ ID NO: 179611 - protein, 372 aa, Glycine max
  Coding DNA Sequence Number=SeqID_62833
  Gene Ontology: Mol. function=DNA binding; Cellular component=nucleus; Biological process=regulation of transcription
  Homolog annotation: Hit_ID=Q9C8W9; Match level="QueryCoverage=97%, HitCoverage=98%, E-value=1e-78, Identity=46%"; Hit description=NAM -like protein; 48543-50167
  Pfam annotation: Domain name=NAM; Domain location=12-141; Score =295.9; E_value=7.3e-86; Accession=PF02365.6; Description=No apical meristem (NAM) protein
ERSSSIDMESCVPPGFRFHPTEDELVGYYLKRKINSLKIDLDVIVEIDLYKMEPWDIQDRCKLGYEQQNEWYFFSHKDKKYPTGTRTNRATAAGFWKATGRDKAVMSKNRIIGMRKTLVFYKGRAPNGRKTDWIMHEYRHQTSEHGPPQASTLPLIKLKVANANYDTLVLLYTIYVNNNTENEEGWVVCRAFRKPSPSHRPGFDHPWCSTSSQQQHFFRDQIQSYSSRPLSIADILDETNNVPHPNAEGTSFSHPFSSDHQQHLNNLLSNQTVAIMDKQLIELPQLDSPTASLAIKECNQQQHNGLTNEEYCSDERSNNSNAQGIDWKSLDNLFGSQLSDNAAYFSHPNLPLMMPHNHDQASHILGCFPDSS

SEQ ID NO: 179612 - protein, 70 aa, Glycine max
  Coding DNA Sequence Number=SeqID_62834
MSQAKKDQKEKADTICNSHVISKYASMIVVEKTMSKPHSLSLIIKQSIVYRYRNLKQRIMIHNNIQSCFQ

SEQ ID NO: 179613 - protein, 107 aa, Glycine max
  Coding DNA Sequence Number=SeqID_62835
  Gene Ontology: Mol. function=diacylglycerol kinase activity; Biological process=protein kinase C activation
  Homolog annotation: Hit_ID=Q84ZM5; Match level="QueryCoverage=95%, HitCoverage=16%, E-value=8e-26, Identity=56%"; Hit description =Putative pentatricopeptide (PPR) repeat-containing protein
MVRDFGIETKPEHYAWMVDLLDRAGKLSEAVDFIKCMPFKPHPAIYGTLLGACRINKNLQLAGFAAKFLLELDPTIATGYVQLANVYAEHKTDDHLASIRRSMKENN

SEQ ID NO: 179614 - protein, 335 aa, Glycine max
  Coding DNA Sequence Number=SeqID_62836
  Gene Ontology: Mol. function=protein serine/threonine kinase activity; Cellular component=flagellin-based flagellum; Biological process=protein amino acid phosphorylation
  Homolog annotation: Hit_ID=O24430; Match level="QueryCoverage=94%, HitCoverage=64%, E-value=1e-131, Identity=70%"; Hit description =Calmodulin-like domain protein kinase isoenzyme beta
  Pfam annotation: Domain name=Pkinase; Domain location=37-296; Score =354.2; E_value=2.2e-103; Accession=PF00069.15; Description=Protein kinase domain
  Pfam annotation: Domain name=Pkinase_Tyr; Domain location=38-294; Score=-61.0; E_value=9.9e-09; Accession=PF07714.7; Description =Protein tyrosine kinase
  Pfam module annotation: Pfam domain module=Pkinase::Pkinase_Tyr; Domain location=37-296::38-294
MYTSLEILAVGGNRKKRMSSKCKNVMPHETPNVKEHYVIGNKVLGKGHVATTYVCTHKETKKRYACKTIPKAKLLKQEDYDEVWREIQVMHHLSEHPNVARVQGSYEDKFAVHLVMEMCRGGELFYRITQKGHYSEKEAAKLMKTIVGVVEACHSLGVIHRDLKPENFLFDSHSETATIKVIDFGFSVFYKPGQTFSDIVGTCYYMAPEVLRKQTGPEVDVWSAGVILYILLRGHPPFWAKSESAIFQEILHGEIDFVSDPWPSISESAKDLIKKMLDKDPEKRISAHEVLCHPWIVDDSVAPDKPLDPAVLTRLKHFSTMNKLQKMALRNCRFL

SEQ ID NO: 179615 - protein, 192 aa, Glycine max
  Coding DNA Sequence Number=SeqID_62837
  Gene Ontology: Mol. function=transferase activity; Cellular component= nucleus; Biological process=regulation of transcription
  Homolog annotation: Hit_ID=Q84ZM5; Match level="QueryCoverage=99%, HitCoverage=40%, E-value=2e-41, Identity=34%"; Hit description =Putative pentatricopeptide (PPR) repeat-containing protein
  Pfam annotation: Domain name=PPR; Domain location=159-192; Score =21.7; E_value=0.0027; Accession=PF01535.11; Description=PPR repeat
  Pfam annotation: Domain name=PPR; Domain location=5-39; Score=24.3; E_ value=0.00043; Accession=PF01535.11; Description=PPR repeat
  Pfam annotation: Domain name=PPR; Domain location=79-113; Score=43.8; E_value=5.8e-10; Accession=PF01535.11; Description=PPR repeat
  Pfam module annotation: Pfam domain module=PPR::PPR::PPR; Domain location=159-192::5-39::79-113
MKDIASWNTMISGYAQVGLMADTRRLFTAMPEKNCFSWSAIVSGYVACGDLDSAWSVFMLRLVELAERLFQQMSMRTLVTWNSIIAGYVENGRAEDGLRLFRTMSETGVKPNALSLTSVLLGCMIRWMAGTSLVSMYSKCGDLKDAWELIVRIPQKYVMCRNAMISGYAQHGAGKKALCLFDEMKNQGMKPD

SEQ ID NO: 179616 - protein, 123 aa, Glycine max
  Coding DNA Sequence Number=SeqID_62838
  Gene Ontology: Mol. function=binding; Biological process=lipoate biosynthetic process
  Homolog annotation: Hit_ID=Q9M4P3; Match level="QueryCoverage=76%, HitCoverage=89%, E-value=1e-30, Identity=68%"; Hit description=DYW10 protein
MKLAGYVPDLEFVLHDAGEELKEQLLLWHSEKLAIAFGLLKVPLGVPIRVFKNLRVCGVCHSATKYISTIEGREITVRDTTRFHHISRMGSAPAGITEQCWHALHLEVDLISSYCARDSEKCA

SEQ ID NO: 179617 - protein, 58 aa, Glycine max
  Coding DNA Sequence Number=SeqID_62839
  Gene Ontology: Mol. function=protein serine/threonine kinase activity; Biological process=protein amino acid phosphorylation
  Homolog annotation: Hit_ID=O24430; Match level="QueryCoverage=88%, HitCoverage=10%, E-value=2e-17, Identity=82%"; Hit description =Calmodulin-like domain protein kinase isoenzyme beta
MIEIILDTFLTQDGRIDYSEFAAMMKKGDPNMGRSRTMKGNLNFNIADAFGMKDKDSS

SEQ ID NO: 179618 - protein, 157 aa, Glycine max
  Coding DNA Sequence Number=SeqID_62840
  Homolog annotation: Hit_ID=O22901; Match level="QueryCoverage=26%, HitCoverage=42%, E-value=3e-07, Identity=67%"; Hit description =Expressed protein
MWMHVHWGWKNMPKATSNTLRCLKFEGKRIWWSQKPSLVSLSLKDLIQGTEENRTSSSYGCLRSKALAAQAKKVKGTKRSVRRPRRILMMKRRSGSRRGSNNGIRRRVRKLKSLVPNSDSLELDGLFRDTADYILSLQTRVRVMQVMVKVLTGSDDE

SEQ ID NO: 179619 - protein, 462 aa, Glycine max
  Coding DNA Sequence Number=SeqID_62841
  Gene Ontology: Mol. function=protein serine/threonine kinase activity; Cellular component=cytoplasm; Biological process=protein amino acid phosphorylation
  Homolog annotation: Hit_ID=O24430; Match level="QueryCoverage=99%, HitCoverage=87%, E-value=0.0, Identity=90%"; Hit description =Calmodulin-like domain protein kinase isoenzyme beta
  Pfam annotation: Domain name=Pkinase; Domain location=24-302; Score =350.9; E_value=2e-102; Accession=PF00069.15; Description=Protein kinase domain
  Pfam annotation: Domain name=Pkinase_Tyr; Domain location=24-306; Score=-40.6; E_value=5.6e-10; Accession=PF07714.7; Description =Protein tyrosine kinase
  Pfam annotation: Domain name=efhand; Domain location=358-386; Score =40.6; E_value=5.6e-09; Accession=PF00036.22; Description=EF hand
  Pfam annotation: Domain name=efhand; Domain location=394-422; Score =26.8; E_value=7.8e-05; Accession=PF00036.22; Description=EF hand
  Pfam annotation: Domain name=efhand; Domain location=430-458; Score =24.4; E_value=0.0004; Accession=PF00036.22; Description=EF hand
  Pfam module annotation: Pfam domain module=Pkinase::Pkinase _Tyr::efhand::efhand::efhand; Domain location=24-302::24-306::358 -386::394-422::430-458
MQKHGFASKRNVLPYQTPRLRDHYVLGKKLGQGQFGTTYLCTHKVTGKLYACKSIPKRKLLCQEDYDDVWREIQIMHHLSEHPNVVQIQGTYEDSVFVHLVMELCAGGELFDRIIQKGHYSEKEAAKLIKTIVGVVEACHSLGVMHRDLKPENFLFDTPGEDAQMKATDFGLSVFHKPGQAFHDVVGSPYYVAPEVLCKQYGPEVDVWSAGVILYILLSGVPPFWAVTHLVIFFVLELHSLFLLPSETEAGIFRQILNGDLDFVSEPWPSISENAKELVKKMLDRDPKKRISAHEVLCNPWIVDDIAPDKPLDSAVLTRLKLFSAMNKLKKMALRLTAYMQMFAKVIAERLSEEEIGGLKELFKMIDTDNSGTITFEELKAGLKSVGSNLMESEIKSLMEAADIDNNGSIDYGEFLAATLHLNKMEREENLVAAFAYFDPHGSGYITIDELQQACKDFSLGH

SEQ ID NO: 179620 - protein, 87 aa, Glycine max
  Coding DNA Sequence Number=SeqID_62842
MSAPIASTVLGYIGEIFLARRTPLELTRIPKQDMALLVRDTNEYLHSIEARHEMCIPMGYSKLGHTRSFCELCQAHRRLTALGIVST

SEQ ID NO: 179621 - protein, 130 aa, Glycine max
  Coding DNA Sequence Number=SeqID_62843
MVVRDATKSLQNLQIEAVMSVPPLKAIGGCYQIVLYYEKFLAGWIVESLAVPWWNNHFLQGGSSKDIGNKGLLEIVSIDSRIRLYEARFPMVLLEFLALLSERNILRLSLSSGRKLMSTILSSLLSSMFR

SEQ ID NO: 179622 - protein, 61 aa, Glycine max
  Coding DNA Sequence Number=SeqID_62844
MVVSSSLSVSCKWRRMKVQVLIFGEKMYYNVGLDNKGLGEREPREEDRVKGKGSFECYERM

SEQ ID NO: 179623 - protein, 183 aa, Glycine max
  Coding DNA Sequence Number=SeqID_62845
  Gene Ontology: Biological process=protein transport
  Homolog annotation: Hit_ID=Q8S3U9; Match level="QueryCoverage=83%, HitCoverage=13%, E-value=3e-41, Identity=57%"; Hit description =Exocyst complex component 2
MDQINSMLRSLRNEATKSEDMFMQLQEIQESVRLAFLNCFLDFAGSLERIGFELGQHRSDEEGSQLPNGYTHELENAPSGLRGGVIDPHQQLLIVLSNIGYCKNELSCELYDKYRHIWQHSRGKDEGNSDLEYLVNSFSALEAKVLEQYTFAKVMRKILFLSFKKITGWEADEYRGCNQSCNL

SEQ ID NO: 179624 - protein, 52 aa, Glycine max
  Coding DNA Sequence Number=SeqID_62846
MAEPAIATGGKAGERGVSSLGAGEAAMLHVKFSFSGLQASALHCLGMQHSIV

SEQ ID NO: 179625 - protein, 226 aa, Glycine max
  Coding DNA Sequence Number=SeqID_62847
AEFEIPEASDSRTKKKILKTVGERWRQFKSDLTRKWALAADKDGADDTVCEKYGISKEKWAQFCQTRRDPSWEDVRKKAQAIQKQNTAPHVLSHGPDSLVEQASQGSFVPHGRQDVLTVAIGRPKHPGRVYAAGAGVTIKQYFGSAPRTSRSSSSMLPEDLQQLTQQIRDQLEESITEKSDSTGDGILQPDVVPVSVSDAITGTYTTSGARGWSLRCSCQHKGELC

SEQ ID NO: 179626 - protein, 83 aa, Glycine max
  Coding DNA Sequence Number=SeqID_62848
MDGSGDDDPREPPLIKLKTFFRFFSKPRMEMFLNNEIQRNRHIEKSQVWLRLRVQTCKAGEFAKQQFVAMSNFRESGILKKIE

SEQ ID NO: 179627 - protein, 265 aa, Glycine max
  Coding DNA Sequence Number=SeqID_62849
MVVEICSENCGVSMSPRISFSHDFSQSDVIPVEKHPLRSNSSGLNSSIDFDFCVHESLELESSSADELFSHGVLLPTQIKNNNINNNAILKPKSQLAPPPPQPQPQLPPPPKAICDNASSTTRKSSKKESHKVGKELNDEVDEKQSSKSFWRFKRSSSCGSGYGSSLCPLPLLSRSNSTGSSPSVKRIPLSKEVKQNSQKRSSSSTRFSQSHHLASHNHQKPPLKRSHGSYANNGVRVSPVLNVPSANLFGLGSIFSNNRDKSKK

SEQ ID NO: 179628 - protein, 155 aa, Glycine max
  Coding DNA Sequence Number=SeqID_62850
MSYRMSRHHASEHADCMCPYEQIKQVNNTRELLTQFGAPHLHLGATKPGRKSTLNSVSSRSNNPCLQPSHLTTTHITDLYVQYYRARCQNIVSDILDPAASMLHLTFILHCTATPVFSSRMSGHCIRHRGSFNFNSSLDTLSCLVHYAARSYSLT

SEQ ID NO: 179629 - protein, 98 aa, Glycine max
  Coding DNA Sequence Number=SeqID_62851
MCRTQRIKEQESCQILFESKRKKSLLKGIHGIKEVFMKYKAKTRKRASNHWAIRTGVWSSRSQGSKISGLSTISDKTSQKSVRLRAMWITVLRSSYVH

SEQ ID NO: 179630 - protein, 87 aa, Glycine max
  Coding DNA Sequence Number=SeqID_62852
MLPDVNIDQMMKGKNRVPALHIQQQQQQQQSLIPLDVKRGQISKIPKLMVSITSKKEQPEWLHFTAIVAQQNHGCDRKALHGGSLCH

SEQ ID NO: 179631 - protein, 230 aa, Glycine max
  Coding DNA Sequence Number=SeqID_62853
  Homolog annotation: Hit_ID=Q9FKN3; Match level="QueryCoverage=45%, HitCoverage=39%, E-value=1e-10, Identity=41%"; Hit description =Arabidopsis thaliana genomic DNA, chromosome 5, P1 clone:MSI17
MADTNTNSNMSLPQTHQPNLTIEPLLHALDPISMILNQNSNSDNPFPLRLTSADSFILERGPNYTAYAELRESRLHMRCLMQEQQQQQQKAHELEPRAKPATPPRKKQVKFQACGGHSKGSFSIAQSVPDFSSALRKENKKPVNNLPSMTPPSKSGNGVVLSSRGSKSVSGGEKKKGGGGGVMARKSYACIDELKSFSSATAIAINGEGRGGGRSNKVMGRTISGHHRQF

SEQ ID NO: 179632 - protein, 32 aa, Glycine max
  Coding DNA Sequence Number=SeqID_62854
MENWRTALRNNFAGLHTRRLVGGGGCMNSARH

SEQ ID NO: 179633 - protein, 66 aa, Glycine max
  Coding DNA Sequence Number=SeqID_62855
MVVFPMPSRVPPPIALLGFCLKLTTTTIMAAVVVTTDDNGGGNDNHGGGCNGSHGGGSDVDEGDGG

SEQ ID NO: 179634 - protein, 123 aa, Glycine max
  Coding DNA Sequence Number=SeqID_62856
  Gene Ontology: Mol. function=nucleotidyltransferase activity; Cellular component=cytoplasm; Biological process=biosynthetic process
  Homolog annotation: Hit_ID=Q1SJM5; Match level="QueryCoverage=83%, HitCoverage=25%, E-value=1e-45, Identity=86%"; Hit description =Nucleotidyl transferase; Trimeric LpxA-like
  Pfam annotation: Domain name=Hexapep; Domain location=42-59; Score =7.1; E_value=20; Accession=PF00132.14; Description=Bacterial transferase hexapeptide (three rep
  Pfam annotation: Domain name=Hexapep; Domain location=60-77; Score =15.4; E_value=0.21; Accession=PF00132.14; Description=Bacterial transferase hexapeptide (three rep
  Pfam annotation: Domain name=Hexapep; Domain location=83-100; Score =5.9; E_value=28; Accession=PF00132.14; Description=Bacterial transferase hexapeptide (three rep
  Pfam module annotation: Pfam domain module=Hexapep::Hexapep::Hexapep; Domain location=42-59::60-77::83-100
MACMDIGLNASQIMSLKCSELYLAQFRYTSLDLLASGDGKKKATIVGDVYIHPSAKVHPSAKLGPNVSISANVRVGAGVRLSSCIILDDVEIKENAFVTNSIIGWKSSLGRWSHVQASSVHFL

SEQ ID NO: 179635 - protein, 68 aa, Glycine max
  Coding DNA Sequence Number=SeqID_62857
MGLRIINMGRFGRRVVFLCTSVVLGYSTATFKISSCHNFCHWRFSFCALGSRDDKWLGTPQMGDRYHE

SEQ ID NO: 179636 - protein, 179 aa, Glycine max
  Coding DNA Sequence Number=SeqID_62858
MDSKWSEVEVVSSRTKRIMLFSEGALSRWPLEKGKQPFPDLRSPMIRPDSFLRALGNDMSRTFTPGTFFRRGTQPDDRIDMAWVKEFYANLYDPEEKSPWQVRVRGRLIKFDGEMLNAFLETPVVLEPGEQYTTYSRFCHTHSDPQELASKLCISGRSFVLNAEGAPWKLLRKDLTTLV

SEQ ID NO: 179637 - protein, 240 aa, Glycine max
  Coding DNA Sequence Number=SeqID_62859
  Gene Ontology: Mol. function=nucleotidyltransferase activity; Cellular component=cytosol; Biological process=biosynthetic process
  Homolog annotation: Hit_ID=Q1SJM5; Match level="QueryCoverage=84%, HitCoverage=50%, E-value=1e-104, Identity=88%"; Hit description =Nucleotidyl transferase; Trimeric LpxA-like
  Pfam annotation: Domain name=NTP_transferase; Domain location=45-240; Score=11.3; E_value=1.6e-10; Accession=PF00483.13; Description =Nucleotidyl transferase
MTALGSCRDIVGVISDVVRISSMATWLSVVMKICALAMENSEKVVAVIMVGGPTKGTRFRPLSFNIPKPLFPLAGQPMVHHPISACKKIPNLAQIFLLGFYEEREFALYVSSISNELKLPEDKPHGSAGGLYYFRDIIMEDCPSHIFLLNCDVCCSFPLPSMLDAHKRYGGMGTMLVIKVSAESANQFGELVSDPTTNELLHYTEKPETFVSDLINCGVYVFTPDIFTAIHDVYINQEGR

SEQ ID NO: 179638 - protein, 669 aa, Glycine max
  Coding DNA Sequence Number=SeqID_62860
  Gene Ontology: Mol. function=nucleoside-triphosphatase activity; Cellular component=integral to membrane; Biological process=transport
  Homolog annotation: Hit_ID=Q84TH5; Match level="QueryCoverage=96%, HitCoverage=97%, E-value=0.0, Identity=58%"; Hit description=White -brown complex homolog protein 26
  Pfam annotation: Domain name=ABC2_membrane; Domain location=403-609; Score=183.4; E_value=5.5e-52; Accession=PF01061.14; Description=ABC -2 type transporter
  Pfam annotation: Domain name=ABC_tran; Domain location=106-295; Score= 166.2; E_value=8.1e-47; Accession=PF00005.17; Description=ABC transporter
  Pfam module annotation: Pfam domain module=ABC2_membrane::ABC_tran; Domain location=403-609::106-295
MPSPTPIPTAVFGGVETPNGDSSNTKPHPKQESRDLSPFLSCSYPITLKFIDVAYRLKIEDKQKNGGSIKRFFTPHESSPSDQGSRAGASQERTILKGVTGIAHPGEILAVLGPSGSGKSTLLNALAGRLHGHGLTGTILANSSKLTKPVLRRTGFVTQDDILYPHLTVRETLVFCAMLRLPRTLPRAAKIAVAEAAIAELGLGKCEDTIIGNSFIRGVSGGERKRVSIAHEMLVDPSLLILDEPTSGLDSTAAHRLVVTLGSLAKKGKTVITSVHQPSSRVYQMFDKVLVLSEGQCLYFGKGSDAMRYFQSVGFAPSFPMNPADFLLDLANGVCHVDGQSEKDRPNIKQNLIHSYNTILGPKVTAACMDSTNVPSRNTHPLRSNSSKEFRRNDRVSFFDWFYQFRILLQRSLKERKHESFNTLRVCQVIAAALLAGLMWWHSDYRNIQDRLGLLFFISIFWGVFPSFNSVFAFPQERAIFMKERASGMYTLSSYFMARIVGDLPMELILPTIFLIVTYWMGGLKPDLWAFLLTLLVVLGYVMVSQGLGLALGAAIMDAKQASTVAAVTMLAFVLTGGYYVHKVPSCMAWIKYISTTFYCYRLLTRIQYEDGKKISYLLGCYQRDKGGCSFVEEDVVGQIGTLGCIGVLLFMFVFYRLLAYLALRRIKS

SEQ ID NO: 179639 - protein, 442 aa, Glycine max
  Coding DNA Sequence Number=SeqID_62861
  Gene Ontology: Mol. function=transporter activity; Cellular component= integral to membrane; Biological process=transport
  Homolog annotation: Hit_ID=Q2A9H2; Match level="QueryCoverage=88%, HitCoverage=72%, E-value=1e-161, Identity=70%"; Hit description =Transporter, putative
  Pfam annotation: Domain name=MFS_1; Domain location=15-359; Score =45.5; E_value=1.9e-10; Accession=PF07690.6; Description=Major Facilitator Superfamily
MYVAGHLGDTLDLRLFLATGMVGSGIFVSLFGMGYFWNIHSFLFYLSMQMIAGMFQATGWPSVVAVIGNWFGKRKRGLIMGVWNAHTSVGNISGSLLAASVLEYGWGWSFVVPGALIVGGGVVVYLFLAPYPEDVGFSCVHGGGDEEAQVNDEKGGGVPTREGSVNRKSVGLVEACMIPGVIPFALCLFFAKLVAYTFLYWLPFYLTQTDVNCMGHKSLHLNFAEIGGKYISVKSAGNLSTLFDVGGIVGGILAGYVSDKLNARAITAASFMYAAIPSMLLYRHYGSVSMNANIGLMMVTGLFVNGPYALITTAVSADLGTHSSLKGDSRALATVTAIIDGTGSVGAALGPLLTGFISTRGWNEVFMMLVLGAFIAGLLLSRLIIAEIAERSGKPLSSGQQNPEATASQPLLEEDRLWKVPKGIRTHNWGWNSIPFHRELIF

SEQ ID NO: 179640 - protein, 61 aa, Glycine max
  Coding DNA Sequence Number=SeqID_62862
MKRRIRDCHQRRLTRVTTTVVIVVIVTMTKIMDVVVVDVGGDDSGYNDGDGGGSDNHDNDA

SEQ ID NO: 179641 - protein, 57 aa, Glycine max
  Coding DNA Sequence Number=SeqID_62863
MVMATVKSLRKCIIDLFIKRDYVTLLSPPRVVFQICIVNLRLLPDRWALMALHIKAD

SEQ ID NO: 179642 - protein, 116 aa, Glycine max
  Coding DNA Sequence Number=SeqID_62864
MLAKSLNKEGGNRGSGGGGENGVRVGSEEEAGRKEMWSEMETRKNLLDNGYHHQKGENFWPQTNYFKQLKALLLRSLVQHERRGREESGEGIMVRVKVEEEGAEREKMGTREERKS

SEQ ID NO: 179643 - protein, 320 aa, Glycine max
  Coding DNA Sequence Number=SeqID_62865
  Gene Ontology: Mol. function=oxidoreductase activity; Biological process=flavonoid biosynthetic process
  Homolog annotation: Hit_ID=Q9LIF4; Match level="QueryCoverage=95%, HitCoverage=92%, E-value=2e-49, Identity=37%"; Hit description =Arabidopsis thaliana genomic DNA, chromosome 3, P1 clone:MHC9
MPPVPISPIKVGHIPDVQEKDEVLTTPLSPQHSDMAVIDFSKLSKGNKDEVLTELFNVVTGCEEWGIFQLNIYISIENLSREFFMLPLEEKQKYPMAPGTVQGYGEAFVLLEDEKLDRCNMFALGIEPEYVTNPNLWPNKPEKFSTKRGSLGGLVLFSNQSWSFTSKTYANLKSLGLGLKGDEFEKMFGESVQAMRMNYYPPCSRPDLVLVCAWFNSNNAAPAGSLDNTVENDFQNHHSQNKVTGLDSHKASEDVPVGVALQHAANGQWTRTETERSNIIVKNANKRIQLVDNCLIADQPQRHRRHNEDPVDTLDKERDE

SEQ ID NO: 179644 - protein, 107 aa, Glycine max
  Coding DNA Sequence Number=SeqID_62866
MLGLTCSRLAIILITLLSARMLALDSPFGVLSDEDPIPMESLTSSNKVIRTGATHSNLGGPSCFWSKHTILHPVQNNENMYWLKFGAMIELWQMKRVMEKKKRKTLS

SEQ ID NO: 179645 - protein, 113 aa, Glycine max
  Coding DNA Sequence Number=SeqID_62867
MEWLRETDGVCEAARAICIAEEEARDDLAEGKAEDAIDAVRAICMAEDEASDDLAEDKTDDAIDAGVDESKGVDSEGGGSVKPDLASRLQTGQKVLHEAEEINLVKQQNINSM

SEQ ID NO: 179646 - protein, 50 aa, Glycine max
  Coding DNA Sequence Number=SeqID_62868
MGGFFGTFSSLSATKLGSIAIEAALKKYRKRILNMFCLLQLQCLLHRVFN

SEQ ID NO: 179647 - protein, 243 aa, Glycine max
  Coding DNA Sequence Number=SeqID_62869
  Gene Ontology: Mol. function=metal ion binding; Cellular component =extrinsic to vacuolar membrane; Biological process=intracellular protein transport
  Homolog annotation: Hit_ID=Q9M621; Match level="QueryCoverage=85%, HitCoverage=53%, E-value=6e-78, Identity=61%"; Hit description =ReMembR-H2 protein JR702
  Pfam annotation: Domain name=PA; Domain location=27-126; Score=80.9; E_value=3.9e-21; Accession=PF02225.12; Description=PA domain
MAASKVVLIGNNITLSFDDIEANFAPTVKGSGEYGILYLAEPLDACTELTNKVEQLPNASSPFALVVRGGCSFEEKVRRAQKAGFKAVIVYDNEDGGILVARNSAGIKIHAVFVSKASGEILSKYAGLTNVEIWLIPTFENSAWHRIRRERPRAPLVREFHGMSSRLVKAMPSLIFTAVLEDNCTSRTCAICLEDYCVGEKLRILPCCHSLKQDISLLGGLHLYSSFSHPSVPLETMVKYLVV

SEQ ID NO: 179648 - protein, 75 aa, Glycine max
  Coding DNA Sequence Number=SeqID_62870
MDGKHSTWEASLRSKEGNFLGKLEEESFLEKLEGATHIPPIAKLTPMPKYMKIQWEASLRSNEGSFLGKQGRKLL

SEQ ID NO: 179649 - protein, 176 aa, Glycine max
  Coding DNA Sequence Number=SeqID_62871
  Homolog annotation: Hit_ID=Q5DTC7; Match level="QueryCoverage=36%, HitCoverage=26%, E-value=7e-21, Identity=47%"; Hit description=Alpha 1,4 fucosyltransferase
  Subcellular localization annotation: CTP_CleavageSite=62; ConfidenceScore=5.05e-01
MSLLHLNFYKTRHHSQSKNVISKTKLAHPCTLEGKTYLNRRRGRFKQQSIRLVSENGRFGPQAAQATRARVQVIQVIGNPTRAPHLRVPLPEGRDQIGEGFGLGRRGCDGARDGRERGGGEVEEAGEEEEEEGEGEHDCDGEGVYGFGRHWHGGEEENGGVLSLSWSQRGHGMGMD

SEQ ID NO: 179650 - protein, 433 aa, Glycine max
  Coding DNA Sequence Number=SeqID_62872
  Gene Ontology: Mol. function=isomerase activity; Cellular component =endoplasmic reticulum; Biological process=cell redox homeostasis
  Homolog annotation: Hit_ID=Q5EUD2; Match level="QueryCoverage=87%, HitCoverage=90%, E-value=1e-132, Identity=57%"; Hit description =Protein disulfide isomerase
  Pfam annotation: Domain name=Calsequestrin; Domain location=4-367; Score=-97.1; E_value=0.014; Accession=PF01216.8; Description =Calsequestrin
  Pfam annotation: Domain name=Thioredoxin; Domain location=32-136; Score=135.0; E_value=2.1e-37; Accession=PF00085.10; Description =Thioredoxin
  Pfam module annotation: Pfam domain module=Calsequestrin::Thioredoxin; Domain location=4-367::32-136
MRMKRVFVVYSVLLLLVQFWLGEAETFSVDGKVLVLDESNFDSAIASFDHILVDFYAPWCGHCKRLSPELDAAAPVLATLKEPIIIAKVDADKHTRLAKKYDVDAYPTILLFNHGVPTEYRGPRKADLLVRYLKKFSASDVSILDSDSAVNMFVEEAGTFFPIYIGFGLNSSVLEKFGIKYKKNAWFSVAKDFSEDLMVLHDFDKIPALVSLNPQYNERNTFYGPFEEDFLEDFVRQNLIPLAVPVSYETLKLMKADGRKIVLTIVEDEDEETTRELIKLLKAAASANRDLIFGYVGVKQMEEFAENFDIDTKLPKMVIWDKSDDYLSVVDSETIEGEDQGTQITKFLEGYREGRTIKKTFSGPSLMRFIHRSFDIRMVYIIVFVVAVLMLIQTFSKGGDEYQSVPNQVQTDHAISSVSEAENNEYKPGDKED

SEQ ID NO: 179651 - protein, 128 aa, Glycine max
  Coding DNA Sequence Number=SeqID_62873
MDLKGWVVVRVKMKLVGDKERGIKSLSTYNACHDMSSLEDQSHDQPGNLFDETMNKTSIKGEIGGVSVGMFERGRGSGQGRPRMRCKEKKENWNKRREKVRRKRKRVIRKLNLCPPRQFCIGVRALDP

SEQ ID NO: 179652 - protein, 249 aa, Glycine max
  Coding DNA Sequence Number=SeqID_62874
MSHRSSSVNGEDTSHKDPLSRILYELSSLKLGKEKLERKEKEKERVEISQDEREQIREEERRKILKELRKEKYASYSTHDSCKSLSEELRGYYEGRHRSHLRPHSHRREKERKPQEANINLPYFHGKDNVEAYLDWEMKVEKLFAWHHTSEERKDPLATLSFQGYALYWWISLPRIVTKHECQSKIYTKLIHMETFTRLKAAPYSQTLPVVILLSVTTFCGSEEFTKAVGIEDEAYSISLIDRGRTRIK

SEQ ID NO: 179653 - protein, 88 aa, Glycine max
  Coding DNA Sequence Number=SeqID_62875
METQTTSREKSAYLDNFDTLKKKKKNKATGQEAEEKTTLQNRAGWKKKTKKEEGRRSQNKKKKRGRRKASWVGATTVDSGGSTMDKGD

SEQ ID NO: 179654 - protein, 127 aa, Glycine max
  Coding DNA Sequence Number=SeqID_62876
GVLDKRYEVQGQRIPYDRDTINQFLGNPLLLEEGQQCEYTSRRDITIGFDDEAIGVATRAVSVASASSRCSTTTTTTTIIGVHLSTPTEDGTPKQFRATVVWLGDKPIFHEEVGHADDQRAAHDQGG

SEQ ID NO: 179655 - protein, 293 aa, Glycine max
  Coding DNA Sequence Number=SeqID_62877
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =75%, HitCoverage=36%, E-value=1e-26, Identity=35%"; Hit description =ATP binding / kinase/ protein kinase/ protein serine/threonine kinase/ protein-tyrosine kinase
MNPRQLLLLLLFFFFSLLEPTITFSLDERFEACVPKTCGNGQNISYPFYIQGKQKPFCGQPGFELTCGHNGFPILTLMYTPYTIHQIFYHNNSLRLSNPIFSQPNASSCIGPTQNLTVGRYIFRLAPNQRDLFVLYGCDPAVLPERVRERMIGCSAAGNETTLVVGLDKDDLDLVTARESCNGGAVNATVEDLKGGVREALWRGFMLIWNATSCRECENSEGRCGFDLDPLVYAFRCYCPDRPHVVKCNPVVKITRITKVIFGVTFIMRYCTFPHESNQFYKRHLEILLETWF

SEQ ID NO: 179656 - protein, 180 aa, Glycine max
  Coding DNA Sequence Number=SeqID_62878
MDCYPTDRIILQNDDDSQIRTDIYVSNPAFQKVEDLVDDNLALEQYLEDYNAQLMEELLHKMQYPYYPYYHLVPPSLVLKRDCHPLDLPPFGTQDLKHKYLGEFNCHHHFEVLFCQKDNNQLAIGMNLVGLGSECLESVLASYATKLEEKTILTLSIKNIHLYMDLSRYGISSGALRRWE

SEQ ID NO: 179657 - protein, 157 aa, Glycine max
  Coding DNA Sequence Number=SeqID_62879
MPKGGDTWQLKWHLQMMEKEIITIIVDTLPVFYYEKMVGYAPSSFADMVFVCKRIEAGLKRGKFDHPTLISEKAGANEEDENEGETHAATVIPYMAKLPTSPTMSLLNQYQLFSLPTTQSSTKAIPKSITKPVYRTPNAQTLPLAKTKKEFCSKTLV

SEQ ID NO: 179658 - protein, 140 aa, Glycine max
  Coding DNA Sequence Number=SeqID_62880
MSKDKIVENCSDRPSYYPLQVPLVIFVGEIENTSVIINIAVSCKVITSKRERKKKSELRWRWINEARLGRIYIGGWNVVSLISTKNSLGSDYIVLKVIVIVNVSTSSELPRSGPPQTEVVIRVGPGLSLLQTLELWVFKN

SEQ ID NO: 179659 - protein, 573 aa, Glycine max
  Coding DNA Sequence Number=SeqID_62881
  Gene Ontology: Mol. function=nucleic acid binding; Cellular component= chromatin; Biological process=DNA integration
  Homolog annotation: Hit_ID=O24438; Match level="QueryCoverage=77%, HitCoverage=30%, E-value=2e-53, Identity=28%"; Hit description =Retrofit
  Pfam annotation: Domain name=zf-CCHC; Domain location=279-296; Score =12.4; E_value=0.0089; Accession=PF00098.13; Description=Zinc knuckle
  Pfam module annotation: Pfam domain module=Retrotrans_gag::zf-CCHC; Domain location=97-186::279-296
MANTSPSLLALANTTNSNLNLQIPSINIKLERDNYSLWRSTIISALETFELESFILNPAPPMQIHIVNTSDGVSTTEPNPDFVLWKKHDRFVLLWIKSTLSEKALSLVVCATSSHMAWTAIEKTFQAQTRARRMAMQVQLQTLTKGSLSMLEYIERKRSIADSLAENLHPISDEDLIGYILSGLDSSYSAFSTAFMMKSDDVSVDDLAGLLLQEEARLEQEHVRQAAVVSQPTNPTPLFTTPAVYTTNRFSKRSSSTNNPNNNFGLFPRHNIDNPRRRPICQLCSKPGHEAINCWQRTNQTDYPSRRANPRVSSRQANVAQTGTSSIVMDPSWYFDTGATDHVTPDISKLTIANDYTDDDKLQVGNGKHLSISHVGSSLLPNLSLPSVFIVPNLTKNLLSVSKLTRDNDVFMEFWPTYCFVKNFQGQTLLQGDISHGLYQLPPVKTNLTSTMALTSVRTSLHGWYQRLAHPHESLLRRLLSSFQLPAKDHLGAVAACLSKLKLNPEVVSSPRRASPLPLKLFGGPGKPNAGMGELRPRKNKEKTLLPSFLGIFCLPDRNIEWFLALHCNWRST

SEQ ID NO: 179660 - protein, 322 aa, Glycine max
  Coding DNA Sequence Number=SeqID_62882
VGLQCLERHAAVRAQAGARGVSHAGHRQAQCPWRRGAQGQVLRPEVGAIFQVGMLLGAVLGRAGLDNLFHQPQQGRAGIAAEAALARRVGVEDAVPIEVFAAQQVEGVWLEMVGGMRPAAIQAARFGHGQQRARQPGDVDVFFVEPAQRARAGIRAGVGRGHAFQRAQALAPVALFQQVIDAPHDLRIGMTAEPWIGKPGARILPHAVGHRARADVLAHRLGVAGQLQCFIGRAGGVDARLEVDVAQVGLRGARLGAVAFELRGVVAGHALQVEAALLAGAGVGPLPAIALLVTRALPAGGAVGRVDRGRVRSRRPRRVRLW

SEQ ID NO: 179661 - protein, 170 aa, Glycine max
  Coding DNA Sequence Number=SeqID_62883
MDDLQNITANGETICKEMKVNKKETMEKEEEDRRREAAMASSSCLRPNFNPKGITQDQLSKFRVGATQEALATEVKIKVQNEIQRFFSSFLNCNDGANKKSHGYGLSSQNSVTQGSNVDHRESRLWNDCEGFDSRIEDSKDDVPVMSEPKKQKLHWGLDTKNRWERKSNM

SEQ ID NO: 179662 - protein, 148 aa, Glycine max
  Coding DNA Sequence Number=SeqID_62884
  Subcellular localization annotation: CTP_CleavageSite=30; ConfidenceScore=5.07e-01
MVASSQHTSLTEQDVFANTSMSTPLPTPIVSSMKSNQGLELLSITEHEEECKKLQPSPSSSFWRRHLPWQISIGFNLQGDGYPGTLSNGVKAREGFQKAKEKIMLIQGPIEKTEKAEAMLVREKEELMVLLKLIQEELRSTRLKLQEL

SEQ ID NO: 179663 - protein, 246 aa, Glycine max
  Coding DNA Sequence Number=SeqID_62885
MKYFPSSLTKNAFTWFITLPPNSIYTWAQLESMFHKHFLRGETKDLDVSQEKDEICVAGLHPRPPYTCQIGMVQKAIDKGRLKFEEKTMKVDTNLFHIQANYVEPMQIMMSGASIGTSKVSTSLSKEEVNQALEEFKKEEELVFRLARDSLVDFLLKKQKDENEVMSCPRCSVMFDRSVSKAFESLEIRKSLKKLQETKVKEKEKQSASMTVSQVQKSYQCISEEVLRSSSKCSNKQVVSTREQKI

SEQ ID NO: 179664 - protein, 43 aa, Glycine max
  Coding DNA Sequence Number=SeqID_62886
MVVTNCGTNPTSILTHRSLPKESSGFKRKDDIPKKYLNFTGWL

SEQ ID NO: 179665 - protein, 145 aa, Glycine max
  Coding DNA Sequence Number=SeqID_62887
  Subcellular localization annotation: CTP_CleavageSite=36; ConfidenceScore=5.46e-01
MEESSKKRKGSSSSTTTAGQRRHNASDDSPAPPNPSLSSPHSLTLFSSNEQFTLILQQFSIPLPNEPFVKVKCSFAIGATAVESFGYRKDLDGQWVRKQDLPTNARNECIPSPPPRDPSSSLLNDVLSELQDLHAFVGERFDSMD

SEQ ID NO: 179666 - protein, 196 aa, Glycine max
  Coding DNA Sequence Number=SeqID_62888
ANSANERHLRGIGLRDGNFKGVGSSDGHGVGEEIVELEGVRVGRVWVTIGEGAPTPPPEPSSRVGELGLPGVSQGTISRRSNSRERDMASQQYDSQGPQTQRGANRDCRTWRKSGQEVNWSLLVLYWNHAKRQAFMLQCRMIFKELIDHKDPTKRPVKSILEGDGELGDSVIQKIGVGFGSRGLCHGYLSMKAPKC

SEQ ID NO: 179667 - protein, 49 aa, Glycine max
  Coding DNA Sequence Number=SeqID_62889
MTMIMAVEVVNIAMIIPAKVVTIMVMGPGLESTLARSKEREISHAVNLV

SEQ ID NO: 179668 - protein, 72 aa, Glycine max
  Coding DNA Sequence Number=SeqID_62890
MSVVTTTTIIVAMVVTIDDNGGGNDNHGGVALVVVVVTATVTKVMAVDNGGGDVLTTTVVMVVTMTFMMVMD

SEQ ID NO: 179669 - protein, 218 aa, Glycine max
  Coding DNA Sequence Number=SeqID_62891
MGEIEEVQEQMKADMEALKEQMITMIEVMMSMEKIMEVNVVVVAATCTVAEVEPTLLFGLNQINHQTSDRVGQGSKELVAFGPIWGHLEYSGKGIASGGSNPACLGELGGNHLPHFLIKWRERAEFEEFNTLIAHKSLKISEEKKKEGKNPSQDTSVTLSRHFQDQFRESFFRVLRTFFIVRRASTGLISSPQLRIHRNKSPAFVDPKKGEIVKGPTP

SEQ ID NO: 179670 - protein, 62 aa, Glycine max
  Coding DNA Sequence Number=SeqID_62892
MTMAVMADNRNDHTDKGGDNHGDGDGAIGGGTLEGIGNTTIANGEHLNDYLEIKDELLKLGD

SEQ ID NO: 179671 - protein, 208 aa, Glycine max
  Coding DNA Sequence Number=SeqID_62893
  Gene Ontology: Mol. function=RNA-directed DNA polymerase activity; Cellular component=chromatin; Biological process=chromatin assembly or disassembly
MWPKREWKLIWATVGFGSSGGSGGCSWLKHKPLSRQEANSADERRLRGIGLRDSNFKGVGSSDGLGVGEEIVELERHQGVSFLVSAPTPPPEPSSRFGELGLPGVSVGTISRRSNSREREMASQQYDSQGLQTQKGFSYCEGGNRDCRAWRKSGQDVNWSLLVLHWNHAKRQAFMLQCRMIFEEVIDLKDPTKRVSAIKPWNIQLHTV

SEQ ID NO: 179672 - protein, 42 aa, Glycine max
  Coding DNA Sequence Number=SeqID_62894
MATPMSTACYLDKDEAGQSVDIKKYRDIKPIPKNLTLVPSKE

SEQ ID NO: 179673 - protein, 241 aa, Glycine max
  Coding DNA Sequence Number=SeqID_62895
  Homolog annotation: Hit_ID=Q5W7C9; Match level="QueryCoverage=53%, HitCoverage=53%, E-value=8e-40, Identity=65%"; Hit description =Unknow protein
  Subcellular localization annotation: CTP_CleavageSite=35; ConfidenceScore=5.10e-01
VIQPHLPVRLPCYDFTPVTSPAFGIPLLAVKVTTSGMASSHSVTGGELQPTIRTEDGFLELAHPRGIAILCPVHCSTHAPPVSAFPKAPLSFKRIRGMSSPGGILNALATALHGSIRTAPSIHRLRLGLLGYLIPFAPLAFVSQCQCRPSRVLSPLVFFPISTHFTAPPEIPSAPTVLQLDALRPIIPDNACILCLTAAAGTELADAYSPDTVIASSPGKEVHDPPSVADHPLGPATDHRL

SEQ ID NO: 179674 - protein, 260 aa, Glycine max
  Coding DNA Sequence Number=SeqID_62896
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-26, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LTFRGLYVLVIRGLHALTFRGLHVLAIRGLHALTFRGLHVLALRGLHALTFRGLHVLTFIGLHTLTFRRVDVLAFSGLHTLTFRGLPVLTFIGLYALTFRGLHVLTFIGVYALTFRGLDVLAFRGLDVLAFKRGLHVLPIRGLHVLTFRGLHVLAVRGLHVLAFRGLQVLTIKGLHVLAFKGLDVLAFRGLYVLTFRGLYVLTFRGLHVLTFSGLQVLTIRGLDVLTFKGLHFFAYRGLRVLSFNGLHSHTLREFKVLCP

SEQ ID NO: 179675 - protein, 66 aa, Glycine max
  Coding DNA Sequence Number=SeqID_62897
MAELRSGKTDQGIILIAVIDLKCILSISIDISQLNSQQSQKTHVGHLGSCCESAESSESAFLAKIL

SEQ ID NO: 179676 - protein, 101 aa, Glycine max
  Coding DNA Sequence Number=SeqID_62898
  Gene Ontology: Mol. function=ribonuclease H activity; Cellular component=mitochondrion; Biological process=DNA integration
MRKLREGICGLHTRGRFLVTKVVRASYYWPALRADALDFTKRCKRCQEFADIPCIPPNNLHSLSYPWPFAMWGMNILGPLPKALGAVKYSLVAIDYFTIWI

SEQ ID NO: 179677 - protein, 185 aa, Glycine max
  Coding DNA Sequence Number=SeqID_62899
VENLKVQLKELESMMEESEQWASRKRKANKELEEELLVYKQEAMEHHEKCFNKAIRQDVKDDVLLDEQEITAEEEAASEEELGFEEKGDNATLSFDEEFCTVYLCLVSMPLSMQRSTLVVLSPLWWRFFLLCGTSPLMLVRSMFDLPLVEGLANQFGVHFVELGPLTVVVIVAVSEQTKGMPWVF

SEQ ID NO: 179678 - protein, 381 aa, Glycine max
  Coding DNA Sequence Number=SeqID_62900
  Gene Ontology: Mol. function=RNA-directed DNA polymerase activity; Biological process=RNA-dependent DNA replication
MATSRWKKCPDSGTKSNKPDKKAISEKEAPRSTYKVPIRLPATKLLRLGLDDQILQDTKRSSIGTTKEIEEEIKGKIKVDRDTSSSDAIDNLHKNRNSPNKSEGINLINQDDPMVVSIIIANFMVSKTRGYVHLKTTFGQGHLSKSLTVRKTLKELRAIVLTPHLKIKFPTVTGEIVTVTPYPPTRESAKPHPTTAEGTQVMSMDEGSPIRAITIYQPSLDNEFDIDPCDDTSNRGPKPIKELVKLQLEPKPGMCTQLSRELTSHKHRRIVDLAICLRPNRYHRRKGRWEKNDANLSEKKCTNYTDMSSACPNDEYPLSNIDRLVDGAFEFLVLSFLDAYSRYNQIRIHTPDKEKTTFIIEDANFCSRIMPFGLKNAGTTY

SEQ ID NO: 179679 - protein, 246 aa, Glycine max
  Coding DNA Sequence Number=SeqID_62901
MEGRREEVDGGEEEIVVLPKVEEEKRGGIETVEDYWLVGKKDMELILKMALWNFNRNLVIIEKIKNYKNPNMVDLSKCPFWVRIYDLLISQRTKTVALKVSLKNNMVIGGINKEVFVEGVMRKLRNEGEKEQNEGIDNRQELRVKIEDVADSLLKFRLSNEESYNKKNEVAKEKVVEEKEGTRSTSANPKEVAKKHKASTEIKEETHIHDMQIPKTGGKKKARNGAGETEDERMDMYNDGGLEQRD

SEQ ID NO: 179680 - protein, 90 aa, Glycine max
  Coding DNA Sequence Number=SeqID_62902
MFQQRQCLLVETTQLAWGKEGRANSFNPPGIWDSLEISEKNCFREDNLSRGASVTLPRHFHGRFREGFPPFFIVLHRSSFVLRRSSVFNR

SEQ ID NO: 179681 - protein, 55 aa, Glycine max
  Coding DNA Sequence Number=SeqID_62903
MALARDFCIRNTRMCTYAIFDSQSALSMHEIGPDESLPQRGPGKTRRPKELVSAP

SEQ ID NO: 179682 - protein, 347 aa, Glycine max
  Coding DNA Sequence Number=SeqID_62904
  Gene Ontology: Mol. function=hydrolase activity; Cellular component =membrane
  Homolog annotation: Hit_ID=Q1SUH7; Match level="QueryCoverage=99%, HitCoverage=19%, E-value=1e-144, Identity=75%"; Hit description =WW/Rsp5/WWP; Synaptojanin, N-terminal; Galactose-binding like
MVPSRPSGFVLKPIANLFPISGGEASLLSFKRKGQVWICPQPADVVEIFIYLGEPCHVCQLLLTISHGADDSTYPSTVDVRTGGHLDGLKLVLEGASIPQCASGTNLLIPLPGAINAEDMAITGANSRLHAQDASPLSLLYDFEELEGKWDFLTRVVALTFYPTVSGRKPLTLGEIEGKRDFLTRVVALTSYPTVSGRKPLTLGEIEILGVSLPWSDIFTNEGPGTRLVEHVKKFEEELNPFLSGSDTNPLNSSSSEKVSPPIQGGTSADLFIDLLSGEDPLSHPLAQPVTENVVYQESDPLDFLDLSVESHSAKSDGKVSSEDARHSDSSAEQYLKCLKTLAGPSL

SEQ ID NO: 179683 - protein, 359 aa, Glycine max
  Coding DNA Sequence Number=SeqID_62905
  Gene Ontology: Mol. function=pyridoxal phosphate binding; Cellular component=chloroplast; Biological process=cysteine biosynthetic process from serine
  Homolog annotation: Hit_ID=Q1SUH8; Match level="QueryCoverage=99%, HitCoverage=91%, E-value=1e-128, Identity=69%"; Hit description =Pyridoxal-5-phosphate-dependent enzyme, beta subunit
  Pfam annotation: Domain name=PALP; Domain location=81-359; Score =372.7; E_value=5.7e-109; Accession=PF00291.15; Description=Pyridoxal- phosphate dependent enzyme
  Subcellular localization annotation: CTP_CleavageSite=60; ConfidenceScore=5.87e-01
MASSASLINSLTCSSPAPTQHCFAFTRTTATATATSLRQFNSHRPPPLTTRISSSPSTVVCKAVSVKPQTETEGLNIADDVTQLIGKTPMVYLNNIVKGSVANIAAKLEIMEPCCSVKDRIGFSMINDAEQRGAITPGKSILVEPTSGNTGIGLAFIAASRGYKLILTMPASMSLERRVLLKAFGAELVLTDAAKGMNGACMNPMFLGMGTHAGCTIISSLQVHYETTGPEIWEDTRGKIDILVAGIGTGGTVSGAGQFLKQQNPKIQVIGVEPLESNILTGGKPGPHKIQGIGAGFVPRNLDQDVLDEVIAISSDEAVETAKQLALQEGLLVGISSGAAAAAALKVGKRPENAGKLIG

SEQ ID NO: 179684 - protein, 698 aa, Glycine max
  Coding DNA Sequence Number=SeqID_62906
  Gene Ontology: Mol. function=hydrolase activity; Cellular component =membrane
  Homolog annotation: Hit_ID=Q1SUH7; Match level="QueryCoverage=94%, HitCoverage=40%, E-value=0.0, Identity=83%"; Hit description =WW/Rsp5/WWP; Synaptojanin, N-terminal; Galactose-binding like
  Pfam annotation: Domain name=Syja_N; Domain location=116-434; Score= -116.8; E_value=0.00019; Accession=PF02383.9; Description=SacI homology domain
  Pfam annotation: Domain name=WW; Domain location=542-572; Score=54.0; E_value=4.9e-13; Accession=PF00397.16; Description=WW domain
  Pfam module annotation: Pfam domain module=Syja_N::WW; Domain location=116-434::542-572
  Subcellular localization annotation: CTP_CleavageSite=49; ConfidenceScore=5.66e-01
MESPGKPSNAGSIPYSVSSLSLPNFQPNSCSFLLSFKFSGALRDTSVIVVTLDSDEVFIIVSLCTRTDTQVIYVDPTTGALRHEAKLGFDLFKSQGEALDFITNGSRFASKSRTLARAILGYAALGNVALLLVATRLIASVPNLPGGGCVYTVAESQWIRIPLQNAVAQGKGEVKNVQELTELDIDGKHYFCETRDVTRPFPSRMPVNEPDQEFVWNAWLSTPFVGVGLPRHCVTLLQLRVFVCENWFPREGFAEYRSFGSSGQLEGVVALTARRSRLHPGNEVECEQLVWVPKRAGQSVPFNRYVWRRGTIPIWWGAELKITAAEAEIYVSDCDPYKGSVQYYERLSKRYDARNLDIRAGENSNRKALVPIVCINLLRNGEGKSESLLVQHFEESINFIRSIGKLPNTRVHLINYDWHASVKLKGEQMTIEGLWKLLKAPTVSIGISEGDYLPSRQRINDCRGEVIYNDGFEGAFCLRTNQNGIVRFNCADSLDRTNAASFFGCLQVFTEQCRRLGISLDSDLAFGYQSMNNNYGGYIAPLPPGWEKRSDAVTGKTYYIDHNTRTTTWMHPCPDKPWKRFDMTFEEFKRSTILSPVSQLADLFLLAGDIHATLYTGSKAMHSQILSIFNEDTGGKFKQFSAAQNVKITLQRRYKNAVVDSSRQKQLEMFLGMRLFKHLPSISLQPLHVCDLPTVKVN

SEQ ID NO: 179685 - protein, 276 aa, Glycine max
  Coding DNA Sequence Number=SeqID_62907
  Gene Ontology: Mol. function=hydrolase activity; Cellular component =membrane
  Homolog annotation: Hit_ID=Q1SUH7; Match level="QueryCoverage=99%, HitCoverage=17%, E-value=1e-123, Identity=79%"; Hit description =WW/Rsp5/WWP; Synaptojanin, N-terminal; Galactose-binding like
MQRKINFIEAIKLEIERLKLNLSAAERDRALLSVGMDPATLNPNTLLDEAYMGRLSKVASNLALLGEASLEDKIVGAIGLGTVDDNPIDFWNIIRIGETCSGGKCEVRAEIRKEVHSSNTMSSAGASETVFLCSQCERKVCRVCCAGRGALLLIGYNSREVQVDLPVNRLLARDGIICKRCCQDVVLHALILDYVRVLISLRRTERVEKSAYNALKQIIGSSWDCHLEKNRFSDSKSAGKAVQLLLNGYESLAEFPFGSFLHPPHAVASTKNVLNP

SEQ ID NO: 179686 - protein, 321 aa, Glycine max
  Coding DNA Sequence Number=SeqID_62908
  Gene Ontology: Mol. function=hydrolase activity; Cellular component =membrane
  Homolog annotation: Hit_ID=Q1SUH7; Match level="QueryCoverage=91%, HitCoverage=18%, E-value=1e-140, Identity=85%"; Hit description =WW/Rsp5/WWP; Synaptojanin, N-terminal; Galactose-binding like
MQMQVETATDSAPFLSLIAPLNSGLRLSYWKAPSIASSVEFGIVLGNISDVSGVILIVSPCGYSMADAPIVQIWASNKIHKEERSLMGKWDLQSMIKASSELNGPEKSGTEHKVPRHVKFPFKNSVRCRIIWISLRLQRPGSSSINIGNDFNLLSLDENPFAQETRRASFGGSAESEPCLHAKRILVVGSPIRKEVDLKPQQSSDQMAMTGWLERAPQLNRFKVPIEAERLMGNDLVLEQYLSPASPLLAGFRLDAFSAIKPRVTHSPFSDAHSKNFPSLVDDKYITPAVLYIQVSVLQVYPWRFSFDELLCFARALILCA

SEQ ID NO: 179687 - protein, 146 aa, Glycine max
  Coding DNA Sequence Number=SeqID_62909
  Gene Ontology: Mol. function=hydrolase activity; Biological process =metabolic process
  Homolog annotation: Hit_ID=Q1SUH1; Match level="QueryCoverage=70%, HitCoverage=30%, E-value=4e-44, Identity=82%"; Hit description =Haloacid dehalogenase-like hydrolase
MNPKCSVPPPQIRPFQFQNLNGLRQLAETRRFKGWLLDQFGVLHDGKEPYPGAISTLENIAKTGAKMVIISNSSRRSSVTIEKVKGLGFDASLFLGAITSGELTHQYLQRRDDPWFATLGRSCIHFTWNGRGAISLEVGRAAMILA

SEQ ID NO: 179688 - protein, 265 aa, Glycine max
  Coding DNA Sequence Number=SeqID_62910
MAFLGETSSQTIVNSRLAFIYPNGSIIHNDTGVYFQTSTPVPIRVPNRCDFASLKTRIHNTLQLSDKQFLDEIHYRKPFTDTGNQIRFECIKLINDDDVNTMLMCNDQFSCVGPIELLCTVGRTPDGIINLLEGTMPRIHDAILYYNGKWNMPPQNKFVGCAFTGKNPKKFQIPSTCTIDELKNLIKQVAPKGIPPLGIHESQTVRRLFFRQPARFEYSDTVIKYEINELITNEELLKVLVQSNYWKKYGQIEILAVFTKYVEDE

SEQ ID NO: 179689 - protein, 143 aa, Glycine max
  Coding DNA Sequence Number=SeqID_62911
MSFDRDCCSLHFFIQRQPSPMVCEDHHDHLLSLFQDYQSPLSTQRQASLMVCGGDDGHPFLIVSFLRFIAVPFATQRQASPMASGDRPWSFIVLKIIEVSPAIPRQSSPMACGDHHSHLFLIAFKVSLIGLVVGWVENSLERN

SEQ ID NO: 179690 - protein, 175 aa, Glycine max
  Coding DNA Sequence Number=SeqID_62912
MCQGWNPDPTDVECTDKNSRSAAPDTYVWQPTGQPHVVYSVPTSVGEQRWTLEVAVVYPPLPAAIRPSTIVVRAVLLDESPINRTSDELAGGDGHSIELTEACNQSGKSQGPVGLLWVHWVRVVVVGQNVAKLQRHPDLCEGGHPLHRSLRPDSFSGYTRTTGPLPRSVGAPETD

SEQ ID NO: 179691 - protein, 146 aa, Glycine max
  Coding DNA Sequence Number=SeqID_62913
DLELICGGVSDGWFESLREWKIGDGSNTKFWEDSWREWFEWERSSVDEFHKMVEDANLINQGDDCWLWVKDVFSLFYDRISSKINLVRRGVQLDDGGITCPLCQEEEEETSHILGHWWDIAWSAIVWCIWNQRNAVIFKANVVTMI

SEQ ID NO: 179692 - protein, 76 aa, Glycine max
  Coding DNA Sequence Number=SeqID_62914
MTNRLRYLLFPLTKIQRTNRLRILCPNTLEVQVEGTSTWLFKENKEGTSLMDLWLVKDFTRLKRNLKNRRLLGDQM

SEQ ID NO: 179693 - protein, 189 aa, Glycine max
  Coding DNA Sequence Number=SeqID_62915
  Gene Ontology: Mol. function=transcription regulator activity; Cellular component=nucleus; Biological process=regulation of transcription
  Homolog annotation: Hit_ID=Q9LSL1; Match level="QueryCoverage=98%, HitCoverage=56%, E-value=1e-64, Identity=66%"; Hit description =Arabidopsis thaliana genomic DNA, chromosome 5, TAC clone:K21L13
  Pfam annotation: Domain name=HLH; Domain location=23-72; Score=40.3; E_value=6.6e-09; Accession=PF00010.16; Description=Helix-loop-helix DNA-binding domain
  Subcellular localization annotation: CTP_CleavageSite=29; ConfidenceScore=5.13e-01
MPAFNMGTGLERKNNRSKKLQGQPSKNLMAERRRRKRLNDRLSMLRAIVPKISKMDRTSILGDTIDYMKELLEKINNLQQVEVDSSMAGIFKDVKPNEIIVRNSPKFEVERSVDTRVEICCAGKPGLLLSTVNTVEALGLEIQQCVISCFNDFTMQASCSEELEQRAMLSSEDIKQALFRSAGYGGRCL

SEQ ID NO: 179694 - protein, 131 aa, Glycine max
  Coding DNA Sequence Number=SeqID_62916
MVRIRGLRQVLDRVLDKALGRHVIGDEEEAPQRRRQTTLTRRQRKAATIVEDVNHMNHAADESLFATYIKLFKLLEYGFHLFDYADFGLSENYQCQHNSFTQTQQQSGLTHAMPISLLYKSDVAHDFSNTA

SEQ ID NO: 179695 - protein, 88 aa, Glycine max
  Coding DNA Sequence Number=SeqID_62917
  Homolog annotation: Hit_ID=Q5ZFS5; Match level="QueryCoverage=67%, HitCoverage=19%, E-value=8e-10, Identity=53%"; Hit description=Nod factor-like protein
MIVLTAYKKDDFFDTISCNSLTHGSRNGQNRFSERMKQDTETFGNFQQRPNFTNGGYGAGRGANFRGSNNWGRGYGYNGRGRGPNFPF

SEQ ID NO: 179696 - protein, 305 aa, Glycine max
  Coding DNA Sequence Number=SeqID_62918
  Pfam annotation: Domain name=DUF1218; Domain location=139-253; Score =87.9; E_value=3.1e-23; Accession=PF06749.3; Description=Protein of unknown function (DUF1218)
MPITISKVYNNNILCNFRCLSLLPFQQAVDQLKTNGKGLAGFSQFRIHAVRNGISFKTMIDILGRKSQLLLLQRKELKQGTKNNHPIMMESPPKCKLTFTLIFFIVVSHSLGLVSFTLCIASETKRNKKGDLRWNGKLCHLPSSPAFGLGIASLVCLVLSQIVGNSILFKTYCSGGKRNAKCEIPFVARILLLISWLSFGIAVILLIVATSMSRRQAYGEGWLNGECYLVKGGIYVGSAILILVSVESLMGSALLTMKTNEEADQECRVGVLMQIKKAITSTTPKRGLTSWHRERFKPTIQSVLS

SEQ ID NO: 179697 - protein, 773 aa, Glycine max
  Coding DNA Sequence Number=SeqID_62919
  Gene Ontology: Mol. function=oxidoreductase activity, acting on CH-OH group of donors; Biological process=electron transport
  Homolog annotation: Hit_ID=UPI000034F0B9; Match level="QueryCoverage =91%, HitCoverage=100%, E-value=0.0, Identity=52%"; Hit description =electron carrier
  Pfam annotation: Domain name=DAO; Domain location=263-602; Score= -61.6; E_value=0.075; Accession=PF01266.14; Description=FAD dependent oxidoreductase
  Pfam annotation: Domain name=GMC_oxred_C; Domain location=609-759; Score=-42.0; E_value=0.003; Accession=PF05199.4; Description=GMC oxidoreductase
  Pfam annotation: Domain name=GMC_oxred_N; Domain location=309-542; Score=307.6; E_value=2.3e-89; Accession=PF00732.10; Description=GMC oxidoreductase
  Pfam module annotation: Pfam domain module=DAO::GMC_oxred_C::GMC _oxred_N; Domain location=263-602::609-759::309-542
MEDRTIGRNGSSSRKGSFRLGLGMDGKKDHTVVELGSIDTQRLLLSNGEREKKLQPLTNTLSPRQMKSLYALCDTILPSVDHFVDTSDESVTKFYQISASMTGTPEQIEAPLDRVTEVCVMAVVYVKRQQIMRSWSLSYLRHFRMLFRTIKLLTLLIFFTQIDESEDNVAWKAIGYCGPDPEFKARLKSHFLDGTSKGGQEDKEDEDAEEVIGPLYKGLVHLNYPRDITADALKRLGFPVSVIRQKHKAAANLSSPSLVIQCDAVVVGSGSGGGVIAGVLAKAGYKVLVLEKGGYSARNNLSLLEGPTMDQMYLNGGLVASDDMGVFILSGSTVGGGSAINWSACIKTPQHVCKEWSDKHGLELFESELYREALNAVCEKMEVQSEIEDEGFNNAILRKGCQEMGYPVSNIPRNSASDHYCGWCCMGCKDGRKKGTSETWLVDLVKSGNGAILPGCEAIKVLHKKKEGRDRKIARGVAFEFEYKGTKDICVVESKVTIVACGALSTPALLKKSGLRNQNIGRNLHLHPVAMAWGYFPDAPESEVWPEAYKKSYEGGIMTAMSTVVAEFEQSGYGAVIQTPSLHPGMFSIVTPWTSGIDIRDRMRKFSRTAHIFALARDQGSGTVKAPDRISYKPAGVDEENLKKGIEKVLRILAAAGAEEIGTHHNKGRTLNVKQVRYHEFEKFVKEESSRSLTDLTTPLCSAHQMGSCRMGSNPKQSAVNQTGETWEVEGLYVADTSVFPTALGVNPMVTVQAIAYCTAQSVVEVLRRKRTK

SEQ ID NO: 179698 - protein, 67 aa, Glycine max
  Coding DNA Sequence Number=SeqID_62920
MTGCGSSISTPFQKVLTVFLVKKTEDQARVRDTYNVALFSIKEINRKSSRPCRKRQLDLLQQRSVLT

SEQ ID NO: 179699 - protein, 111 aa, Glycine max
  Coding DNA Sequence Number=SeqID_62921
EVVAAQLAQASSARPGEQGCFLQKQPPSGGIFWRVQMGLGPKNGRTSSSKGPRTKLGYDRREDIVEMYLRRFHESHLPSLSRFGFSPILKFGGEGGFGIADNCPVPAPAPH

SEQ ID NO: 179700 - protein, 167 aa, Glycine max
  Coding DNA Sequence Number=SeqID_62922
MTRKDAAGEGSSAAPQVDVEFDGHRFWSEEHQHRFEAIKGWSFLMERRVQLRDREYAKFQEEIARRQWTQLVSPMAKGESQRQALLGEGPRIPFDEDAINQFLGHPLVLEEGQRCEFSQRRSQASRFNEEAISQLLCVPGKTLPVAWQGDRCGSCALDFNVFRSRLS

SEQ ID NO: 179701 - protein, 334 aa, Glycine max
  Coding DNA Sequence Number=SeqID_62923
  Subcellular localization annotation: CTP_CleavageSite=25; ConfidenceScore=5.02e-01
MNLQIKSPTPSSKSEEQVFSDPAVIQSEYSGLRSSPVGELPSSPVAGLLSSPVASVGGRSLTESIQRQDSPAISSKAFPSGLPSHQSVTQLGPSNLSDATQVASHPSFSAAMYWQGPSGISSSSYHSLLQSSSLHPTSLAASLVVQNQMQNAETQVPINGGWTGLSEYGLPVSSAMTSLVNQTHSPSLTSLKNSDSLDIPSLLSTKTPVSYSPSMTFDGSNMPQFSSTLQDINSIQAQISGNICPDPRPIHPQHSVHRSAPSYVDSTSGSLPTATSLLTPDQFAYPREQLLSLSHLNPTQKDMGSLTLTSSGSSALIPSPASQHHCFHYQLQCK

SEQ ID NO: 179702 - protein, 73 aa, Glycine max
  Coding DNA Sequence Number=SeqID_62924
  Homolog annotation: Hit_ID=Q9FH77; Match level="QueryCoverage=56%, HitCoverage=7%, E-value=1e-09, Identity=69%"; Hit description =Arabidopsis thaliana genomic DNA, chromosome 5, TAC clone:K9E15
MATESGANGPSSSSAESFIGCFISLISKCEIRYEGVLYFLNIQDSTIGLKNEPKIMHNLLLQTPETERAAGEW

SEQ ID NO: 179703 - protein, 973 aa, Glycine max
  Coding DNA Sequence Number=SeqID_62925
  Gene Ontology: Mol. function=binding; Cellular component=trans-Golgi network; Biological process=protein transport
  Homolog annotation: Hit_ID=Q9C6W3; Match level="QueryCoverage=99%, HitCoverage=98%, E-value=0.0, Identity=64%"; Hit description=Epsilon- adaptin, putative
  Pfam annotation: Domain name=Adaptin_N; Domain location=27-590; Score= 186.2; E_value=8.1e-53; Accession=PF01602.10; Description=Adaptin N terminal region
  Pfam annotation: Domain name=HEAT; Domain location=138-174; Score =22.5; E_value=0.0015; Accession=PF02985.12; Description=HEAT repeat
  Pfam annotation: Domain name=HEAT; Domain location=306-342; Score =7.5; E_value=5.2; Accession=PF02985.12; Description=HEAT repeat
  Pfam module annotation: Pfam domain module=Adaptin_N::HEAT::HEAT; Domain location=27-590::138-174::306-342
MGSHHGHSKEFLDLIKSIGEARSKAEEDRIVLREIETLKRLLNDADTPKRKIKEYIIRLLYVEMLGHDASFGYIHAVKMTHHDALLLKRTGYLAVTLFLSDDHDLIILIVNTIQKDLASDNYLVVCAALNAVCRLINEETIPAVLPRVVDLLNHSKDAVRKKAVMSLHRFYLKSPSSVSHLLSNFRKRLCDNDPGVMGASLCPLFNLVSDDVHSYKDLVVSFVNILKQVAEHRLPKTYDYHQMPAPFIQIKLLKILALLGSGDKQASGHMYTVLEDIIRRSDSMTNIGNAVLYQCICCVASIYPNPKLLEAAADVIAKFLKSDSHNLKYMGIDALGRLIKLSPHIAEQHQLAVIDCLEIKAVGDFDPDDSLKRKTFELLYKMTKSSNVEVIVDRMIDYMISISDDHYKTYIASRCVELAEQFAPSNHWFIQTMNKVFEHAGDLVNIKVAHNLMRLIAEGFGEDDDAADSQLRSSAAESYLRIIGEPKLPSVFLQVICWVLGEYGTADGKYSASYISGKLCDIAEAYSNDENVKAYAISALLKIYAFEVAAGRKVDILSECQSLIEESLASHSTDLQQRAYELQALIGLDVQAVETIMPRDASCEDIEVDKNLSFLNGYVQQSLERGAKSYIPEDVRTGMGNMNNFRSQDHHETLQHGLRFEAYEVPKAPMQPKVTPVSFASSADIVPVPEVLSSRETHHISSVGSTSEAGSSELKLRLDGVQKKWGKPMYSSSTSSASVSYSTSQKPTNGATQVDGATTVNSKVRDSYDSRKTQVEITPEKQKLAASLFGGSTKPEKRSSTSHKVSKSSASAADGSQGSKAAVVPNDVAVEKTIHQPPPPDLLDLGEPTVTTAPPYVDPFKELEGLLDPSTKSATNHNVAAATNAPDIMSLYAETTASGGYSIPVSGGYDVNLLSELSNAAAKATSGETIVTSLPQSIMGRNAKDSLEKDALVRQMGVNPSSQNPNLFSDLLG

SEQ ID NO: 179704 - protein, 87 aa, Glycine max
  Coding DNA Sequence Number=SeqID_62926
PWGFQLWLRASIVLQGARSPRQGHIIIGIVPARHPVDPKKFSRVLELSSSNYGQAQGETPQQPGDGQQRATDTPPSPLDFTSAHPQK

SEQ ID NO: 179705 - protein, 147 aa, Glycine max
  Coding DNA Sequence Number=SeqID_62927
MKEHFHKPVRSRNTRFPRIEGITRFQRIEENTRKQKSGKTIWMKGLLAIPNAPDKPLDNSITTRSQTFLAWFMSLFLVSTSTSTYFSHKMVLVELDGVDDFMLGRADLNLFMLTNLAENLLDGDLNWSVGFVCKPQRDWEEESFPDL

SEQ ID NO: 179706 - protein, 462 aa, Glycine max
  Coding DNA Sequence Number=SeqID_62928
  Gene Ontology: Mol. function=oxidoreductase activity; Biological process=electron transport
  Homolog annotation: Hit_ID=Q9LJI8; Match level="QueryCoverage=93%, HitCoverage=85%, E-value=2e-76, Identity=40%"; Hit description =Arabidopsis thaliana genomic DNA, chromosome 3, P1 clone: MZN14
MAKAVVGEETRLKLAEDRLSQSAVPSEALTHSIVGLLIGKFSSALGRAFLFDLIPTPHNDSGEPACSLTEPDKKKGPKSKSKSELADSSSLFIDKDWVAEHVRQVSRMLVGGIKVVGLYVWVSDAAFKNSTIMLCQTVKGVADAAPGLDGNWDERLLLHISYSPRRWNCRNCSLSSNITSSSLRPCDFKMGKVLTSLQTFKCMHNFNLRLPILRDSASKFQTLSDVLRHAISIHAKELAGAKALIDGKLVVESESYSSDGVHEVELLLSFLNDSSIEACSQGDVVGILSFSGLICSFAYLNSKEPISQAITDIKGDIITSLQSRLDIICDEVDADSGNNHDVGSQVSDELSAETPVPQLVLHLLRLLWDLSPTVGLFQTTAAKVVIPCMKLPPLGRVDICSFSSCSSQGDLINNLGRKGCSLPFPRRVFAPWLAVVYTNCYCVGSFCITCIVAENRFFVEEF

SEQ ID NO: 179707 - protein, 383 aa, Glycine max
  Coding DNA Sequence Number=SeqID_62929
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=96%, HitCoverage=96%, E-value=0.0, Identity=78%"; Hit description=Ser/Thr protein kinase
  Pfam annotation: Domain name=NAF; Domain location=241-302; Score =108.2; E_value=2.5e-29; Accession=PF03822.5; Description=NAF domain
  Pfam annotation: Domain name=Pkinase; Domain location=9-199; Score =146.4; E_value=7.6e-41; Accession=PF00069.15; Description=Protein kinase domain
  Pfam annotation: Domain name=Pkinase_Tyr; Domain location=9-197; Score=-58.3; E_value=6.8e-09; Accession=PF07714.7; Description =Protein tyrosine kinase
  Pfam module annotation: Pfam domain module=NAF::Pkinase::Pkinase_Tyr; Domain location=241-302::9-199::9-197
MVVRKVGKYEIGRTIGEGTFAKVKFAQNTETGESVAMKVLDRSTIIKHKMVDQVLASRTKIYIILEFITGGELFDKIIHHGRLSEADSRRYFQQLIDGVDYCHSKGVYHRDLKPENLLLNSLGNIKISDFGLSAFPEQGVSILRTTCGTPNYVAPEIERAEFSCPSWFPVGAKMLIHRILDPNPETRITIEQIRNDEWFQRSYVPVSLLEYEDVNLDDVNAAFDDAEEPRADQQCDKEDMGPLMLNAFDLIILSQGLNLATIFDRGQDSVKYQTRFISQKPAKVVLSSMEVVAQSMGFKTHIRNYKMRVEGISANKTSYFSVILEIFEVAPTFYMVDIQKAAGDTGEYLKFYKNFCSNLEDIIWKPPHEASKSRISKTKSKRR

SEQ ID NO: 179708 - protein, 197 aa, Glycine max
  Coding DNA Sequence Number=SeqID_62930
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPIKLKGKFYRTAVRPAILYGTECWAVKSQHENKVGVTEMRMLRWMCGKTRQDKIRNEAIRERVGVAPIVEKMVENRLRWFGHVERRPVDSVVRRVDQMERRQTIRGRGRPKKTIREDVFDEIATLGEWSGTTGAGEAVTSLQSITGQDIAFPNIWRCVAIETKQG

SEQ ID NO: 179709 - protein, 86 aa, Glycine max
  Coding DNA Sequence Number=SeqID_62931
MASTRFSRWKLSLDQHTLLRRKVTMDRYCIMHGHVERLAKAMVKGVRYYGATSGGLNQQRTGVNLWTLEIILVKQGIVHLEVPVQK

SEQ ID NO: 179710 - protein, 54 aa, Glycine max
  Coding DNA Sequence Number=SeqID_62932
  Homolog annotation: Hit_ID=Q8L7A5; Match level="QueryCoverage=65%, HitCoverage=18%, E-value=5e-10, Identity=75%"; Hit description =Expressed protein
MARKDELVNTPWQPCPIKTLVYALTVIGLFLRQILICILFIALETLKDAKFVTT

SEQ ID NO: 179711 - protein, 603 aa, Glycine max
  Coding DNA Sequence Number=SeqID_62933
  Gene Ontology: Mol. function=helicase activity; Cellular component =mitochondrion; Biological process=protein amino acid phosphorylation
  Homolog annotation: Hit_ID=Q6Z7E0; Match level="QueryCoverage=86%, HitCoverage=92%, E-value=1e-163, Identity=52%"; Hit description =Putative pentatricopeptide (PPR) repeat-containing protein
  Pfam annotation: Domain name=PPR; Domain location=108-142; Score =15.8; E_value=0.1; Accession=PF01535.11; Description=PPR repeat
  Pfam annotation: Domain name=PPR; Domain location=143-177; Score =32.7; E_value=1.3e-06; Accession=PF01535.11; Description=PPR repeat
  Pfam annotation: Domain name=PPR; Domain location=210-244; Score =34.8; E_value=3e-07; Accession=PF01535.11; Description=PPR repeat
  Pfam annotation: Domain name=PPR; Domain location=245-279; Score =38.2; E_value=2.8e-08; Accession=PF01535.11; Description=PPR repeat
  Pfam annotation: Domain name=PPR; Domain location=280-314; Score =47.3; E_value=5.1e-11; Accession=PF01535.11; Description=PPR repeat
  Pfam annotation: Domain name=PPR; Domain location=315-349; Score =35.4; E_value=2e-07; Accession=PF01535.11; Description=PPR repeat
  Pfam annotation: Domain name=PPR; Domain location=350-384; Score =41.8; E_value=2.3e-09; Accession=PF01535.11; Description=PPR repeat
  Pfam annotation: Domain name=PPR; Domain location=385-419; Score =40.6; E_value=5.2e-09; Accession=PF01535.11; Description=PPR repeat
  Pfam annotation: Domain name=PPR; Domain location=420-454; Score =38.3; E_value=2.7e-08; Accession=PF01535.11; Description=PPR repeat
  Pfam annotation: Domain name=PPR; Domain location=455-489; Score =49.7; E_value=1e-11; Accession=PF01535.11; Description=PPR repeat
  Pfam annotation: Domain name=PPR; Domain location=490-524; Score =40.6; E_value=5.6e-09; Accession=PF01535.11; Description=PPR repeat
  Pfam annotation: Domain name=PPR; Domain location=525-559; Score =36.5; E_value=9.3e-08; Accession=PF01535.11; Description=PPR repeat
  Pfam annotation: Domain name=PPR; Domain location=560-594; Score =27.3; E_value=5.3e-05; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=108-142::143 -177::210-244::245-279::280-314::315-349::350-384::385-419::420 -454::455-489::490-524::525-559::560-594
  Subcellular localization annotation: CTP_CleavageSite=61; ConfidenceScore=5.65e-01
MDLVAPTEQFCSFHPFHITRARVSDNTVSRPFVLSPASSVSHHFTKLKATRSRKRLENRVSAVSKSEASGMNGRLQQIVSTPNGDLNGIGMESSSPNGVNGSRSFEEFASNIHLRKLVRNGELEEGLKFLERMIYQGDIPDVIACTSLIRGFCRSGKTRKATRIMEILENSGAVPDVITYNVLIGGYCKSGEIDKALQVLERMSVAPDVVTYNTILRSLCDSGKLKEAMEVLDRQMQRECYPDVITYTILIEATCNDSGVGQAMKLLDEMRKKGCKPDVVTYNVLINGICKEGRLDEAIKFLNNMPLYGCQPNVITHNIILRSMCSTGRWMDAERLLADMLRKGCSPSVVTFNILINFLCRKRLLGRAIDVLEKMPKHGCMPNSLSYNPLLHGFCQEKKMDRAIEYLEIMVSRGCYPDIVTYNTLLTALCKDGKADAAVEILNQLSSKGCSPVLITYNTVIDGLTKVGKTEYAAELLEEMRRKGLKPDIITYSTLLRGLGCEGKVDEAIKIFHDMEGLSIKPSAVTYNAIMLGLCKAQQTSRAIDFLAYMVEKGCKPTKATYTILIEGIADEGLAEEALELLNELCSRGFVKKSSAEQVAVKM

SEQ ID NO: 179712 - protein, 68 aa, Glycine max
  Coding DNA Sequence Number=SeqID_62934
MNDEVTEGGVLTTTTKSDRSRDTCHTTECVEITLLWETAVPEVHNRKQSRRTQHFIRCRIIAEICLVP

SEQ ID NO: 179713 - protein, 428 aa, Glycine max
  Coding DNA Sequence Number=SeqID_62935
  Gene Ontology: Mol. function=carbohydrate binding; Biological process= DNA integration
  Homolog annotation: Hit_ID=UPI00005DC1AF; Match level="QueryCoverage =81%, HitCoverage=99%, E-value=1e-127, Identity=68%"; Hit description= lyase
  Pfam annotation: Domain name=Rhamnogal_lyase; Domain location=1-167; Score=376.8; E_value=3.4e-110; Accession=PF06045.2; Description =Rhamnogalacturonate lyase family
MDNGIVQVTLSNPDGIVTGIRYNGVDNLLEVLNKETNRGIKGTCFKVIVQNEEQVELSFARMWDHSLEGKFVPLNIDKRFIMLRGSSGFYSYGIYEHLNGWPDFDISETRITFKLRKDKFQYMAMADNRQRVMPFPEDRLAGRCQTLGYPEAVLLVNPKDPRLKGEVDDKYQYSCVNMNNRVHGWISFSPPVGFWQITPSDEFRSGGPLKQNLTSHVGPTTLAMFLSSHYAGQDLVPKFRGGESWKKVFGPVYIYLNSGAVGDNPLWLWEDAKIQMMNEVQSWPYSFPASEDFLKSDQRGNVSGRLLVLDRDGPTLWEIGIPDRSAAEFYAPDPSPQHINKLFINHPDRQYGLWDRYSELYPDADLVYTIGVSDYTKDWFYAQAPRKKVDNTLQGTTWQIKFEICSVVKGSTYKLRVAIASATLAELQ

SEQ ID NO: 179714 - protein, 86 aa, Glycine max
  Coding DNA Sequence Number=SeqID_62936
MEEMCDSGRGDRGNFHYTCKQDGHAQDNCYSLHGFPYKIAKVSQSLNLAIEQKIKSERNHLSLFSANEYKGYLQLRKPNEPFLQPL

SEQ ID NO: 179715 - protein, 78 aa, Glycine max
  Coding DNA Sequence Number=SeqID_62937
MALICEIVTCWHRISKAYQTTCEDPVILECMVEQQILPTPKRESGLALTELVTQCAQCRVGLALTSHPLVLNKEEKSI

SEQ ID NO: 179716 - protein, 737 aa, Glycine max
  Coding DNA Sequence Number=SeqID_62938
  Gene Ontology: Mol. function=helicase activity; Cellular component =mitochondrion; Biological process=embryonic development ending in seed dormancy
  Homolog annotation: Hit_ID=Q6K8I3; Match level="QueryCoverage=64%, HitCoverage=97%, E-value=1e-105, Identity=39%"; Hit description =Fertility restorer homologue A-like
  Pfam annotation: Domain name=PPR; Domain location=127-161; Score=7.4; E_value=1; Accession=PF01535.11; Description=PPR repeat
  Pfam annotation: Domain name=PPR; Domain location=234-268; Score =28.6; E_value=2.1e-05; Accession=PF01535.11; Description=PPR repeat
  Pfam annotation: Domain name=PPR; Domain location=270-304; Score =49.3; E_value=1.3e-11; Accession=PF01535.11; Description=PPR repeat
  Pfam annotation: Domain name=PPR; Domain location=306-340; Score =45.3; E_value=2.1e-10; Accession=PF01535.11; Description=PPR repeat
  Pfam annotation: Domain name=PPR; Domain location=341-375; Score =37.7; E_value=4.1e-08; Accession=PF01535.11; Description=PPR repeat
  Pfam annotation: Domain name=PPR; Domain location=376-410; Score =55.5; E_value=1.7e-13; Accession=PF01535.11; Description=PPR repeat
  Pfam annotation: Domain name=PPR; Domain location=411-445; Score =37.8; E_value=3.6e-08; Accession=PF01535.11; Description=PPR repeat
  Pfam annotation: Domain name=PPR; Domain location=446-480; Score =15.8; E_value=0.1; Accession=PF01535.11; Description=PPR repeat
  Pfam annotation: Domain name=PPR; Domain location=481-515; Score =16.6; E_value=0.081; Accession=PF01535.11; Description=PPR repeat
  Pfam module annotation: Pfam domain module=PPR::PPR::PPR::PPR::PPR::PP R::PPR::PPR::PPR; Domain location=127-161::234-268::270-304::306 -340::341-375::376-410::411-445::446-480::481-515
MGRVIGLTGVRNGFHNMLLLQATTSFAPGEFGTDDITHLMVVLNVCRIMKFCAMYRSRHGSWLPWISPLKFTKADPPPEPLPSPPRKRKHISHDSAIDLIKREKDPQHALNIFNMVSEQNGFQHNNATYATILDKLARCNNFHAVDRVLHQMTYETCKFHEGIFVNLMKHFSKSSLHEKLLHAYFSIQPIVREKPSPKALSTCLNLLLDSNRVDLARKLLLHAKRDLTRKPNVCVFNILVKYHCKNGDLDSAFEIVEEMRNSEFSYPNLVTYSTLMDGLCRNGRVKEAFDLFEEMVSRDHIVPDPLTYNVLINGFCRGGKPDRARNVIQFMKSNGCYPNVYNYSALVDGLCKVGKLEDAKGVLAEIKGSGLKPDAVTYTSLINFLCRNGKSDEAIELLEEMKENGCQADSVTFNVLLGGLCREGKFEEALDMVEKLPQQGVYLNKGSYRIVLNSLTQKCELKRAKELLGLMLRRGFQPHYATSNELLVCLCKAGMVDDAAVALFDLVEMGFQPGLETWEVLIGLICRERKLLFSIFYSMGIGGSALGPHFVAEALAPDNPPLKDLMTTLPSFTSLPQIRFVDNTDPAGVDHQIAQLGLELASTLVIVISKSGGTPETRNGLLEVQKAFREAGLDLPKQGVAITQENSLLDNTARIEGWLARLPMFDWVGGRTSEMSAVGLLPAALQGIDIIEMLAGASLMDEANRSTALRSNPAALLALCWYWATDGLGSKLRIMIG

SEQ ID NO: 179717 - protein, 212 aa, Glycine max
  Coding DNA Sequence Number=SeqID_62939
MVGASVNWFPRWKEGRTEVLSLCEGFSNIPLMGTMGCINYNLILAIRQLGYPMRGASSEESITPFIARGFTDPNARIFQGVRKAWNVVQRKHKELRGSINRIIDSYHKWLKAQTQELVWLPNLKASSEEEAETPEESEEVQALNAELERAQVVQEKFKMTTIKVRKECDKSRDVNVAIAKALERETKRVPKEEWGRDKFRGALWDNNSELKL

SEQ ID NO: 179718 - protein, 101 aa, Glycine max
  Coding DNA Sequence Number=SeqID_62940
MGGVNSNLTHLGLPEDYKKRVGKEGRRKGFSPSGIEESLKISEKNCFHGKNPSQGTSVTLLRRFLKRFHGDSSPFFIILRCSSVFNRKFPKSNLSIHSTYP

SEQ ID NO: 179719 - protein, 96 aa, Glycine max
  Coding DNA Sequence Number=SeqID_62941
  Gene Ontology: Mol. function=RNA-directed DNA polymerase activity; Biological process=RNA-dependent DNA replication
MASEDIEKMAFVTLWGTFCYKVISFRLKNAGATYQRAMVALFHDMMHKEIKVYVDDMIAKSKIEEEHLDQAMPYESFGACATRAGKTPYSIHDCAG

SEQ ID NO: 179720 - protein, 97 aa, Glycine max
  Coding DNA Sequence Number=SeqID_62942
  Subcellular localization annotation: CTP_CleavageSite=48; ConfidenceScore=5.27e-01
MRTAILACCTAHSAAPAWPVPLTPSPEAYVVGTRQSNWRFPLLCMSPLGMMSSRLHVHIATRSGESFTNSKPASPIGGLLAPCMHFTSKRAPLDKLF

SEQ ID NO: 179721 - protein, 249 aa, Glycine max
  Coding DNA Sequence Number=SeqID_62943
MGYLISHQISLTAQHDTSRLGFPTLITTLCKARGVQSNSRSLESLNPTINLAYIKKNCWNLDDPTVTFRGPRKARGNRSEAPSTSAPSEAPTPSSSTLPPSSSTKIRLIPPAPSQIPLPAPVSVGPADFIFTPQMIHSMLQSIHRVQYIIMQSLQGLGLPSIISIEEFDAQVAWPGDQPSSSGGGGASTAQEPMTEEPPAPAPSPPAAEEETTLAQTPQPSPPSAPTLEEIQPSAMDLNEDQPQEEPDV

SEQ ID NO: 179722 - protein, 301 aa, Glycine max
  Coding DNA Sequence Number=SeqID_62944
  Gene Ontology: Mol. function=nucleotide binding
  Homolog annotation: Hit_ID=Q9ZVF7; Match level="QueryCoverage=95%, HitCoverage=41%, E-value=1e-113, Identity=70%"; Hit description =Similar to axi 1 protein from Nicotiana tabacum
  Pfam annotation: Domain name=DUF246; Domain location=1-200; Score =164.6; E_value=2.5e-46; Accession=PF03138.5; Description=Plant protein family
MRKHSAINGGKYVSVHLRFEEDMVAFSCCVFDGGKQEREDMIAARERGWKGKFTKPGRVIRPGAIRINGKCPLTPLEVGLMLRGMGFTKNTSIFLASGKIYNAEKTMAPLLQMFPNLHTKETLASEEELAPFKNYSSRMAAIDYTVCLHSEVFVTTQGGNFPHFLLGHRRYLYGGHSKTIKPDKRKLALLFDNPNIGNKIIFANDTFDATKLLDDAVFLLWTWLRNLEKDFVTHYNHWSSNITSGFSRWKSLKRQLLSMRSHSDSKGVELKRPNDSIYSFPCPDCMCRANRTDDSRSSSAT

SEQ ID NO: 179723 - protein, 193 aa, Glycine max
  Coding DNA Sequence Number=SeqID_62945
  Gene Ontology: Mol. function=oxidoreductase activity, acting on single donors with incorporation of molecular oxygen, incorporation of two atoms of oxygen; Cellular component=beta-galactosidase complex; Biological ...
  Gene Ontology: Cellular component=process=hypusine biosynthetic process from peptidyl-lysine
  Homolog annotation: Hit_ID=Q9ZVF6; Match level="QueryCoverage=92%, HitCoverage=63%, E-value=1e-73, Identity=69%"; Hit description =Expressed protein
  Pfam annotation: Domain name=PhyH; Domain location=2-162; Score =125.8; E_value=1.3e-34; Accession=PF05721.4; Description=Phytanoyl -CoA dioxygenase (PhyH)
MKPMWSQKLPKSRSLHEIEPAFKKFSSSEKVSSLMRSLGYKRPAVMQSMYIFKQPGIGGEVVPHQDNSFLYTEPQTCTGLWLALEDANILNGCLWTIPGSHKNGLARRFLRDEDGVKFDRPSPSYDQKDFVPIEVKAGSLVVIHGDLIHQSFENQSPKSRHAYSLHVVDMVGCKWAPENWIRRKVEPEPLFVS

SEQ ID NO: 179724 - protein, 58 aa, Glycine max
  Coding DNA Sequence Number=SeqID_62946
MGFKGCQSGINASKLFLDFWNCREIIENSTSNSRGRNDMKTLNDEGMKLGVTRGGVDW

SEQ ID NO: 179725 - protein, 337 aa, Glycine max
  Coding DNA Sequence Number=SeqID_62947
  Gene Ontology: Mol. function=sequence-specific DNA binding; Cellular component=nucleus; Biological process=regulation of transcription, DNA-dependent
  Homolog annotation: Hit_ID=Q1SSB6; Match level="QueryCoverage=85%, HitCoverage=82%, E-value=2e-34, Identity=33%"; Hit description =Homeodomain-related
  Pfam annotation: Domain name=Homeobox; Domain location=76-137; Score =65.1; E_value=2.2e-16; Accession=PF00046.19; Description=Homeobox domain
  Subcellular localization annotation: CTP_CleavageSite=55; ConfidenceScore=5.22e-01
MSDSFGSTFHSSTPNSTLNSHAPPKITTFCSIAQPYCICTHCNHILTFNHHVGNVAEEGTNSTGSHNNNLQSQQQQSTRWSPTPVQLLVLEELYRQGTKTPSAEQIQQIASQLRQFGKIEGKNVFYWFQNHKARERQKRRRREMEENNNNNISASSSGEGLKETGCGVKETKKWASTSNCSGHAEDSAALDIAEKGSNGWTQFEGKDSIQVLMRRNIAEKQAKLQEIMEMPCFPPVTMEASTPTTSHRRTTHYNTQLLTPQNYNNLPSSVINRESLNYYGGEENAAPRTLDLFPHKRDDQHGISLAERKSSMFCASASMDTEVTSNNQFFEFLPLRN

SEQ ID NO: 179726 - protein, 162 aa, Glycine max
  Coding DNA Sequence Number=SeqID_62948
  Gene Ontology: Mol. function=structural constituent of ribosome; Cellular component=ribonucleoprotein complex; Biological process =translation
  Homolog annotation: Hit_ID=P49205; Match level="QueryCoverage=58%, HitCoverage=67%, E-value=4e-39, Identity=86%"; Hit description=40S ribosomal protein S17-1
NRVNLCDAGDVVDSEGMKHVKGFFVDFDVVGVDGGDVGDEVHAALALLLLELEGDAANGTLLDALHEMRGETRDLVPQPLGRDDGHFFEKLFVCVEDFFTVFVLTRPIVCGGGCSSVAAAAAAEEKGGGGSGGMAKDTMEGVKEKGDMEGKGFQRREIVAIG

SEQ ID NO: 179727 - protein, 152 aa, Glycine max
  Coding DNA Sequence Number=SeqID_62949
  Gene Ontology: Mol. function=structural constituent of ribosome; Cellular component=ribonucleoprotein complex; Biological process =translation
  Homolog annotation: Hit_ID=P49205; Match level="QueryCoverage=84%, HitCoverage=92%, E-value=6e-54, Identity=83%"; Hit description=40S ribosomal protein S17-1
  Pfam annotation: Domain name=Ribosomal_S17e; Domain location=2-122; Score=222.6; E_value=8.9e-64; Accession=PF00833.8; Description =Ribosomal S17
MGRVRTKTVKKSSRQVIERYYSRMTLDFHTNKKLLEEVAIIPSKRLRNKIAGFSTHLMKRIQKGPVRGISLKLQEEERERRMDFVPDVSAINTDHIEVDKETLDMLHSLGINDIPGITQVDPVPVQQAFPFTRRDQYAVPNVASHILTLPSS

SEQ ID NO: 179728 - protein, 73 aa, Glycine max
  Coding DNA Sequence Number=SeqID_62950
MSDLSVPNMVIGMGRVDAVGSSKNMPVEEHTVTFKTVDKTVDNYLTVTFKNQSQFGRRDLMSIEEHTINLKIK

SEQ ID NO: 179729 - protein, 62 aa, Glycine max
  Coding DNA Sequence Number=SeqID_62951
  Homolog annotation: Hit_ID=Q2A9T4; Match level="QueryCoverage=68%, HitCoverage=12%, E-value=3e-14, Identity=83%"; Hit description=MO25 protein-related
MALYQICSGLTTKKFFDYIQLPNFDIVADAAATFKELMTRHKSTVADFLSNYYEWVVLTLVY

SEQ ID NO: 179730 - protein, 107 aa, Glycine max
  Coding DNA Sequence Number=SeqID_62952
MLSLRCELAMVPFSEPRVTDTAMATGEDGYGYEHDDSLNRMRFHETNKMARRLEVGGWNYLTSHDMEERLERVLRGEDIGEGAVGVDGEGAAAREGSEVGGGGAEKI

SEQ ID NO: 179731 - protein, 162 aa, Glycine max
  Coding DNA Sequence Number=SeqID_62953
MNDSLEKYPRRVFIDVGVPEKDGGSGMEWFSKNYPTRNQKFEMYNIETVAEESSSSSLSPGKEQIEMSDWVRKNVKEEEYVVMKAEAEVVEEMMKSKSIGLVDELFLECKPKRENRSSGNSSRRAYWECLALYGKLRDEGVAVHQWWDGDKRLKRDEETGES

SEQ ID NO: 179732 - protein, 581 aa, Glycine max
  Coding DNA Sequence Number=SeqID_62954
  Gene Ontology: Mol. function=GTPase activator activity; Cellular component=intracellular; Biological process=signal transduction
  Homolog annotation: Hit_ID=UPI000034F109; Match level="QueryCoverage =56%, HitCoverage=40%, E-value=2e-41, Identity=36%"; Hit description =Rho GTPase activator
MPHSSDRLLRSFLRLDVLCWYAESYLPLGGSVSPDIYTDSEEESGSESEGATDDDDDDDDDDDYEDDDDDEQDESIHESDADDDLVSESYSGTVDSEADDEDHDHASSSSKSSGKSEKLKATRKLSSKSLEGSLTQHEDFKSSELVTSSKKTGYIDQSNKPADIVGGVSTNQATLHNSNSPSPASCIKKSNTMSNGPAPRHRTTLGRTSARKNLSMESIDFPLEDEDEIERLEAARTELQTQIDEEVKANEKLQSHVDKQKKALEERHLALEQDVARLQELLHKEKNSRVALENKAELEELALVEADLANLEWKVDEIGVRLNAQIERNHGSTSDSSNKPRQISNQERKLKHKVDAEVAATPQFDRSISKDTNIGGAENDIERKPESTPLPNKHPPTSSKRSGTKGEGANSTPSALTKLTSRLNFLKVGRSQTQNELQSMDKGRDSSRYSINVEKGKGYERPQSLPSPKLPSPRLPSPRLPSPKHLSPNRFGGSEAQSVPNPEKGKGSEAVQISEKGLSKGKSHQSSEKLKKSDSQPAHHSDGWNQQPKQLERGRSEGHQTYNADKGRSEGHQTYNVDKGR

SEQ ID NO: 179733 - protein, 214 aa, Glycine max
  Coding DNA Sequence Number=SeqID_62955
  Gene Ontology: Mol. function=binding; Cellular component=integral to membrane; Biological process=mitochondrial transport
  Homolog annotation: Hit_ID=Q2PEQ8; Match level="QueryCoverage=69%, HitCoverage=47%, E-value=5e-54, Identity=72%"; Hit description =Putative mitochondrial dicarboxylate carrier protein
  Pfam annotation: Domain name=Mito_carr; Domain location=126-214; Score=98.1; E_value=2.6e-26; Accession=PF00153.17; Description =Mitochondrial carrier protein
  Pfam annotation: Domain name=Mito_carr; Domain location=33-121; Score= 8.3; E_value=0.00061; Accession=PF00153.17; Description=Mitochondrial carrier protein
  Pfam module annotation: Pfam domain module=Mito_carr::Mito_carr; Domain location=126-214::33-121
  Subcellular localization annotation: CTP_CleavageSite=77; ConfidenceScore=5.87e-01
DFSNPPTRRRLHHPPTRPHQSPNATSTNPHSPPSLFHLSRSQPNAAASVLRPRLRRPPHRPVGEPRRNYNGVFDAIRRMSNQEVVGSLWRGSVLTVNRAMIVTASQLASYDQFKETILGRGLMEDGLGTHVAASFAAGFVASVASNPIDVIKTRVMNMNAEAYNGALDCALKTVRAEGPLALYKGFIPTISRQGPFTVVLFVTLEQVRKLLKDF

SEQ ID NO: 179734 - protein, 257 aa, Glycine max
  Coding DNA Sequence Number=SeqID_62956
  Gene Ontology: Mol. function=GTPase activator activity; Cellular component=intracellular; Biological process=signal transduction
  Homolog annotation: Hit_ID=UPI000034F109; Match level="QueryCoverage =99%, HitCoverage=30%, E-value=1e-100, Identity=68%"; Hit description= Rho GTPase activator
  Pfam annotation: Domain name=PH; Domain location=1-107; Score=57.6; E_ value=4e-14; Accession=PF00169.19; Description=PH domain
  Pfam annotation: Domain name=RhoGAP; Domain location=146-257; Score =28.3; E_value=1.1e-07; Accession=PF00620.17; Description=RhoGAP domain
  Pfam module annotation: Pfam domain module=PH::RhoGAP; Domain location=1-107::146-257
  Subcellular localization annotation: CTP_CleavageSite=39; ConfidenceScore=5.17e-01
IFKSGPLLISSKGIGWTSWKKRWFILTQTSLVFFRSDPNAVPQKGNEVNLTLGGIDLNNSGSVVIKADKKLLTVQFPDVHDGRAFTLKAETTEDLYEWKTALENALALAPNAANVTEQNVKDREPVKSTVVGRPILLALEDVDGTPSFLEKALTFIEEHGANIEGILRQAADVDEVERRVREYEQGKVEFSPDEDAHVVGDCVKHVIRELPSSPVPASCCKALLEACRTERGSRVAAMRAAINDTFPEPNRRLLQRV

SEQ ID NO: 179735 - protein, 247 aa, Glycine max
  Coding DNA Sequence Number=SeqID_62957
  Gene Ontology: Mol. function=nucleic acid binding; Cellular component= intracellular; Biological process=DNA integration
  Homolog annotation: Hit_ID=Q1S3Z1; Match level="QueryCoverage=82%, HitCoverage=20%, E-value=3e-65, Identity=50%"; Hit description =Integrase, catalytic region; Zinc finger, CCHC-type
MTKEAAGIFFLFNHTWLFIDWKVILEFEPNCSLMVKASTCPGYLNKVVERFRMHQSKPISTPFKLSITQTPNIEEERRKMDTIPYASGVGSIMYGMVCSRPDLAHVVSIVSKFMVDLGQVHWEASKWLFGSLKPGLKYKKAAQGGDTIREGMKEALCLKGMIGESGIVENYVTIHCDSQSVVHLANHQVYHVKTQHIDVRLHFTRDVVESEKVRILKIMPDDNPIDVFTKSLPRSKFKHWLDLINFS

SEQ ID NO: 179736 - protein, 334 aa, Glycine max
  Coding DNA Sequence Number=SeqID_62958
  Gene Ontology: Mol. function=nucleic acid binding; Cellular component= intracellular; Biological process=DNA integration
  Homolog annotation: Hit_ID=Q1RXN8; Match level="QueryCoverage=83%, HitCoverage=30%, E-value=3e-68, Identity=42%"; Hit description =Peptidase S8 and S53, subtilisin, kexin, sedolisin; Integrase, catalytic region; Zinc finger, CCHC-type
VRENVIDVRNIREKNVIDVRNIREKTLGTKRETKNGDVIPVDFNEFCKKLGIKRHKTIAGTPQQNGLNERMNRSILERVSCMLLGVDPYGSVEMEINKLFQLEGVCSLAFAHVKQEKLEPWAVKCIFIRYIDGVKGYKLWKLDPEESRCFINRDTTFVETMVMMCKNLEGRKEKTQLEVESPIHDSRHEAYEELRNFKEAIEEKESQYWLPTMNEEMYLGVEKARYKARLIMAKGFTQVEGVYYNEIFSPVVKHCFIRILMAIINQYDLELKQLDAKTTFLHGDLVDTIYMQQPEGFAEDQMKMRDPSTVRRIFGMDIVSHLSNSLSPQGLEFT

SEQ ID NO: 179737 - protein, 81 aa, Glycine max
  Coding DNA Sequence Number=SeqID_62959
  Gene Ontology: Mol. function=carboxypeptidase activity; Cellular component=membrane
  Homolog annotation: Hit_ID=Q9SUF1; Match level="QueryCoverage=91%, HitCoverage=20%, E-value=1e-17, Identity=54%"; Hit description =Nodulin-like protein
MCGANMLNQAKPYLLIVGLQFGMAGTFIIIKATLDHGMSRFVLTVYRNAIAAIMLAPWCKNVRPKMTMSVFMQILALGFLE

SEQ ID NO: 179738 - protein, 163 aa, Glycine max
  Coding DNA Sequence Number=SeqID_62960
MASRKRKSTASRPTAQYDTRRFQSLEAWNRYIDNILGWNILPERNVKLYHTEFDEFKVELERRNLHKRLANLQDGSIDVAVVKEFCANLYSPEDQASKQARVRGHLIKIDADRLNEFLQTPVVLEEGESLPTYSRFCRLRTNHQEIKVRLCIPRKGFVLNAKG

SEQ ID NO: 179739 - protein, 257 aa, Glycine max
  Coding DNA Sequence Number=SeqID_62961
  Gene Ontology: Mol. function=carboxypeptidase activity; Cellular component=membrane; Biological process=auxin mediated signaling pathway
  Homolog annotation: Hit_ID=Q9SUF1; Match level="QueryCoverage=92%, HitCoverage=61%, E-value=6e-73, Identity=56%"; Hit description =Nodulin-like protein
  Pfam annotation: Domain name=DUF6; Domain location=101-230; Score =33.3; E_value=8.5e-07; Accession=PF00892.11; Description=Integral membrane protein DUF6
  Pfam annotation: Domain name=TPT; Domain location=92-230; Score= -27.5; E_value=0.023; Accession=PF03151.7; Description=Triose -phosphate Transporter family
  Pfam module annotation: Pfam domain module=DUF6::TPT; Domain location= 101-230::92-230
MQYTSASFASAIMNAVPSVTFVLAVILRLERLKLKELHSQAKLIGTLVSFGGALLMTLYKGPQINLFDHPNTTHQKIDESNSYQGQKHWVTGTLFLCLGCLAWSSFYILQSITVKRYPAELSLSSLICFAGALQSAVVALIADHSPRTWAIDFDYTLYGPLYAGIMSSGIAYYVQGLIMKTRGPVFITSFNPLLMIIVATLGSFVLGEQLYLRSIIGAIIIVAGLYSVVWGKAKDYPIFTPPSAATKQLPISSSLHE

SEQ ID NO: 179740 - protein, 38 aa, Glycine max
  Coding DNA Sequence Number=SeqID_62962
LCQSLEGNVGALTNFEVLDFLRAKGASKDPTRVIAKVA

SEQ ID NO: 179741 - protein, 51 aa, Glycine max
  Coding DNA Sequence Number=SeqID_62963
  Gene Ontology: Mol. function=amino acid transporter activity; Cellular component=membrane; Biological process=amino acid transport
  Homolog annotation: Hit_ID=Q9SQZ0; Match level="QueryCoverage=96%, HitCoverage=11%, E-value=1e-10, Identity=76%"; Hit description =Putative amino acid transporter; 33388-30195
MPSSLWRRQHWKARTKGDAEVAKGTAGDGHVDGELGVAEGGEEGTESDNGN

SEQ ID NO: 179742 - protein, 101 aa, Glycine max
  Coding DNA Sequence Number=SeqID_62964
  Homolog annotation: Hit_ID=Q9LVN4; Match level="QueryCoverage=96%, HitCoverage=40%, E-value=1e-15, Identity=45%"; Hit description =Arabidopsis thaliana genomic DNA, chromosome 5, P1 clone:MBM17
MVFEDFDPISSKPKVEWASQSSSSLCPFFLHAYAPDSSHLVIHVTNIYEGWETLLSLSMLEDIRDMVGIGCSWSDFANYFATSLKSQDLNLVLEPDSNSNA

SEQ ID NO: 179743 - protein, 96 aa, Glycine max
  Coding DNA Sequence Number=SeqID_62965
  Subcellular localization annotation: CTP_CleavageSite=39; ConfidenceScore=5.28e-01
MTKFSSHIIWLDASKQDINSTIMSSPLCSHHHRATVNIKAVNPSSNVLSSLEGMNPFLAFSLGLHMNFVGARVGMAIDDIGVWGVVKGALGFRVVV

SEQ ID NO: 179744 - protein, 164 aa, Glycine max
  Coding DNA Sequence Number=SeqID_62966
MFDFLSIKLPFIANRGIMWVSGIRSQYNHICTMFPWRRASHAYLENVIRWIKITQLQLQVAHLTEQLASLHLQPQHHVHEVGFKVNMLDFDVDIGPIIVADDEIVMDANEEPDGLLICTIVDSRMNLYEEVGNDVEIWCNHGLRRDQRGCQGSSIEIHLPKRSV

SEQ ID NO: 179745 - protein, 379 aa, Glycine max
  Coding DNA Sequence Number=SeqID_62967
  Gene Ontology: Mol. function=3-deoxy-7-phosphoheptulonate synthase activity; Cellular component=cytosol; Biological process=aromatic amino acid family biosynthetic process
  Homolog annotation: Hit_ID=Q7WAL9; Match level="QueryCoverage=89%, HitCoverage=91%, E-value=1e-161, Identity=83%"; Hit description =Phospho-2-dehydro-3-deoxyheptonate aldolase, Phe-sensitive
MAQWLARLEILAAFLEVAFDHHAGDAAIAAAELGGDVARHVDLAQVRLVGIGVRAIDHDLFALAGGAQHGATGVDAGRIVVRALLAAAQDHVGVHVAAGFEDGGHAHLGHAHEGMLGTGGDDGVGRDLHAAVGAVLEPQRAAQAGAELAMAGTFGGARADGAPGDQVGDVLRAEQVEEFGGDRQAQAADVQQQLAGTAQAFVDAEAAIQARVVDVALPADGGARLFEVHAHDDQQVIAILVGGGAQLARVFHGLGVVVDGAGADHQHQAVVAAVKHVGDAGAAVFDQRLDLGRNRQFVLQQGGRNQRPHGADAGVVRAGVVLGGVGRADLAVVQGIVNAGQGKLRAIDAEKSVIIAPAGFVRPGYVPHGLGRSAAAGAQ

SEQ ID NO: 179746 - protein, 126 aa, Glycine max
  Coding DNA Sequence Number=SeqID_62968
  Gene Ontology: Mol. function=RNA-directed DNA polymerase activity; Biological process=RNA-dependent DNA replication
MTLCLANMHSSSFFQILPRAQPRWVALSGLLAKPTDWLSEKMNHSFFLDSSCCPNIHAINSSNTVIYRIRGLPGTDGTSIGGFIRHHLILLNATWQSSSQWTDWFLRNSLKRGSQVAVSYNMNLAM

SEQ ID NO: 179747 - protein, 153 aa, Glycine max
  Coding DNA Sequence Number=SeqID_62969
  Gene Ontology: Mol. function=RNA-directed DNA polymerase activity; Cellular component=intracellular; Biological process=RNA-dependent DNA replication
MVEQENREVKPHQEETEVVSLGDGEERKEVKVVIGMSTNIRDELVALLRDYQDIFAWSYQDMPGLSPDIVQNCEGSSSRYGFSGYNQIKMAPEDMEKDDGATYQVMFFGLKNDGATYQRAIVALFHDMMHKEIEVYVDDIIVKSMTEEEHLVN

SEQ ID NO: 179748 - protein, 72 aa, Glycine max
  Coding DNA Sequence Number=SeqID_62970
MVSQGNKNMCLRVLLGNVLGFVYNGVASVVATDEEHEAVDHRLESEELGEVVVGVENNAEVGSFAYYELSNS

SEQ ID NO: 179749 - protein, 83 aa, Glycine max
  Coding DNA Sequence Number=SeqID_62971
MAQNDHNLSLHATGHDRLWMAKRAQNDHNLSLRVYHLLSPIDSKSVWMTIICLRVSSGPSPLDDKRAQNDHNLSLCAIGHDCV

SEQ ID NO: 179750 - protein, 119 aa, Glycine max
  Coding DNA Sequence Number=SeqID_62972
MVPPRTPPFPSPPIEAKIFLITTLPPFHFSFGYLCLLIDDCKKNVSVALIDMHSCSLEAKIKMNLDAQVVEQVAEVKKPERKKPKSKEPMVKKAKVEKGKKVKDPNMPMRPPTTFFAFL

SEQ ID NO: 179751 - protein, 285 aa, Glycine max
  Coding DNA Sequence Number=SeqID_62973
  Gene Ontology: Mol. function=phosphoglycolate phosphatase activity; Cellular component=mitochondrion; Biological process=metabolic process
  Homolog annotation: Hit_ID=Q6Z026; Match level="QueryCoverage=77%, HitCoverage=71%, E-value=6e-64, Identity=53%"; Hit description =Haloacid dehalogenase-like hydrolase-like protein
  Pfam annotation: Domain name=Hydrolase; Domain location=43-269; Score= 82.6; E_value=1.2e-21; Accession=PF00702.16; Description=haloacid dehalogenase-like hydrolase
  Subcellular localization annotation: CTP_CleavageSite=30; ConfidenceScore=5.10e-01
MGTTLMRCSHANALFRALKPKPRNSSLPLSSMAINKGNSNKAYDALLLDAGGTLLQLAKPVEEIYATIGSKYGVTVDPAMIKQGFKRAFAAPWPEKLRYQVYALPLIILLVMFCVIAHFCIVTLERWCMMGDGRPFWKLVVSEATGCGDEDYFEEVYEYYAKGDAWHLPDGAFETITFLKDAGVKMAVVSNFDNRLRKLLKDLNVLNLFDAVIISSEVGYEKPDPRIFQAALDEVNVEACKALHIGDDQKADKLGANAVGIDCWLWGIDVKTFSDIQIRILNSEA

SEQ ID NO: 179752 - protein, 38 aa, Glycine max
  Coding DNA Sequence Number=SeqID_62974
MAFIGSFTAPVSLLTALNRATTFTSPKASASNNDLHSK

SEQ ID NO: 179753 - protein, 234 aa, Glycine max
  Coding DNA Sequence Number=SeqID_62975
  Gene Ontology: Mol. function=DNA binding; Cellular component=nuclear origin of replication recognition complex; Biological process=DNA replication
  Homolog annotation: Hit_ID=Q9ZVH3; Match level="QueryCoverage=96%, HitCoverage=79%, E-value=3e-79, Identity=63%"; Hit description =Origin recognition complex subunit 6
  Pfam annotation: Domain name=ORC6_1; Domain location=3-152; Score =286.5; E_value=5e-83; Accession=PF05460.4; Description=Origin recognition complex subunit 6 (
MDVSELAKKLGLSDSKLVVRKAAELRRLCEVQFDSSVIGVGEVAKSIICLEIAAMRLSILFDRSSAARLSGMSERAYIRSYNSLHNGLGVKMKLDVRELAIQFGCVRIITLVRDGLKLYKDRFVSSLPASRRASADFTRPVFTAVAFYLCAKKHKLKVDKLKLIELCGTSESEFSSVSATMKDLCHDVFGVAKEKKDPKQVQSNRDLLDVLPSKRKAEDGGYSSDDGPEEAVPH

SEQ ID NO: 179754 - protein, 652 aa, Glycine max
  Coding DNA Sequence Number=SeqID_62976
  Gene Ontology: Mol. function=methyltransferase activity; Cellular component=cellulose and pectin-containing cell wall
  Homolog annotation: Hit_ID=Q1SBL8; Match level="QueryCoverage=99%, HitCoverage=100%, E-value=0.0, Identity=81%"; Hit description =Putative methyltransferase
  Pfam annotation: Domain name=DUF248; Domain location=93-641; Score =1182.7; E_value=0; Accession=PF03141.7; Description=Putative methyltransferase
  Pfam annotation: Domain name=Methyltransf_11; Domain location=210 -305; Score=20.5; E_value=0.00052; Accession=PF08241.2; Description =Methyltransferase domain
  Pfam module annotation: Pfam domain module=DUF248::Methyltransf_11; Domain location=93-641::210-305
MAKPSSADGRTRSHVQIFIVVGLCCFFYILGAWQRSGFGKGDSIALEITKKGADCNVVPNLSFDSHHGGEVSKIGEFESKSKVFEPCDSRYIDYTPCQDQRRAMTFPRENMNYRERHCPPEEEKLHCMIPAPKGYVTPFPWPKSRDYVPYANAPYKSLTVEKAIQNWIQYEGNVFRFPGGGTQFPQGADRYIDQLASVIPIKDGTVRTALDTGCGVASWGAYLWSRNVIAMSFAPRDSHEAQVQFALERGVPAVIGVLGTIKLPYPSAAFDMAHCSRCLIPWGANDGMYMMEVDRVLRPGGYWVLSGPPINWKVNYKAWQRSKEDLEEEQRKIEETAKLLCWEKKSENSEIAIWQKTVDTESCRSRQEDSSVKFCESTDANDVWYKKMEVCITPSPKVYGDYKPFPERLYAIPPRIASGSVPGVSVETYQEDSKKWKKHVNAYKKINRLLDTGRYRNIMDMNAGLGSFAADIQSSKLWVMNVVPTIAEKSTLGVIYERGLIGIYHDWCEAFSTYPRTYDLIHSDSLFSLYKDNMHLILVAAMIMISGPLTLQIAMESSLQWLCLLRTLVESNVCLYILCDTEDILLEMDRILRPEGAVIIRDEVDVLIKVKKLVEGMRWDTKMVDHEDGPLVPEKVLIAVKQYWVANATSTQ

SEQ ID NO: 179755 - protein, 159 aa, Glycine max
  Coding DNA Sequence Number=SeqID_62977
  Gene Ontology: Mol. function=transcription regulator activity; Cellular component=nucleus; Biological process=regulation of transcription, DNA-dependent
  Homolog annotation: Hit_ID=Q94FV2; Match level="QueryCoverage=64%, HitCoverage=18%, E-value=4e-26, Identity=53%"; Hit description=EIL3
  Pfam annotation: Domain name=EIN3; Domain location=37-159; Score= -164.8; E_value=1.1e-05; Accession=PF04873.4; Description=Ethylene insensitive 3
MDSMDDHNMTIDLLDTSMRTIEEEGMIEEEGMIEEEEDEDEEEEDDDDDDNGQKQVLTIEELETRMWRDRMLLRKLKDERKEKEQGQTVEMMKKKALTRAQDIVLKNMLKMMEVCDVRGFVYGIIPDKGKPVSGASDNLRGWWKERVKFDRNGPAAMLR

SEQ ID NO: 179756 - protein, 79 aa, Glycine max
  Coding DNA Sequence Number=SeqID_62978
MAVISPTKISQPLFPRGYNPNVTCTYHEGFSGHSIKHCMTLKHKVQSLIDAVICALESISKSIQLEIARSPCLVRGCRK

SEQ ID NO: 179757 - protein, 1270 aa, Glycine max
  Coding DNA Sequence Number=SeqID_62979
  Gene Ontology: Mol. function=RNA-directed DNA polymerase activity; Cellular component=chromatin; Biological process=chromatin assembly or disassembly
  Pfam annotation: Domain name=rve; Domain location=951-1107; Score =95.9; E_value=1.2e-25; Accession=PF00665.16; Description=Integrase core domain
  Pfam annotation: Domain name=zf-H2C2; Domain location=895-933; Score =15.8; E_value=0.0028; Accession=PF09337.1; Description=His(2)-Cys(2) zinc finger
  Pfam module annotation: Pfam domain module=RVT_1::Retrotrans _gag::rve::zf-H2C2; Domain location=519-822::105-195::951-1107::895 -933
MANGTRLKASLERLEDAIAKLTASQLAMNSKIDDLLQRMSQLEANQQQPQSPPSSSARHTPQTQTSFHHMKLDVPRFDGSDPIGWTFKITQFFEFHSTPDHERLTIASFYMEGLALAWFQWMHRNAQLSSWSAFLHALHSRFATSTYEDPTGLLCKLQQRSSVSTYLSEFKSLANRIVGLPTSFVLSCFISGLNPTIRREVQVLQPISLAQAVSYARLQEEKLVDARRPPPYRPLVSTVPSNTRSSSSNSTQSLLPTPVRTSSSIPFKRLTPEELGSRRENGLCFHCDEKFSRGHKCASSLFFLVMDDEDTTIEEESLRDYTPTQELLPESPTHNFLHNRVVLSLGLQTTKTAPLRVTVGNGEEIHCNQLCTAVQTLGPVLTDYGALTMKFITGGKLIELHGDREKGIEPVSPSQLRRFVHTNPTTTFIHIHVETATTHNSSPNHPLPTINTLISKYASLFRPSANLPPSRSTDHTINLLPNSTPVNIRPYRFPYFQKKEIEEQVASMLEKGFIKPSSSPFSSLVLLVRKKDGSWRFCVDYRALNAITIRDRFPIRTVDELLDELGEARWFSKLDLMQGYHQILMNTFQATMNQLFQPYLRKYIIVFFDDILIYSRTMHDHLLHLEKAFQLLYLGHMVSSNGVTPVPEKVQAVSRWPTPRTPRALRGFLGLIGFYRRFIKGYAALASPLTKLLCHDQFEWSQEAETAFQNLKRALIEAPVLALPDFTTPFVVETDASGSSMGAVLTQKRHPLAYYNKQFCPKLLNASTYVRELAAITAAVKKWHQYLLGHHFVILTNHQSLRELMNQTIQTPEQHRYLARLLGFDYSIQYRAGRNNVELASLETFQDLRKRIQENLASYPDYALTKGLIMYKKRIWLPSNSSFIKQLLEEFHQSHTGGHMGIQKTLQRLHDNFTWASIKEDTRKFVTACATCQHTKYDNRKPVGLLCPLLVPTLPWEDLSMDFITGLPSYRDNTCIFVVVDRFSKGLHLGMLPTQHSAHTVALLFIELVGRLHGMPKSIASDRDLLFISKFWRELFTLSGTKLRLSSSYHPQSDGQTKVTNRIIEQYLRAFVHEKPATWGRYLPWAEWSYNTSSHSTTGMTPFEITFGQKPPTYPHYIAGTSTVEAVDAILSQREEVFAMLRRKLLKAQSRMKTNADRHRRDQEFQVGDWVLIKLRPQRQSYTVNPTTATTIMDLPPLASDNHPVITPLAIVASKVIPSETGPRHMDKELLHGQGSATGDVREGVSIAREVQEARNARPRRERLTPAYLE

SEQ ID NO: 179758 - protein, 104 aa, Glycine max
  Coding DNA Sequence Number=SeqID_62980
  Subcellular localization annotation: CTP_CleavageSite=32; ConfidenceScore=5.55e-01
MAMQGFGSVQHNPQAVWVWTTGPARRVQTNVLSSYKSAGQSGPSVTIRFPERRVHRKGDTWQHLGRALRTGATGSAAAAGASGRVGDPGATQLGRTLFNIFYIL

SEQ ID NO: 179759 - protein, 174 aa, Glycine max
  Coding DNA Sequence Number=SeqID_62981
MLNEGSVGKLFYKNEKDNVQLLMCISQCSPTINHNNNPTTSFQSTPPSHGTLSINDSERYSKRHTVNVSCIQRNLMSSFEHKKNRTTASTSTCQGSNPYSNMTQSDIHRDKHERATNTTQHNQFVAHDSSHSTDNDAVVAEIKLLMDKYAERRKRRQSILQERKKQRSATNGST

SEQ ID NO: 179760 - protein, 160 aa, Glycine max
  Coding DNA Sequence Number=SeqID_62982
  Gene Ontology: Mol. function=molecular_function; Cellular component =membrane; Biological process=auxin mediated signaling pathway
  Homolog annotation: Hit_ID=Q69TY0; Match level="QueryCoverage=70%, HitCoverage=30%, E-value=1e-21, Identity=47%"; Hit description =Putative MtN21
  Subcellular localization annotation: CTP_CleavageSite=61; ConfidenceScore=5.15e-01
MHAGPVLLLDRALGACASVGSGAGRLAGLSARNGFRHAQRLQPVLDQNLYNMGMKMTSTTFASTTVNVLPAITFVMALIFRLEKVNLRKFHSVAKVIGTVITVSGAMVMTLYKGPAFQIIKGGGAMSHHSNSSSTSTTEPSDQHWIVGTVYLLFLHFFPI

SEQ ID NO: 179761 - protein, 138 aa, Glycine max
  Coding DNA Sequence Number=SeqID_62983
MDNIRFTAPFKVQKNLLQVPFSYHRQWLRNYPKYVLFHCDGEIHFIRTLPAAASKFVYGSKKSITIHHGLPKSTKWPLSIHNDMPAITEPWFNLIHEKNLRPGDEVAFYYRFHEHAWELLIRKTIEWDNNNIDLDFDE

SEQ ID NO: 179762 - protein, 72 aa, Glycine max
  Coding DNA Sequence Number=SeqID_62984
MRERRRMGKFIVRLDQRICDCGKPQKLHMPYAYVIAALYTLDYVSSVYKVPLAGMHHHDYWPHMKDHNYVSI

SEQ ID NO: 179763 - protein, 56 aa, Glycine max
  Coding DNA Sequence Number=SeqID_62985
  Subcellular localization annotation: CTP_CleavageSite=14; ConfidenceScore=5.05e-01
MAMQDFGSVQHNPQAMWVWTTGPARRVQTNVLSSCKSAGLLPLWAYAGRDGLLTYT

SEQ ID NO: 179764 - protein, 517 aa, Glycine max
  Coding DNA Sequence Number=SeqID_62986
  Gene Ontology: Mol. function=RNA-directed DNA polymerase activity; Cellular component=chromatin; Biological process=chromatin assembly or disassembly
MSFGLCNASSSFQATMNVLFRPYLRHFIIVFFDDILIYSHSFNDHLTHLEQVCNQLHLKSRQFNTGLCPTPRELYAASWAWLNSIEAQLAFSKLKEALSSASVLSIPNFTLRFTVETDASEIGMGAIFSQKGHPIAFFSKPFSSKTLQASTTNMVADALSHILENSSSTLLLLSVPCFTFLEELKSRLARDSVFQQLRQDISDNPKDYPEMLNALLLHVLTANIRSTRPKRWWVYYVPYRCHVDLSLDFINGLLPYWGYTTILVVVDLDSGGIISYKWHTVKDELSVPSTDRQPNRGLQSASWGKFLHWVEWSYNTLWHSGSRTTPYEITFGKKPFNVSQYISSSSPVEAVNDLLTNREAIFKKIRKKLIKVQEVMKTIADTKRRNVNFEIGDWVMVILRPYRQSTVLGPHSKLAKRFYGLFQILARIGSATYKLQLPKGAKIHLVFHCSMLKKFHHPPSGDPTPFHPLPTIFIDNQHVISPLTILDTLLASDTANSKLQVLVQWQGFSPDDTSWED

SEQ ID NO: 179765 - protein, 256 aa, Glycine max
  Coding DNA Sequence Number=SeqID_62987
MVNVNPTIGRGSSPHKEKFHNYLGLSWEEFAASRKTLNWQLLENKLLEGKRKKRQEEAMLTEDSTMIIDPPSPIERHVKWKLTRTKRYGQMTFKATQEISNKIGRASRCCHAHNGVTRLVALGKLYEGVSTIHHVPCADDVVKVKVAEVWDANIGVPFLITEVQYVRQALDTFIAYPRQIRPKKQVELVHRSIPTGGIDPLGDLIKNLIDLYKKPLELFWNGDKCLNISILKMWMMFMNDLSIRLGRGSLYEFIEP

SEQ ID NO: 179766 - protein, 111 aa, Glycine max
  Coding DNA Sequence Number=SeqID_62988
MASNQPLDLTSSTFPVLFLELLLEPFPACKLECIQSLDLSIGTRSGSNESREEKVMVEYSTVPTTMEKGGRGAEWRVKAVVAQRKTRLAAGFDGDAAALVGAATAIEEDEE

SEQ ID NO: 179767 - protein, 317 aa, Glycine max
  Coding DNA Sequence Number=SeqID_62989
MVGAKHSFAYIIFMHSNWVVPLKEVQFGEPTCTPQLIKKFINGWDRKAIFDERTGTGSDEALLKHGVNLGFNFMFLKMRIAIRFNIDRLGIWNEEEYGGSGFGSKGPNDPRESENLFGSLSGSKDLTGWVKALKGWHLPEEEWVEAELKGTGVSRKKIVGLNWVENDPAVDEDCPEASPLGVWAWTSCRISGVNPEMKQLKRNGGGRPMMWLAKSLNSERKVGHDVNWPFIMIREELVDLEDSTERIYSIKPWNIQFHAMGVVTGTGEVIVVDDEGEEREKSRGNGLLKAIRENFETGQLNHCKGDNESNTMLTLGN

SEQ ID NO: 179768 - protein, 151 aa, Glycine max
  Coding DNA Sequence Number=SeqID_62990
  Gene Ontology: Mol. function=transporter activity; Cellular component= mitochondrial inner membrane; Biological process=mitochondrial transport
  Homolog annotation: Hit_ID=Q6F2C9; Match level="QueryCoverage=63%, HitCoverage=34%, E-value=9e-20, Identity=50%"; Hit description =Mitochondrial carrier protein
  Pfam annotation: Domain name=Mito_carr; Domain location=18-104; Score= 24.9; E_value=1.9e-05; Accession=PF00153.17; Description =Mitochondrial carrier protein
MCSIHRGQAEKIKGGSRGYWQSLVAETTTFPIHLIKTRLQLHGDSLLSSHPTSAFRVGLGIIREQGALCLYSGLSPKIFRHMFYTLIQNVVSVDNASISIIGKAVVGGIFGVVAQAVVDEWASSLFWLCYKVLQISYYTDSAMSQTDNTDS

SEQ ID NO: 179769 - protein, 68 aa, Glycine max
  Coding DNA Sequence Number=SeqID_62991
MATRSCKLELTLEVAGSPKQAGYFTLKSFGGLGEPEASLGELGSKKLNEKTLLPFFFGIFHILDQNIE

SEQ ID NO: 179770 - protein, 438 aa, Glycine max
  Coding DNA Sequence Number=SeqID_62992
  Gene Ontology: Mol. function=DNA binding; Cellular component=nucleus; Biological process=regulation of transcription
  Homolog annotation: Hit_ID=Q6ZGU0; Match level="QueryCoverage=60%, HitCoverage=69%, E-value=6e-93, Identity=65%"; Hit description =Putative NAC domain protein NAM
  Pfam annotation: Domain name=NAM; Domain location=16-144; Score =293.2; E_value=4.8e-85; Accession=PF02365.6; Description=No apical meristem (NAM) protein
MMEERNNDAEKLDEVMLPGFRFHPTDEELVGFYLKRKIQQRPLTIELIKQLDIYKFDPWDLPKLATTGEKEWYFYCPRDRKYRNSARPNRVTGAGFWKATGTDRPIYSSEGSKCIGLKKSLVFYKGRAAKGVKTDWMMHEFRLPSLTDSLSPKYIDKTIPANESWAICRIFKKINATAQRTLSQSWASSLPPDTRTSDHHIQTKDQDSTTQFCSDNMPMTNKTTLTSQFCNNNYNDSQPLPTNSSSSPLCPLDVASYKSIINPLLYKAFDHFPISNEDLRTSLLFSPPFETSDANPKSTMVDVSSMLLSLPSSVLGDFNKTTSEDTNTASNFGVLQEHCSGYPIPFLPEMQTTFGNQQQQYCDNINALVKGPNVNVPRVDDQELELETVVQRSIGFPLSATMPLNIVDAWKSNNLLWDTSSFPCDMPSSYYSTTKCYT

SEQ ID NO: 179771 - protein, 397 aa, Glycine max
  Coding DNA Sequence Number=SeqID_62993
  Gene Ontology: Mol. function=RNA-directed DNA polymerase activity; Cellular component=exocyst; Biological process=RNA-dependent DNA replication
MLYTLLRYSIRLRGVIHKVVAKSQSVFVGGRHMLDGVFIANEIIHEEKSKKKPTLIFMVDFEMTYDIVIVNWDFLFSMMVKMGFSNVWLRGIRDALNHHQFLCWDGGLIKGAVDNNYLPGVKLGSNELCICVQKFTDDTLISMEPSLQNVLSVKAIFRCYEATLGLRVNFHKSKLIGGNVKVYHRQIEEEDGSLEKKILVYRQMGCSDYYILAKEFSLGREGEERKVAWVKWGDVCLLKDKGGLGEVRGMVVKKFRDGASTRFLFNVWIGSYALKSKYERLFRLSYQHDLNVNVIGIWDLYRLHNQLMESVVGTKAQHILYGTTFPTAISEFPYAQGVVESEVESSSHLFFSSPSLIRYGNAAIVGIAFNKHCRVTSWTISGNTVVQHVLDSVILKS

SEQ ID NO: 179772 - protein, 57 aa, Glycine max
  Coding DNA Sequence Number=SeqID_62994
MEDAPVSLASPSRQRMDERDFTDHVMQVHKALKQEKEKWERVVQVELIATLAKEAIA

SEQ ID NO: 179773 - protein, 678 aa, Glycine max
  Coding DNA Sequence Number=SeqID_62995
  Gene Ontology: Mol. function=nucleoside-triphosphatase activity; Cellular component=membrane; Biological process=defense response
  Homolog annotation: Hit_ID=Q1SVC8; Match level="QueryCoverage=98%, HitCoverage=58%, E-value=2e-89, Identity=41%"; Hit description=TIR; Disease resistance protein; AAA ATPase
  Pfam annotation: Domain name=LRR_1; Domain location=545-570; Score =5.3; E_value=29; Accession=PF00560.23; Description=Leucine Rich Repeat
  Pfam annotation: Domain name=LRR_1; Domain location=611-632; Score =5.3; E_value=29; Accession=PF00560.23; Description=Leucine Rich Repeat
  Pfam annotation: Domain name=LRR_1; Domain location=634-659; Score =9.7; E_value=4.3; Accession=PF00560.23; Description=Leucine Rich Repeat
  Pfam annotation: Domain name=NB-ARC; Domain location=229-483; Score= -16.3; E_value=3e-09; Accession=PF00931.13; Description=NB-ARC domain
  Pfam annotation: Domain name=TIR; Domain location=2-103; Score=32.7; E_value=4.4e-08; Accession=PF01582.10; Description=TIR domain
  Pfam module annotation: Pfam domain module=LRR_1::LRR_1::LRR_1::NB -ARC::TIR; Domain location=545-570::611-632::634-659::229-483::2-103
MDDQGVRKGEEITPTLMKAIQESKIAIVIFSENYASLTFCLQELVKIMECFKHNGRLVWPVFYKVDQVDMGHPKGSYVEALVKHETRISEKDKLKKMETLCSATSCSQPRTCTLAFTLATPCAYSHSQPHFLSQARLSHVLFCVIVRETIEAHDLVRYGGADEGFEIVGILVQSFLVRVELEVVICFFELIESFVYGFESIVECSCLAFQLNDVVVVGFVSDVGLEGYDKEAEFGIECTNMGSFEIQEVSKRINRIPLGVAKSPVGLVSRAEGIYGTGRIGKTTLACAVYNFVADQFKGLSFLFDVRENSDKNGLVYLQQTLLSDIVGEKDNSWGIIIITTRDIHQLHSHGVETERTYKVDGLNHDEALELFSWHAFKSKQVNPSFQNISLRIIQHFDCLPLPLEILGSDLFGKTVPEWNSALDAYERIPHKSIQKILIVSYDGLEELEKEIFLDLACYFVGYKQRNVMAILQSGRGITLDYAIQVLIDKNHPQPGERSRLWFYKDIVRVLKENNGSDKTQIIVLDLPKDKEVQWDGNTLKKMENLKILVVKNTCFSRGPSALPKRLRVLKWSRYPESTLPADFDPKKLVIFDLSLSFFTFKNQGNMKFKSLTDMKLSDCKLLEEVPDLSGATNLKKLHLDNCKELREIRGLPPNIEYLSAINYTLLTSKSKERLMNK

SEQ ID NO: 179774 - protein, 56 aa, Glycine max
  Coding DNA Sequence Number=SeqID_62996
MWDPRQLEVRTYKRDNMLWVGSSSVYRFYKERVSIIVSRDDGKCGQRSWKDGGHEQ

SEQ ID NO: 179775 - protein, 98 aa, Glycine max
  Coding DNA Sequence Number=SeqID_62997
MVSSPSLDLLRKSIDYGHGTLDAYWNRIQSLDEKVKVIPDRKESGGEKCITLRSRRGRSCSDLVLENLRGEELDLEVGGDGEAAIEGVGLLELDEQID

SEQ ID NO: 179776 - protein, 843 aa, Glycine max
  Coding DNA Sequence Number=SeqID_62998
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=99%, HitCoverage=90%, E-value=0.0, Identity=41%"; Hit description =Tyrosine protein kinase, active site
  Pfam annotation: Domain name=LRR_1; Domain location=100-122; Score =14.4; E_value=0.43; Accession=PF00560.23; Description=Leucine Rich Repeat
  Pfam annotation: Domain name=LRR_1; Domain location=124-146; Score =14.5; E_value=0.4; Accession=PF00560.23; Description=Leucine Rich Repeat
  Pfam annotation: Domain name=LRR_1; Domain location=148-170; Score =10.0; E_value=3.8; Accession=PF00560.23; Description=Leucine Rich Repeat
  Pfam annotation: Domain name=LRR_1; Domain location=172-194; Score =13.7; E_value=0.65; Accession=PF00560.23; Description=Leucine Rich Repeat
  Pfam annotation: Domain name=LRR_1; Domain location=196-218; Score =4.5; E_value=41; Accession=PF00560.23; Description=Leucine Rich Repeat
  Pfam annotation: Domain name=LRR_1; Domain location=220-242; Score =8.9; E_value=6.2; Accession=PF00560.23; Description=Leucine Rich Repeat
  Pfam annotation: Domain name=LRR_1; Domain location=244-266; Score =7.9; E_value=9.5; Accession=PF00560.23; Description=Leucine Rich Repeat
  Pfam annotation: Domain name=LRR_1; Domain location=268-290; Score =18.0; E_value=0.034; Accession=PF00560.23; Description=Leucine Rich Repeat
  Pfam annotation: Domain name=LRR_1; Domain location=28-50; Score =16.3; E_value=0.11; Accession=PF00560.23; Description=Leucine Rich Repeat
  Pfam annotation: Domain name=LRR_1; Domain location=292-314; Score =18.8; E_value=0.019; Accession=PF00560.23; Description=Leucine Rich Repeat
  Pfam annotation: Domain name=LRR_1; Domain location=316-338; Score =10.5; E_value=3.1; Accession=PF00560.23; Description=Leucine Rich Repeat
  Pfam annotation: Domain name=LRR_1; Domain location=340-362; Score =8.0; E_value=9; Accession=PF00560.23; Description=Leucine Rich Repeat
  Pfam annotation: Domain name=LRR_1; Domain location=364-386; Score =14.4; E_value=0.42; Accession=PF00560.23; Description=Leucine Rich Repeat
  Pfam annotation: Domain name=LRR_1; Domain location=388-410; Score =14.7; E_value=0.35; Accession=PF00560.23; Description=Leucine Rich Repeat
  Pfam annotation: Domain name=LRR_1; Domain location=4-26; Score=14.0; E_value=0.54; Accession=PF00560.23; Description=Leucine Rich Repeat
  Pfam annotation: Domain name=LRR_1; Domain location=412-433; Score =16.3; E_value=0.11; Accession=PF00560.23; Description=Leucine Rich Repeat
  Pfam annotation: Domain name=LRR_1; Domain location=435-456; Score =13.2; E_value=0.94; Accession=PF00560.23; Description=Leucine Rich Repeat
  Pfam annotation: Domain name=LRR_1; Domain location=52-74; Score=9.3; E_value=5.2; Accession=PF00560.23; Description=Leucine Rich Repeat
  Pfam annotation: Domain name=LRR_1; Domain location=76-98; Score=9.8; E_value=4.2; Accession=PF00560.23; Description=Leucine Rich Repeat
  Pfam annotation: Domain name=Pkinase; Domain location=561-834; Score =137.4; E_value=3.9e-38; Accession=PF00069.15; Description=Protein kinase domain
  Pfam annotation: Domain name=Pkinase_Tyr; Domain location=561-834; Score=70.1; E_value=7.1e-18; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::Pkinase::Pkinase_Tyr; Domain location=...
  Pfam module annotation: Domain location=100-122::124-146::148 -170::172-194::196-218::220-242::244-266::268-290::28-50::292 -314::316-338::340-362::364-386::388-410::4-26::412-433::435-456::52 -74::76-98::561-834::561-834
KLTNLSYLDLDQNNFYGHIPREIGKLSNLKYLWLAENNFSGSIPQEIGNLRNLIEFSAPRNHLSGSIPREIGNLRNLIQFSASRNHLSGSIPSEVGKLHSLVTIKLVDNNLSGPIPSSIGNLVNLDTIRLKGNKLSGSIPSTIGNLTKLTTLVIYSNKFSGNLPIEMNKLTNLENLQLSDNYFTGHLPHNICYSGKLTRFVVKINFFTGPVPKSLKNCSSLTRVRLEQNQLTGNITDDFGVYPHLDYIDLSENNFYGHLSQNWGKCYNLTSLKISNNNLSGSIPPELSQATKLHVLHLSSNHLTGGIPEDFGNLTYLFHLSLNNNNLSGNVPIQIASLQDLATLDLGANYFASLIPNQLGNLVKLLHLNLSQNNFREGIPSEFGKLKHLQSLDLGRNFLSGTIPPMLGELKSLETLNLSHNNLSGGLSSLDEMVSLISVDISYNQLEGSLPNIQFFKNATIEALRNNKGLCGNVSGLEPCPKLGDKYQNHKTNKVILVFLPIGLGTLILALFAFGVSYYLCQSSKTKENQDEESPIRNQFAMWSFDGKIVYENIVEATEDFDNKHLIGVGGQGNVYKAKLHTGQILAVKKLHLVQNGELSNIKAFTSEIQALINIRHRNIVKLYGFCSHSQSSFLVYEFLEKGSIDKILKDDEQAIAFDWDPRINAIKGVANALSYMHHDCSPPIVHRDISSKNIVLDLEYVAHVSDFGAARLLNPNSTNWTSFVGTFGYAAPELAYTMEVNQKCDVYSFGVLALEILLGEHPGDVITSLLTCSSNAMVSTLDIPSLMGKLDQRLPYPINQMAKEIALIAKTAIACLIESPHSRPTMEQVAKELGMSKSSSVH

SEQ ID NO: 179777 - protein, 360 aa, Glycine max
  Coding DNA Sequence Number=SeqID_62999
  Gene Ontology: Mol. function=nucleoside-triphosphatase activity; Cellular component=membrane; Biological process=defense response
  Homolog annotation: Hit_ID=Q1SVC8; Match level="QueryCoverage=99%, HitCoverage=32%, E-value=1e-71, Identity=43%"; Hit description=TIR; Disease resistance protein; AAA ATPase
  Pfam annotation: Domain name=LRR_1; Domain location=121-143; Score =11.3; E_value=2.2; Accession=PF00560.23; Description=Leucine Rich Repeat
  Pfam annotation: Domain name=LRR_1; Domain location=145-164; Score =8.2; E_value=8.3; Accession=PF00560.23; Description=Leucine Rich Repeat
  Pfam annotation: Domain name=LRR_1; Domain location=168-190; Score =5.7; E_value=25; Accession=PF00560.23; Description=Leucine Rich Repeat
  Pfam annotation: Domain name=LRR_1; Domain location=192-213; Score =9.7; E_value=4.4; Accession=PF00560.23; Description=Leucine Rich Repeat
  Pfam annotation: Domain name=LRR_1; Domain location=215-237; Score =6.7; E_value=16; Accession=PF00560.23; Description=Leucine Rich Repeat
  Pfam annotation: Domain name=LRR_1; Domain location=239-262; Score =1.6; E_value=1.4e+02; Accession=PF00560.23; Description=Leucine Rich Repeat
  Pfam annotation: Domain name=LRR_1; Domain location=293-314; Score =10.2; E_value=3.5; Accession=PF00560.23; Description=Leucine Rich Repeat
  Pfam annotation: Domain name=LRR_1; Domain location=31-56; Score=5.4; E_value=28; Accession=PF00560.23; Description=Leucine Rich Repeat
  Pfam annotation: Domain name=LRR_1; Domain location=316-341; Score =8.7; E_value=6.9; Accession=PF00560.23; Description=Leucine Rich Repeat
  Pfam annotation: Domain name=LRR_1; Domain location=74-90; Score=0.6; E_value=2.2e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=121 -143::145-164::168-190::192-213::215-237::239-262::293-314::31 -56::316-341::74-90
MGSDKTEIIMLHLPKEKEVHWDGTALEKMKNLKILVVKNARFSRGPSALPESLRVLKWCRYPESSLPADFDAKKLVILDLSMSSITFKNPMIMMKFKYLMEMKLSGCELLKEVSDMSGAPNLKKLHLDNCKNLVEVHDSVGFLDKLECLNLNHCTSLRVLPRGMYLTSLKTMSLRRCTSLMSFPEILGKMENIRYLDLIGSAISVLPFSIGNLVGLTRLNLNKCTGLVELPISVFMLPKLENLEANYCDRLAQVQNGEGQDHETVSSSVRDANFNYCYLTEKFLATLLPCLCNVTSLSLNSSNITVLPSSISACLSLTELYLNECKELREIRSLPPNIKYLSAINCKSLTSESKEMLLNQ

SEQ ID NO: 179778 - protein, 290 aa, Glycine max
  Coding DNA Sequence Number=SeqID_63000
  Gene Ontology: Mol. function=transmembrane receptor activity; Cellular component=membrane; Biological process=defense response
  Homolog annotation: Hit_ID=Q1S472; Match level="QueryCoverage=99%, HitCoverage=27%, E-value=5e-85, Identity=56%"; Hit description=TIR domain, putative
  Pfam annotation: Domain name=TIR; Domain location=20-152; Score =157.8; E_value=2.9e-44; Accession=PF01582.10; Description=TIR domain
MPNPTLASSSSLAYEWTYDVFLSFRGEDTRLGFTGHLYHALCEVGVNTFMDDQGLRKGEEITPFLMKAIQESRIAIVIFSENYASSTFCLQELVMIMECLKHQGRLVWPVFYKVDPSDVRHQKGSYAEALAKHETRISDKDKVEKWRLALQKAASLSGWHSNRRYEYDIIRDIVLEVSKKINRNPLHVAKYPVGLESRVQKVKSLLDVESNDGVHMVGIYGIGGIGKTTLACAVCNFVADQFEGLSFLSDVRENSEKHGLVHLQETLLSDILEEKDIKLGNEREELPIIK

SEQ ID NO: 179779 - protein, 56 aa, Glycine max
  Coding DNA Sequence Number=SeqID_63001
MKADSISVWHVSEMKAEEMHTATNEARPKYTCQQMKQGQNDVEQPKTKARIISNWA

SEQ ID NO: 179780 - protein, 262 aa, Glycine max
  Coding DNA Sequence Number=SeqID_63002
  Gene Ontology: Mol. function=uridine kinase activity; Cellular component=cytoplasm; Biological process=biosynthetic process
  Homolog annotation: Hit_ID=Q54R62; Match level="QueryCoverage=71%, HitCoverage=44%, E-value=1e-35, Identity=38%"; Hit description =Uridine kinase
  Pfam annotation: Domain name=PRK; Domain location=65-230; Score= -15.7; E_value=3.7e-06; Accession=PF00485.8; Description =Phosphoribulokinase  Uridine kinase family
MDDEVVQRVFHEGGRDYFQQQPSTSSSSSSSILQSLPLHVSFDHGYYLLVKSIQELREKKDGLVTVGIGGPSGSGKTSLAEKVASVIGCTVISMENYRVGVDEGNDLDSIDFDALIKNLEDLTKGNDTSIPEFDYQEKKRVGYKAIKSASSAVVILDGTYALQAKLRSLLDIRVAVVGGVHFSLLSKVRYDIGDSCSLDYLIDSIFPLFRKHIEPDLHHAQIRINNSFVSSFREAVYKVKCRSEVQTSLSSQVEHLKFKLGS

SEQ ID NO: 179781 - protein, 42 aa, Glycine max
  Coding DNA Sequence Number=SeqID_63003
MLVNVVAKAKSEGILVAMKGEATVVASGRQRKDAETAVKQQQ

SEQ ID NO: 179782 - protein, 95 aa, Glycine max
  Coding DNA Sequence Number=SeqID_63004
MYLRPPSASEEARINDWIKVRQSGIRYYLSLGDQRIVDKNFIIRPKAEFEGVCKRFDWYCRIGIRTDLCQHINVYIFEKDFTLNDNDKTKIIVFH

SEQ ID NO: 179783 - protein, 185 aa, Glycine max
  Coding DNA Sequence Number=SeqID_63005
  Gene Ontology: Mol. function=uridine kinase activity; Biological process=cAMP biosynthetic process
MGINGPWITKSYLEMILQRKGVPRLSTPPLVSNTTVAGSQETVIAAPKPIRVTPNLVTGIDDLPQPWTRSPTKSKMEPVAAEWHFISSDSSQPDNSVLGIFLELENVSIFGDNFLHAYLRFPLYQDFSHEATTDPSSFRDSIRLASMPDSFDLDRGLLLAVQAIQALLENKGVPVIVGIGNMDVS

SEQ ID NO: 179784 - protein, 135 aa, Glycine max
  Coding DNA Sequence Number=SeqID_63006
SLRVNGLAFLWLTNGVDDDVSLCVSTGSLASGGQKSLRVNGLDCLWLTKGADNDVSLCVSTVRITIRYSRMSSDSPSLDDKGVEDDKSTLATACYQTLSLTDSERVCAGYRIWHLRVPKDSQVTIAKGGAVNKSE

SEQ ID NO: 179785 - protein, 114 aa, Glycine max
  Coding DNA Sequence Number=SeqID_63007
MPPTRHPLDPDKSNRALGFPVLITGLCQSFGVPVTPSMIHECLYQLSLSQQSQGFTPFVCPTPDQFRAKVAWPRDWPEAQEGEAPAEAPSDAEEAHMVEEMTDLLGFLGGSGAT

SEQ ID NO: 179786 - protein, 242 aa, Glycine max
  Coding DNA Sequence Number=SeqID_63008
  Homolog annotation: Hit_ID=Q7N9D0; Match level="QueryCoverage=78%, HitCoverage=45%, E-value=7e-12, Identity=28%"; Hit description =Similar to macrophage infectivity potentiator
TQQAEREKQLAALDSEKQQQAHNLAQLTRELEAAKQQPAAAPKLSAPKSDAERDGYTLGQFIASNAVVQLQMVKDIGLSISMDQLIAGLTTQLQSGDSLLDGEEMARRYATMQASIGKGLNALIEKGYAQLDKKVAKRKALKKDLGMQWFAVKSVKGKLLPDQQAAVSVRVTTLSGKVINDFSHDQVPFNDSLSPLLQEGMSLTGKGGAVEGWALAKDIYEREPLPPWVAPYDVIHYQLTIK

SEQ ID NO: 179787 - protein, 303 aa, Glycine max
  Coding DNA Sequence Number=SeqID_63009
  Homolog annotation: Hit_ID=UPI00006A17C9; Match level="QueryCoverage =47%, HitCoverage=100%, E-value=9e-11, Identity=28%"; Hit description= UPI00006A17C9 related cluster
TLTFRGLHVLPTRGLHVLTFRGLHILDFIGLHALNFRGLDFLAFRGLDVLTFRGLHVLAFRGLHVLAIRGLHVLTFRGLHVLAIRGLHALTFRGLHALKCLTETCAPGYGTNSFLLLVPGPPPDIGGRPAVRAQPEREAITQLLCIPGQDFTRAATKRRVRIMRTNMTTLTQIWMTLLLSNIPPDDHNVDLPPTEVSVGLYRRDIGEDHAHETPNGPGEVQQGPGVSSSGYGPLSVLQGAHPPQQGVAPTRHPVDPEEPNRALGFPALVTGHCQSYRAPVPPASSCHRDIGKDHTRKTLSGPG

SEQ ID NO: 179788 - protein, 203 aa, Glycine max
  Coding DNA Sequence Number=SeqID_63010
MDFFSDESFECIQAFQNSNLIPFMSLKLPVYSELVKAFYSNLEIQESILIFKVFGIKMVIDQSLFYDLTQLSSDGVRFEGALDDDWKFDFSMHDARWLRSFLIGAVVVASFGYRKERDGSWVKNGAQPNDDEGHLPVEEDSSLLHSILHRFDGLQTYVGEGFDSLERQVDTRFEERNSRIAEVKEDVTIIRDCFDLPPATTSV

SEQ ID NO: 179789 - protein, 122 aa, Glycine max
  Coding DNA Sequence Number=SeqID_63011
  Homolog annotation: Hit_ID=Q47336; Match level="QueryCoverage=44%, HitCoverage=63%, E-value=3e-13, Identity=64%"; Hit description=LacZ -alpha peptide
DAGSRQARQGASAGVGGCRGWLNYAASEQIVLRVHHMRAIGAGLFAITPAGERGMCCKAIKLGNARVFPGLTSLGYVNSYFQIKYVGNEQEKRSLQMEGLNLMDKTLSVQGARISFRIWDVA

SEQ ID NO: 179790 - protein, 111 aa, Glycine max
  Coding DNA Sequence Number=SeqID_63012
MKRKQFTAKNIHPSKSGEKEGMISSMKEVVESLKEFVEVIKKKMENKKKMEIKEAQEVIHEVVNELDNIPNFNGALRHREIDWLTENPIKFEIIKALPLYEKEDHISSFMP

SEQ ID NO: 179791 - protein, 190 aa, Glycine max
  Coding DNA Sequence Number=SeqID_63013
MQLKNDDDDVNTMLMCNDQYSCVGPIELLYTIGRTPDGILSLLQVTMTLTHDVLLYYNGRWNMSRQHEFVGYSFIGKHPKRFDIPSRCTIDGLKDVINQVAPQGIPPYDIHESQTVTRLFFEQSGHSEYLDKVIKFEIIELKADDDVLKVLVQYNYWKQFGPIEILAVFSKPVIKMEDDMSRSQHDSMKN

SEQ ID NO: 179792 - protein, 80 aa, Glycine max
  Coding DNA Sequence Number=SeqID_63014
  Homolog annotation: Hit_ID=Q1S175; Match level="QueryCoverage=50%, HitCoverage=11%, E-value=3e-08, Identity=51%"; Hit description=MtN19- related
MVSLRYKISWVDWDIYQIPVKVYILDSTDKVRSNGSKILHDCLAEYTIPATGGGGDTPHVQKANIPMEKGGDEQYFSPFL

SEQ ID NO: 179793 - protein, 147 aa, Glycine max
  Coding DNA Sequence Number=SeqID_63015
  Gene Ontology: Mol. function=metallopeptidase activity; Cellular component=membrane; Biological process=peptidoglycan metabolic process
  Homolog annotation: Hit_ID=Q8PL85; Match level="QueryCoverage=73%, HitCoverage=18%, E-value=3e-08, Identity=31%"; Hit description =Hemolysin related protein
MARHTPVAVHRRRWTAQALLTRRQVIVLAPPSVASHARALEYADRSVHAIQRPPPIWRNCPRSVYSTPSDSRNPPVDAPGSRVPPARQKLGHDFRPQGDPPDSTQPAGLRWFRPSPNAQLPDPATHPGCMPVFLPLGNSACRWHLPR

SEQ ID NO: 179794 - protein, 419 aa, Glycine max
  Coding DNA Sequence Number=SeqID_63016
  Homolog annotation: Hit_ID=Q0X1B9; Match level="QueryCoverage=71%, HitCoverage=42%, E-value=2e-47, Identity=38%"; Hit description =Hypothetical protein precursor
RPARAAIGCPYSRWRRTTASQKAEEHGSQASASQPCIHPVHPSVTRKYLNRPVGGTSVLQTDRPVSSALTCRPLEWRHRAGGSYGNHGLGLHRPHDPHHHRAAHPWRLRHVAPVRAVGAGGLGHPRPVHRPEARRHPHHRQAQFGHHGNAARGRSRRRLLRQARPALHRGHGRQHRGARGGQALKPGRAVAAACDDPAGAQARVLHLRPCQERDHRAGCRFPTAPGRVDAGRAPSLRLSVLHRAHRQPAWFRGPPDPGARLLQPGRAGSLGAVVQRLCHRARAQPGQPFPAGPLDLRAGTFRRGIAAGYAYPHRTGTGGLAVVHRHAAQRASPRWLRCRTGGRDGGSGRHHRHHAAGHNTRRAGHHTGHAELERDAVAIDDGTAALLRKEPVGSAARRRAGTGDPRSLPGHGSHPAWAA

SEQ ID NO: 179795 - protein, 413 aa, Glycine max
  Coding DNA Sequence Number=SeqID_63017
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-23, Identity=27%"; Hit description= UPI00006A17C9 related cluster
RPRYQRVARPRHQRAARPHLQRLHILAFQGLHALTFRGLHALTFRGLHAFAIRRLHVLSFRGLHVLPFRGLHAPAFRGLHVLTFRGLHALALRGLHALALRGLLVLAFRGLHVLAIRGLHVLVIRGLHALAIRGLHALTFRGLYVLALRTARLHALNMRGLLVHAIRGLHALTFRGLHVLALRSTHPYLQRATRPHHQRTARLHALTFRWLHAFTFIGLHALNFSGLQVLALRTTCRHLQTTTCPHTQKATRPHLQRTTRPHLEEYTSTPSESCTLSPSEGFTPSPSEDYMSSPSEDCTSSPSEDYTTTHPRLQRATRPCLPRLHALTIRGLHTLTIRGLHALAIRRLHVLAFMGLHVLAFIELHVLPFRAIHAPAFRGLHVLTFKGLHALALKGLQVLAFRGLHVLAIRGLH

SEQ ID NO: 179796 - protein, 109 aa, Glycine max
  Coding DNA Sequence Number=SeqID_63018
MKWKMVCTKKTRQMTSEEAKEIADKIEQATQGSFFAHGRQDVLTTAIGRLEHPSRMRAAGVSVTIKRYFGSAPRTSCTSSSMAPEDLEQLTQKIRDKLEESITEKCLNN

SEQ ID NO: 179797 - protein, 60 aa, Glycine max
  Coding DNA Sequence Number=SeqID_63019
PFAKRKPRAKRISVHALSHESRALSAQPLHLRLIHSAKLAKAKLSLIEFDLSSAKRQPNR

SEQ ID NO: 179798 - protein, 47 aa, Glycine max
  Coding DNA Sequence Number=SeqID_63020
MNENAIHEAPKKGLRMEICIKQSISYGSKLKGVGHMNENAIHGAPKR

SEQ ID NO: 179799 - protein, 176 aa, Glycine max
  Coding DNA Sequence Number=SeqID_63021
  Homolog annotation: Hit_ID=Q7A8Q6; Match level="QueryCoverage=32%, HitCoverage=13%, E-value=8e-17, Identity=56%"; Hit description =Putative integrase
TKSFHSFRHTVSTLLKEKGVSPELRAQLVGHVRAKFNIADGLDAVRDALRRKRGKQTGKLPSAFFIEGSGFYGAKFGGAQNVSGEVYYCFNAGLYAANDVFAWAVAPVCACVKSIENRSHAFSAVKGANQGHADDLHYGVKSSSGAFVQGVLQYRDGSQSIISASPLDGSLVDSNI

SEQ ID NO: 179800 - protein, 114 aa, Glycine max
  Coding DNA Sequence Number=SeqID_63022
GLRDRGSLVVGDSGTQGKEHRSLEQMDQWLTLNSGFTCDSPQISASPHQLDLAPYASGPYNAQWNAPGLLHDKHTLRSSRILGEMEVDEPWLGLWLPLNYQVDMGASQHRTLEL

SEQ ID NO: 179801 - protein, 130 aa, Glycine max
  Coding DNA Sequence Number=SeqID_63023
MKDKGEDFESYETSQYRCRNLPFGGRATRGSRVRLPGEEGAQSRHQRLFRENVGKTEKRVWSTELLIVKGSGVVFAHGKGISTPRVRHKGRQPLIECARHDFKGISLAPTYPQLQLGNQTYVVLLELNIG

SEQ ID NO: 179802 - protein, 294 aa, Glycine max
  Coding DNA Sequence Number=SeqID_63024
  Gene Ontology: Mol. function=helicase activity
  Homolog annotation: Hit_ID=Q1SRJ5; Match level="QueryCoverage=99%, HitCoverage=52%, E-value=2e-50, Identity=43%"; Hit description =Probable helicase [imported]-Arabidopsis thaliana-related
MIHGPCEILRPASPCRKEGKCSRFYPKKFQPTTLIDGDGYPVYRRRNTGQTITKNGIIIDNRCIVPYNPRLLKKYQAHINIEWCNQSTSIKYLFKYINKGYDRVTAVMVHDDNETVSHANTPNDEIKEYLDCRKPSVERLQFHLPGQHSVLYQDHDDIDDLLSNPSISKSKFIAWMNTNQAFVEGTMNKPEEVWEKTWHWLSDDIVYSHHRSSNTPGLHIDDSNLMNLVLLEVEKLLLVNQRSLKDYPSMPYPENANLLTHVDNHLILSELNFNNEELRSEFLNLFSQMTDQQA

SEQ ID NO: 179803 - protein, 84 aa, Glycine max
  Coding DNA Sequence Number=SeqID_63025
MEELINKTQLFPKIIPTSSRWLCGSIKEYYFTYSTILILFPRTKVHDHHRYQPHGTKIERVDKSGALAPAYPPSKRKSDHVVLS

SEQ ID NO: 179804 - protein, 162 aa, Glycine max
  Coding DNA Sequence Number=SeqID_63026
  Homolog annotation: Hit_ID=Q6CQF2; Match level="QueryCoverage=25%, HitCoverage=50%, E-value=2e-10, Identity=73%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRLTWVGRCGCSVEPRHGIESSKWAIFGKQNWRCGMNRKLGYGAQLRANLDPTKGVGRLRQQDG

SEQ ID NO: 179805 - protein, 123 aa, Glycine max
  Coding DNA Sequence Number=SeqID_63027
SLAARVSTKERFSDPSGNDLDTGDSENYGLHVEENPPRLVALGRLYEGSITIHNIPLCHDQVRVGVKEVSYADAPIHVPIEEVQHMTETSMRAGNVDVYGFLEPQSIQRSGQSQFESESYIKN

SEQ ID NO: 179806 - protein, 85 aa, Glycine max
  Coding DNA Sequence Number=SeqID_63028
MPKSSPNMRVKQEVSTRVKPRLLCKQSMGQNTPNKIDDDDSNSHQGEKTRISIHKMPRNSYFKNNYPLPVHNPKFKEEHAMLYKT

SEQ ID NO: 179807 - protein, 103 aa, Glycine max
  Coding DNA Sequence Number=SeqID_63029
  Gene Ontology: Mol. function=DNA polymerase processivity factor activity; Cellular component=PCNA complex; Biological process =regulation of DNA replication
  Homolog annotation: Hit_ID=P22177; Match level="QueryCoverage=92%, HitCoverage=39%, E-value=2e-25, Identity=65%"; Hit description =Proliferating cell nuclear antigen
  Pfam annotation: Domain name=PCNA_C; Domain location=2-99; Score =78.8; E_value=1.7e-20; Accession=PF02747.6; Description =Proliferating cell nuclear antigen, C-terminal domain
PIEVTEEGVGFSTKRDIGTSIIFCWHNTSVHKADEEATAIEMTQTVSLNFGLTFLNSFTKATPLSNTVTIFLSNQLHLPVVFQYQIGEKGHLRFYLKPIKPEY

SEQ ID NO: 179808 - protein, 75 aa, Glycine max
  Coding DNA Sequence Number=SeqID_63030
MLQPYGINIGLKEHLNPVTPKAYTPKSPSGPLPPDSGYNAKGFPLSSDIIWKFPTVRMLGIGLRTWCSNFTTIQW

SEQ ID NO: 179809 - protein, 88 aa, Glycine max
  Coding DNA Sequence Number=SeqID_63031
  Pfam annotation: Domain name=Toxin_23; Domain location=32-57; Score =9.7; E_value=0.048; Accession=PF08093.2; Description=Magi 5 toxic peptide family
  Subcellular localization annotation: CTP_CleavageSite=53; ConfidenceScore=5.05e-01
MVKSAGPNGSRMSSGPMPLDDKRAQKTTLVSACHWTRLCLNGKKVCGMTIICLCMSYDRKVSMTEIVGRPTKARLLLLRILNEELRPT

SEQ ID NO: 179810 - protein, 305 aa, Glycine max
  Coding DNA Sequence Number=SeqID_63032
MAKPNNAKPGCFSDFFQLLFCAEDGNSSPMHPSNHITKPYATEVVHSHKDAMAKNATKPGVVARLMGLDSLPSTKLVSNTNNTPDSIPRSRSVNFVDYLRKFDTTSQANHHQVKTTSASFREVPSLLQHKNKNNDLVVFYWNNESEDQEVVSFLRKQEMGLGESRQRKKQGSKNKEIVSVTKERSHTKRKKISKFENEPRVVLPLKHSSKVRNHHETKVLAPVSACSKSCSNSRRKCGSGPSGLRPSSNLPNKQKKVFSEPKCTKKTKKQQSTKKIDTECSTENFSPISVLDDYDYSFLYGPDFP

SEQ ID NO: 179811 - protein, 85 aa, Glycine max
  Coding DNA Sequence Number=SeqID_63033
MVKYLRCNYICTRKFLDNFVGLRKTFQYVLNFGLINSICLYGTFREKEVGGLGIKDLRALNLVLLEEGLSGGRIFGIWMRMVKGM

SEQ ID NO: 179812 - protein, 1411 aa, Glycine max
  Coding DNA Sequence Number=SeqID_63034
  Gene Ontology: Mol. function=protein binding; Cellular component =membrane; Biological process=defense response
  Homolog annotation: Hit_ID=Q19PK7; Match level="QueryCoverage=61%, HitCoverage=91%, E-value=1e-70, Identity=27%"; Hit description=NBS -LRR type disease resistance protein
  Pfam annotation: Domain name=LRR_1; Domain location=1100-1121; Score =10.7; E_value=2.9; Accession=PF00560.23; Description=Leucine Rich Repeat
  Pfam annotation: Domain name=LRR_1; Domain location=1123-1144; Score =6.6; E_value=17; Accession=PF00560.23; Description=Leucine Rich Repeat
  Pfam annotation: Domain name=LRR_1; Domain location=1145-1173; Score =1.5; E_value=1.5e+02; Accession=PF00560.23; Description=Leucine Rich Repeat
  Pfam annotation: Domain name=LRR_1; Domain location=1280-1305; Score =9.4; E_value=4.9; Accession=PF00560.23; Description=Leucine Rich Repeat
  Pfam annotation: Domain name=LRR_1; Domain location=1353-1375; Score =8.9; E_value=6.1; Accession=PF00560.23; Description=Leucine Rich Repeat
  Pfam annotation: Domain name=LRR_1; Domain location=1377-1401; Score =1.6; E_value=1.4e+02; Accession=PF00560.23; Description=Leucine Rich Repeat
  Pfam annotation: Domain name=NACHT; Domain location=688-839; Score= -34.5; E_value=0.028; Accession=PF05729.3; Description=NACHT domain
  Pfam annotation: Domain name=NB-ARC; Domain location=648-946; Score =125.4; E_value=1.6e-34; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=1100-1121::1123 -1144::1145-1173::1280-1305::1353-1375::1377-1401::688-839::648-946
MAQLAVSFIVPRVARKLSDVLIQESARLVEVADRIRWIVKELEYMQKFVQDLERSNSNQLEEMFEEITNVVARQAEDVIDTFLNKSVNRRKKGVQYLLEKYDIAKELEPICDRVREISERISNYLNEPIAVTIETPRVRATTIVSPALEELDHILTQNLIILDEELIEIVEHVRDKDLGDTHNIVSKLNSAEESIHSQSQRARVWLKDIENICADTVAVAENFIATRRKRLSRTGWLWQVFYFFEQRVSERKFKQQMEYIRTQLEDALYRRWTFGDGGKDMGDKIGSRSRPAPSLSLVRLTLAKVPLFLFNSSFAPLLFVAVITTIDFFMFGRKRRAREHKLKEKKKSRQLTPFLWFDLVDFMVYVFFYAFPAELWIVLQFVWIVYTVIPLSVSLERSLDENLETIRRYLALMDALFSDINTESAEGLNKRQQVWVNQLRLVAHKVHSLSAYPKPRGWNIVNKIIFAEDITDFLNEILDISDKKNIYGFASIQGRKELVSTVQRSESKDIAEHSGAHPQPYASSSSYQRVTGLRSKYQLIKDEMDLMNALIDDVGELGKLEGRSEIWVEQMKGIASEAEAVIRECDSELESNHYFKHLLVRYKIMGKIDRITEEIEDASRRRNAYGLVQLQSRDESLSTVQMLRRKSEQPSLIGKESIIVGKEFTIIGFNEDVDFLTDHLLSNEESCCVTSIVGIEGTGKTTLARLIFDNKAVEDGFTCRVPVSVSPGCTVDKLLEEIAKEAATQIMGGQRNKWTIQEALRALGSTKYLILVDGIETCQLLDSLTEAIPDKSKGSRFLLTTRNANIVARQPGTRSFVYHLQLLDDENSWILFKKKLKVPIPSEPKLIEVAKKIVAKCGGLPLEILKMSELLSNKDVTEEQWSRVQEQPNPSQNPWSETLSSVTISLPSHLRRCLFYLELFPANFGIPARRLVVLWVAEGLVQHGENQEPPEQVAERYLTKLIDLNLVQIAKRRPNGKVKTCRLPNALREILVEEVQARKDLNSVSNISRIRQVADRLDRKDKWDKHMHGITTSDSASLGIYKDVFSFLSFDFREGSKPGQDISNFLNLCISSKCLLLLRVLDLEGVHKPELPENIKKLARLRYLGLRWTYLESLPSSISKLLKLQTLDLKHTYIHTLTNSIWKMELRHLFLSETYRTRFPPKPRAAGDSLSDLQTLWGLFVDEETPVKGGLDKLVNIRKLGIACQSMSPEQGAMQSQLDAVADWIVKLEYLQSLRLKSRDEKGRPWNLHLKSLKNHINLTDIYLLGNLNGPSILTQLPPNLVELTLSHSKLEEDPMKILKDLPNLRSLSLHAESYIGIKLVCNSKSFPQLYVLKVWKLEQLKDWEVKQQALPSLRQLEIRSCLRMTKLPDGLKHVNSLLELKLTNMPVEINTDKHNIPPNCEVHRDDSAQL

SEQ ID NO: 179813 - protein, 284 aa, Glycine max
  Coding DNA Sequence Number=SeqID_63035
  Gene Ontology: Mol. function=structural constituent of ribosome; Cellular component=intracellular; Biological process=translation
  Homolog annotation: Hit_ID=Q2R0M4; Match level="QueryCoverage=99%, HitCoverage=38%, E-value=2e-56, Identity=45%"; Hit description =Expressed protein
MLLAVVWNVLEIRVLVLFSLILQIILIVCGNQRKYKAGWVLQFGVWFTYLSADWAATFVLGILSKDSKNPSTDPTNSIIMAIWAPFLLVHLGGPDTITAYSLEDNELWLRHFLGLISQLFGAVYVVYSSWNDRNLNYVTIPVMVAGIIKYTERTLSLWLGSSKKFRESIHRPPDPGPNYAKFMDDCTAKIAEGYKVELKVESTPILSDHSLAAIANESVPDALRLHYGFYFLEIFECLFADLILGFQELQESQHFFQNKSWEHAYKVIEVELGLMYDKLYTKAV

SEQ ID NO: 179814 - protein, 288 aa, Glycine max
  Coding DNA Sequence Number=SeqID_63036
  Gene Ontology: Mol. function=structural constituent of ribosome; Cellular component=intracellular; Biological process=translation
  Homolog annotation: Hit_ID=Q2R0M4; Match level="QueryCoverage=80%, HitCoverage=32%, E-value=2e-45, Identity=42%"; Hit description =Expressed protein
MPLAVVWKILELRVLVLLSLAFQIMLIVFGNQRKYQADLVATYVLGILSKDSKDHPVHMAIWAPFLLVHLGGPDTITAYALEDNELWKRHFLGIMTQIFGAVYVVYSSWNGSKLNYVTIPVMVAGVIKYGERTWSLWCGSSEKFRESILPPPDPGPNYAKFMDDCTAKKAEGYKVELKVKDTSTLSYNSKGAIANENVQDALLLHDGFYFFKIFERLFADLILSIQELKISRNYFQHNGMSWERAFKVIEVELGLMYDKLYTKAVVTYCGLGFGFGPGFCFGLGLGLK

SEQ ID NO: 179815 - protein, 356 aa, Glycine max
  Coding DNA Sequence Number=SeqID_63037
  Gene Ontology: Mol. function=nucleic acid binding; Cellular component= intracellular; Biological process=DNA integration
GCPVEVKVYNPHEKNVDARTISGFFICYPKKSKGCRFYCPNHSTGIVESGNAQFIENGQLVGSINTQRQHNIQITRDDEPADNVQVINEEVIEVVQEIAPRRSERHRRPAISSDYVVYSLEHECDLSIDEDPVSFRQAMESEILKSSKRVGCKWVYRTKCGSKGNIERYKARLVAKVFTLKNGNDYKEIFSLVSKNDSLRIVLVLVARYDLDLHQMNVKIAFLNGDLEEEVYMNKPEWFVSTRKEHLVCKLKKSIYGLKQGSRQWYLKFTITPYGFVENTIDRFIYMKVSGRIFVILILYVGDIFLVANDVAMLHNVKKYLSNNFEMKDMGKASYVIGIEIFCEKSQGLLGLSQKG

SEQ ID NO: 179816 - protein, 405 aa, Glycine max
  Coding DNA Sequence Number=SeqID_63038
  Gene Ontology: Mol. function=DNA binding; Biological process =regulation of transcription
  Homolog annotation: Hit_ID=Q84QT1; Match level="QueryCoverage=50%, HitCoverage=76%, E-value=2e-48, Identity=54%"; Hit description =Transfactor-like
  Pfam annotation: Domain name=Myb_DNA-binding; Domain location=126 -177; Score=40.8; E_value=4.7e-09; Accession=PF00249.21; Description =Myb-like DNA-binding domain
MIGGKQRAANAKKEEKKGKAAESDKIPVKSDSASSLKPKSCAFHIPIFPFPFLLPLSPNGSPITQSSPFFFPLSFFFASRWGFKFHHRMFSRLIHPHEGQEDMQGGSNHAHLGDPCLVLTSDPKPRLRWTADLHERFVDAVTQLGGASKATPKAIMRTMNVKGLTLYHLKSHLQKYRLGKQSGKDSDEGCKDVNFILLIEKTVQGMSASYLQESPGTDNSSPKLPDANEGHEVKEALRAQMEVQSKLHLLVEAEKHLQIRQDAERRYMGMLERACKMLADQFIGDVTIDMDGQKFQGLESKTSRSSLVDHVGFYPQACTEVGGMHASVVSPILQPQGADCFTESCLTSLESLGGLTLEGSPGGSKKRMLNLDSMVAPLIWSEANTRTQGIHLAKVNPSGMTRYGM

SEQ ID NO: 179817 - protein, 1325 aa, Glycine max
  Coding DNA Sequence Number=SeqID_63039
  Gene Ontology: Mol. function=nucleoside-triphosphatase activity; Cellular component=membrane; Biological process=defense response
  Homolog annotation: Hit_ID=Q19PL1; Match level="QueryCoverage=59%, HitCoverage=80%, E-value=9e-51, Identity=25%"; Hit description=NBS -NBS-LRR type disease resistance protein
  Pfam annotation: Domain name=LRR_1; Domain location=1018-1039; Score =10.4; E_value=3.3; Accession=PF00560.23; Description=Leucine Rich Repeat
  Pfam annotation: Domain name=LRR_1; Domain location=1041-1062; Score =7.5; E_value=11; Accession=PF00560.23; Description=Leucine Rich Repeat
  Pfam annotation: Domain name=LRR_1; Domain location=1063-1081; Score =1.3; E_value=1.7e+02; Accession=PF00560.23; Description=Leucine Rich Repeat
  Pfam annotation: Domain name=LRR_1; Domain location=1196-1221; Score =8.2; E_value=8.4; Accession=PF00560.23; Description=Leucine Rich Repeat
  Pfam annotation: Domain name=LRR_1; Domain location=1269-1291; Score =11.6; E_value=1.9; Accession=PF00560.23; Description=Leucine Rich Repeat
  Pfam annotation: Domain name=NACHT; Domain location=550-689; Score= -36.3; E_value=0.039; Accession=PF05729.3; Description=NACHT domain
  Pfam annotation: Domain name=NB-ARC; Domain location=514-855; Score =30.9; E_value=2.9e-12; Accession=PF00931.13; Description=NB-ARC domain
  Pfam module annotation: Pfam domain module=LRR_1::LRR_1::LRR_1::LRR _1::LRR_1::NACHT::NB-ARC; Domain location=1018-1039::1041-1062::1063 -1081::1196-1221::1269-1291::550-689::514-855
MHFFDIYRHGNEAEQSTGRLRERLLMNCEQTIIDVSVETPGAVEQSNDRLRKRLLLNSEQTNIDVSIETPGAVEQSTDRPRERLLLISEQTNIDVSVETPGAVATALEKLDHILTQNLITLEDVIKRVGYVRDDLLGDTQNIILSSNLSSTAGELSQREKLWLEEVKDVCDYTVGVAEKFIARTERRLSMGRLWKVFYLYGQYASEQEFSKQMEYISTQFGDALYRRWIFGDRGDKIGSRSRPVAFPSFSPPANLFTVIARTVSLWRSLDENLKTSQRYLALMSALFSDIGSADEGLNQRQKVWVNQLKLVARKGESLVAAYPKDGFPFSVSRYRYAKNINRLLNEIIHISDRKNIYDIANIQGGKQNESIAEDNHNSPDSICYRDTTELDTGEKQLMDALLLDVKQSGYEDNHNSPDSICYRDTTELDWELDLITGEKQLMDALLLDVKRIGYEDLDGRYKIWVNQIKGIARETKAVIDESGGRELDRKPMLNRIRQKIKDASRSRKAHYGLVQCESGAESLRPRTQPFFNENVKVLMAQLLSDEKFRCITSIVGIKGTGKTKLAKMILRNEAVINHFDYRIFVPPSYATVEQIKEYIAKKAAEIIKGDKQNALATLASKKHLIVIDGIETPHVLDTLIEIIPDMLTASRFLLTTHNANVAQQAGMRSFVHPLQLLDDENSWTLFTTDLKVNIPLESKLSETGKKIVAKCGGLPLEIRKTRSLLSGKDVTQEDWSSVLKHPNLPLEILKISKLFSRKDVTEEKKWSSVLKHPGLPSEILKIIKLLRRKDLTEEEWPSVRQNPWSDTLNTININLPSHLRRCLFYFELFPANFGIAARRLVALWVAEGLVHHGEDQEPPEQVAERYLKELIDLNLVQIAKSKPNGTVKTCRLPHALHDLLLRKPEDARFPQVYTSKELIANQKYPEIREVADRLDENHNWHQHIHGNITNDSPQVGTYYKGVHSFLSFDFREGSRPGQELCNFLNLCISSNCLLLLRVLDLEGVYKPKLPESIERLTRLRYLGLRWTYLESLPSSISSLLQLQTLDLKHTYIHTLTSSIWNMKLRHLFLSETYRTRFPSKPKGTGNSLSDVQTMWGLFVDEETPVKGGLDQLVNITKLGIACQSMSLQQEVMESQLDAVADWIVKLEYLQSLRLKSRNEEGQPWKINLKSLKKHNNLTDMYLLGSLTNASVLFPESLVELTLSHSKLENDPMKILKDLPNLRSLSLLAESYEGEKMICKSKSFPQLYVLKVWNLKQLKNWLIKQQALPSLRQLEIRSCPGLTNLPFGLWHVKSLLELTLTNMSKEINIGIYRLPDNCKVRRDNSQ

SEQ ID NO: 179818 - protein, 432 aa, Glycine max
  Coding DNA Sequence Number=SeqID_63040
  Gene Ontology: Cellular component=chromosome, pericentric region; Biological process=meiotic chromosome segregation
  Homolog annotation: Hit_ID=Q4QSC8; Match level="QueryCoverage=80%, HitCoverage=91%, E-value=5e-14, Identity=24%"; Hit description =Shugoshin-1
  Pfam annotation: Domain name=Shugoshin_C; Domain location=371-397; Score=20.2; E_value=0.0071; Accession=PF07557.2; Description =Shugoshin C terminus
MEGVGAIFLDSNLEAVGLGGAKAKRVKVVKGDSVPVANVGASQNKILADISNLPQQPKQHISVDHLLKFLFTGVLSTCVDSAIIESCKAELHKCQTNFQKLRKQNAELALTNAQMLAELNSSRQKLRELQLELGSKNGILNAMRLELTLKEQTDKTKHETDANEVRACQSKLSDQSLQEDNKGNAKRKRVSKPQCSVVNLLSSAPAVIKQVKSTGKVDNQRYSLRRQSAGLKAEKPEPTKDSLEVVEVKDDISHLQENLANENGPTSLGSKVHDEAREATESSRPTNTEQVHVKKNIEKKRQSMRRQTNRFRPGNPEPAEDFFKIDDAKFTVSQLSDNMSEKNCPTTSTVTSEQENDACTFEPQETRRSSVGRPLRRTVEKIVSYKEVPLNLKMRRDKSEALYALHPDAIVHGDRGSMDLFFNSFLFRALHP

SEQ ID NO: 179819 - protein, 44 aa, Glycine max
  Coding DNA Sequence Number=SeqID_63041
MGSKGAFIFVLLVALAVVEFLVNVIKMELGVLLYIPMLHARALR

SEQ ID NO: 179820 - protein, 102 aa, Glycine max
  Coding DNA Sequence Number=SeqID_63042
MSLSCKQAASGSDEHCSVHLRLVKGLVHWDLKIQLQHMGLGSQSLIETTGSQCGVHKSGYQTYHKDNTCKGTNFICEQPSGKNSLLYYFCSSKMSPKTHSAK

SEQ ID NO: 179821 - protein, 156 aa, Glycine max
  Coding DNA Sequence Number=SeqID_63043
  Gene Ontology: Mol. function=iron-sulfur cluster binding
  Homolog annotation: Hit_ID=Q00XT4; Match level="QueryCoverage=49%, HitCoverage=12%, E-value=1e-16, Identity=49%"; Hit description =Homology to unknown gene
MAPPYETRNAIAIWWHFSKNPQWSRLTFSSHCPNQALSLVTLDAYLTWASGICNVINQTITDEDVERLIELVKGISCKINLISFNPHSGSFFKPTKYERMIEFRNTLAGAGLIVFLRLSRGDDQLASCGQLGKPGTIQAPLLRVPEQFQMAIGSST

SEQ ID NO: 179822 - protein, 156 aa, Glycine max
  Coding DNA Sequence Number=SeqID_63044
  Homolog annotation: Hit_ID=Q2PS26; Match level="QueryCoverage=30%, HitCoverage=8%, E-value=4e-07, Identity=52%"; Hit description=SUMO isopeptidase
MESLGEERDIDHHQENCSFNALVNFPNVILLVMELRGIVSCYSKYSIEFKCHIGWLEDEWMIYEYSKKDAFQAIQLDGSRPRKPIVLDIDDDDDDDEAHIVEKTENKFPEYLKEAKIYFPSRDDPECVEICYTDTNCLAPEGYLTSTIMNFYIQSF

SEQ ID NO: 179823 - protein, 225 aa, Glycine max
  Coding DNA Sequence Number=SeqID_63045
  Homolog annotation: Hit_ID=Q9FMC7; Match level="QueryCoverage=82%, HitCoverage=97%, E-value=2e-58, Identity=60%"; Hit description =Genomic DNA, chromosome 5, P1 clone:MUK11
  Subcellular localization annotation: CTP_CleavageSite=32; ConfidenceScore=5.03e-01
MATLMGKAPRILYTTQHLVNNSVTLPTNFAAMATHSAATERTYKESFDSAANKRYADHIIPHILHLYGSSATSRDFEIYAANASFEDPLMCAHGVKQIKSAFYTLPKVFKKSKIVEYSIKENMVSPGKGEILIDNKQYYKFLGKDINMVSLIKLYIEEGKVVRHEDCIKQSRALICKDYVRWDKKPISNRETAKLPLLGRIAEMTRRGSMLATHVLMRFGKDPNV

SEQ ID NO: 179824 - protein, 212 aa, Glycine max
  Coding DNA Sequence Number=SeqID_63046
  Gene Ontology: Mol. function=sugar porter activity; Cellular component=integral to membrane; Biological process=carbohydrate transport
  Homolog annotation: Hit_ID=Q1T5Y7; Match level="QueryCoverage=100%, HitCoverage=27%, E-value=8e-94, Identity=84%"; Hit description=Sugar transporter superfamily; Major facilitator superfamily MFS_1
  Pfam annotation: Domain name=MFS_1; Domain location=11-209; Score= -46.9; E_value=0.044; Accession=PF07690.6; Description=Major Facilitator Superfamily
  Pfam annotation: Domain name=Sugar_tr; Domain location=7-212; Score= -144.0; E_value=0.023; Accession=PF00083.14; Description=Sugar (and other) transporter
  Pfam module annotation: Pfam domain module=MFS_1::Sugar_tr; Domain location=11-209::7-212
MSGAVLVAVAAAIGNLLQGWDNATIAAINPESLYAGSILYIKKEFQLENEPTVEGLIVAMSLIGATVVTTCSGALSDLLGRRPMLIISSMLYFVSSLVMLWSPNVYILLFARLLDGLGIGLAVTLVPLYISETAPPEIRGLLNTLPQFTGSLGMFFSYCMVFGMSLMKAPSWRIMLGVLSIPSLIFFALTLLFLPESPRWLVSKGRMLEAKK

SEQ ID NO: 179825 - protein, 91 aa, Glycine max
  Coding DNA Sequence Number=SeqID_63047
MELLHVWEPFSGFNPLFLGNSFMCEQECHQDEFNSEDAPSTTKKNLGRATPQKLAFVVGVLESPRPINLTLDSHTSNVGLKSQTLEVGIGS

SEQ ID NO: 179826 - protein, 74 aa, Glycine max
  Coding DNA Sequence Number=SeqID_63048
  Homolog annotation: Hit_ID=Q8VZV6; Match level="QueryCoverage=40%, HitCoverage=9%, E-value=1e-08, Identity=80%"; Hit description =Putative phospholipase
AAAGGGGTVGAAAVAGFITGSGGHSFSDGLVAHIPDINPVVDDCITFVENFRSELGDGRRGCWRRGSGPRGWRK

SEQ ID NO: 179827 - protein, 347 aa, Glycine max
  Coding DNA Sequence Number=SeqID_63049
  Gene Ontology: Mol. function=sugar porter activity; Cellular component=integral to membrane; Biological process=carbohydrate transport
  Homolog annotation: Hit_ID=Q1T5Y7; Match level="QueryCoverage=89%, HitCoverage=42%, E-value=1e-139, Identity=79%"; Hit description =Sugar transporter superfamily; Major facilitator superfamily MFS_1
EMALLVEGLGVGGDTAIEEYIIGPANELDEEDQSREKDQIKLYGPEQGQSWVARPVAGQNSVGLVSRKGSMVNQSGLVDPLVTLFGSIHEKHPETGSMRSTLFPHFGSMFSVGGNQPRNEDWDEESLAREGDDYVSDAAAGDSDDNLQSPLISRQTTSMDKDITPPAHSNLSSMRQGSLLHGNAGEPTGSTGIGGGWQLAWKWSERESPDGKKEGGFQRIYLHQDGGSGSRRGSVVSLPGGDLPTDGEVVQAAALVSRSALYNKDLMCQRPVGPAMIHPSETIAKGPSWSDLFEPGVKHALIVGVGMQILQQDCEGLRASPGAAVKLCLGDLLVMGSNPETASLHMQ

SEQ ID NO: 179828 - protein, 255 aa, Glycine max
  Coding DNA Sequence Number=SeqID_63050
  Gene Ontology: Mol. function=transferase activity, transferring glycosyl groups; Biological process=biosynthetic process
  Homolog annotation: Hit_ID=Q9LPN6; Match level="QueryCoverage=99%, HitCoverage=65%, E-value=3e-79, Identity=51%"; Hit description =Mannosyltransferase, putative
MKNLALELYQNQCRMNETIVICHSEPGAWYPLLSETFPCPPSSYHDFKSLIGRTMFETNRVNDEHMERCNIMDYVWVTTEFHESTFVQSGIDPSKVVKIVQPVDVKFFDPVRYKPLDLASRAKLVLGSGEFSKDDWVALYLLTNPYHTDMDFGNKILDFMESSDMVEPVSGWAPEHVIDTHIALRKFPRFFLPEGRMGETTGGGHVNGIAVTEGPFKGHLWAEPSEDKLQVLMRHVMDNLTEATAKGRKAREDMI

SEQ ID NO: 179829 - protein, 251 aa, Glycine max
  Coding DNA Sequence Number=SeqID_63051
  Gene Ontology: Mol. function=sugar porter activity; Cellular component=integral to membrane; Biological process=carbohydrate transport
  Homolog annotation: Hit_ID=Q1T5Y7; Match level="QueryCoverage=85%, HitCoverage=29%, E-value=1e-82, Identity=72%"; Hit description=Sugar transporter superfamily; Major facilitator superfamily MFS_1
KNSFNSKAEAICKIKLSIFLKRSAFWFGSCLIAGGVTIESHFSGINGVLYYTPQILEQAGVGYLLSSLGLGSTSSSFLISAVTTLLMLPCIAIAMRLMDISGRRTLLLSTIPVLIVALLILVLGSLVDLGTTANASISTISVIVYFCFFVMGFGPIPNILCAEIFPTRVRGLCIAICALTFWICDIIVTYTLPVMLNSLGLAGVFGIYAVACFIAWVFVFLKVPETKGMPLEVIIEFFSVGAKQVDDAKHN

SEQ ID NO: 179830 - protein, 383 aa, Glycine max
  Coding DNA Sequence Number=SeqID_63052
  Gene Ontology: Mol. function=protein disulfide oxidoreductase activity; Biological process=cell redox homeostasis
  Homolog annotation: Hit_ID=Q60DI7; Match level="QueryCoverage=55%, HitCoverage=70%, E-value=1e-44, Identity=43%"; Hit description =Glutaredoxin domain containing protein
  Pfam annotation: Domain name=Cu_bind_like; Domain location=214-276; Score=-2.6; E_value=0.00012; Accession=PF02298.8; Description =Plastocyanin-like domain
  Pfam annotation: Domain name=Glutaredoxin; Domain location=84-149; Score=52.6; E_value=1.3e-12; Accession=PF00462.14; Description =Glutaredoxin
  Pfam module annotation: Pfam domain module=Cu_bind_like::Glutaredoxin; Domain location=214-276::84-149
TDLPSFRRPDLSSGSLFDPNLLAAFEHAVKEHARMTEEQRRARVEEESSQKVEDHDPDPDPDPDPDPLMFFEEKCPPGGDGTVIFYTTTLRGIRKTFEDCNKIRFLLQSFKVLYFERDISMHKEFKDELWSSLEGKSLPPRLFVKGRYIGGAEEVLSLHEQGKLRKILVGVPMDYSNGPCDACGGIRFVLCFKCNGSHKVVEENGESNQCLQCNENGLIFDDKFYNLIQVSQKEYQHCTSLEPLRIFNSSPVILPLRERGVLFFICNIPNYCCLGQKIVISVHKDSLEKTPSPSPSQVPITISPHPSSPNASAPQPHGSSSGMSSPPSPTTNTSGGNGGNSPGPSSTQEGKSNAVALVGGRSFTVSLGQLLSMLGAFFGLWVM

SEQ ID NO: 179831 - protein, 146 aa, Glycine max
  Coding DNA Sequence Number=SeqID_63053
  Gene Ontology: Mol. function=zinc ion binding; Cellular component =integral to membrane; Biological process=ubiquitin cycle
  Homolog annotation: Hit_ID=Q1T0Q0; Match level="QueryCoverage=86%, HitCoverage=72%, E-value=4e-18, Identity=36%"; Hit description=Zinc finger, RING-type; RINGv
  Pfam annotation: Domain name=PHD; Domain location=90-135; Score=2.1; E_value=0.036; Accession=PF00628.19; Description=PHD-finger
  Pfam annotation: Domain name=zf-C3HC4; Domain location=91-132; Score =30.4; E_value=6.1e-06; Accession=PF00097.15; Description=Zinc finger, C3HC4 type (RING finger)
  Pfam module annotation: Pfam domain module=PHD::zf-C3HC4; Domain location=90-135::91-132
MLVFLNTTFVIGLVFLLVTIAFACVRLRMARGPNMLNILAGIPPSRQARSEEDSAEQGLHHIDTSFESYPKLLYSQVEKGSSSSSVVSSSCSICLGDYKESDTLRLLPHCDHLFHLACVDPWLRLHSTCPICRKSSIQASHSDSNI

SEQ ID NO: 179832 - protein, 47 aa, Glycine max
  Coding DNA Sequence Number=SeqID_63054
MVSRQKIELTGGVTAGVFIYIQMRLFATQSEYADRLAAAVTQLLCSY

SEQ ID NO: 179833 - protein, 146 aa, Glycine max
  Coding DNA Sequence Number=SeqID_63055
  Gene Ontology: Mol. function=metal ion binding; Cellular component =integral to membrane; Biological process=ubiquitin cycle
  Homolog annotation: Hit_ID=Q8RX29; Match level="QueryCoverage=87%, HitCoverage=57%, E-value=7e-19, Identity=39%"; Hit description=RING -H2 finger protein ATL2I
  Pfam annotation: Domain name=zf-C3HC4; Domain location=92-133; Score =19.9; E_value=0.0014; Accession=PF00097.15; Description=Zinc finger, C3HC4 type (RING finger)
MNSSEETVLLLVSFIVLTLIVTLTAYVCSNNIPRTIPSVPGGATHSNNNHTIITVETPEPRLDHTSVRSYPSLQFSKAKLCSSNSNSSSSSCSICLMDYKECDSLRVLPACAHFFHVKCVDPWLRINLTCPVCRTPIALPDICKNL

SEQ ID NO: 179834 - protein, 1069 aa, Glycine max
  Coding DNA Sequence Number=SeqID_63056
  Gene Ontology: Mol. function=transmembrane receptor protein kinase activity; Cellular component=integral to membrane; Biological process=protein amino acid phosphorylation
  Homolog annotation: Hit_ID=P93194; Match level="QueryCoverage=96%, HitCoverage=94%, E-value=0.0, Identity=50%"; Hit description =Receptor-like protein kinase precursor
  Pfam annotation: Domain name=LRRNT_2; Domain location=22-64; Score =32.5; E_value=1.5e-06; Accession=PF08263.3; Description=Leucine rich repeat N-terminal domain
  Pfam annotation: Domain name=LRR_1; Domain location=116-138; Score =15.7; E_value=0.16; Accession=PF00560.23; Description=Leucine Rich Repeat
  Pfam annotation: Domain name=LRR_1; Domain location=140-159; Score =13.6; E_value=0.7; Accession=PF00560.23; Description=Leucine Rich Repeat
  Pfam annotation: Domain name=LRR_1; Domain location=164-186; Score =15.1; E_value=0.26; Accession=PF00560.23; Description=Leucine Rich Repeat
  Pfam annotation: Domain name=LRR_1; Domain location=188-210; Score =17.9; E_value=0.035; Accession=PF00560.23; Description=Leucine Rich Repeat
  Pfam annotation: Domain name=LRR_1; Domain location=212-234; Score =18.2; E_value=0.029; Accession=PF00560.23; Description=Leucine Rich Repeat
  Pfam annotation: Domain name=LRR_1; Domain location=236-258; Score =9.1; E_value=5.6; Accession=PF00560.23; Description=Leucine Rich Repeat
  Pfam annotation: Domain name=LRR_1; Domain location=260-282; Score =17.2; E_value=0.059; Accession=PF00560.23; Description=Leucine Rich Repeat
  Pfam annotation: Domain name=LRR_1; Domain location=284-306; Score =0.6; E_value=2.1e+02; Accession=PF00560.23; Description=Leucine Rich Repeat
  Pfam annotation: Domain name=LRR_1; Domain location=308-330; Score =9.1; E_value=5.7; Accession=PF00560.23; Description=Leucine Rich Repeat
  Pfam annotation: Domain name=LRR_1; Domain location=332-354; Score =17.1; E_value=0.064; Accession=PF00560.23; Description=Leucine Rich Repeat
  Pfam annotation: Domain name=LRR_1; Domain location=356-378; Score =9.8; E_value=4.1; Accession=PF00560.23; Description=Leucine Rich Repeat
  Pfam annotation: Domain name=LRR_1; Domain location=380-402; Score =9.2; E_value=5.3; Accession=PF00560.23; Description=Leucine Rich Repeat
  Pfam annotation: Domain name=LRR_1; Domain location=404-423; Score =8.6; E_value=6.9; Accession=PF00560.23; Description=Leucine Rich Repeat
  Pfam annotation: Domain name=LRR_1; Domain location=428-447; Score =11.3; E_value=2.2; Accession=PF00560.23; Description=Leucine Rich Repeat
  Pfam annotation: Domain name=LRR_1; Domain location=452-474; Score =4.7; E_value=38; Accession=PF00560.23; Description=Leucine Rich Repeat
  Pfam annotation: Domain name=LRR_1; Domain location=476-497; Score =7.2; E_value=13; Accession=PF00560.23; Description=Leucine Rich Repeat
  Pfam annotation: Domain name=LRR_1; Domain location=499-521; Score =14.0; E_value=0.55; Accession=PF00560.23; Description=Leucine Rich Repeat
  Pfam annotation: Domain name=LRR_1; Domain location=523-545; Score =11.2; E_value=2.3; Accession=PF00560.23; Description=Leucine Rich Repeat
  Pfam annotation: Domain name=LRR_1; Domain location=547-569; Score =22.2; E_value=0.0019; Accession=PF00560.23; Description=Leucine Rich Repeat
  Pfam annotation: Domain name=LRR_1; Domain location=571-593; Score =4.4; E_value=44; Accession=PF00560.23; Description=Leucine Rich Repeat
  Pfam annotation: Domain name=LRR_1; Domain location=595-617; Score =8.7; E_value=6.6; Accession=PF00560.23; Description=Leucine Rich Repeat
  Pfam annotation: Domain name=LRR_1; Domain location=619-641; Score =9.4; E_value=4.9; Accession=PF00560.23; Description=Leucine Rich Repeat
  Pfam annotation: Domain name=LRR_1; Domain location=644-666; Score =4.8; E_value=35; Accession=PF00560.23; Description=Leucine Rich Repeat
  Pfam annotation: Domain name=LRR_1; Domain location=668-689; Score =15.9; E_value=0.14; Accession=PF00560.23; Description=Leucine Rich Repeat
  Pfam annotation: Domain name=LRR_1; Domain location=68-90; Score=1.0; E_value=1.8e+02; Accession=PF00560.23; Description=Leucine Rich Repeat
  Pfam annotation: Domain name=LRR_1; Domain location=691-713; Score =11.7; E_value=1.8; Accession=PF00560.23; Description=Leucine Rich Repeat
  Pfam annotation: Domain name=LRR_1; Domain location=92-114; Score =16.3; E_value=0.11; Accession=PF00560.23; Description=Leucine Rich Repeat
  Pfam annotation: Domain name=Pkinase; Domain location=807-1054; Score= 113.2; E_value=7.3e-31; Accession=PF00069.15; Description=Protein kinase domain
  Pfam annotation: Domain name=Pkinase_Tyr; Domain location=807-1062; Score=17.6; E_value=1.5e-13; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR _1::Pkinase::Pkinase_Tyr; Domain location=22-64::116-138::140 -159::164-186::188-210::212-234::236-258::260-282::284-306::308 -330::332-354::356-378::380-402::...
  Pfam module annotation: Domain location=404-423::428-447::452 -474::476-497::499-521::523-545::547-569::571-593::595-617::619 -641::644-666::668-689::68-90::691-713::92-114::807-1054::807-1062
MGYLYLLLISYLSALLYAASALNSDGLALLSLLRDWTIVPSDINSTWKLSDSTPCSSWAGVHCDNANNVVSLNLTSYSIFGQLGPDLGRMVHLQTIDLSYNDLFGKIPPELDNCTMLEYLDLSVNNFSGGIPQSFKNLQNLKHIDLSSNPLNGEIPEPLFDIYHLEEVYLSNNSLTGSISSSVGNITKLVTLDLSYNQLSGTIPMSIGNCSNLENLYLERNQLEGVIPESLNNLKNLQELFLNYNNLGGTVQLGTGNCKKLSSLSLSYNNFSGGIPSSLGNCSGLMEFYAARSNLVGSIPSTLGLMPNLSLLIIPENLLSGKIPPQIGNCKALEELRLNSNELEGEIPSELGNLSKLRDLRLYENLLTGEIPLGIWKIQSLEQIYLYINNLSGELPFEMTELKHLKNISLFNNQFSGVIPQSLGINSSLVVLDFMYNNFTGTLPPNLCFGKQLVKLNMGVNQFYGNIPPDVGRCTTLTRVRLEENHFTGSLPDFYINPNLSYMSINNNNISGAIPSSLGKCTNLSLLNLSMNSLTGLVPSELGNLENLQTLDLSHNNLEGPLPHQLSNCAKMIKFDVRFNSLNGSVPSSFRSWTTLTALILSENHFNGGIPAFLSEFKKLNELQLGGNMFGGNIPRSIGELVNLIYELNLSATGLIGELPREIGNLKSLLSLDLSWNNLTGSIQVLDGLSSLSEFNISYNSFEGPVPQQLTTLPNSSLSFLGNPGLCGSNFTESSYLKPCDTNSKKSKKLSKVATVMIALGSAIFVVLLLWLVYIFFIRKIKQEAIIIKEDDSPTLLNEVMEATENLNDEYIIGRGAQGVVYKAAIGPDKTLAIKKFVFSHEGKSSSMTREIQTLGKIRHRNLVKLEGCWLRENYGLIAYKYMPNGSLHDALHEKNPPYSLEWIVRNNIALGIAHGLTYLHYDCDPVIVHRDIKTSNILLDSEMEPHIADFGIAKLIDQPSTSTQLSSVAGTLGYIAPENAYTTTKGKESDVYSYGVVLLELISRKKPLDASFMEGTDIVNWARSVWEETGVVDEIVDPELADEISNSEVMKQVTKVLLVALRCTEKDP

SEQ ID NO: 179835 - protein, 211 aa, Glycine max
  Coding DNA Sequence Number=SeqID_63057
  Gene Ontology: Mol. function=protein binding; Cellular component =nucleus; Biological process=protein transport
  Homolog annotation: Hit_ID=Q9FMC5; Match level="QueryCoverage=68%, HitCoverage=62%, E-value=2e-69, Identity=88%"; Hit description =Genomic DNA, chromosome 5, P1 clone:MUK11
  Pfam annotation: Domain name=Snf7; Domain location=1-141; Score=97.0; E_value=5.7e-26; Accession=PF03357.11; Description=Snf7
MPLVRYEGQRDMLYNQTFNLDQVQFAAEGIKDAQQTMTALKSANKELKGMMKTVKIQDIDNLQDEMMDLMDVSNEIQETLGRSYNVPDDIDEDDLMGELDALELDMGNETEADGVPSYLQPDKEPDLDAELNLPPAPTGQTAVPPGRSNAQLLTVLKMRGLVWRGDLVKSHCEKLGVKTGSYTNAGIRILKISIAGLLEIEAVDLKHLNWL

SEQ ID NO: 179836 - protein, 191 aa, Glycine max
  Coding DNA Sequence Number=SeqID_63058
  Homolog annotation: Hit_ID=Q60DI6; Match level="QueryCoverage=46%, HitCoverage=25%, E-value=1e-32, Identity=74%"; Hit description =Pyrimidine 5'-nucleotidase-related
  Pfam annotation: Domain name=UMPH-1; Domain location=2-190; Score= -125.7; E_value=0.015; Accession=PF05822.2; Description=Pyrimidine 5'- nucleotidase (UMPH-1)
MANEFYLISVNVVEWRHHCRHAEWHGGCFANRHRQFMSGGLLWWHHRFQWHVHMTEFCPSAIFRHWVTNNILESLTLDIFIITPMIPLVTNGKLIHSLNKNEHALDMAAPVHERLGDMDGPTDDNSSLKKRTNVLLLGDHTGDLGMSDGLNYETRISMGFLNHNVENSLSCYQEAFDVVFVVTTVYSCGGI

SEQ ID NO: 179837 - protein, 456 aa, Glycine max
  Coding DNA Sequence Number=SeqID_63059
  Gene Ontology: Mol. function=RNA-directed DNA polymerase activity; Cellular component=nucleus; Biological process=RNA-dependent DNA replication
MVSGLKINFAKSCFGAFGMTDRWKIEAVSCLNCSLLPIPFVYLGIPIGANPRRCHMWNPILEKILKKVVEKLVSIQRRFLWGGGTDQNKIAWIKWETVCLPKDKGGLGIKDINTFNIALLGKWRWNLFQHEGQLWARVLESKYRGWRGLDEAHRDNHESIWWRDLKLVFQNLQGVEMHNSIEWRPGCGDRIKFWEDKWMDGEESLAAKYPRLYLISCQQNQIIQHMGGYKEADWEWNFLWRRPLFDNEIPMAVNFLQHIESKPIQIHKRDEWVWTADPNGTQDRAFEELWKLKVPIKYAVFAWRLLRDRLPTKVNLLRRQVEIIDRTCPFFRSAEEEVGHLFFHCSKIIPIWWESLSWVNTVGVFPQDPRQHFLHHGSIVADGLRINRWKCWWLAVTWTIWMKRNDIIFSNDSFDNNKMMDEAAFLMWTWLRNLEKDFVTHFNQWSSNLREGFVYQ

SEQ ID NO: 179838 - protein, 289 aa, Glycine max
  Coding DNA Sequence Number=SeqID_63060
  Gene Ontology: Mol. function=structural constituent of ribosome; Cellular component=intracellular; Biological process=translation
  Homolog annotation: Hit_ID=Q2R0M4; Match level="QueryCoverage=95%, HitCoverage=38%, E-value=1e-48, Identity=41%"; Hit description =Expressed protein
MTNDIIRGLITKVIWNVLELRCVVLLSFFLQVFLIFFGNRRKYIANTWLHVCVWLTYLLADLVATFALGKLSRDINPSTDPNFVIWVPFLLVHLGGPDTITAYGLEDNELWLRHLLGLFSQLAVASYVVYSSWNGNNLNYVTIPVMVVGIIKYGERTWSLWLGSSKKFRKSILPPPDAGPNYAKFMDNYTAKEAEGYKVELKGEWESTPILLDHPPGTIANESVPDALLLQDGFYFLEIFECLFADLILSIQDHRSSQHFFQNRSWEHAYKVIEVELGLMYDKLYTKAV

SEQ ID NO: 179839 - protein, 928 aa, Glycine max
  Coding DNA Sequence Number=SeqID_63061
  Gene Ontology: Mol. function=protein binding; Cellular component =membrane; Biological process=defense response
  Homolog annotation: Hit_ID=Q19PK7; Match level="QueryCoverage=96%, HitCoverage=93%, E-value=5e-48, Identity=24%"; Hit description=NBS -LRR type disease resistance protein
  Pfam annotation: Domain name=LRR_1; Domain location=585-606; Score =9.9; E_value=4; Accession=PF00560.23; Description=Leucine Rich Repeat
  Pfam annotation: Domain name=LRR_1; Domain location=608-629; Score =6.7; E_value=16; Accession=PF00560.23; Description=Leucine Rich Repeat
  Pfam annotation: Domain name=LRR_1; Domain location=630-648; Score =0.9; E_value=1.9e+02; Accession=PF00560.23; Description=Leucine Rich Repeat
  Pfam annotation: Domain name=LRR_1; Domain location=801-823; Score =9.3; E_value=5.3; Accession=PF00560.23; Description=Leucine Rich Repeat
  Pfam annotation: Domain name=LRR_1; Domain location=874-896; Score =9.5; E_value=4.8; Accession=PF00560.23; Description=Leucine Rich Repeat
  Pfam annotation: Domain name=NB-ARC; Domain location=139-436; Score =29.0; E_value=3.9e-12; Accession=PF00931.13; Description=NB-ARC domain
  Pfam module annotation: Pfam domain module=LRR_1::LRR_1::LRR_1::LRR _1::LRR_1::NB-ARC; Domain location=585-606::608-629::630-648::801 -823::874-896::139-436
MAAAEIAVDNIVSRVVRKVNDVLTQDWALLNKKERRMLKWLRTELSDMQEFIQHLERSDSSQLEYFEGKIKDVALQTERIIDTFIKSVERRRRRELNIFRCFDDKIEKQLKQASITDSIEDISDEIMKYESRPGSLSEYQLDRRGEVWPWQPRIIFGFDGDVETLKDKLLSVSDEDPRCIISIVGIAGTGKTALATLIRNNEDIRDGFKHILKKCLKKYLKAATQIMGSQQDTSLEALASKKNLIVVDGVATPRVFDALTEKIADKSTEDSFLLTTHNANIIPQQDAGTTRSSFVHHLKLLDDEDSWILFKTELKVHRDVQMEPEMTDLGKKIVAKCGGLPSQILDLSKFFSDKDVTKEEWLRLQEQWLRDQGQGQGQNPWSETLNAIVSDFNLPSYESHLKCLSYFKLFPANFGIPARRLVALWVAGDVVPHREEEQEPPEQVAERYLEELIDLNLVQIAKRKPNGKVKTCRLPNALRELLLSEAPENSRILQVADCLDENDIWYNHIHGNTATTSDSVSLREHYKDVLSFLSFDAREGSRPGQEICNFLNLCILSDCLLQLQVLDLEGVFKPKLPENIARLTGLRYLGLRWTYLESLPSSISKLLKLQTLDLKHTYIHTLTSSIWKMELRHLFLSETYRTRFPPKPICAGDSLSDLQTLWGLFVDEETPVKGGLDKLVNIRKLGITWQSMSPQQKATKSQKPTGVDLLVGVLGSLDRILGSNLVDVIAQKRTMESQVDAVVDWIVKLTNLESLRLKSRDEEGRPWNLPLKSLKNHKKLIDMHLLGILSHSSILSEFPTSLVELTLSHSKLEDDPMQILKDLPELRSLSLCAESYVGEKLVCNSQSFPQLYVLKVWKLEQLKEWKIEQKALGSLRQLEIRSCPCMTKLPDGLKHVKTLLDLKLTNMSKEIKTEDHDIPPYCEILVQN

SEQ ID NO: 179840 - protein, 253 aa, Glycine max
  Coding DNA Sequence Number=SeqID_63062
  Gene Ontology: Mol. function=protein dimerization activity; Cellular component=nucleus; Biological process=regulation of transcription, DNA-dependent
  Homolog annotation: Hit_ID=Q39897; Match level="QueryCoverage=87%, HitCoverage=57%, E-value=4e-40, Identity=43%"; Hit description=TGACG- motif-binding protein
  Subcellular localization annotation: CTP_CleavageSite=14; ConfidenceScore=5.06e-01
MSSSNQLNQSSRFLANKPRNEVNVQGYTFRIDGNTTFVMNYGRWSEKRKRLISEIRSALNVHNDQVLDDKLLFLIDTVMKHYFELFEMKTSAANLDVFSVVSAIWCTTAERNLLWIGGFRPSQLLQDTNIIVTIMFPKCVLWVQAILPQVQHSCSQQQLSDIFSFVQSCQQAEDALAQGMEKLQQNLDKATAAGDKALKLTCVSQQMSFLKQANHVRQQFLYQLSRLLTICQYAEFLLAFGECLYNSQPWSSL

SEQ ID NO: 179841 - protein, 81 aa, Glycine max
  Coding DNA Sequence Number=SeqID_63063
MKEPWHASTFDFSGLKLTKVKGELLLKKHGEEGGDDIDHDRRLLSSSDDYTSGKHNLSPAMSSKGKLTGKTMLENNLIDNI

SEQ ID NO: 179842 - protein, 157 aa, Glycine max
  Coding DNA Sequence Number=SeqID_63064
  Subcellular localization annotation: CTP_CleavageSite=54; ConfidenceScore=5.43e-01
MTFNFKKWLNQALARLKPSNSIITTKQSPVLQFLQVTLRHCNASNQRILFTIKSAKPLQPWSHPFVTHPYYVFRGFDLCFKTQHHHHCTVGPHCNVVGANEVHHVHLGTGKIQQRTQGREREENDLCFGSENWSVVLIVVHDGGEGEKKYKRKLFNF

SEQ ID NO: 179843 - protein, 792 aa, Glycine max
  Coding DNA Sequence Number=SeqID_63065
  Gene Ontology: Mol. function=DNA binding; Biological process =regulation of transcription
  Homolog annotation: Hit_ID=Q9S7B1; Match level="QueryCoverage=99%, HitCoverage=100%, E-value=0.0, Identity=52%"; Hit description=Nodule inception protein
  Pfam annotation: Domain name=PB1; Domain location=691-776; Score =90.6; E_value=4.7e-24; Accession=PF00564.15; Description=PB1 domain
  Pfam annotation: Domain name=RWP-RK; Domain location=511-562; Score =100.2; E_value=6.3e-27; Accession=PF02042.6; Description=RWP-RK domain
  Pfam module annotation: Pfam domain module=PB1::RWP-RK; Domain location=691-776::511-562
MEYGGLVQNAYGSYGSFSDILGPETDFIDELFVEGCWLETRVGSYLNCGTEANSSKSNTMRSMESTQIIFQQEESLPDPEISLMVGKRWWIGPRENPGPSSSVKERLVIAVGYLKEYAKNSNLPIQVWVPERRSARAQPQDNIYPYAAALLNGDAAAFQIQEDWVHVNDQYWTPNVRFFRSHEYPRHLRTPGSLALPVFERGTAMCLGVVEILMPNNPPDLQCTVDFTSSTSSHHHNFIPPAVTVKGFDELYQSALNGIVQVLTCVCKAHNLPLALTWAPCIQQAGKSGCGHSNDEMNYVSTVYAASFVADVELMGFLEACSECHLLGGQGVVGTAFTTTKPCFANDITSFSKAEYPLAHHANMFGLHAALGIPLRSASADFVLEFFLPKDCHDTQDQKQLLNSLFMLVQQACRSLHLVMEEEEELIALPSVVGKEMESSSWIAHMMEAQQKGKGVSVSLEYLQEPKQEFKVTTNCSNTNEQVSVGVESTAAFCGRRVGRKSAGDKRRTKAEKTISLPVLRQYFAGSLKDAAKSIGVCPTTLKRICRQHGITRWPSRKIKKVGHSLRKLQLVIDSVQGAEGAIQIGSFYTSFPELSSAANGVSESSNINNNNNDNSKFFSEYNQGQGATTFKSPTTSPCSQTTIVMSESQPLGLGASVQVVQEEAKHFAHQHLESLPPLPQSSTSVWNMGTFRVKATFGDEKIRFSLQPNWGFRDLQKEISRRFNLNEISNIQLKYLDDAREWVLLTCDADLEECKGINTSSQSQSRTIRLFLFHASPLNHANAFPGTSPSS

SEQ ID NO: 179844 - protein, 86 aa, Glycine max
  Coding DNA Sequence Number=SeqID_63066
MESSARVFGSQRKASNEKEDLLHHSTENAKVREDAGSDHLIKMEGRSGLQGGCNKYNMLTCVNKYENIIVRDRKSIFQRINFAKKR

SEQ ID NO: 179845 - protein, 333 aa, Glycine max
  Coding DNA Sequence Number=SeqID_63067
  Homolog annotation: Hit_ID=Q9ST97; Match level="QueryCoverage=27%, HitCoverage=20%, E-value=5e-38, Identity=80%"; Hit description=Alpha- 1,3-mannosyl-glycoprotein beta-1,2-N- acetylglucosaminyltransferase
  Pfam annotation: Domain name=GNT-I; Domain location=1-329; Score= -157.4; E_value=1.4e-07; Accession=PF03071.5; Description=GNT-I family
  Subcellular localization annotation: CTP_CleavageSite=31; ConfidenceScore=5.08e-01
MGRQSDFDANYAGSVTGRRSTSGSKKQNVARSSAEGEFRAMAQGMCEVLQINIVLDDLNISDDSTLQNGLIQPLPSMVMCVEPLTFGWGVQMWCMSGLGSRWHFCGVEVAKRSNDPTRSSSFRQLHPSSAIAVLNTITATRIAAAIARHEKSTRPPILYGGWDIDRDLGNMGCLSLTLSKYGMLGGDLKVPTGLDAYQLVLEPSIMSLRCKQAMHGSSLGQFFKQFLEPIKLNDVKVDWKSMDLSYLLEDKYSMHFANVVKKATPVYGADMVLKAYNIDGDVRIKYEDQSDFENIARQFGIFQEWKAVSSASIVRHAMVVSFPKLINQRLKIP

SEQ ID NO: 179846 - protein, 53 aa, Glycine max
  Coding DNA Sequence Number=SeqID_63068
MKEGMKALKRNGTWEIVDKPYDQRLAKEGFIWVKIVTTSLVQKIHKSNDAHGL

SEQ ID NO: 179847 - protein, 102 aa, Glycine max
  Coding DNA Sequence Number=SeqID_63069
  Subcellular localization annotation: CTP_CleavageSite=72; ConfidenceScore=5.01e-01
MGNNEEKKKKLEKAQPSLSLSAQLTLARQTTHALSEALSTRVRTCAHRAARAKRVRQKQNALSAHHALNAVLAMVGAVAVGVLFTDMCTSSLGTLLLLRAGN

SEQ ID NO: 179848 - protein, 120 aa, Glycine max
  Coding DNA Sequence Number=SeqID_63070
MKPKTKGFIGKKEVLDRLPLYFPKKQLWISPFLSPKPVLLRSLPLSAVQSLRNCCDSPETPEPFAAVDFPPKQARGHSHSGFGSIRELRRFCPRRRSAPHRLPSQFAGTTPFLIVFNLFP

SEQ ID NO: 179849 - protein, 50 aa, Glycine max
  Coding DNA Sequence Number=SeqID_63071
MAQTQLSESKFMKIVGKETGNDVFVEEIGNKAREEVEVQRKGSEGAKIVE

SEQ ID NO: 179850 - protein, 200 aa, Glycine max
  Coding DNA Sequence Number=SeqID_63072
  Gene Ontology: Mol. function=transferase activity, transferring glycosyl groups; Biological process=metabolic process
  Homolog annotation: Hit_ID=Q8LP23; Match level="QueryCoverage=71%, HitCoverage=32%, E-value=2e-37, Identity=54%"; Hit description =Rhamnosyl transferase
MASPPMAALEGLIHGEKMPSEVVNNCELHVVMFPFLAFGHISPFVQLSNKLFSHGVRVTFLSAASNIPKIRSTLNLNPAITVIPLQFPNGIANTAELPPHLAGNLIHALDLTQDQVKSLLLELKPHYVFFDFAQNWIPKLASEVGIKSVHFSVYSAISDASITVPSRFDDVEGRNINFEDLKKPPPGYPKKLQYNFPQGL

SEQ ID NO: 179851 - protein, 485 aa, Glycine max
  Coding DNA Sequence Number=SeqID_63073
  Gene Ontology: Mol. function=transferase activity, transferring glycosyl groups; Cellular component=integral to membrane; Biological process=metabolic process
  Homolog annotation: Hit_ID=Q43716; Match level="QueryCoverage=95%, HitCoverage=98%, E-value=1e-139, Identity=53%"; Hit description =Anthocyanidin 3-O-glucosyltransferase
  Pfam annotation: Domain name=UDPGT; Domain location=12-481; Score= -128.3; E_value=0.00037; Accession=PF00201.9; Description=UDP -glucoronosyl and UDP-glucosyl transferase
MSCEVVNNDELHVVMFPFLAFGHINAFVQLSNKLFSHGVRITFLSAASNIPRIKSTLNLNPAINVIPLYFPNGITSTAELPPNLAANLIHALDLTQPHVKSLLLELKPHYVFFDFAQNWLPKLASELGIKSVRFASFSAISDSYITVPSRLADIEGRNITFEDLKKPPPGYPQNSNISLKAFEAMDLMFLFKRFGEKNFTGYERVLQGFSDCSLIVFRSCKEIEESYLDYIEKQFGKLVLLTGFLVPEPSMDVLEEKWSKWLDSFPAKSVILCSFGSEQFLNDDQIKEVASGLELSGLPFILVLNFPSNLSAKAELERALPKGFLERVKNRGVVHTGWFQQQLVLKHSSVGCHLGHGGFNSVIEALASDCELVLLPFKADQFFNAKLIAKALEAGIEVNRSEDGDFKKEDILKAVKTIMVEDDKEPGKQIKENHMKWKEFLLNKGIQNKFITDLVAQLNVVESEKISTGYDWWNGNFPVNFTVLH

SEQ ID NO: 179852 - protein, 66 aa, Glycine max
  Coding DNA Sequence Number=SeqID_63074
MDDADDMIIFNSLCDAVTHGWSLSDSTTTKPENDAADQRPAHEISYSDCQNDDSKAAVLAQKMTMG

SEQ ID NO: 179853 - protein, 126 aa, Glycine max
  Coding DNA Sequence Number=SeqID_63075
  Gene Ontology: Mol. function=transferase activity, transferring glycosyl groups; Biological process=metabolic process
  Homolog annotation: Hit_ID=Q43716; Match level="QueryCoverage=99%, HitCoverage=27%, E-value=1e-37, Identity=57%"; Hit description =Anthocyanidin 3-O-glucosyltransferase
MHTGWFQQKLVPKHSRVGCYVCHSGFSSVIEAMFNDCQLVLLPFKGDQFFMAKDLEAGVEVNRGDEDGFFHKEDILEALKTIIVKDSKEPGKHTRENHMKWCKFLSNKEIQNKFITGLAAQLKSMA

SEQ ID NO: 179854 - protein, 270 aa, Glycine max
  Coding DNA Sequence Number=SeqID_63076
  Gene Ontology: Mol. function=transferase activity, transferring glycosyl groups; Cellular component=integral to membrane; Biological process=metabolic process
  Homolog annotation: Hit_ID=Q43716; Match level="QueryCoverage=99%, HitCoverage=54%, E-value=1e-62, Identity=47%"; Hit description =Anthocyanidin 3-O-glucosyltransferase
  Subcellular localization annotation: CTP_CleavageSite=78; ConfidenceScore=5.55e-01
MGVATCTQIASDSCNSPLGLHPLQKPAKACPNSLVMVATSTCRQLATTSGVFHATWLRTANSPLTITVCYRTHANLSECSKRDSETFLNEDQIKELATGLELIGLPFILVLNFPSNLSAKAELERALTKGFLERVKNRGVVHTGWFQQQLALKHSSLGCYVCHGGFSSVIEALINECQLVLLPFKGDQFFNSKLIANDLKAGVEVNRGDEGGFFHKEDIIDAIKTIMMEDNKEQGKQTRESHMQWSMFLSNQEIQNKFITDMVAQLKSMA

SEQ ID NO: 179855 - protein, 86 aa, Glycine max
  Coding DNA Sequence Number=SeqID_63077
  Subcellular localization annotation: CTP_CleavageSite=24; ConfidenceScore=5.04e-01
MHRSASWNRFSDDYFKHATTSSPSSGHRSSYSMFDGNNLPTYDPIAELAKRERARVKFAENAVHVIPLVLIVCAIILWLFSNPAHY

SEQ ID NO: 179856 - protein, 212 aa, Glycine max
  Coding DNA Sequence Number=SeqID_63078
  Homolog annotation: Hit_ID=Q45W87; Match level="QueryCoverage=40%, HitCoverage=62%, E-value=1e-22, Identity=63%"; Hit description =Oleosin 1
  Pfam annotation: Domain name=Oleosin; Domain location=92-202; Score =168.5; E_value=1.7e-47; Accession=PF01277.8; Description=Oleosin
  Subcellular localization annotation: CTP_CleavageSite=66; ConfidenceScore=5.44e-01
MGFACKPCMKSLPTRAKPPPQVLPPKPPLTNFSIYTLITTTLNPTTLITHSSLKTLVFHFDNSHTMAELHYQQQHQYPHRYPNDPYEQQTSYSTQVVKAATAVTAGGSLLILASLILAGTIIALTIVTPPLVIFSPVLVPAVITVALLSLGFLASGGFGVAAITVLAWIYRYVTGKYPPGADQLDSAPHKIMDKAREIKDYGQQQISGVQAS

SEQ ID NO: 179857 - protein, 91 aa, Glycine max
  Coding DNA Sequence Number=SeqID_63079
  Gene Ontology: Mol. function=transcription factor activity; Cellular component=nucleus; Biological process=regulation of transcription, DNA-dependent
  Homolog annotation: Hit_ID=Q9LW50; Match level="QueryCoverage=95%, HitCoverage=37%, E-value=2e-25, Identity=62%"; Hit description =Ethylene-responsive transcription factor 2
  Pfam annotation: Domain name=AP2; Domain location=2-67; Score=133.3; E_value=6.6e-37; Accession=PF00847.10; Description=AP2 domain
MGTCYRGVRQRPWGKFTAEIRDPARNGARAWLGTYQTAEDAALAYDRAAFKLRGSKALLNFPHRINFNEPPPVRVTAKKRKVPASVKLSRS

SEQ ID NO: 179858 - protein, 111 aa, Glycine max
  Coding DNA Sequence Number=SeqID_63080
MDPYDSYSNSELNLKFIEYKLSVIHTNISVLKKYVINVWKKKVATASNVLVKELIYQEIVKKNDAIGRTSFSPLQKCTAEICMLAYGLPIDSMDEYVHIGEMLTEVYPRSE

SEQ ID NO: 179859 - protein, 58 aa, Glycine max
  Coding DNA Sequence Number=SeqID_63081
VGIIGDPIEARIEGLSLEGEIENDSDGTQMGFLPIVTSEEISTTEFGAEKDSIIPKNL

SEQ ID NO: 179860 - protein, 263 aa, Glycine max
  Coding DNA Sequence Number=SeqID_63082
  Gene Ontology: Mol. function=transcription corepressor activity; Cellular component=nucleus; Biological process=regulation of transcription, DNA-dependent
  Homolog annotation: Hit_ID=Q1SQF4; Match level="QueryCoverage=77%, HitCoverage=37%, E-value=5e-34, Identity=46%"; Hit description =Paired amphipathic helix
  Pfam annotation: Domain name=PAH; Domain location=202-248; Score =63.7; E_value=5.8e-16; Accession=PF02671.11; Description=Paired amphipathic helix repeat
  Pfam annotation: Domain name=PAH; Domain location=96-142; Score=54.7; E_value=3.1e-13; Accession=PF02671.11; Description=Paired amphipathic helix repeat
  Pfam module annotation: Pfam domain module=PAH::PAH; Domain location =202-248::96-142
MGYLVGSWVLKEIDVLVRASNMSSVANYHVGSFRILIDGSTMCVSAFCVLSFGQNQVPGSGNGGDVCRGATTSQKLTIIDAVSYLKEVKVVFMDQVVKYDMFCEILIDFKAKRVNIYDVIKRVKELFKGHNNLILGFQTFLPKGYKITFDKDEAPSNFGQNQVPGSGNGGDVCGGATTSKEVTAADALSYLWEVKAAFQDQREKYNMFIEIMKDFEARRIRTNAVITRVKELFKGHNNLILGFQTFLPEGYEITTDKDDAPPK

SEQ ID NO: 179861 - protein, 106 aa, Glycine max
  Coding DNA Sequence Number=SeqID_63083
  Gene Ontology: Mol. function=DNA polymerase processivity factor activity; Cellular component=PCNA complex; Biological process =regulation of DNA replication
  Homolog annotation: Hit_ID=Q9ZW35; Match level="QueryCoverage=61%, HitCoverage=32%, E-value=2e-15, Identity=55%"; Hit description =Proliferating cell nuclear antigen 2
MEARRGESEHWGIKVSGNYCRVGITGYGSALAGRFAKGKESESVATIIGLDGDDVVVAAVVLEVLGSKEERNKGDMAGVHGLEGEPGGGAIKVCVIIKDLMTSVFK

SEQ ID NO: 179862 - protein, 463 aa, Glycine max
  Coding DNA Sequence Number=SeqID_63084
  Gene Ontology: Mol. function=inositol or phosphatidylinositol phosphatase activity; Cellular component=intracellular; Biological process=abscisic acid mediated signaling
  Homolog annotation: Hit_ID=Q1SU89; Match level="QueryCoverage=90%, HitCoverage=80%, E-value=2e-81, Identity=42%"; Hit description =Inositol polyphosphate related phosphatase
  Pfam annotation: Domain name=Exo_endo_phos; Domain location=68-411; Score=149.8; E_value=7.1e-42; Accession=PF03372.13; Description =EndonucleaseExonucleasephosphatase family
MEVENQKQRRYQKLRNWFNSKQKEDRPSSFSLNEIQDGAEDESDDYEGNLSLRSLELDPCISTNKLRVFVGTWNVAGRSPVGSLAVDLDEWLNLKNAADVYVLGFQEIVPLKTLTVIGAEDPAVATSWNQLIGKTLNAKFGCPWMTPMLNCSSCDDDDNNYQYVENPNTKGGNNSNNDKYTLVASKKMVGVFISVWMREEVLRKHCVSNVRVCSVACGVMGYLGNKGSVAVSMSIEGTSFCFVAAHLASGEKKGDEGRRNHQVAEIFRRTSFSRTTKDHHHFPLTILGHDRIFWFGDLNYRLYLEDNFARHLIRKQDWKALQEFDQLQKELEEGGVFEGWKEGDIEFAPTYKYSSSTTNRYCGSLPSRSGEKQRTPAWCDRILWYGKGVEQLHYFRSESKFSDHRPVSALFSTQIEIKSSNRGLMGLHNIPPTMLNPKNGMNKGDEDGKSSLLSSLTKNVQGC

SEQ ID NO: 179863 - protein, 257 aa, Glycine max
  Coding DNA Sequence Number=SeqID_63085
  Gene Ontology: Mol. function=superoxide dismutase activity; Cellular component=chloroplast; Biological process=superoxide metabolic process
  Homolog annotation: Hit_ID=P28759; Match level="QueryCoverage=85%, HitCoverage=91%, E-value=1e-115, Identity=90%"; Hit description =Superoxide dismutase [Fe], chloroplast precursor
  Pfam annotation: Domain name=Sod_Fe_C; Domain location=124-247; Score= 198.8; E_value=1.3e-56; Accession=PF02777.8; Description =Ironmanganese superoxide dismutases, C-term
  Pfam annotation: Domain name=Sod_Fe_N; Domain location=41-114; Score =75.3; E_value=2e-19; Accession=PF00081.12; Description=Ironmanganese superoxide dismutases,
  Pfam module annotation: Pfam domain module=Sod_Fe_C::Sod_Fe_N; Domain location=124-247::41-114
MEGEEVPEKWGAEKLRGGGRGAGKKREGEGRIRKGPKVNAKFELKPPPYPLPVMSQQTLEFHWGKHHKTYVENLKKQVVGTELDGKSLEEIIVTSYNKGDILPAFNNAAQACMLATRISNSCGGGKPSGELLELIERDFGSFVKFLDEFKAAAATQFGSGWAWLAYRARKFDGENVANPPSPDEDNKLVVLKSPNAVNPLVWGGYYPLLTIDVWEHAYYLDFQNRRPDYISVFMDKLVSWDAVSSRLEQAKALITSA

SEQ ID NO: 179864 - protein, 339 aa, Glycine max
  Coding DNA Sequence Number=SeqID_63086
  Gene Ontology: Mol. function=transcription corepressor activity; Cellular component=nucleus; Biological process=regulation of transcription, DNA-dependent
  Homolog annotation: Hit_ID=Q1SQF0; Match level="QueryCoverage=81%, HitCoverage=20%, E-value=1e-108, Identity=73%"; Hit description =Paired amphipathic helix
  Pfam annotation: Domain name=PAH; Domain location=143-189; Score =66.0; E_value=1.2e-16; Accession=PF02671.11; Description=Paired amphipathic helix repeat
  Pfam annotation: Domain name=PAH; Domain location=59-105; Score=69.4; E_value=1.2e-17; Accession=PF02671.11; Description=Paired amphipathic helix repeat
  Pfam module annotation: Pfam domain module=PAH::PAH; Domain location =143-189::59-105
MKRARDDIYGQNQVPGSGGGGGGGNGGVVGGGANTSQKLTTNDALSYLKEVKDMFQDQREKYDMFLEVMKDFKAQRTDTAGVIKRVKELFKGHNNLIFGFNTFLPKGYEITLDEDEAPPKKTVEFEEAISFVNKIKKRFQNDELVYKSFLDILNMYRKEHKDIGEVYSEVATLFKDHRDLLEEFTRFLPDTSAAPSTQHAPYIRNSLQRFNERGSMAPMIRQMPADKAQRYRRDRLPSHDRDMSAERPELDDDKTMMNIHKEQRKRESRERRMRDQDEREHDLDNNRDLNLQRFPDKKKSVKKAEGFGMASDFASYEDKDTLNSKPCCYAFGQMHCLNT

SEQ ID NO: 179865 - protein, 118 aa, Glycine max
  Coding DNA Sequence Number=SeqID_63087
MATSPTTPSLGKTRTGDGWCRQLPLLRKVGKGWVDDEWQCGADDGFGGWSERAVGQKELQWNSYETLDEQLKQDWLMSVEPRKQIARTPCSKRASKYHKQRRKRAPKYIDLWFSCHGH

SEQ ID NO: 179866 - protein, 131 aa, Glycine max
  Coding DNA Sequence Number=SeqID_63088
  Gene Ontology: Mol. function=electron carrier activity; Cellular component=membrane; Biological process=electron transport
  Homolog annotation: Hit_ID=Q6V5G1; Match level="QueryCoverage=83%, HitCoverage=54%, E-value=9e-20, Identity=46%"; Hit description=Cu2+ plastocyanin-like
  Pfam annotation: Domain name=Cu_bind_like; Domain location=1-58; Score=25.2; E_value=1.4e-07; Accession=PF02298.8; Description =Plastocyanin-like domain
FQYSSSQSVEEVTKENFDTCNTTNVLATYGSGNTTVPLTRAGGRYYVSGNKLYCLGGMKLHVHVEGDDKSLAPTIAPKAVAGTDQNTSTLPQSPSSKKNTHFSAGAANCARDAIQLVYIALVAAVYGMMKI

SEQ ID NO: 179867 - protein, 74 aa, Glycine max
  Coding DNA Sequence Number=SeqID_63089
MASIRSSIKQILKEREHSKVCTLCIFFSARSTVSFENGLKTLKAVYMEDAKMKVPQKLMAVSTSIFEATMIRTA

SEQ ID NO: 179868 - protein, 838 aa, Glycine max
  Coding DNA Sequence Number=SeqID_63090
  Gene Ontology: Mol. function=transcription corepressor activity; Cellular component=nucleus; Biological process=regulation of transcription, DNA-dependent
  Homolog annotation: Hit_ID=Q1SQF0; Match level="QueryCoverage=97%, HitCoverage=60%, E-value=0.0, Identity=70%"; Hit description=Paired amphipathic helix
MLLESVSSAAKKAEELYNNINENKIGMETLNRIEDHFTVLNLRCIERLYGDHGLDVIDILRKNPTHALPVILTRLKQKQEEWSKCRSDFNKVWAEIYAKNHYKSLDHRSFYFKQQDSKNLSTKSLVTEIKEIKEKQQKEDDIIQSIAAGNKQPLIPHLEFEYSDVGIHEDLYKLVCYSCEELFSSKELLNKIMRLWSTFLEPMLGVPSQSHGTERAEDRKTGHNVRNFGAPNIGGDGSPRGDSLLMNSRVPKSDKNEADGRVTEVKNVHRTTVASNDKENGSVGGELVSRDDPLMDKGQKNVEYNDKASGFSKQFTSDEQGAKNNVSIAIRGENSLNRTNLDVSPGRALTPSRPTDVDDSVSKSQGVNAPSVEGCDMATPVPVANGVLSESSKVKTHDESVGPCKIEKEEGELSPNGDSEEDNIVAYGDSNVQSMAKSKHNIERRKYQSRNGEDESCPEAGGDNDADADDEDSENVSEAGEDVSGSESAGDECFREDHEEEEDIEHDDVDGKAESEGEAEGICDAQAGGDGTSLPLSERFLSSVKPLTKHVSAVSFVEEMKDSRVFYGNDDFYVFFRLHQALYERLLSAKTHSMSAEMKWKAKDASSPDPYSRFINALYNLLDGSAENAKFEDECRAIIGNQSYVLFTLDKLIYKLVRQLQTVATDEVDNKLLQLYEYEKSRKPGKLNDSVYHANAHSSTPSRLSIQLMDNMNEKPELFAVSIDPNFSFYLHNDFLSVFPNKKEPHGIILHRNKRQYGKLDELSAICSAMEGVKVINGLECKIACSSSKCGAAIISYVLDTQDFFFRPRKKRRTPSGTTTSRFRRDREERFRKLLACS

SEQ ID NO: 179869 - protein, 62 aa, Glycine max
  Coding DNA Sequence Number=SeqID_63091
MTENASKHTNGAPKMHENGNRKKSRCGGSEKSIEILLHFHSKKKESVTNQDLLSQRLGAFQL

SEQ ID NO: 179870 - protein, 74 aa, Glycine max
  Coding DNA Sequence Number=SeqID_63092
MHCDHFGQGNNVKEVRWQVMIMTVVGVIVTGGCTIDELKDLIKQVAPQGILPHGIHASQTVMEMEDDMATSLQD

SEQ ID NO: 179871 - protein, 816 aa, Glycine max
  Coding DNA Sequence Number=SeqID_63093
  Homolog annotation: Hit_ID=Q10RW2; Match level="QueryCoverage=92%, HitCoverage=78%, E-value=1e-107, Identity=32%"; Hit description =Expressed protein
GGDEKWLRLDKPATFDHVIHITKCAIEKLSQIGVLAANDGGNSVNILNVSWKGVVSLLQGGGGHFTEVNIANIVLTLLALITEPLKCAAQAWSSSLNEAISVTEAKRIFVPVKFYLINAVKICSLYPHQAYTVYKEITLCVLKIKCFWIFVSNENLLKCASVIITELLEETTLNLLLSLLNSHKLKLEQRLQVLEWLFINKGDCHSGLDCPTLSDCNLAWVNEIFCNSYESMSRSKILILGRVVLFINFLRHSLELDGDVRIAITQKLYWFLDVLVEEDVYSHILVLQFPLLYGSGKTVELLWQPMFTFLLQAFKTFMIVISSSTAWEELESFLLENFFHPHFLCWEIVMECWCFMLRYAETQMANSILGKLCSLLKLSASSYSVFLPYSSFRKLARSICMLLTDGAQSMVNVVYMSLVGDGKSHLSSVFCLALFMEGFPFDLLTDELRKTSIQRIISDYFDFIDNFDEAPLMACSSGLFGVPDGLSDIDERALKFLVAISSNYKSTVDKVIKDRFLQLFSETLGIISYLKKLYTSNAIEQVIMEIQNIFLSEPPALLDKCKPHLAQFLAGLVHMEISESDDDAKSCAVWELYHLLLKERHWALSHLAITAFGYFASHTRCNKLWRFVPEDAALSYDTVSGVESDQQRFMVEFGKFLKKEIALLTLEPSPEQLDLLGREGFVLKQMVQKISATAEEREKCEIMDVDHKNQSNKKRKLPDGISRGVELLKNGLKIIGDGFSQWQLNDFDTTELHVKYLTQFSQLEDVITNFEELTGSGEHSSTKSVYVKTKLLMYRSNVFTLNEEVRSEIRRKEDRK

SEQ ID NO: 179872 - protein, 1162 aa, Glycine max
  Coding DNA Sequence Number=SeqID_63094
  Gene Ontology: Mol. function=alpha-mannosidase activity; Cellular component=Golgi apparatus; Biological process=carbohydrate metabolic process
  Homolog annotation: Hit_ID=Q1SJM4; Match level="QueryCoverage=95%, HitCoverage=97%, E-value=0.0, Identity=78%"; Hit description =Glycoside hydrolase, family 38; Galactose mutarotase-like
  Pfam annotation: Domain name=Alpha-mann_mid; Domain location=477-562; Score=109.5; E_value=9.7e-30; Accession=PF09261.1; Description=Alpha mannosidase, middle domain
  Pfam annotation: Domain name=Glyco_hydro_38; Domain location=144-473; Score=482.2; E_value=6.2e-142; Accession=PF01074.12; Description =Glycosyl hydrolases family 38
  Pfam annotation: Domain name=Glyco_hydro_38C; Domain location=621 -1131; Score=329.7; E_value=5e-96; Accession=PF07748.3; Description =Glycosyl hydrolases family 38 C-termi
  Pfam module annotation: Pfam domain module=Alpha-mann_mid::Glyco _hydro_38::Glyco_hydro_38C; Domain location=477-562::144-473::621-1131
  Subcellular localization annotation: CTP_CleavageSite=29; ConfidenceScore=5.76e-01
MPFSSSRRGTSWASSILPSSNPPKSKAPRKGRKRALVKDFIFSNFFAIGLVLSLSLFLLILLRFGVPKPLSTHFRTTTRSSRARHTRKPLPAGTNRSTLAGAAVDVTTKALYDKIEFLDVDGGAWKQGWSVTYRGNEWDSEKLKVFVVPHSHNDPGWKLTVDEYYDRQSRHILDTIVQTLTKDFRRKFIWEEMSYLERWWRDASDEMKESFINLVKNGQLEIVGGGWVMNDEIAEGNMWLNDTIGFVPKNSWAIDPFGYSSTMAYLLRRMGFDNMLIQRTHYELKKELAWHKNLEYIWRQSWDAEETTDIFVHMMPFYSYDIPHTCGPEPAICCQFDFARMSGFAYEQCPWGQYPVETTQENVQERALKLLDQYKKKSTLYRTNTLLVPLGDDFRYINVEEAEAQFRNYQMLFDYINSNPSLNAEAKFGTLEDYFVTLREEAERINYSSPGEIGSGLVEGFPSLSGDFFTYADRQQDYWSGYYVSRPFFKAVDRVLEQTLRATEMMVALILGTCWRSHCEKFAMGFSYKLTAARRNLALFQHHDGVTGTAKDHVVMDYGMRMHTSLLDLQIFMSKAAEALLGIRFDKLDHSPAQFEPAIVRSKYDAQPLHKVISVHEGSYESVVFFNPLEQTREEVVMVVVDSPDVTVVDSSWTCVQSQILPELQYHSSKIFTGKHRLYWKVSVPAMGLETYYISNSFAQCEKARPAKLKIFSKSSSVACPTPYSCVKIEADVAEIENEHQKLIFDVKYGLLQKIISENSSPNTVNEEIGMYSSSGGAYLFKPHGDAQSIIEEGGQLLVSEGPLMQEVYSYPRTAWEKSPISHSTRIYSGESTVQGFAIEKEYHVELLGHDFNDRELIVRYKTDIDNKKIFYSDLNGFQMSRRETYDKIPLQGNYYPMPYLAFIQGSNGRRFSVHSRQSLGVTSLKNGWLEIMVDRRLVRDDGRGLGQGVMDNRVMNVVFHLTVEANVSATSNLVPTPFPYSPSLLSHRVGSHLNYPIHAFVSKKPQDMSMKPPPRSFSPLAAPLPCDLHIVNFKVPKPLKFLQQPPEGPRFGLILHRRHWDSSYCQKGRSQCTNLANGTMNLFSMFKNLTVSKAKATSLNLLHEDPEVMGFSEQFGDLAQEGHLNHTGFLDRFKDELLANFFDCSIDGRDELFLDCLLGGA

SEQ ID NO: 179873 - protein, 65 aa, Glycine max
  Coding DNA Sequence Number=SeqID_63095
MLLGAENSTKEKFTDFAEALEAEEILQTSLLFSPEALEREDIKKVHSMECGVQDVSGEESGYVGF

SEQ ID NO: 179874 - protein, 165 aa, Glycine max
  Coding DNA Sequence Number=SeqID_63096
  Gene Ontology: Mol. function=glutathione transferase activity; Cellular component=cytoplasm; Biological process=metabolic process
  Homolog annotation: Hit_ID=Q9FQE3; Match level="QueryCoverage=96%, HitCoverage=99%, E-value=1e-68, Identity=63%"; Hit description =Glutathione S-transferase GST 15
  Pfam annotation: Domain name=GST_N; Domain location=2-75; Score=52.3; E_value=1.7e-12; Accession=PF02798.10; Description=Glutathione S -transferase, N-terminal domain
MAEVKLHGFWYNLFTLRVVWTLKLKGIPYLNIEKDRYNKSLQLLEYNPVYRKTPVLVHNGKPLCESMLIVEYIDEIWPHNSLLPADTYERALARFWIKYADEIFPAVSAFFSSNNDEEREKSIEKIWEHLRVVENQCFVIKENLPDHEKMVAFIKFIREKRLASS

SEQ ID NO: 179875 - protein, 821 aa, Glycine max
  Coding DNA Sequence Number=SeqID_63097
  Gene Ontology: Mol. function=binding; Cellular component =mitochondrion; Biological process=cell cycle
  Homolog annotation: Hit_ID=Q1RSH5; Match level="QueryCoverage=99%, HitCoverage=99%, E-value=0.0, Identity=71%"; Hit description =Tetratricopeptide-like helical
  Pfam annotation: Domain name=PPR; Domain location=148-182; Score =29.9; E_value=8.8e-06; Accession=PF01535.11; Description=PPR repeat
  Pfam annotation: Domain name=PPR; Domain location=183-217; Score =36.0; E_value=1.3e-07; Accession=PF01535.11; Description=PPR repeat
  Pfam annotation: Domain name=PPR; Domain location=218-252; Score=4.0; E_value=2.5; Accession=PF01535.11; Description=PPR repeat
  Pfam annotation: Domain name=PPR; Domain location=282-316; Score =41.9; E_value=2.2e-09; Accession=PF01535.11; Description=PPR repeat
  Pfam annotation: Domain name=PPR; Domain location=317-351; Score =41.3; E_value=3.3e-09; Accession=PF01535.11; Description=PPR repeat
  Pfam annotation: Domain name=PPR; Domain location=352-386; Score =33.8; E_value=5.9e-07; Accession=PF01535.11; Description=PPR repeat
  Pfam annotation: Domain name=PPR; Domain location=387-421; Score =29.2; E_value=1.4e-05; Accession=PF01535.11; Description=PPR repeat
  Pfam annotation: Domain name=PPR; Domain location=490-524; Score =25.9; E_value=0.00014; Accession=PF01535.11; Description=PPR repeat
  Pfam annotation: Domain name=PPR; Domain location=525-559; Score =16.7; E_value=0.078; Accession=PF01535.11; Description=PPR repeat
  Pfam annotation: Domain name=PPR; Domain location=560-594; Score =36.8; E_value=7.3e-08; Accession=PF01535.11; Description=PPR repeat
  Pfam annotation: Domain name=PPR; Domain location=595-629; Score =27.1; E_value=6.4e-05; Accession=PF01535.11; Description=PPR repeat
  Pfam annotation: Domain name=PPR; Domain location=630-664; Score =21.9; E_value=0.0022; Accession=PF01535.11; Description=PPR repeat
  Pfam annotation: Domain name=PPR; Domain location=665-698; Score =20.4; E_value=0.0067; Accession=PF01535.11; Description=PPR repeat
  Pfam annotation: Domain name=PPR; Domain location=699-732; Score=3.9; E_value=2.6; Accession=PF01535.11; Description=PPR repeat
  Pfam annotation: Domain name=PPR; Domain location=733-767; Score =33.9; E_value=5.6e-07; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR; Domain location=148 -182::183-217::218-252::282-316::317-351::352-386::387-421::490 -524::525-559::...
  Pfam module annotation: Domain location=560-594::595-629::630 -664::665-698::699-732::733-767
MFVKLQLLYTHAPLLANANAFLLPEKTEQVTPNGRKQRVPLHNGAVKQETHSKKRRPEKNPEECVPRKTKPEKSHTKCSMKRVSYGGCITAILEALDVVLDVDEALGPWEDRLSNKERSIILKEQLRWDRALEIFEWFNKKGHELNVIHYNIMLRSLGRARQWRRVESLWNEMNARGIAATCSTYGTLIDVYSKGGRRDDALSWLNMMLGQGVQPDEVTMVIVVQLYKKAGEFQKGEEFFRKWSSGKPLRSKSKPLRSNDNVVASPELDERVACANASFGSHTYNTLIDTYGKAGQLKEASQTFVEMLKQGVAPTTVTFNTMINICGNHGRLEEVSLLVRKMEELRCSPNTRTYNILISLHAKHDDIGMATKYFETMKEACLEPDLVSYRTLLYAYSIRKMIREAEELVKEMDKRRLEIDQYTQSALTRMYIEAGMLDRSLLWFLRFHVAGNMTSECYAANIDAYGEHGHTLEAEKVFIWCQKQKNLSVLEFNVMIKAYGIGKCYEKACQLFDSMEKHGVVADRCSYTSLIHILASADQPHIAKPYLKKMQEAGLVSDCIPYCAVISSFAKLGQLEMTEDIYREMIRHGVQPDVIVHGILINVFSDAGRVKEAIGYVDEMKKAGLPGNTVIYNSLIKLYAKIDNLEKAKEAYKLLQLSDEGPGVYSSNCMIDLYVKRSMVDQAKEIFETLKKNGAANEFTFAMMLCLYKKIERFDEAIQIAKQIRKLGPLTDLSYNNVLDLYAIAGRPKEAIETFKEMVRASIQVNDCSLRSLGNLLLRYGVSRLAVHKLEALVKKDASNGLQAWMSALASVLEVDDYDHD

SEQ ID NO: 179876 - protein, 433 aa, Glycine max
  Coding DNA Sequence Number=SeqID_63098
  Gene Ontology: Mol. function=nucleic acid binding; Cellular component= intracellular; Biological process=DNA integration
  Homolog annotation: Hit_ID=Q1S1X7; Match level="QueryCoverage=64%, HitCoverage=28%, E-value=1e-64, Identity=39%"; Hit description =Integrase, catalytic region; Zinc finger, CCHC-type; Peptidase aspartic, catalytic
MGNLAGATFSGILRSQQHFTRLEPSLCLEGPRVLIVPCDDGGEEEAVEGVFGDGDGDSEVVGGEQSEHGGNGLLHGVSGGGGHAFRDGGVVEGLDAAEHGGDHGEATVEVARGDGVVGEAGGDEAAAAAREGEEDGGRVPWSGGGAGEGERSLYGLKQSPKQWYKLFDSYMFQIGYRRLTILCDVNELKSLLSKEFDMKDLGPVKKIFGMEIHRNKKSKRLWLSQQGYVEKVLDKFNMSNAKPVSTSLPKHFKLYVDQCLKIDVEVEYMSMVTYANVVGCLMYAMVCTRPNLAHIVSQVCKFMSNSVKRHCEVMKWILRYLKGTIGHDIMFDSQQGDLSIAGYVDCDYSIIQSLVAMSTTEVEYMAVTKASNGVVWLAGLVKELGIEQGEIKELMASGQILFRKVHNVADMLTKMVTTNKFKHLLDLLNVVKC

SEQ ID NO: 179877 - protein, 1147 aa, Glycine max
  Coding DNA Sequence Number=SeqID_63099
  Gene Ontology: Mol. function=protein-tyrosine kinase activity; Biological process=protein amino acid phosphorylation
  Homolog annotation: Hit_ID=Q1RSI5; Match level="QueryCoverage=99%, HitCoverage=100%, E-value=0.0, Identity=66%"; Hit description =Octicosapeptide/Phox/Bem1p; Protein kinase
  Pfam annotation: Domain name=PB1; Domain location=185-272; Score =98.0; E_value=2.9e-26; Accession=PF00564.15; Description=PB1 domain
  Pfam annotation: Domain name=Pkinase; Domain location=867-1130; Score= 202.2; E_value=1.3e-57; Accession=PF00069.15; Description=Protein kinase domain
  Pfam annotation: Domain name=Pkinase_Tyr; Domain location=867-1130; Score=268.1; E_value=1.7e-77; Accession=PF07714.7; Description =Protein tyrosine kinase
  Pfam module annotation: Pfam domain module=PB1::Pkinase::Pkinase_Tyr; Domain location=185-272::867-1130::867-1130
MSNEDHGVSGKQYIDAVSVGLSDRIPSDDDADYICLQTGEEFSAEFLRDRVASRKFPVITDADQHLPNRLDANIRENSPQLVYEDLKHVLGLRRTESDSNSDLLEIASVRGYVDEVDSRAYPNNLNRYQCEHSGFRQASGPNAPSVYVVESPHSCHPYGSVFSEGSFYKKIKFLCSFGGRILPRPNDGKLRYVGGETRIISIRKNIKWEELMRKTSAICSQTHIIKYQLPGEDLDALISVCSNEDLHHMIEEYEELERAGGSQWLRIFLIPSNECESPSSNEARVNQPSDADYHYVVAVNGMLNPSPQKNSNGLSLANHTSQFGNTTDYNSPHFYRDSSTSAFASEMKDCTPTSPNLVGILSKPGSQYFTALAGKSVNQMSPLSPACVQPTDPKISNVQIFKDKPYNAINESITPFVTEKVPCNNSLYVDNTNYIDPVAYHNNQYIVKSDLIRKPGKNLHLHRRNNSSNEFVSSTACSLTDLIFERPLVTNEGSYHFNKVVSRPHESSSLFSESDVREGSRYRMLHAHSDSTLKENDENYKVHLQFPLSVERDNFPSLKNSCSLEECSIQPGKTIDRKEHSAKYQNLPIFGMTDSFNVSEKGKEILQHADNSNDFFNENVGAMSQDNSIDLKHLQYIYTPHGVCSSSPDFQSSECNLSTASSISLESTRNLRGQPHGLSLDRTASEFSTRSQNSSMHHQYAMPETKDGQPLFPGSFESQTERGSILPISYMDMGSSLREVVIPVEDPAYNLHQKEQNTVIKNQCSEYINEFCVNKPVPESVAVVKGAMDYISSGIQSCLKDVSNVDEEAEVEPTSPEKEGIECDNPESESKHAESDSGNVNKPMGDRATAETEAEVYGLQNIENADLEELQELGSGTFGTVYHGKWRGTDVAIKRIKSSCFSGRLSEQERLTKDFWREAQILSTLHHPNVVAFYGVVPDGPGGTLATVTEYMVHGSLRNVLTKKDRVLDRRKRLLIAMDAAFGMEYLHLKNIVHFDLKCDNLLVNLGDLERPVCKVGDFGLSRIKRNTLVSGGVRGTLPWMAPELLDGNSCRVSEKVDIFSFGIAMWEILTGEEPYSNMHCGAIIGGIVNNTLRPPIPKRCDSEWKKLMEECWSPDPAARPTFTEITNRLRSMSDSLPKKRHNIVKR

SEQ ID NO: 179878 - protein, 574 aa, Glycine max
  Coding DNA Sequence Number=SeqID_63100
  Gene Ontology: Mol. function=nucleotide binding; Cellular component =spliceosome; Biological process=mRNA processing
  Homolog annotation: Hit_ID=Q84MU4; Match level="QueryCoverage=94%, HitCoverage=93%, E-value=0.0, Identity=68%"; Hit description =Putative pre-mRNA splicing factor
  Pfam annotation: Domain name=WD40; Domain location=274-313; Score =43.8; E_value=5.8e-10; Accession=PF00400.22; Description=WD domain, G-beta repeat
  Pfam annotation: Domain name=WD40; Domain location=318-356; Score =47.3; E_value=5.1e-11; Accession=PF00400.22; Description=WD domain, G-beta repeat
  Pfam annotation: Domain name=WD40; Domain location=360-400; Score =9.7; E_value=2.7; Accession=PF00400.22; Description=WD domain, G -beta repeat
  Pfam annotation: Domain name=WD40; Domain location=404-442; Score =34.2; E_value=4.4e-07; Accession=PF00400.22; Description=WD domain, G-beta repeat
  Pfam annotation: Domain name=WD40; Domain location=447-485; Score =10.7; E_value=2; Accession=PF00400.22; Description=WD domain, G-beta repeat
  Pfam annotation: Domain name=WD40; Domain location=492-532; Score =11.7; E_value=1.6; Accession=PF00400.22; Description=WD domain, G -beta repeat
  Pfam annotation: Domain name=WD40; Domain location=536-573; Score =16.1; E_value=0.13; Accession=PF00400.22; Description=WD domain, G -beta repeat
  Pfam module annotation: Pfam domain module=WD40::WD40::WD40::WD40::WD4 0::WD40::WD40; Domain location=274-313::318-356::360-400::404 -442::447-485::492-532::536-573
  Subcellular localization annotation: CTP_CleavageSite=45; ConfidenceScore=5.05e-01
MDLLHQYSDGDDPDSPSENPSSPPRLLPGRSAAPNVDDTMLALTVASSSSALSRPIDPTQHLVGFNPSYDQLWAPIQGPAHPFAKDGIAQGMRNHKLGFVEDASIEPFLFDEQYNTFHKFGYAADPAANNFVGDLDALRDNNAVSVYNIPRHEHKKRRIEAKQKKKSEEDDDGDVNEEIENPASEAWIMKNKKSPWAGKKEGLQGELTEEQQKYAEEYAKKKGEEKSGLGGEKVEVVKDKSTFHGKEERDYQGRSWIAPPKDAKANSDRCYIPKRLIHTWSGHTKGVSAIRFFPKYGHLILSAGMDTKVKIWDVFNSGKCMRTYMGHSKAVRDICFSNDGTKFLSAGYDKNIKYWDTETGQVISTFATGKIPYVVKLNPDEDKQNVLLAGMSDKKIVQWDMNTGQITQEYDQHLGAVNTITFVDNNRRFVTSSDDKSLRVWEFGIPVVIKYISEPHMHSMPSISLHPNANWLAAQSLDNQILIYSTREKFQLNKRKRFGGHIVAGYACQVNFSPDGQYVMSGDGEGKCWFWDWKTCKVYRTLKCHEGVCIGCEWHPLEQSKVATCGWDGMIKYW

SEQ ID NO: 179879 - protein, 166 aa, Glycine max
  Coding DNA Sequence Number=SeqID_63101
  Subcellular localization annotation: CTP_CleavageSite=79; ConfidenceScore=5.21e-01
MNSKNQTPIRVFGQRTIASTFRNLSPRYPPSERNERNQALRKSETAHPSLSHFLNLKLQKSPQTVPGKSTPFLSPLGLRRGEEGEAVKEVEKEKNGGSDDKVIFESFKHTEEDKGDFIDQIDVGELEKSVADDIKSQRKGKFRLKLFGLFRGGYRIVSGHEKELSE

SEQ ID NO: 179880 - protein, 102 aa, Glycine max
  Coding DNA Sequence Number=SeqID_63102
  Gene Ontology: Mol. function=ribose-5-phosphate isomerase activity; Biological process=pentose-phosphate shunt, non-oxidative branch
  Homolog annotation: Hit_ID=Q9ZU38; Match level="QueryCoverage=98%, HitCoverage=36%, E-value=1e-19, Identity=52%"; Hit description =Probable ribose-5-phosphate isomerase
  Pfam annotation: Domain name=Rib_5-P_isom_A; Domain location=10-102; Score=-67.8; E_value=0.00014; Accession=PF06026.5; Description =Ribose 5-phosphate isomerase A (phosphoriboisomerase A)
MSMRPTLSLASSRVVVGACCKKKWSWMSHVCKKFIFIVDEFKLVNYLGGSRLAMPVEVIQFCWRFTVVRLHKLFEEAGCVAKLRTFRKKEKPYVTNNGNFIV

SEQ ID NO: 179881 - protein, 374 aa, Glycine max
  Coding DNA Sequence Number=SeqID_63103
  Gene Ontology: Biological process=peptidoglycan metabolic process
  Pfam annotation: Domain name=PG_binding_1; Domain location=174-237; Score=55.5; E_value=1.8e-13; Accession=PF01471.9; Description =Putative peptidoglycan binding domain
  Subcellular localization annotation: CTP_CleavageSite=53; ConfidenceScore=5.24e-01
MSSTLLPVTATPIFTLTKTLPLPKPYLLSYKFKFNTLVRRCSLSDHEEQRWLREEQRWLRDEHRWLREEQRWARERDQLLREIADLKLQIQALERRLLTRDLSSPASISDAVANVTLLLQVLKDKNLVLESGSSLRNTEEVKQLEEVVEHVKEVVVVEESARVEKRISLRIGSEGEEVRQMQEALLKLGFYSGEEDMEYSSFSSGTERAVKTWQAALGAPEDGIMTAELLERLYLEIRNKDTGSATQDKQSTTVLPKEVENGAAVASVAENSEGQQKDVKSDKGTEVSHRGVFLLGENRWEEPSRLFTRNGVDRSKNKDVTTKCLQCRGEGRLLCTECDGSGEPNIEPQAIELINEFFNAVFGMGGRGYKMPIL

SEQ ID NO: 179882 - protein, 319 aa, Glycine max
  Coding DNA Sequence Number=SeqID_63104
  Gene Ontology: Mol. function=hydrolase activity, acting on glycosyl bonds; Cellular component=integral to membrane; Biological process =sphingolipid metabolic process
  Homolog annotation: Hit_ID=Q2R859; Match level="QueryCoverage=76%, HitCoverage=26%, E-value=3e-70, Identity=50%"; Hit description =Expressed protein
MVSGNIFHCRKNSWPPQEYISKSTLQLLFFVFGELASWSCDVAAPFVISENHTFAPFVFDYDSSAPPEQAWRRRLNSHANLLKEFRVRLGIRIWSYVREEASHGRKAPIDPFTRESCKPSASQGVPLGGMGSGSISRGFRGEFRQWQIIPSLCEASPVMANQFSIFISREGGNKNFASVLAPGQHEGLGSSRKPDDQGISSWGWNLSGQHSTYHALFPRAWTVYDGEPDPELKISCRQISPFVPHNYRESSLPAAVFVYTLVNTGKERAKVSLLFTWANSIGGSSHLSGDHVNEPFKAEDGVSGVLLYHKQVIKPYSYI

SEQ ID NO: 179883 - protein, 130 aa, Glycine max
  Coding DNA Sequence Number=SeqID_63105
  Gene Ontology: Mol. function=nucleoside-triphosphatase activity; Cellular component=chromosome; Biological process=DNA metabolic process
  Homolog annotation: Hit_ID=Q1SHN5; Match level="QueryCoverage=97%, HitCoverage=29%, E-value=6e-55, Identity=79%"; Hit description=SMC protein, N-terminal; AAA ATPase
MAESRPPKRPKISRGDDDYMPGNILEIELCNFMTFDYLKCKPGPRLNLVIGPNGSGKSSLVCAIALGLCGEPQLLGRATSIGAYVKRGEESGYIKITLRGDHKVEHITIMRKINTNNKSEWLLNGGVLIL

SEQ ID NO: 179884 - protein, 159 aa, Glycine max
  Coding DNA Sequence Number=SeqID_63106
  Gene Ontology: Mol. function=nucleoside-triphosphatase activity; Cellular component=chromosome; Biological process=DNA metabolic process
  Homolog annotation: Hit_ID=Q1SHN5; Match level="QueryCoverage=69%, HitCoverage=25%, E-value=1e-45, Identity=82%"; Hit description=SMC protein, N-terminal; AAA ATPase
MFLPQDRVCEFAKLTPVQLLEETEKAVGDPQLPEQHRALVDKSRALKHIELSLEKNEGTLKQLKERNAELETDVERVRQRDELLAKAEAMKKKLPWLRYDMKQAEYREAKERENDAAKALEEAAELLNDLKEPIMYGGLSYFYTYSQLLKFLIFLFLVF

SEQ ID NO: 179885 - protein, 229 aa, Glycine max
  Coding DNA Sequence Number=SeqID_63107
MALCESVNTYCSGKPEQMHHLWDRVIKDVPWFLSSFLALVAIEAAWGRSSLKSWRELHELAQGRQSWACQIAKELGGSSSLYAHRITVEHQLCREHVPHSKQIHSSEMRFMAKPTKPQSDVRCLSGVVRTIQLLHKEWEVRKHWSVCLSWGGVPSEAMGGEITVGSAAGKGAMPKNSDGDVSGRSEKIDERLVKRRDHRALKEVELDASGSLEEENYHRDRGSTGQHGY

SEQ ID NO: 179886 - protein, 232 aa, Glycine max
  Coding DNA Sequence Number=SeqID_63108
  Subcellular localization annotation: CTP_CleavageSite=64; ConfidenceScore=5.78e-01
MPSSDSGKPSDVPVPFASTIGSKPVGNNPRATTSGTVNQATMPLMKAPNGNVVDTLSLCRAEITCMNEESSIVKKGYSAEGREKHVVLGDDFQMAKDNLQQIQQPNMTIGDDGTWCKKKKGLSNTCANLMEAGTEAWIQQQREITPVINLRPTTGHEAPHSDTHTDYEVNQQAENKEDITEHFQQAKQQWEMAQELGVSTNIGHDSIIARICDMESRDSKEAEKLGNRSVTS

SEQ ID NO: 179887 - protein, 72 aa, Glycine max
  Coding DNA Sequence Number=SeqID_63109
  Gene Ontology: Mol. function=protein kinase activity; Biological process=protein amino acid phosphorylation
  Homolog annotation: Hit_ID=Q1SAG3; Match level="QueryCoverage=98%, HitCoverage=12%, E-value=2e-14, Identity=52%"; Hit description =Protein kinase; Integrase, catalytic region
MPPPTSSALELPISLCKGEAMTDPRWQLAMLDEMAALHASGTWELVPLPPEKTTIGCRWVYMVKLGPNGNID

SEQ ID NO: 179888 - protein, 106 aa, Glycine max
  Coding DNA Sequence Number=SeqID_63110
MSLICSKFEPLYIDEVETLLQAHEARLDKFHKNKSLVSVNLTEGALTSNSTIVQTVEIPNFVLNVPNSLNGNLNNQSFDAQVHLTMQEDIFDIQLVKRPMVMIAIA

SEQ ID NO: 179889 - protein, 403 aa, Glycine max
  Coding DNA Sequence Number=SeqID_63111
  Gene Ontology: Mol. function=ATP binding; Cellular component =chromosome; Biological process=DNA metabolic process
  Homolog annotation: Hit_ID=Q1SHN4; Match level="QueryCoverage=95%, HitCoverage=52%, E-value=1e-131, Identity=63%"; Hit description =Structural maintenance of chromosome protein SMC, C-terminal
MSSFLINFPHQQRLTAKIAELDYSAKQMRQKKSQAENEINHKKSSMNRIKERLIEMNNKSTKCLHALQRSGAEKIFEAYKWVQDHRHEFNKEVYGPVLLEVNVSNKDHAAYLEGQVAHYTWKSFITQDSGDRDLLAKHLRFFDVNVLNYTGGDGPQREPFEISEDKRALGIYSRLDQIFDAPIAVKEVLISQFNLDYSYIGSEKSDQNAGEVRKLGILDFWTPENHYHWSKSRYANYESAVVNQVQRPQLLLNNLNVGEIEKLSSEQRELEEIVANLEESVKRFHDEERSLLNQSANLRKQWEDISITVQNEQKKRQAIISRIDQKKKFLKLMEERDDLDTEIAKLVDQATKYNIRRFHNAMEIKDLLVEAVSYRRIFIEQRMAFIEFDAKSLLGDDEVRNCK

SEQ ID NO: 179890 - protein, 135 aa, Glycine max
  Coding DNA Sequence Number=SeqID_63112
MVEETHSAEGRRARHRRSFSGSSEEITSDVSDFDTPLTGYSGPSPRFLATKAMDGSNVHWVEKIPSSLPGNEYPTGIEGSSKAHGSIPDQCVTKSDKGKTIALEAGPMSEEIAISGEGAGGNANSTANSRGKKGK

SEQ ID NO: 179891 - protein, 616 aa, Glycine max
  Coding DNA Sequence Number=SeqID_63113
  Gene Ontology: Mol. function=RNA-directed DNA polymerase activity; Cellular component=nucleus; Biological process=RNA-dependent DNA replication
MSVARFREEEIKAAVWDCGSEKSPGPDGFNFKFIKQFWETLKPDFIRFLDEFHVNGIFPKGCNASFIALIPKVKDPQSLNEYRPISLIGCVYKTVAKILANRLKEVLPNIIDERQTAFIRERHLLHGVVIANEVVEEAKREKKTLSVSNKHDEEIGFLQQMDTLDQGLPPFSIGVYFEGLTGLMREAVDKERFSSFLVGKNKEPVSILQYADDIIFFGEATMENVKVIKMILRCFELASGLKINFAKSRFGAIGKPEQWGKEAAEFLNCSLLSTPFSYLGIPIGANPSHSELWDHIISKVPNKIIEKLVNIQRRFLWGGGMEQTKIAWVNWETICLPKAKGGLGIKDLRAFNTALLGKWRWEMFQHKGEMWTRILISKYGGWRSLDDERNSTYHSHWWKDLKKINQQQETSVLKKQIKWRVGSGDKIRFWEDTWAAEDRPLMEKYHSMNQISNQQQQIISRIGSHTEVGWEWKFSWRRTLFDNEVFMAADFLEESTRLTIQQNGEDSWIWKADSSGKYSTTTAYELLLEAARGETKDETFVELWKLKIPLKAAVFAWRLFRDRLATKVNLRRRQVELNDTLCPLCNTKEEDTAHLFFNCSHTLPLWWESRTWVNTV

SEQ ID NO: 179892 - protein, 1848 aa, Glycine max
  Coding DNA Sequence Number=SeqID_63114
  Gene Ontology: Mol. function=RNA-directed DNA polymerase activity; Cellular component=nucleus; Biological process=RNA-dependent DNA replication
  Pfam module annotation: Pfam domain module=RVT_1::RVT_1; Domain location=1498-1761::582-834
MARCSPWGCAPLSGAIDPYPKADDKFGPTSATYTPTTLPTQHPESLVKEQMDPNVSSTFHPRNQIPLRGQLSPHKSFSFYSRKTWQKKKAPETTISATAPEEEILAHNPTKEAEHIWNMAMDLGATTGSMQKEYEDNPMNIITYNETKETIDRSICQALWGDNEINWEAQPASNAAGGILCIWSEKSFVLERKVIGNGFIMLIGTWLQEAERVHIVNIYSPCDIQNKRLLWDSIKQLKTPTSGGLWCIVAVEDGSSREFNDWIAELEVEEAPWVGRKFTWFRPNGSAKSKLNRFLLSPEWFSKWPGTAQYTLDSNFSDHCPLLLRSKCVDWVPKPFRILDCWLTDSSFRETVHQSWSSNQQSGWGGFVLKEKIKRLKADIKNWNRDQFGNTLKKYKKIEEDLNKLEEDTIDRILEPQEVALRKKLQEELWMAAQSHQSLLRQKARSRWISEGDCNSRYFHLLINSSRRNNCLKGVMIDGSWTEEPTRVKEAVRLFFLKRFQEPNFAKPRLDGITFKTINSHQNDMLVARFQEDEVKRAIWSCGSEKSPDPDGLNFKFIKQFWHVFQPDFLRFLDEFFVNGIFPKGSNAFFLALIPKVADPLLLNDYRPISLIGCMYKVVAKILANKLKKVMHTLIDESQSAFIEGRHMLHSVVIANEVVDEAKRSNKPCIVFKVDYEKAYDSVSWDFLLYMLRRMGFYSRWIHWIEGCLKSTSVSILINGSPSQEFLPQRGLRQGDPLAPLLFNIIAEALSGLMSQAIRKGLYRGFSVGVNQVENVKAIKAILRTFKLVSGLKINFAKSSFGTFGVPDQWKSEAASYLNCSLMSFPFTYLGVPIGANPRLLTLIRVPKKVEDKMVSIQRRFLWGGTHDQNKIAWIKWESVYLPKEHGGLGIKDINTFNLALLGKWKWKMFQHQRELWVRVLESKYGGWRNLSELPRISSESIWWRDLKLLDQHPLHGLTIQSAISWQVGCGDQFRFWEDNWRGGEGTLLSKYPRLYAISCQQNQTIQQMGNFRQTRWEWDFKWRRSLFDNEIDMAVSFLGDIDQCRIQAQSRDQWVWLLEPSGHYSVNGAYRVLKGEITEEIQDRVFEDLWKLKVPNKILVFAWRLLKDRLPTRANLRRRQIEVVDNTCPFCRSVEENASHLFFRCSKVIPVWWESLSWVRLVGPLPNDPKQHFLQHVAAATEGIGATRKFTWFRPNGSAKSKLDRFLISHEWIAKWPDTTQFTLERNFSDHCPILLRSKIIYWGPKPFKVLDCWMKDSSFKRTVHECWTSSLLGGWGGFVLKEKLKRLKRRLKIWNKEQFGDTFKKYKQIQEELNRLEEQTIDKFLSPQEANVTKQLQQDLWAAAHSQESLLRQKSRSRWIKEGDYNSRYFHLLMNANRRNNLMKGILIDGSWVEEPQKVKEEVRLFFLKRFQESDFHRPTLDGIPFQAVSQQQKDMLIERFREEEVKEAVWGCGSEKSPGPDGFNFKFIKKFWPTIKPDILRFLDEFYVNGCFPKGSNVSFIALIPKVADPQSLHDYRHISLIGCVYKIVSKLLANRLKKVMPSIRDERSKKPCLVFKVDYEKAYDSVSWEFLKYMMRRMDFCPKWIQWIVGCLSSASVSILVNGSPSTEFTPQRGLRQGDPLAPLLFNIVAEGLKELMRQAVEKNIFRGFGAIGMPEMWKQNAADFLNCSLLSIPFVYLGIPLGITREGVSCGILFSENGSYKGDRKIGGHLEKIPLGILTASTLHCWANGNGVYFKITKSYGLECWNQNMEDGGVWMKHLEILMIHFALAAKYPRLYLITCQQNHLIQQMGDHKGTGWEWDFKWRRHLFDSEVSMADSFINEVADPSGKYSAKTDYDMLRGDAV

SEQ ID NO: 179893 - protein, 62 aa, Glycine max
  Coding DNA Sequence Number=SeqID_63115
MSIINLSNYAKQYYSIRKVKGGGLQTVPSASAVNPAKPTIDETCLPTLQGCPHTHSLLGKFA

SEQ ID NO: 179894 - protein, 893 aa, Glycine max
  Coding DNA Sequence Number=SeqID_63116
  Gene Ontology: Mol. function=DNA binding; Cellular component =chromatin; Biological process=chromosome organization and biogenesis (sensu Eukaryota)
  Homolog annotation: Hit_ID=Q53QK3; Match level="QueryCoverage=74%, HitCoverage=93%, E-value=1e-35, Identity=28%"; Hit description=PWWP domain, putative
  Pfam annotation: Domain name=PWWP; Domain location=258-331; Score =44.8; E_value=3e-10; Accession=PF00855.8; Description=PWWP domain
MDGERETLEEPIEKEGSLVGDGKDLKVGVLGSDLCIEGVVCTRERDAELNGDVGFDGSKEEGKGVDPSGGEAAEALGEDSQVLRSLESKSVNEIAELDGNEATLKTLDEQKNIDDKEVNKLVEKEAISDVIQAEPDVTQSIKEHAGDLGEGSQVVRSLEGKSENETAELDGNDVTLKTLDEQKNIDIQVESDISQSIEGQAGIAEQVGSQGEQEIEGEKLDDAKQRKPTHGRVAKHVSNKSSGNILQASYQLPKEKSEFSVYDMVWGKVKSHPWWPGQIFDPSDSSVEAKKHLKKDRHLVAYFGDRTFAWNESSQLKLFRTHFSNVVKQSNSDAFQNAVDCALDEVGRCAEFGLACSCIPKDTYDEIKLQTVQNTGIREELSFTRRVDESLNASSFSPENILEYLKTLSEFPTGGFDRLELLIAKAQLLAFYRLKGYSCLPELQYCGVVDNDTDAFLIKDLIKGSDKSLSEVNKHATHASKKGQTGAGNLKTANGSCLKRKHNLKDDLYPEKKKIILSEAAGGTPDSSLGNYQPGDATDNLISPASSKKRKTIDHCAGVSGMKDRRKTISLAKVSNTINQSFKIGERILRVANQLTGPPSSMLKCSGDRTQMEDGSADGFPGNGSDVFSPNPEKTQKSSFTVPTEYSSLDDLLHLLQWVAHEPLGDYSSLNVIVSFFSDFRNSIIVANDSGKENFPTKKVGAKRNKRPVGGSPETFEFDDLSHTHWTDMGIQSGSEKQQSQRSSRRDYQHAPAEPEKPFIVYTRRSYSRKQCSDSNHVAVPEKHSGCADENSPVELVLNFAELDSVPSEMRLNKIFRRFGPLNESETEVDRGSSRARVVFKKCVDAEVAFSSAKKFNIFGSVLVNYKLNHTPSTLSKASSLATTQDQENGNAS

SEQ ID NO: 179895 - protein, 99 aa, Glycine max
  Coding DNA Sequence Number=SeqID_63117
MENGVSLKEKYPRLYQISQQQHQHIQQMGTIANIGWEWKLQWRRFLLEAEIDTVAKFMEDLQRLTWVLSRKIQNNTSFNIPTTISADLGFSGGRPGGLL

SEQ ID NO: 179896 - protein, 69 aa, Glycine max
  Coding DNA Sequence Number=SeqID_63118
MVAELVSPSRELWARVLDSKYGGWKNLDENRRNLAESVWWQDLRSACQSMGEGNWFKRGIRLSVGCGSK

SEQ ID NO: 179897 - protein, 495 aa, Glycine max
  Coding DNA Sequence Number=SeqID_63119
MCGKSSYPTEGIITEGDMDVRFKGVRDTHNLAKQLDNIIIRGLKLYVNIPRYNRERLGQRTPGNKSQDKDDNTQHEVDCCKKKKYTNQGSYAEVLRRNIGPKGSRQPYHSHPQAHHTTTSSIHLNIEPEDTNWLKDAWVRRLSNPAMFDRVEEELLWETGLDISPKYIGDDLILLLGLTDNGAKHLMNGGQHGGTSMFYSMEKWNPGIRTGFRLTWVQVWGIPLQAWDTKYFRHILAAMGDLVEIDDDTKEKRRLDRARVLLKTPWRPTINHMVEVHISDECFKVFVVEETRGGSFHYQRRRSSMGGSSDDISSKDISLGSLTLRTTSPRGLEDVTRLSPAQVGGDADSDGGGIAEVEEAHREPLLPSGSHDGSYPLGNASTPRATDQVTSQSATRALTASSAHDTPPNHGLAQCTEGVGVAGSGVKLHKKGKSDEGDSTGAVDALKKKPKASADMAATSNVADETELGSTNLKVETAQVQQVQNLCLWISTPLM

SEQ ID NO: 179898 - protein, 78 aa, Glycine max
  Coding DNA Sequence Number=SeqID_63120
  Subcellular localization annotation: CTP_CleavageSite=47; ConfidenceScore=5.10e-01
MATTTSTFQPQTHHPTLLLPINFLTITINLTSTMLRRWRRSKPQIRREDHVGDGDDEGTRDSDDGCSGSAREEQKTIC

SEQ ID NO: 179899 - protein, 169 aa, Glycine max
  Coding DNA Sequence Number=SeqID_63121
  Homolog annotation: Hit_ID=Q1S326; Match level="QueryCoverage=16%, HitCoverage=7%, E-value=7e-07, Identity=85%"; Hit description =Putative receptor kinase-related
MAWHLASMLGLATIFCFLLLHENKFPSKSQSLQPGAYLIYLRIDISKDAHDSIPMAITRGIEELTYHTYCKEAPESSIQGPREENWEKKATGLPDFTTITGKAGCLAAQNWRKSIYSLAKIVTLLCGAGRSVANEWVWPKSSSRAKKGSCVEACVEASIDTTSNAEVVG

SEQ ID NO: 179900 - protein, 63 aa, Glycine max
  Coding DNA Sequence Number=SeqID_63122
MVSLPSDLGRPSKKSYEMSLQTCEGISNGCNKPAGVSQVATKNTGYPSSSPLIIPTQLVFDKF

SEQ ID NO: 179901 - protein, 466 aa, Glycine max
  Coding DNA Sequence Number=SeqID_63123
  Gene Ontology: Mol. function=ATP-dependent DNA helicase activity; Biological process=DNA repair
  Homolog annotation: Hit_ID=UPI000034F112; Match level="QueryCoverage =99%, HitCoverage=35%, E-value=8e-74, Identity=40%"; Hit description =ATP binding / ATP-dependent DNA helicase/ DNA binding
MIPEKYLLEQRAVVDVDGGTLLNEDYDIRSVLQYLLDDVSEFLSTKLVEVKEEREISEDKGCIFVLKAFIDYLLEREKENFGARRKDNENSVTLTTIHQAKGLEWDVVFIVKANDSEIPLLHDFKGTVKDTAALLEEERRLLYVAMTRAREKLFILHVMMDSNWQMLQPSRFLKEIPRHLTEVQLHYTNVEPQYWPPLETEGPTKNLWSSARDLMDRSGQRLLEQAAGKDSLQKTTPRAVHEHLALRRMDYYWCITGEISFQELLIKQEALQKETAHCTTDLLIKEKQSEADVIPMPHEILDNHSSETSNELAQFAEANNRNDFLRRFSVENRSIVSHLFHQWAKKKAFQDPKRLLDKVSFVIDERLRQKRNKNKDLLNTLKSCLSCDEAFQYAQYVLRWEQIPADKRAHLMREKQEHFLKLKIENAMGSATPTDKQISYLKKLGCTAIPTSRLHASHLIEQFKSL

SEQ ID NO: 179902 - protein, 319 aa, Glycine max
  Coding DNA Sequence Number=SeqID_63124
  Homolog annotation: Hit_ID=A0BWD8; Match level="QueryCoverage=56%, HitCoverage=87%, E-value=2e-14, Identity=25%"; Hit description =Chromosome undetermined scaffold_131, whole genome shotgun sequence
MGLIRFLRLPVYLHENTMGVMYAFVMRPESLPKSYQDFIQKTGPVAEPVYKAVRDSCRGHPVDVASLHAYLSRVGRSDYVKLEEFPSIIPCSIIHPATNSCLAHQGNATSLTFKKTFPLYFSLTFVPFVVLHLQKFTDAPFRTFWLAIKGAVRSTTFLSAFVGIFQGVICSHRKVFSRDHKLVYWIAGGIAALSVLLEKKARRGELALYVLPRAVDSLWYILVNRHLLPNIRNAEVFLFSLCMGGIMYYLEHEPETMAPFLRGLIRRFLASRISNPSPPNRTASYTYLQALDGITKPTLQEKRDTESSEKYNLESIPGL

SEQ ID NO: 179903 - protein, 80 aa, Glycine max
  Coding DNA Sequence Number=SeqID_63125
MASETIENVCAWNIFGAENTTGSSSNIMEGARLSLGNLKSLLQFITSRTLAISPWLKWHTKSFSMVEDTESTFIRYLLKD

SEQ ID NO: 179904 - protein, 59 aa, Glycine max
  Coding DNA Sequence Number=SeqID_63126
MALMCLFVFEEGDLVALGSLRGLSLQPCSSEIPSDKSGKGSRDKRPVHKVAAEFRRHVI

SEQ ID NO: 179905 - protein, 148 aa, Glycine max
  Coding DNA Sequence Number=SeqID_63127
  Gene Ontology: Mol. function=protein-tyrosine kinase activity; Biological process=protein amino acid phosphorylation
  Homolog annotation: Hit_ID=Q1ENY6; Match level="QueryCoverage=50%, HitCoverage=42%, E-value=1e-17, Identity=60%"; Hit description =Protein kinase, putative
MAVMVEFSATLSKKPSDIMASTWEKSRRSSMAKGSPIQNQAKCNYHLFYLWIIALLFQKGSFHILCIDAATETRYLNASNRELCPPNEARLSSDNPDSPSKENKVPCQLLQFTFQELKAATGNFRPDSIPREGRFGYIHHLHVLRLLT

SEQ ID NO: 179906 - protein, 45 aa, Glycine max
  Coding DNA Sequence Number=SeqID_63128
MEITMAIEGVICSTGGKVMDVATDNKASGERIVQRVEVTTPDSMV

SEQ ID NO: 179907 - protein, 133 aa, Glycine max
  Coding DNA Sequence Number=SeqID_63129
  Gene Ontology: Mol. function=nucleic acid binding
  Homolog annotation: Hit_ID=Q9LX90; Match level="QueryCoverage=71%, HitCoverage=43%, E-value=2e-18, Identity=55%"; Hit description=RNA binding protein-like
MEQEEHEVYGADIPDEEIDMDADAEQQDEQLAPNHTNKELEDMKKRLKEIEEEASALREMQAKVEKEMGAVQDSSGTSATQVEKEEVDARSIYVGNGVVLTYVRSHRRHIHMTGYYVNFIPHSFKRIGKDLGP

SEQ ID NO: 179908 - protein, 78 aa, Glycine max
  Coding DNA Sequence Number=SeqID_63130
MIESDIEALSHYGLTMILLVDHNPHELIRTLVSLPRSSSDPLRGYGKACIVPNNSSMKKHFDMSISVLNGPNNKDPIR

SEQ ID NO: 179909 - protein, 323 aa, Glycine max
  Coding DNA Sequence Number=SeqID_63131
  Gene Ontology: Mol. function=metal ion binding; Cellular component =intracellular; Biological process=protein kinase C activation
  Homolog annotation: Hit_ID=Q5NAR1; Match level="QueryCoverage=93%, HitCoverage=61%, E-value=1e-34, Identity=31%"; Hit description =Pentatricopeptide (PPR) repeat-containing protein-like
  Pfam annotation: Domain name=PPR; Domain location=107-141; Score =21.6; E_value=0.0028; Accession=PF01535.11; Description=PPR repeat
  Pfam annotation: Domain name=PPR; Domain location=240-274; Score=0.2; E_value=7; Accession=PF01535.11; Description=PPR repeat
  Pfam module annotation: Pfam domain module=PPR::PPR; Domain location =107-141::240-274
MPRRNVGSFNVVISGCAALENSNSTSHDDLWNFFVRMHCEGFKADAFKVASLLPVYCSDTGKWDYGRELHCYVVKNGLDLKMGSDVHLGSSLIDMRVFDQMKNMNVYVWTAMIDGYVQNGVPEDALVLPREMQMKDGIRPNKFGLCKMSLRNWFLLQRCCHLEFNDLCIWITWKRRRGYYYVLQNASARASLIKPRNSSKICLSPSVWGSILTASVMHGNSRTRDLAYWHLLELEPENPSNYISLSNTYASDRKWDVVTEVRTIMKQRGLKKVPGCSWITISGKTHSFSVADKAHPSSSLIYEMHDDLVSIMMDGCADIDILT

SEQ ID NO: 179910 - protein, 529 aa, Glycine max
  Coding DNA Sequence Number=SeqID_63132
  Gene Ontology: Mol. function=serine-type endopeptidase activity; Cellular component=mitochondrion; Biological process=proteolysis
  Homolog annotation: Hit_ID=Q8S3I6; Match level="QueryCoverage=85%, HitCoverage=97%, E-value=0.0, Identity=70%"; Hit description=D1 protease precursor
  Pfam annotation: Domain name=PDZ; Domain location=211-297; Score =49.5; E_value=1.1e-11; Accession=PF00595.14; Description=PDZ domain (Also known as DHR or GLGF)
  Pfam annotation: Domain name=Peptidase_S41; Domain location=333-496; Score=240.5; E_value=3.5e-69; Accession=PF03572.8; Description =Peptidase family S41B
  Pfam module annotation: Pfam domain module=PDZ::Peptidase_S41; Domain location=211-297::333-496
MGGGLQLRQGRNEEKIKTAMSIMMNMRCQGVSQWKCFSLRVIESRFPLAHRRKKGLGSRNRDSGKEFSIGVVPRISSICYPQCGYFPSSGGFTAKRRKCNSLLRLKDCSENIRQHASILFVRLVTGVMLVMAVSLASSEPSWALSEENLLFLEAWRTIDRAYIDKSFNGQSWFRYREDALRNEPMNNRDETYTAIRKMLATLDDPFTRFLEPEKQSGTKGALTGVGLSIGYPTKADMQPGGLVVISASPGGPAYRAGVSSGDVILAIDDTNTENMGLYDAAERLQGPEGSSIALTIRSGSDIKHLDLTREKVSLNPVKSRLCKLPASGNDSPTIGYIKLTSFNQKASSAIKEAINTLRSDNVNAFVLDLRDNSGGLFPEGIEIAKIWLDKGVIVYICDSRGVRDILDTDGSSALATSEPLVVLVNKGTASASEILAGALKDNKRAVLFGEPTFGKGKIQSVFELSDGSGLVVTVARYETPAHTDIDKVGVIPDHPLPISFPKDEDAFCNCLQDPASSCYVNRIQLFSKS

SEQ ID NO: 179911 - protein, 41 aa, Glycine max
  Coding DNA Sequence Number=SeqID_63133
  Homolog annotation: Hit_ID=P45458; Match level="QueryCoverage=80%, HitCoverage=7%, E-value=5e-08, Identity=77%"; Hit description=Malate synthase, glyoxysomal
MKVFNNNMGNAPNLMEDAATAEISRVQNWQWLKYGDGLGVK

SEQ ID NO: 179912 - protein, 119 aa, Glycine max
  Coding DNA Sequence Number=SeqID_63134
MFSSVFKPAKASDCVADWSSESGRKKQVLCKYLKFEVGEEVWLLVITVINTSSVTSNLKRNTWQWIKCTKREGNRVADDLAKLAFSTYEMYWMEECPSQLLLYFNDIGNTTTKSRFYIG

SEQ ID NO: 179913 - protein, 184 aa, Glycine max
  Coding DNA Sequence Number=SeqID_63135
  Homolog annotation: Hit_ID=Q9M4H4; Match level="QueryCoverage=70%, HitCoverage=63%, E-value=1e-33, Identity=53%"; Hit description =Ripening-related protein grip22 precursor
  Pfam annotation: Domain name=DPBB_1; Domain location=80-152; Score =23.7; E_value=9.2e-05; Accession=PF03330.8; Description=Rare lipoprotein A (RlpA)-like double
MANNIGVLMMVFLLCLLNVITHLPNLTNASSSCKSKGLHSPPYNPSGTHAILTLNNFARGGDGGGPAECDGKFHPLPQRVVALSTGWYNKGARCGKMIRIKARNGRSTLAKVVDECDSVHGCACKTNVVDASKTVWKDLGLNTNDGEVPVTWTMFNYLSSSSLATSFLVSFNTIFPVSSFNHRK

SEQ ID NO: 179914 - protein, 55 aa, Glycine max
  Coding DNA Sequence Number=SeqID_63136
MILAWTSKDKHEMVDDGEDDGYKSAPEKGCGSKYPESIFLNCFTCKFQINPDLIE

SEQ ID NO: 179915 - protein, 89 aa, Glycine max
  Coding DNA Sequence Number=SeqID_63137
  Homolog annotation: Hit_ID=Q1SUQ3; Match level="QueryCoverage=93%, HitCoverage=14%, E-value=2e-14, Identity=47%"; Hit description=WD40 -like
MTVVEEREAVLACSDKNMKIGATMWDLETGEKLFHIPTCASPPFGFLCLRNRFLVASQSNKLGSVGDGAIAIWSFNKEENIYHVYTHSL

SEQ ID NO: 179916 - protein, 168 aa, Glycine max
  Coding DNA Sequence Number=SeqID_63138
  Gene Ontology: Mol. function=transferase activity; Cellular component= intracellular; Biological process=translation
  Pfam annotation: Domain name=GnsAB; Domain location=40-89; Score=7.1; E_value=0.099; Accession=PF08178.2; Description=GnsAGnsB family
MEYEILMKDKSNMSEQQRQDHENYHVMDPNINLDEALDQMVDEELEDKIEEEIIRLILKSQHQLDGNTTKRRQSRRMVHQNHKEGHDRLFNDYFSANLVYTETRFRRKFCMQRHVFLRIIDALNNHDEYFQMRIDALSQKDLSPLQKCTTALRILAYGSSINNVDEYV

SEQ ID NO: 179917 - protein, 135 aa, Glycine max
  Coding DNA Sequence Number=SeqID_63139
  Homolog annotation: Hit_ID=Q9M4H4; Match level="QueryCoverage=86%, HitCoverage=53%, E-value=4e-38, Identity=62%"; Hit description =Ripening-related protein grip22 precursor
  Pfam annotation: Domain name=DPBB_1; Domain location=52-132; Score =7.2; E_value=0.0032; Accession=PF03330.8; Description=Rare lipoprotein A (RlpA)-like double
MATSCQSNGAHSPAFNPSGTPAILTVNDFGPGGDGGGPSECDGTYHPLPQRVVALSTGWYNGGSRCGKMVRITARNGRTAVAKVVDECDSTQGCDQEHANQSPCKTNIVDASENVWHDLGLNTDDGEVPVTWTMV

SEQ ID NO: 179918 - protein, 108 aa, Glycine max
  Coding DNA Sequence Number=SeqID_63140
MEFVNRIVDIATRAVNSNAVINVCLLASFATLGVRSMNQQKTIEALQDEKESLTKSNKSIRKTLWDWKQQLYAEASADSAVVPLARLKAIYGEAPPPPRATLENGFVD

SEQ ID NO: 179919 - protein, 109 aa, Glycine max
  Coding DNA Sequence Number=SeqID_63141
MDKRHGNYIQCSTIGQGEFNRIAFPNPDTFLQNKYHGEIDYERALHAEAAVRGKAISKRFHVICFEDIRPYTGWLHRNDSKASIANGVTPEGFIDYDSLRFWITGNSVI

SEQ ID NO: 179920 - protein, 88 aa, Glycine max
  Coding DNA Sequence Number=SeqID_63142
  Gene Ontology: Mol. function=protein serine/threonine kinase activity; Biological process=protein amino acid phosphorylation
  Homolog annotation: Hit_ID=Q8LK24; Match level="QueryCoverage=69%, HitCoverage=14%, E-value=1e-10, Identity=55%"; Hit description=SOS2 -like protein kinase
MVGKEKTSFREYLIKVVGKEESVMEVFMEGREAKVEDLQVIGTIQEEVLWLEVAMGDVVAMAEAEHGDELCEVAVDEGLREAFVAREP

SEQ ID NO: 179921 - protein, 451 aa, Glycine max
  Coding DNA Sequence Number=SeqID_63143
  Gene Ontology: Mol. function=argininosuccinate synthase activity; Cellular component=chloroplast; Biological process=arginine biosynthetic process
  Homolog annotation: Hit_ID=Q1T0B7; Match level="QueryCoverage=99%, HitCoverage=100%, E-value=0.0, Identity=76%"; Hit description =Argininosuccinate synthase
  Pfam annotation: Domain name=Arginosuc_synth; Domain location=82-447; Score=615.7; E_value=4.1e-182; Accession=PF00764.9; Description =Arginosuccinate synthase
  Subcellular localization annotation: CTP_CleavageSite=55; ConfidenceScore=5.09e-01
MAQLKASPACSTRATAPSFHTTGHLYHHFWKAKPSSFKELGLRTSVGANKLQVIKAAARSDTEVVSETTKAGGLRGKLNKVVLAYSGGLDTSVIVPWLRENYGCEVVCFTADVGQGIKELEGLEQKAKASGACQLVVKDLKEEFVKDYIFPCLRAGAVYERKYLLGTSMARPVIAKVRFELTFFALNPKLNVVAPWREWDITGREDAIEYAKKHSIPVPVTKKSIYSRDRNLWHLSHEGDILEDPSNEPKKDMYMMSVDPEDAPDQAEYVEIGLESGLPVSVNGKSLSPASLLAELNEIGGRHGIGRIDMVENRLVGMKSRGVYETPGGTILFAAARELESLTLDRETIQVKDSLALKYAELVYAGRWFDPLRESMDAFMQKITETTTGSVTLKLYKGSVTVTSRTSPFSLYREDISSFESGQIYDQADAAGFIRLYGLPVRVRAMLEQGI

SEQ ID NO: 179922 - protein, 58 aa, Glycine max
  Coding DNA Sequence Number=SeqID_63144
MAARGCRHFGRRWWRNGLMVVVFDLVAWGQSKIVVVVGNSGARELGDKGEVGSVGNFQ

SEQ ID NO: 179923 - protein, 395 aa, Glycine max
  Coding DNA Sequence Number=SeqID_63145
  Gene Ontology: Mol. function=binding; Cellular component =intracellular; Biological process=RNA processing
  Homolog annotation: Hit_ID=Q1SXC6; Match level="QueryCoverage=75%, HitCoverage=44%, E-value=3e-32, Identity=53%"; Hit description =Tetratricopeptide-like helical
  Pfam annotation: Domain name=TPR_2; Domain location=151-184; Score =22.5; E_value=0.0015; Accession=PF07719.7; Description =Tetratricopeptide repeat
  Pfam annotation: Domain name=TPR_2; Domain location=185-219; Score =6.7; E_value=5.5; Accession=PF07719.7; Description=Tetratricopeptide repeat
  Pfam annotation: Domain name=TPR_2; Domain location=299-333; Score =7.8; E_value=4.1; Accession=PF07719.7; Description=Tetratricopeptide repeat
  Pfam annotation: Domain name=TPR_3; Domain location=151-184; Score =12.9; E_value=0.23; Accession=PF07720.3; Description=Tetratricopeptid e repeat
  Pfam annotation: Domain name=TPR_3; Domain location=299-333; Score =8.8; E_value=0.82; Accession=PF07720.3; Description=Tetratricopeptide repeat
  Pfam module annotation: Pfam domain module=TPR_2::TPR_2::TPR_2::TPR _3::TPR_3; Domain location=151-184::185-219::299-333::151-184::299-333
MDSSSNSVMEDEVESTTLHSAPSFAIYNNLHGDDDITPEEVLKRTVLVGQSLEATGSGDFSFGSNKMDLIEEGENENENNDWSTGIRNLSIEEEDVQPASPPMYLAAGLGVDADVGFDKFISDDVFNPSLEESEDLEGYYKRMVDEYPCHPLVLKKYAQLLQSNGDLQGAQEYFLQATVADPNDGEILMQYAKLVWENHHDKDRAMVYFERAVQAAPQDSNVLAAYTSFLWNIEDDENEDRKHEIQSDMEIQKTEPVKPSKEESGQVIDAANVTTANFGEESNVEDYLKKMVDENPSNPLFLKKYAQFLLQSKRDLQAAEDYYSRAVVADPSDGEMISEYANLVWELHHDQEKASFLFEQAVQATPGDRREKSIAMFWQHIPVFSGKQMTQKAEI

SEQ ID NO: 179924 - protein, 451 aa, Glycine max
  Coding DNA Sequence Number=SeqID_63146
  Gene Ontology: Mol. function=3-isopropylmalate dehydratase activity; Cellular component=chloroplast; Biological process=leucine biosynthetic process
  Homolog annotation: Hit_ID=Q1SSZ5; Match level="QueryCoverage=99%, HitCoverage=96%, E-value=0.0, Identity=64%"; Hit description=3 -isopropylmalate dehydratase large subunit
  Pfam annotation: Domain name=Aconitase; Domain location=60-442; Score= 2.3; E_value=4.9e-15; Accession=PF00330.10; Description=Aconitase family (aconitate hydratase)
  Subcellular localization annotation: CTP_CleavageSite=68; ConfidenceScore=5.85e-01
KDLGFFAFPSPSSIIGKRQKCKKTSSNKIVSVVSSPKNKRSPSATGSVVFTFFPTKIPMTATEKILARAAEKCEVRPGENAWANVDVLMINDITCPGISGIFKKEFGNTAKVWDREKIVVIPDHYIFTNDERAHRNVDIARDFCVEQDIKYFYDIQDRSNFRANPDYKGVCHVALAQEGHCRPGEVLFGTDSHTTSAGAFGQFATGVGNTDAAFVLGTGKILLKAKRMTLCNMVIEAGGKNGIVAADRTTYKYLEDKTSAPYEPVSSDENARQVLFLAQYRFDVSNMEPLVAKPHSPDNRALARECNNVKIDRVYIGSCTGGKTEDFMAAAKVFLAGGKTVKVPTFLVPATQKVWMDLYTLEVPDSGGKTCSMIFEEAGCDPPASPSCAACMGGPRDTYGRLNEPQVCVSTTNRNFPGRMGHMEGQIYLASPYTAAASALTGFVTDPREFL

SEQ ID NO: 179925 - protein, 341 aa, Glycine max
  Coding DNA Sequence Number=SeqID_63147
  Gene Ontology: Mol. function=nucleic acid binding; Cellular component= intracellular; Biological process=transport
  Homolog annotation: Hit_ID=Q1S206; Match level="QueryCoverage=90%, HitCoverage=63%, E-value=5e-34, Identity=32%"; Hit description=RNA -binding region RNP-1 (RNA recognition motif); Nuclear transport factor 2
MGITVSNHLLGGDIHARDFVATNEVKENGAVNNYGFSHQQMLRVHDSEHIQEDVVAEESHGSFQPTVDAVQEHVPSAEESPEEPQKHTYASILRVAKGQATPSVASQPSQKNLTSLDWDHAPLTNSQQTTSFERSETVVVEEAPTTEDEDEIKSVYVRNLSPTVSASEIEEEFKNFGRIQPDGVVIRSRKWYHTVAPCCCCVACCGAVSFSSVNCGRFHDVGVCYAFVEFEDMMGVHNAVKAGSVEVAGRHVYIEERRPNSNIPSRGGRRGRGRSSYQLSEAQRGRFGPRSFCRGSGQDGGEWEYNKPKGNGFYRQSTRQERGYSSGYQGPRNGQNPAESA

SEQ ID NO: 179926 - protein, 60 aa, Glycine max
  Coding DNA Sequence Number=SeqID_63148
MNQAMKLFVGEDVFFVEFVGGFGAFEGSDPGEDGGDAAASASARRGGTRSGGGGGGGGRA

SEQ ID NO: 179927 - protein, 642 aa, Glycine max
  Coding DNA Sequence Number=SeqID_63149
  Homolog annotation: Hit_ID=Q1SSZ2; Match level="QueryCoverage=99%, HitCoverage=99%, E-value=8e-65, Identity=57%"; Hit description=C2 calcium/lipid-binding region, CaLB
  Pfam annotation: Domain name=C2; Domain location=11-95; Score=51.3; E_ value=3.2e-12; Accession=PF00168.20; Description=C2 domain
  Pfam annotation: Domain name=Cytadhesin_P30; Domain location=189-442; Score=-146.9; E_value=0.039; Accession=PF07271.2; Description =Cytadhesin P30P32
  Pfam annotation: Domain name=Extensin_2; Domain location=302-590; Score=-95.8; E_value=0.0013; Accession=PF04554.4; Description =Extensin-like region
  Pfam module annotation: Pfam domain module=C2::Cytadhesin _P30::Extensin_2; Domain location=11-95::189-442::302-590
MSQILAPFQLLELNVISAQDLAPLGRNMRTYAVSWVHPDRKLSTRVDSEGHTNPTWNDKFVFRVDEEFLYSDTSAIMIEIYALHWFKDIHVGTVRVLVGNLAPPPSKPFHNNRTPLGMRFIALQVRRPSGRPQGILNIGFTVLDSSMRSMPLYTHNASAVGYRHLMGEKDAYDSHNHLSPRIRPTAVATPMPELRRTKSDTSSMLGAAEAVARHHRAMAVRADSTISGSEVSVKKKKGKKKKTKAKKSSSVVSSVNETNSVLSDTVLPWKVKSGKASPDDIVHVHNNVVEEVHNDNDDDNENAHSTVNSVSEIATSETDADEGQQHVHVNHVQYEVRASPKPQFRNSPAPQFKNSPAPQFKNSPAPQFKNSPAPHFKNSPAPQYKNSPAPRYMNSPKPQFKNSPAPQFKNSPAPQFKNSPTPQYKSSPVLQYMNSPKPQFKNSPMPQYMPTPKPQFRNSPAVSKFNPAVGFNGSQRGTPMHPFGKVNGAGFEYMTPRRSNLANMGHVVITESELGPSPSEVAAAIARKPVIDEGENSTVGGWSLDAESVEGLQSKLERWRTDLPPVVDRGEVSSYPTTSTTKTSRHSRRHTDGGSTGSGLFSCFSNICGVECYVGCGGDPKGKKNRIRSRRTPSADDSSSLL

SEQ ID NO: 179928 - protein, 192 aa, Glycine max
  Coding DNA Sequence Number=SeqID_63150
MDQKVVSTASIVKAPKCYVPVTIPRVLVTEEDSGDFSSVSDSSGATGSEKDDSTDENKVNIRASSIPRPRAVISSPENDMMIGNRNKNGDGRLSASKNGGVLENRHAHCKVKSHDVTDIPPDTRKQREPGSKDKADPVGKKKIKGLLKLFQIFMLAAHFGYGFIIGIISLYSAPELVKGRSLQPLVGNPTVI

SEQ ID NO: 179929 - protein, 278 aa, Glycine max
  Coding DNA Sequence Number=SeqID_63151
  Gene Ontology: Mol. function=binding; Cellular component=nucleus; Biological process=mRNA editing
  Homolog annotation: Hit_ID=Q6ZIP5; Match level="QueryCoverage=93%, HitCoverage=64%, E-value=8e-40, Identity=30%"; Hit description =Pentatricopeptide (PPR) repeat-containing protein-like protein
  Pfam annotation: Domain name=PPR; Domain location=240-274; Score =48.3; E_value=2.6e-11; Accession=PF01535.11; Description=PPR repeat
  Pfam annotation: Domain name=PPR; Domain location=32-66; Score=5.4; E_ value=1.7; Accession=PF01535.11; Description=PPR repeat
  Pfam annotation: Domain name=PPR; Domain location=96-130; Score=34.9; E_value=2.9e-07; Accession=PF01535.11; Description=PPR repeat
  Pfam module annotation: Pfam domain module=PPR::PPR::PPR; Domain location=240-274::32-66::96-130
MGNRNLAQLTHTSLTRAVHAHILTSGFKPFPLIINRLINHYCKFSNISYARHLFDKIPKPDIVATTTMLSAYSAAGNVKLAHLLFNATPLSIRDTVSYNAMITAFSHSHDGHAALHLFIHMKSLGFVPDPFTFSSVLGALSLIADEERHCQQLHCEVLKWGALSVPSVLNALMSCYVCCASSWLVDSCVLMAAARKLFDEVPPGRRDEPAWTTIIAGYVRNDDLVAARELLEGMTDHIAVAWNAMISGYVHRGFYEEAFDLLRRMHSLGIQLDEYTPV

SEQ ID NO: 179930 - protein, 165 aa, Glycine max
  Coding DNA Sequence Number=SeqID_63152
  Gene Ontology: Mol. function=hydrolase activity; Cellular component =intracellular; Biological process=thiamin biosynthetic process
  Homolog annotation: Hit_ID=Q6ZIP5; Match level="QueryCoverage=80%, HitCoverage=21%, E-value=8e-37, Identity=46%"; Hit description =Pentatricopeptide (PPR) repeat-containing protein-like protein
MPFEPSAPIWEALLAGCWIHGNMELGIQATERLLELMPQQDGTYISLSNMYAALGQWDEVARISGAMVHEMRKLGYVPDPKFVLHDMESEQKEYALSTHSEKLAVVYGIMKLSLGATIWVLKNLRICRDCHNAFNLKDGNLPSANPLLLHMDDRVDYCYIKSLTM

SEQ ID NO: 179931 - protein, 75 aa, Glycine max
  Coding DNA Sequence Number=SeqID_63153
MENYLYQCSIVEALEARESKTAVNLNNRESYWLYCTTEFFLRVPGMEMAWTRVLYGLGHWPLMNDLTYFFHHQWL

SEQ ID NO: 179932 - protein, 68 aa, Glycine max
  Coding DNA Sequence Number=SeqID_63154
MDEVEAAIIAPDLACEDQEHSKEEEEEFAFGSRWWVSWKSWSDEKNLQAAGGGGRESNEREGSVGTNL

SEQ ID NO: 179933 - protein, 48 aa, Glycine max
  Coding DNA Sequence Number=SeqID_63155
MELHSLLKGSENGLPSVKGEWIELMSYFGIWKFKMYIDQQLTLGKLRL

SEQ ID NO: 179934 - protein, 345 aa, Glycine max
  Coding DNA Sequence Number=SeqID_63156
  Gene Ontology: Mol. function=DNA binding; Biological process=DNA integration
  Homolog annotation: Hit_ID=Q1S8Y1; Match level="QueryCoverage=48%, HitCoverage=52%, E-value=3e-20, Identity=42%"; Hit description=TLD, putative
VIVGFTTKVLQTFGLDTACKEDNVEGGIIHGDNKMGKEEYQSHNDVQNEIGTNDDKSEANVVQNFEDEDLYLATTNEVAKSKWIMDSPASKHICRDRAMFDTLKTNGEFGHFNLGNGEKMKVEVIETVRMKLHNNIIQTFQNVRFVPSATTNVISLGEMTSPGYRYVGLNWGCKDSPYSQEDKPLSSYLSYIIPSVSFDGSKTNKNQHELKPIQSTSAGYNYENFEYQDVPSDNYVDCTNMDLLKDDNDNINEDPISRRTSSSSSSEVFEEANEQQTPNTSKKSRLNLTDDSTFISPELYEFLEICLPNIVKGRQWVLLYSTLKHGVSLRTLIRKSAELSCPGLL

SEQ ID NO: 179935 - protein, 139 aa, Glycine max
  Coding DNA Sequence Number=SeqID_63157
  Homolog annotation: Hit_ID=Q1S8Y1; Match level="QueryCoverage=47%, HitCoverage=22%, E-value=5e-15, Identity=57%"; Hit description=TLD, putative
  Pfam annotation: Domain name=TLD; Domain location=8-132; Score=-11.9; E_value=0.0002; Accession=PF07534.6; Description=TLD
MTDWPYHLCMSSSSISSVEVRENSRNKKKEKRFFLANFSVEKRHFPMSMSICFNPFDLIGIDSLHIVGEGVNRYYYMCLNGLLALGGGGNYALCLEEDLLTGTSGPSDTFGNKCLAHSPEFELKNVELWGFAHPSPFQG

SEQ ID NO: 179936 - protein, 85 aa, Glycine max
  Coding DNA Sequence Number=SeqID_63158
MNGIVNAIEKGEIERTTRDSYRGSGEFAGKGRVIAGEMRGSGAARMAPTEGKRKRQYGDVLKWLLILLRFSIHTWQPLTLPAMCV

SEQ ID NO: 179937 - protein, 203 aa, Glycine max
  Coding DNA Sequence Number=SeqID_63159
  Gene Ontology: Mol. function=transcription factor binding; Cellular component=intracellular; Biological process=regulation of transcription, DNA-dependent
  Homolog annotation: Hit_ID=Q40569; Match level="QueryCoverage=81%, HitCoverage=82%, E-value=3e-84, Identity=91%"; Hit description=Ras -related GTP-binding protein
  Pfam annotation: Domain name=Arf; Domain location=18-196; Score= -49.6; E_value=6e-06; Accession=PF00025.11; Description=ADP -ribosylation factor family
  Pfam annotation: Domain name=MMR_HSR1; Domain location=36-151; Score =2.8; E_value=0.00056; Accession=PF01926.13; Description=GTPase of unknown function
  Pfam annotation: Domain name=Miro; Domain location=37-151; Score =94.6; E_value=3.1e-25; Accession=PF08477.3; Description=Miro-like protein
  Pfam annotation: Domain name=Ras; Domain location=37-198; Score =361.9; E_value=1e-105; Accession=PF00071.12; Description=Ras family
  Pfam module annotation: Pfam domain module=Arf::MMR_HSR1::Miro::Ras; Domain location=18-196::36-151::37-151::37-198
MSLKHVIRDTIFISKCIEDHHLLGKGASGKSCDYLFKLLLIGDSGVGKSCLLLRFADDSYIESYISTIGVDFKIRTVEQDGKTIKLQIWDTAGQERFRTITSSYYRGAHGIIIVYDVTDEDSFNNVKQWLSEIDRYASDNVNKLLVGNKSDLTANRVVSYDTAKEFADQIGIPFMETSAKDATNVEDAFMAMSAAIKNRELAF

SEQ ID NO: 179938 - protein, 46 aa, Glycine max
  Coding DNA Sequence Number=SeqID_63160
MAYHSPLNLSPYMAIYRKSHFVQGKLTQASSLLKAEAFSWPRRARC

SEQ ID NO: 179939 - protein, 58 aa, Glycine max
  Coding DNA Sequence Number=SeqID_63161
MGSSRPIPKPQVGLRDTGPLFSEIAYAPYMQKVSVDQAAPPGCPLICTVGGLALFAEG

SEQ ID NO: 179940 - protein, 116 aa, Glycine max
  Coding DNA Sequence Number=SeqID_63162
  Homolog annotation: Hit_ID=Q1PFY7; Match level="QueryCoverage=99%, HitCoverage=23%, E-value=1e-25, Identity=55%"; Hit description=Zinc finger CONSTANS-like protein
  Pfam annotation: Domain name=CCT; Domain location=1-62; Score=37.7; E_ value=4e-08; Accession=PF06203.4; Description=CCT motif
MKKRNERNFSKKIKVFLAYKQPLVIAYFQVQLMMQPNMQYACRKTLADSRPRVRGRFAKNDDFGETNRTTSSNHEEDDEEEVVMKDEDDMVDSSDIFAHISGLNSFKCNYSIQSWI

SEQ ID NO: 179941 - protein, 219 aa, Glycine max
  Coding DNA Sequence Number=SeqID_63163
MEINMKDLSLVEKEEDGLAYDVEKDPDVSSNVELCLMGHFLADKVIRVGPMKERIINIWWPGKGALIREIPRVYLCSSSMTKVLNSSLWSFDNHLLIPKSIKPGNVIDQIPLFYVNFMVRVHSLLVDQFFVKLFDLENNVGHKEWGLDFRVKVKKGEGGSQWLWEEGKDWNSIEINHTRFSRTMNIVTKDLNSERFLVVVPRPARSNEYHQLEIGMVKA

SEQ ID NO: 179942 - protein, 180 aa, Glycine max
  Coding DNA Sequence Number=SeqID_63164
  Homolog annotation: Hit_ID=Q1SDI2; Match level="QueryCoverage=40%, HitCoverage=8%, E-value=4e-07, Identity=50%"; Hit description=RNA -directed DNA polymerase
MALKLDICKAYHRIDQGKILGLTFDDWVEQKGNIQVCYRENLEEKSFHEWGVKGKGIKWMKWEKLISKGGEAWTFEIYMASIWPCLGNKELYFAKHLENSGVDQGGSTRPFPIECFVFTRNGYECNSNSSTGGSHGGRVWKFDFKGLYTVKFAYNLYMEHFVNNEQFTIQGNLESIWSLK

SEQ ID NO: 179943 - protein, 344 aa, Glycine max
  Coding DNA Sequence Number=SeqID_63165
MENTGLWIQKEGHGRKDSLRGLLNDREISEEEDSSKSQLKKLIKRSNSHRAIVVNAIQSQISKVFLKDLFVQRVHGLDNRIPKHVVSVDEKYIHRCLEFIHNTALKAAQFNIPESLRATNMETLSESLNTAKFFGGNACGSGHFVFECPVVTETGRVVISANAGDQWTLGTIMGSKSMINILNSTLLQQFGASHRTDNLNRMNFSDPEGLVCYDFMDSPSDLCISSSYKLEKEKQLVRSHKYGPISVHKRLVSTSSTTSTCSDWLSSTSSNLSQGMIQCTWKQGIPHFVFSADDQKEVYVTKLRKVDSTDNKALDYVYEFHLNKGGQKGREIPDGDLPFVGKMH

SEQ ID NO: 179944 - protein, 103 aa, Glycine max
  Coding DNA Sequence Number=SeqID_63166
  Gene Ontology: Mol. function=protein serine/threonine kinase activity; Cellular component=membrane; Biological process=protein amino acid phosphorylation
  Homolog annotation: Hit_ID=Q1ENV3; Match level="QueryCoverage=87%, HitCoverage=15%, E-value=8e-31, Identity=70%"; Hit description =Protein kinase family protein
MVVAKSQQGTKDKDTQAGNFSLEQIRDATNDFSSANKIGEGGVGPVYKGQLLDGTFITVKQLSSKSRQGNREFINEIGLISCVQHPNLVKLHGYCAEGEQLLL

SEQ ID NO: 179945 - protein, 92 aa, Glycine max
  Coding DNA Sequence Number=SeqID_63167
MAVTVTLTVASLEGRKVEDHSNREDESDSNSLLPVRKGGIARKSDKTYRKRKVQWNDRIGNKLVEVLEYEPSDVSDSEDEDDGGDPCICSIM

SEQ ID NO: 179946 - protein, 286 aa, Glycine max
  Coding DNA Sequence Number=SeqID_63168
  Gene Ontology: Mol. function=phosphoric monoester hydrolase activity; Cellular component=nucleus; Biological process=biological_process
  Homolog annotation: Hit_ID=Q9FK73; Match level="QueryCoverage=57%, HitCoverage=60%, E-value=4e-49, Identity=60%"; Hit description =Arabidopsis thaliana genomic DNA, chromosome 5, P1 clone:MRA19
AFSLPTHNQALNKQLIVDFSTHEGNIPHIITFTAIRPIKKASQFPKLPVENIVHEGPYQNRVLGLVRERIRVIVDDNDPFEVATRFVKVLHELPVNVSARVAVEPVRDEPVPVEPVQDHGGVLLKRRGENDNLVLGGEGLEELVDAGALQDVEIHGLAVDDRPDDEVEALRRRRGVRVDERFVEVEEHRFSDGEQRREERGGGGGGGVVEHEGSANVVEFSVGCCSLFEDFVGGCFFLVGAGAEARDLREEFRDTAADGGQRGGGSRHHIFYGGFPSPATVVVVAE

SEQ ID NO: 179947 - protein, 78 aa, Glycine max
  Coding DNA Sequence Number=SeqID_63169
  Gene Ontology: Mol. function=calcium ion binding; Biological process =response to abscisic acid stimulus
  Homolog annotation: Hit_ID=O23959; Match level="QueryCoverage=100%, HitCoverage=48%, E-value=1e-28, Identity=60%"; Hit description=Ca+2 -binding EF hand protein
MAVEMERESLITEAPNAPVTAQRRVRSDLENSLPKPYHNGIIYPWETYMGLRAIGFNVVASVILAVVINAGLSYPTQP

SEQ ID NO: 179948 - protein, 141 aa, Glycine max
  Coding DNA Sequence Number=SeqID_63170
FMMFGMLNCLDVVEAWRDCWGPGVERNEDKGYVGVRELSEGGQLGMVGVCVICGCGELTSTIARPPPSTTLVPGDMSRGSGDLGDVRRAPGSQPIKEQRPQSKETCVVAGQLLRNGTGMLKGPLVIDYQCCVIDYTEEQAT

SEQ ID NO: 179949 - protein, 132 aa, Glycine max
  Coding DNA Sequence Number=SeqID_63171
  Homolog annotation: Hit_ID=Q852R1; Match level="QueryCoverage=32%, HitCoverage=8%, E-value=4e-11, Identity=76%"; Hit description=Serine palmitoyltransferase
MVIVEGIYNMEGELCKRLEVIAVAIVTVAFPATPLLLARARICIFAAHSREDLIKALQILPREADPYNCSQIQVNVSWREVYSYFAPSLDNIYLIKVQVYDGTGKACFKLVDANVEELLQIPCHDLILLIKR

SEQ ID NO: 179950 - protein, 104 aa, Glycine max
  Coding DNA Sequence Number=SeqID_63172
  Gene Ontology: Mol. function=integrase activity; Biological process =DNA integration
MLRHNKGIFNLGFCSALMISTGCCILSALVQCIAGQKEVLNTPEVVHVYISVKRGGPNVTSNSVLAVVLGKAKELDVSKDIVDRNIKRANEKGQEAYIEKAYEV

SEQ ID NO: 179951 - protein, 151 aa, Glycine max
  Coding DNA Sequence Number=SeqID_63173
MFLVFNDIYRSRQRKKRHLPGEELYQLQNLELIHFIHGVLSLHPQPTLHSGANPSSPCSPPRLSLRTPLTGSPDMALEFPRMVQLGTYLSRGTLSTTPTTVESWWRSLSAHRTQSAAGAPVRTLMTCVSALPQQVHQLRRGGCHNRFTLAA

SEQ ID NO: 179952 - protein, 487 aa, Glycine max
  Coding DNA Sequence Number=SeqID_63174
  Gene Ontology: Mol. function=nucleic acid binding; Cellular component= ribonucleoprotein complex
  Homolog annotation: Hit_ID=O22791; Match level="QueryCoverage=54%, HitCoverage=60%, E-value=2e-74, Identity=54%"; Hit description =Putative RNA-binding protein
  Pfam annotation: Domain name=RRM_1; Domain location=125-195; Score =90.9; E_value=3.9e-24; Accession=PF00076.12; Description=RNA recognition motif. (a.k.a. RRM, R
  Pfam annotation: Domain name=RRM_1; Domain location=8-77; Score=76.4; E_value=8.9e-20; Accession=PF00076.12; Description=RNA recognition motif. (a.k.a. RRM, R
  Pfam module annotation: Pfam domain module=RRM_1::RRM_1; Domain location=125-195::8-77
MDSDQGKLFIGGISWDTTEDKLKEHFGNYGDVLSTSVMREKNTGKPRGFGFVVFADPNILDRVLEDKHVIDGRTGLNCSRGLFMEVDAKKAFSREDQQISVTSRGGNSNSGMNSENGGNIRTKKIFVGGLPPTLTEEKFRLYFESYGHVTDVVVMYDQNTGRPRGFGFISFDTEEAVDRVLHKSFHDLNGKQVEVKRALPKDANPGASGRMMGGAGGGGAGIGGYQGYGASGGSQNAYDGRMDSSRYMQPQSAAGGFPPYGSSAYSAPGYGYGPANNGIGYGAYGSYGSATAGYGGPAGATYGNPNVPNAAYAGGPPGGPRSSWPAQAPSGYGSMGYGNTAAWGAPSGGAGSGGGGPGSATAGQSPGGAAGYGNQGYGYGGYAGYGGSDSSYGNSSAYGTVGGRTGSGPNSNASAPGGTELTSSGGSGNYMGGGYGDANGNSGYGNAAWRSEQTHASGNYGTPQGNGGQVGYGGGYGGAQSRQAQQQ

SEQ ID NO: 179953 - protein, 815 aa, Glycine max
  Coding DNA Sequence Number=SeqID_63175
  Gene Ontology: Mol. function=cyclopropane-fatty-acyl-phospholipid synthase activity; Biological process=lipid biosynthetic process
  Homolog annotation: Hit_ID=Q3L7F1; Match level="QueryCoverage=99%, HitCoverage=99%, E-value=0.0, Identity=67%"; Hit description =Cyclopropane fatty acid synthase
  Pfam annotation: Domain name=Amino_oxidase; Domain location=11-424; Score=-3.4; E_value=6.5e-06; Accession=PF01593.14; Description =Flavin containing amine oxidoreductase
  Pfam annotation: Domain name=CMAS; Domain location=544-802; Score =223.5; E_value=4.7e-64; Accession=PF02353.10; Description =Cyclopropane-fatty-acyl-phospholipid synthase
  Pfam annotation: Domain name=DAO; Domain location=3-426; Score=-33.0; E_value=0.00084; Accession=PF01266.14; Description=FAD dependent oxidoreductase
  Pfam annotation: Domain name=MTS; Domain location=570-689; Score= -67.2; E_value=0.00088; Accession=PF05175.4; Description =Methyltransferase small domain
  Pfam annotation: Domain name=Methyltransf_11; Domain location=589 -688; Score=49.8; E_value=9.1e-12; Accession=PF08241.2; Description =Methyltransferase domain
  Pfam annotation: Domain name=Methyltransf_12; Domain location=589 -686; Score=63.0; E_value=1e-15; Accession=PF08242.2; Description =Methyltransferase domain
  Pfam annotation: Domain name=NodS; Domain location=551-731; Score= -92.3; E_value=0.044; Accession=PF05401.2; Description=Nodulation protein S (NodS)
  Pfam module annotation: Pfam domain module=Amino_oxidase::CMAS::DAO::M TS::Methyltransf_11::Methyltransf_12::NodS; Domain location=11 -424::544-802::3-426::570-689::589-688::589-686::551-731
RMRVAVVGSGISGLASAYLLAKGGVNVVLYEKEDSLGGHAKTVNVDGVDVDLGFMVFNRVTYPNMLDFFENLGVDMESSDMSFSVSLDKGRGCEWGSRNGLSSLFAQKKNVLNPYFWQMIREIVKFKDDVIRQISFNFSGLNIEFELNSKKFKVVMNTNYNYLDMLENNPDIDRNEPLGEFIKSRGVMSFSAFSVLSFCRNHHLLQLFGRPQWLTVRWRSQTYVNKVKQELEREGSQIITNREVHLVSTTSEKGCVVYCNDGSQEMYDGCIMAVHAPDALRLLGDEATYDERRILGAFQYAYSDIFLHRDKNLMPQNPAAWSAWNFLGSNNNKVCLTYWINILQNIKETSQPFLVTLNPDHIPENTLLKWSTGHPVPSVAAFKASLELDHIQGKRKIWFSGAYQGYGFHEDGFKAGMIAAHGILGSCCALQTNPKHMGGTMFTFEGTGKNCGLKSVLRVHDPQFYWKVMTQADLGLADAYINGDFSFVDKDEGLLNLILILIANRDSNASNSKLKKNRGWWTPVFFTSALTSAKFFMDHVSRRNTLTQARRNISRHYDLNKDEDLKDAQKRKISLLIEKARIDKTHEILEIGCGWGSLAIEVVKQTGCKYTGITLSEEQLKLAEQRVKDAGLQDRINFVLCDYRQLPKTYKYDRIISCEMIEAVGHEYMEEFFGCCESVLADNGLLVLQFISIPDERYDEYRRSSDFIKEYIFPGGCLPSLSRITSAMAATSRLCVEHVENIGIHYYQTLRCWRKNFLKRQNEILALGFNEKFIRTWEYYFDYCGAGFKSLTLGNYQVVFSRPGNVPALGDPYKS

SEQ ID NO: 179954 - protein, 70 aa, Glycine max
  Coding DNA Sequence Number=SeqID_63176
MAGNGGDHKAEFVSRTKEAGEDSYNSQNKNKPAMTTTNNAKNNLEMSNQMEREKENMSDLSIIHHKTHSN

SEQ ID NO: 179955 - protein, 314 aa, Glycine max
  Coding DNA Sequence Number=SeqID_63177
  Gene Ontology: Mol. function=transferase activity
  Homolog annotation: Hit_ID=Q1RWU8; Match level="QueryCoverage=87%, HitCoverage=53%, E-value=2e-38, Identity=32%"; Hit description=Di -trans-poly-cis-decaprenylcistransferase
MAACNGITEIVEVIIHFHPHSIEHVSDDEQNILYMAVKHRQKKIYQILKKLKMVRSLAGKIDKESNTVLHYTAEFQGGSQPGFALQLQEELHWFDRIEKRLPYHYTIHKNQYNKTAKQLFVEKHEALLNDAREWIKETAQSCSAVAVLVATVVFAAAYTVPGGTDDNGFPRFLHETIFMVFTIMDIVALVSSLGSVIMFLSILTSPCEMWDFRKSLPRKLNTGFALLFFSMATTMLSFSATILINIKLEKNKWTSSLTYAAAFFPVCIFALVQFPLYVAMKGCVRSMLRNLKKIIPRFLLNLLKKSRRKKLWDI

SEQ ID NO: 179956 - protein, 56 aa, Glycine max
  Coding DNA Sequence Number=SeqID_63178
MLDGVAIHDMIMGMLLTCTVCFATIKAKPHMARECFFCMNNVVAMWGYTDGNGDIT

SEQ ID NO: 179957 - protein, 586 aa, Glycine max
  Coding DNA Sequence Number=SeqID_63179
  Gene Ontology: Mol. function=zinc ion binding
  Homolog annotation: Hit_ID=Q6EUF2; Match level="QueryCoverage=76%, HitCoverage=83%, E-value=1e-165, Identity=61%"; Hit description =LAs17 Binding protein; Lsb3p-like
  Pfam annotation: Domain name=DUF500; Domain location=452-584; Score =181.1; E_value=2.7e-51; Accession=PF04366.3; Description=Family of unknown function (DUF500)
  Pfam annotation: Domain name=FYVE; Domain location=271-339; Score =67.3; E_value=5e-17; Accession=PF01363.12; Description=FYVE zinc finger
  Pfam module annotation: Pfam domain module=DUF500::FYVE; Domain location=452-584::271-339
MGMIFANTVGGTYAGWCGDTWHGHGDAADMHSVFRHYHWRNPHGVPMEGKILDSRNQAQVVENLSARVSSCSLGDKISYSDSPLDDEVVGMRKNSVTKEYCDSFSTDSTEGHCINSSRLYPELPEKQMEKNNEDMESSANLQKRGRYFYYDTPLHEDTGVWIPVSVPPMLEDDHKEWTKGFHSNGGYFPDDDMGWNQYVGDERELTMWDVLAEMLLVARGKVTSLALGDIHTCNFSWISSHVLEQAWREMAQTLTEANFGNVKELLEAEPPKWLADSAAASCMLCGVRFHPIMCSRHHCRFCGGIFCGECSKGRSLLPSKFQVSDPQRVCDVCCVRLDSVQPYLMDHVSNAAQLPTHDLTDLSTLRSWINFPWGQSMEYEIYKATNTIKAYNQIGFLKLEKSIPDAILRQAKGLAIITVVKVGVGVTYNIGTGLVVARREDGSWSPPSAVSTFGVGWGAQAGGELTDFIIVLRTNDAVKTFGGNMHLSLGAGLSAAVGFVGRSVKADVRAGDGGYAACYTYNCSKGAFVGCSLEGSMVTTRTQENSRFYGSQSITATDILFGSLPRPPAAAILYRALADLYSKFDD

SEQ ID NO: 179958 - protein, 240 aa, Glycine max
  Coding DNA Sequence Number=SeqID_63180
  Homolog annotation: Hit_ID=Q8L5W2; Match level="QueryCoverage=44%, HitCoverage=65%, E-value=2e-36, Identity=80%"; Hit description=BZIP transcription factor ATB2
MMFLSLHSNLHSLTLLQQAPENHTPKLLNSHSLDFPYRTPLILFQPPPRAPPQQQSYLRPPSPRHRRPRPRRHYQRPNSLEPRHSCKFIRSVEEAEAEAPQEGQELLRQQMYEEDHTGDSEKVTGGAEESAPLVSQVAQLRKENQQILTSINITMQQYLSVEVENSVLRAQVGELSHRLESLNEIVDVLNATIVAGFGAATTSSTFVEPINNNNNNSFFNPLNMGYLNHPIMTSADILQY

SEQ ID NO: 179959 - protein, 194 aa, Glycine max
  Coding DNA Sequence Number=SeqID_63181
  Gene Ontology: Mol. function=transferase activity
  Homolog annotation: Hit_ID=Q1RWU8; Match level="QueryCoverage=82%, HitCoverage=41%, E-value=7e-13, Identity=26%"; Hit description=Di -trans-poly-cis-decaprenylcistransferase
MNAPIEQDAGNPTYTPLLMVACNAITEIVESITSFHPHSIEHVSEDEQNILNLAVKHRQKEKEYREQSPLNNRQGSNKTAKQLFMEKHEPLFKDARQWIKETSQSCSAVAVLVATVVFAAAYTIPGGANDNGFPIFLDNPIFIVFTVMYVVALCNILAVCIFALVEFPLYVAVKGCVRTILKTLKKIIPRFLLN

SEQ ID NO: 179960 - protein, 338 aa, Glycine max
  Coding DNA Sequence Number=SeqID_63182
  Gene Ontology: Mol. function=transferase activity
  Homolog annotation: Hit_ID=Q1RWV0; Match level="QueryCoverage=62%, HitCoverage=93%, E-value=8e-17, Identity=28%"; Hit description =Ankyrin
  Pfam annotation: Domain name=Ank; Domain location=139-172; Score=6.9; E_value=3.1; Accession=PF00023.20; Description=Ankyrin repeat
  Pfam annotation: Domain name=Ank; Domain location=57-95; Score=14.2; E_value=0.28; Accession=PF00023.20; Description=Ankyrin repeat
  Pfam annotation: Domain name=Ank; Domain location=96-136; Score=9.1; E_value=1.5; Accession=PF00023.20; Description=Ankyrin repeat
  Pfam module annotation: Pfam domain module=Ank::Ank::Ank; Domain location=139-172::57-95::96-136
MRELQIGRKKLEMTRHSVALIEKMKKPYILAKRYEWEEFGRFFNKHKDLLDKQIDLHHSTPLHYAAHCGNPTMYREMIEWVGEGDIKRVLRLQDDMGNTPLHEVAFTGEVEMTKSILEHEEEEGPNQQYEPLLRMRNKLGETAVYRAAALGKTDLLSFFLQDLGADAHRDIHFHRKGDKMSILHTAVIDQFFGTALWILERYEHLAYEKEDNELTTLQLLAKMPSTFKSQTQMGPLKNFIYLLLPNFQDYKYYNQNKEYTTKKEDLESGREDKNEPSPTQMKLEDNTREGQILKSGGKARRNEPPTTQRKLSDAGNRKVLNARRKWVISMDERPIRKN

SEQ ID NO: 179961 - protein, 118 aa, Glycine max
  Coding DNA Sequence Number=SeqID_63183
  Gene Ontology: Cellular component=intracellular; Biological process =signal transduction
  Homolog annotation: Hit_ID=O82458; Match level="QueryCoverage=65%, HitCoverage=18%, E-value=4e-28, Identity=78%"; Hit description=Rac GTPase activating protein 1
  Pfam annotation: Domain name=RhoGAP; Domain location=1-84; Score= -39.7; E_value=0.0054; Accession=PF00620.17; Description=RhoGAP domain
MALMCTTWQAWFRELPTGVLDPLSSEEECAQLVRLLPPTEAALLDWAINLMADVAQMENLNNMNARNIAMVFAPNMTQLKLVDDDSTYMVICGKLVYCTVPSKIWHNIQRRLITINSL

SEQ ID NO: 179962 - protein, 60 aa, Glycine max
  Coding DNA Sequence Number=SeqID_63184
MEETLSLSLIHANKSLVSDPSFFIFLLIPLSALTKHLVEVLSTGGTFKKWIIEQRICMIT

SEQ ID NO: 179963 - protein, 105 aa, Glycine max
  Coding DNA Sequence Number=SeqID_63185
  Subcellular localization annotation: CTP_CleavageSite=86; ConfidenceScore=5.03e-01
MEHATRGTARRTRQQQGSASNEGASGSALPLGATGAWVVPASGALQVASALGALPVAPSGRALPDVPASGALPCCCLVRRAVPRVACSMEAPSWGALCNKKIDPP

SEQ ID NO: 179964 - protein, 998 aa, Glycine max
  Coding DNA Sequence Number=SeqID_63186
  Homolog annotation: Hit_ID=Q7XDI4; Match level="QueryCoverage=91%, HitCoverage=91%, E-value=0.0, Identity=45%"; Hit description =Expressed protein
  Pfam annotation: Domain name=DUF810; Domain location=45-998; Score =1569.1; E_value=0; Accession=PF05664.2; Description=Protein of unknown function (DUF810)
  Subcellular localization annotation: CTP_CleavageSite=38; ConfidenceScore=5.09e-01
MGHHTRRESYPSATSSRLDYNLHSQRPLDYAAGSRGPSGSSTASTPTMSSPGFGGHHALTFYSNHENGGEGGKQNQVVTKPTSRVKKMLGLKMLKRSPSRRLATSAGSSTPSSPVGAPGSPLSRTVPPFRPRRPMTAAEIMRQQMRVTEHDDNRLRKTLLRTHVGQMGRRAETIILPLELIRHLKPSEFSDSHEYHMWQKRQLKVLEAGLLLYPSIPLEQTNTFAMRLRDIVNSGESKPIDTGKNADIMRTLCNSVVSLSWRSHNGIPTDVCHWADGFPFNIHLYTSLLQSIFDVRDETLVLDEVDELLELIKKTWSTLGITLPIHNVCFTWVLFKQYVSTGQIEPDLLCASHAMLNEVAIDAMREKESLYFKMLSSVLNSIQGWAEKRLLNYHDYFQRGNAGQIENLLPVVLTASKILGEDLTLTGGERGEKGGITVVDSSSDRIDSYIRSSMKNAFDKVLEAANAKSAEFERKKELSEVLLQLAQETEALVMKERHHFSPILKKWHSIAGAVAAMVLHTCFGKMLKQYVRELTSLTTESVQVLQKAGKLEKVIVQMMVEDSSECEDGGKTLIREMVPYDVDSVILSLLGKWIDESLHKGKECLQRAKETETWNPKSKSELHAQSAAELMKLAATTVEEFFQVPIAITEDLVQDLADGLENLFQDYMKFVASCGSKQSYIPMLPPLTRCNSDSRFTKLWKRAAPCNAGFDAHIQHINGRHEGHNPRPSTSRGTQRLYVRLNTLHYLVTQIHSLEKTLSMNSGVVPSNRLRFASNRKSCCSYFETVNLSILGACQHVSEVAAYRLTFHDSSSVLYDSLYVGGVGRGEIRAALRILKQNLTLMTTILTDRAQPLAMKEVMKASYDAFLMVLLAGGSSRVFHRYDHEIIREDFENLKIVFSNSVEGLIAENVVNGEAAVVEGVIALMGQSSEQLMEDFSIMSCESSGIGLMSNGYKLPMPPTTGKWNRSDPNTILRVLCYRKDRAANLFLKRTFQLAKRR

SEQ ID NO: 179965 - protein, 379 aa, Glycine max
  Coding DNA Sequence Number=SeqID_63187
  Gene Ontology: Cellular component=integral to membrane
  Homolog annotation: Hit_ID=UPI0000162E4C; Match level="QueryCoverage =96%, HitCoverage=89%, E-value=7e-80, Identity=41%"; Hit description =auxin:hydrogen symporter
  Pfam annotation: Domain name=Mem_trans; Domain location=9-377; Score =178.0; E_value=2.3e-50; Accession=PF03547.8; Description=Membrane transport protein
  Subcellular localization annotation: CTP_CleavageSite=36; ConfidenceScore=5.02e-01
MQLWKLFITALMPVLKLLLLTAVGAFLALHRFNILRKSARKHLNVIVYFVFTPALAFSILTKTITFRSLIMVWFMPLNVLLTYIIGAALGWLFLKITKEPSDMQGLVLGCCAADLMQTGNQSVRKAGSPFGAVDVCNKKGMAYASLSLAIGNIYLWTFAYNIIRIYSGKIFNVNKVDDSTVGPVSAIETDLESHSTVPVVTAEDISENNDRTTHFGSEFTLPGEKARASLRTLVDKLNLKVILSPATIGSILGLIVGVVPPFQKMFVGDNAPLSVVEDSASMLGDSSIPAMTLLLGANLLNGLKRSGMKFSLLVGIIVIRYIALPILGVVIVKGAIHFGIIHHDPLYQFVLMLQYALPPATSIRCLTVKEQHVMGYRLF

SEQ ID NO: 179966 - protein, 165 aa, Glycine max
  Coding DNA Sequence Number=SeqID_63188
MKVLNFILALNLLLAVVHVQPNQAGRVLSMKEQLSLMSLDDKGPVTPSGPSTCTYIPGTGGTNCPPVKEMNMAGNAQHHSHETYPRLPNLAGRVLNMKEQLNLMSLDKGPVTPSGPSTCTYIPRTGGRNCPPVEEMNNVAGNAQHHGGETYPRLVVPFGVATNQH

SEQ ID NO: 179967 - protein, 58 aa, Glycine max
  Coding DNA Sequence Number=SeqID_63189
  Subcellular localization annotation: CTP_CleavageSite=31; ConfidenceScore=5.22e-01
MTTTTTTRVAQRESFWGVSSLNKTRESTQTRSSLRKIGRVYSGFDSTSDLTRQPSVES

SEQ ID NO: 179968 - protein, 72 aa, Glycine max
  Coding DNA Sequence Number=SeqID_63190
  Gene Ontology: Mol. function=alpha-amylase activity; Cellular component=cellular_component; Biological process=carbohydrate metabolic process
  Homolog annotation: Hit_ID=Q1RYE2; Match level="QueryCoverage=64%, HitCoverage=11%, E-value=8e-18, Identity=82%"; Hit description=Alpha amylase, catalytic region; Alpha-amylase beta-sheet, C- terminal
MDEFLTSLCFLFLCIFLFPSFSSSAILFQGFNWASSEKAGEWYNFMKTLVPDIADSGVDYVWLPPPSNSHDR

SEQ ID NO: 179969 - protein, 158 aa, Glycine max
  Coding DNA Sequence Number=SeqID_63191
  Gene Ontology: Mol. function=oxidoreductase activity; Biological process=metabolic process
  Homolog annotation: Hit_ID=Q1RYD8; Match level="QueryCoverage=99%, HitCoverage=100%, E-value=1e-50, Identity=66%"; Hit description =Sterol-binding
  Pfam annotation: Domain name=SCP2; Domain location=10-104; Score =24.7; E_value=5.2e-05; Accession=PF02036.7; Description=SCP-2 sterol transfer family
MADSSSNLKSDAIMEQMKQHLATDSGKQVTKKIGLVYQIQIAPKKLGIDEVVYTVDLRKGEVTKGPYEGGKPDASFSFKDEDFVKVALGKMNPQIAFMRFDLSMDFFLPKFFLLLCLCIRVLVSDVVVNGCRGAMKIKGSLSAAQKFTPDIFPKPSKL

SEQ ID NO: 179970 - protein, 520 aa, Glycine max
  Coding DNA Sequence Number=SeqID_63192
  Gene Ontology: Mol. function=monooxygenase activity; Cellular component=membrane; Biological process=electron transport
  Homolog annotation: Hit_ID=Q1RYD7; Match level="QueryCoverage=98%, HitCoverage=98%, E-value=0.0, Identity=73%"; Hit description=E-class P450, group I
  Pfam annotation: Domain name=p450; Domain location=38-502; Score =109.4; E_value=1e-29; Accession=PF00067.12; Description=Cytochrome P450
MDGIFAYIILILVTIFSFMFLPKPNRRRPQNQTLAKLPPGSMGWPYIGETLQLYSQDPNAYFSTKHKRLFNVYYATSTPLMYGEIFKTNILGCPCVMLTSPEAARFVLVTQAHLFRPTYPKSKERLIGPFALFFHQGEYHTRLRKLVQRSLSLEALRNLVPHIETLALSAMNSWGGDGQVINTFKEMKRCDSDSNSATEHHTGHIAEATNRPRRFSFEVGILTVFGHLEPRLREELKKNYRIVDNGYNSFPTCIPGTQYQKALLARRRLGKIICDIICERKEKKLLERDLLSCLLNWKGEGGEVLSDDQIADNIIGVLFAAQDTTASAMTWVVKYLHDEPKLLESVKAEQKAIHKSNEGNLPLSWDQTRNMRITHKVVLESLRMASIISFPFREAIADVEYKGFLIPKGWKAMPLFRNIHHNPEFFPEPQKFNPLRFEVAPKPNTFMPFGSGVHACPGNELAKLETLIMIHHLVTKFRWEVVGSKCGIQYGPFPLPLNGLPARCWRESYQLEKAAREENA

SEQ ID NO: 179971 - protein, 49 aa, Glycine max
  Coding DNA Sequence Number=SeqID_63193
MRCRRTWNQRAEVCQKGHNLSPEILERERPSERNKEKVEQQQGAKVVSC

SEQ ID NO: 179972 - protein, 76 aa, Glycine max
  Coding DNA Sequence Number=SeqID_63194
  Gene Ontology: Mol. function=oxidoreductase activity; Biological process=metabolic process
  Homolog annotation: Hit_ID=Q0Z2V9; Match level="QueryCoverage=96%, HitCoverage=15%, E-value=2e-17, Identity=65%"; Hit description =Aldehyde dehydrogenase
MLLLRAFLDAGVPSGAISLLYGQPAQISERLIASPIIRKVSFTGSVPVGAAAGHAGRAPSQAVHDGTGRPCAGARL

SEQ ID NO: 179973 - protein, 331 aa, Glycine max
  Coding DNA Sequence Number=SeqID_63195
  Gene Ontology: Mol. function=oxidoreductase activity; Cellular component=mitochondrion; Biological process=metabolic process
  Homolog annotation: Hit_ID=Q7WFF4; Match level="QueryCoverage=61%, HitCoverage=42%, E-value=1e-64, Identity=62%"; Hit description =Putative aldehyde dehydrogenase
MPPVITAADAMLGDDAEFQRGATVRALAVHDANVAALVAKRHQVLAHDADGLGHVRQFLRQAHRLPMAAHVFAHRRAGIAAGQFQVRAGPVALLVAGEPQRMLVAGRGHGTRGLCHVLSPDDGNGSNTQIRLADEADLLVCVQAFRPAFVAQSAVLDAADRRVRQRGREVVDADPGGIDALGKGGGALQVVGERIGRQAILDGIGPGDGVVEGAERQDRRHRAERFVVQDAGRGRYVGQHGRREEVALARQAGPAQPDVGATPQRVLDQADRGGQAPRVVQRPHPHAGGQSVAHVELAGVVHEVRDESLVETVLHEEADGQTGTPGRCSGT

SEQ ID NO: 179974 - protein, 220 aa, Glycine max
  Coding DNA Sequence Number=SeqID_63196
  Gene Ontology: Cellular component=mitochondrion
MTKAPFFDIKNPIINLTEKANNYMMSIGFRFMPGQGEFLIKDLRAPDTLVGLRKLKDSLGLSLTKGSLNSNPLLKLKGISDSVSNSMESLASRVLVEVITFNEGYYGRFLILVQMGIGCTVWYGFVPGDGINMPIEGLNTLFSPIENYDTIFTNPDAHVIPGFNKMTLIEGVNNPAAPLSQAFAQDRPFMDMDIEIPDSNKSIIIGVSLGLAVPSYLHLD

SEQ ID NO: 179975 - protein, 41 aa, Glycine max
  Coding DNA Sequence Number=SeqID_63197
MLVATVYRRLSLEVHKGAVALSEPFGLSVHPTLSATSARLA

SEQ ID NO: 179976 - protein, 178 aa, Glycine max
  Coding DNA Sequence Number=SeqID_63198
TNVVFCTLCQSRSEPVDTQRLTSSSTPFVNRDPEHDSMQRLTSSSAPFVNHGGNTRVVIRINIILLSIRPEHDTMQRLTSSSAPFVNRGGNTQVVIRINILLLSIRPRARQHAKTNVVFCTLCQLRSEPVDTRRFTSSSVLSITLTLKLGGKRKYPSGYPYKHSFAIHQTQSTIACRD

SEQ ID NO: 179977 - protein, 121 aa, Glycine max
  Coding DNA Sequence Number=SeqID_63199
NCSSGLIPEEHFFRKLLPEIPNVFRKNPSSGKFPEEGFFRKTFGFFRKNTSSGKFPEQVLPEALPSALFPIFSGTSCSRLLPYGSANLSNGVQAKEAVAGLAVEEKARGRGKKRKKSRSKK

SEQ ID NO: 179978 - protein, 44 aa, Glycine max
  Coding DNA Sequence Number=SeqID_63200
MSRVYVGNLDSGVTERDVKDEFRVFGVIRRYYVPGSLVKVQIHF

SEQ ID NO: 179979 - protein, 269 aa, Glycine max
  Coding DNA Sequence Number=SeqID_63201
  Gene Ontology: Mol. function=transferase activity, transferring hexosyl groups; Cellular component=soluble fraction; Biological process=carbohydrate biosynthetic process
  Homolog annotation: Hit_ID=Q1RYE8; Match level="QueryCoverage=99%, HitCoverage=44%, E-value=1e-131, Identity=79%"; Hit description =Glycosyl transferase, family 8
  Pfam annotation: Domain name=Glyco_transf_8; Domain location=1-188; Score=114.4; E_value=3.3e-31; Accession=PF01501.10; Description =Glycosyl transferase family 8
GTKRDLVLLLDSSISVAKRRALELSGWKIRLITRIRNPRAENGTYNEYNYSKFRLWQLTDYERVIFIDADIIVLRNLDILFHFPQMSATGNDQSIFNSGIMVLEPSNCTFEILMSRRHDVVSYNGGDQGFLNEIFVWWHRLPRRVNYLKNFWANTTIEAGRKNAMFAAEPPKLYAIHYLGLKPWHCYKDYDCNWDVQDQRVYASDVAHRRWWKVHDAMDENLQKLCRLTRQRRMELNWERRKAGKLGLPDMHWKINVTDPRRAGSMLIG

SEQ ID NO: 179980 - protein, 362 aa, Glycine max
  Coding DNA Sequence Number=SeqID_63202
  Gene Ontology: Mol. function=DNA binding; Cellular component=proton -transporting two-sector ATPase complex; Biological process=DNA integration
  Pfam annotation: Domain name=rve; Domain location=88-273; Score=42.3; E_value=1.6e-09; Accession=PF00665.16; Description=Integrase core domain
MATVNSETCNEEWWYLDTGCSNHTTGHKYWFCEIDETVKRSIKFGDGRSVMAKGIGKVAIRIVDGSKVTISDVLYVPNMESNLLSLGQLLEKGFLMHMEGEHMEVVDSNGKCVLKVVVSKNRTFKVGVSTIEQKCLTGQSNDSVWKWHRRLGHLNFNSLNKLQKKNMVVGLPSIEVPRQMLRTDGEGEYTSLEFENFCKEEGIIHEVMAPYTPQHNGTAKRRNRTMLNMVRCMLREKHLPHDFWAEAVSTGAHILNRCPTKRLDSLPLEEAWSGLKPSVKHFKVFGSLCYRHVPEHNKKKTGLKGSNHDLGRSLRQMSPPVRFQDYDVFPDAAININGELMNLVLLAEAELVSLEETLASPH

SEQ ID NO: 179981 - protein, 68 aa, Glycine max
  Coding DNA Sequence Number=SeqID_63203
MSPDNANSKLVVTCASYEFALLAVSLKLVSPGSLFEDAAGDDVELRRHHRASNYQLGPQSRSLQTRRM

SEQ ID NO: 179982 - protein, 276 aa, Glycine max
  Coding DNA Sequence Number=SeqID_63204
  Gene Ontology: Mol. function=transferase activity, transferring hexosyl groups; Biological process=carbohydrate biosynthetic process
  Homolog annotation: Hit_ID=Q1RYE8; Match level="QueryCoverage=99%, HitCoverage=46%, E-value=1e-128, Identity=79%"; Hit description =Glycosyl transferase, family 8
MDVLSLQKLVKTAPSKALIIRINLVCLAIFLVVYATLLLRPSSSVYFENAASLVRCSLSECHHKGEKSTTMKAVLEEPQLKSRRAKQNATKIEVPSFFGEMGKGMKIGMVNMQEDDVSEWSTFGETSQVYFERVSHFFNWTDLFPEWIDEEEETDVPSCPEIPMPEFAAYEGMDVIVAKLPCKYPEEGWGRDVLRLQVHLIVANLAVKKGKRDWNWKTKVVLWSKCRPMLELFRCNDLVKQENEWWYYEVDVKRLEQKVSLPVGSCNLALPLWEQG

SEQ ID NO: 179983 - protein, 53 aa, Glycine max
  Coding DNA Sequence Number=SeqID_63205
TAFSSLCSLVCYAEHWPFPQKGRTRFPCGTVKMVGAFVVVVYNKVMDFAGGAF

SEQ ID NO: 179984 - protein, 368 aa, Glycine max
  Coding DNA Sequence Number=SeqID_63206
  Gene Ontology: Mol. function=protein binding
  Homolog annotation: Hit_ID=Q9FMZ0; Match level="QueryCoverage=81%, HitCoverage=99%, E-value=1e-17, Identity=27%"; Hit description =Arabidopsis thaliana genomic DNA, chromosome 5, P1 clone:MJB21
MSFDNDSLSFLFFLIFLIPLSPSKGLFDIHTRNITKLFPLAITKRKDYTPRISDIASNLVILQGNLTVMETHHQHQKNTENDVPKQQNQIEEAVNRELDQTSSSPSSPSQEFSFTISLHHSTFPSDNSKAPPNSSSLALDLSPADDIFFHGHLLPLQLLSHLPSSPPRSSTNSMDSFTLPIRELLEDESHSIKDSSGSSRSSTSDSNNSSKRDQDNNNNNIGKKVQGKSKFAFSLFGLTKGHKGYQDKEDKVKHKKKVRFDVIHAIKKYLRMVQPRMLFKGQREKIRPRGQCYSYSGNVTPRNYKQGWRGQYSAPASMTTSPTNSGLLIATTPLPPASDSTMEELQAAIQAAIAHCKNSIAKEEKLKC

SEQ ID NO: 179985 - protein, 125 aa, Glycine max
  Coding DNA Sequence Number=SeqID_63207
MGSSRCGVSTENNGGLWWLMVAVGDGERAWNVGNGFGRKKGEEMAFFQSYLNYKAQNAQVSNALRNGNVAHTTNIFSKIPTLHTKFREDPMVNEGWEAFLLRQLHVASLRSFIKRLPQEASSWLL

SEQ ID NO: 179986 - protein, 820 aa, Glycine max
  Coding DNA Sequence Number=SeqID_63208
  Gene Ontology: Mol. function=two-component response regulator activity; Cellular component=membrane; Biological process=two -component signal transduction system (phosphorelay)
  Homolog annotation: Hit_ID=Q0PHI2; Match level="QueryCoverage=99%, HitCoverage=100%, E-value=0.0, Identity=64%"; Hit description =Ethylene receptor
  Pfam annotation: Domain name=GAF; Domain location=182-331; Score =41.5; E_value=2.8e-09; Accession=PF01590.16; Description=GAF domain
  Pfam annotation: Domain name=HATPase_c; Domain location=479-581; Score=12.7; E_value=0.0035; Accession=PF02518.16; Description =Histidine kinase-, DNA gyrase B-, and HSP90-like ATPase
  Pfam annotation: Domain name=HisKA; Domain location=367-432; Score =39.2; E_value=1.4e-08; Accession=PF00512.15; Description=His Kinase A (phosphoacceptor) domain
  Pfam annotation: Domain name=Response_reg; Domain location=694-810; Score=89.6; E_value=9.7e-24; Accession=PF00072.14; Description =Response regulator receiver domain
  Pfam module annotation: Pfam domain module=GAF::HATPase _c::HisKA::Response_reg; Domain location=182-331::479-581::367 -432::694-810
MLKAVASGLVITSILICVSANDNGFPRCNCDDEASLWTIESILECQRVGDFLIAVAYFSIPIELLYFISCSNVPFKWVLIQFIAFIVLCGLTHLLNGWTYGPHTFQLMVALTVSKILTALVSCATAITLITLIPLLLKVKVREFMLKKKTWDLGREVDHIMRQKEAAMHVRMLTQEIRKSLDRHTILYTTLVELSKTLGLQNCAVWMPNVDKTEMNLTHELNGRNFNLTIRITDPDVVRIKGSDGVNILSSDSALAVGSRGVSGEAGPVAAIRMPMLRVCNFKGGTPELRQACYAILVLILPSGDNQEPRSWSNQELEIIKVVADQVAVALSHAAILEESQLMREKLEEQNRALQQAKRNALMASQARNAFQKVMSDGMRRPMHSILGLLSMIQDDKLKSEQKLIVDAMLRTSNVLSNLINDAMDNSTKDEGRFPLEIRSFGLHSMLKEAACLSKCMCVYKGFGFMVEVEKCLPDNVMGDERRVFQVILHMVGNLLEHNHGGGILVYRVFAETGSQGRSDKGWTTWRPSSSSGDVNIRFEIGINSSDSEVGSSISSGFGGRKYSSDRVGGRLSFSICKRVVQTLVEGGYYAVLQYSAKFSFCQPLDDSPGWLFIHIFHSLFSLFIFSSLKCFRRSSGRLELMQGNIWLVPCNHGFPQSMTLLLRFQLRPSISIAISDPGEGSERTDSNSMLRNLQVLLVENDDVNRAVTQRLLQKLGCVVTPVASGFECLTVIGPAGCSIQVILLDLHMPDLDGFEVATRIRKFRSGNQPMIVALTASAEEDLWERCMQVGINGVIRKPVLLHGIASELRRILMQGNNVL

SEQ ID NO: 179987 - protein, 169 aa, Glycine max
  Coding DNA Sequence Number=SeqID_63209
NGSIAICRIDAMTLRSLLCISYVIEKSLKRHKQFDFPLNLLHKIKARIAFVDFGSPYISAIMLLPKDASGGLICDSLGNPRATFHLNLSLCYRLKMRIHVSWELNLHHVIFEMDSLAVVHIVPRGSFISALLKPLFKVIRESLSFILVSSLVDGRQVVVTVAGLVVNGR

SEQ ID NO: 179988 - protein, 117 aa, Glycine max
  Coding DNA Sequence Number=SeqID_63210
  Homolog annotation: Hit_ID=Q1RW99; Match level="QueryCoverage=38%, HitCoverage=5%, E-value=6e-08, Identity=53%"; Hit description=RNA -directed DNA polymerase
MGKCENGRLYLKQWPIRGERRCSRSLGGGGGVVMSHQVDEFVNKVSPSSKKAPRDNQRIVESVNYQLRVYFQPKVMPTPLVSPFNGSNIATNNSAKRVFHGVSHITLLEAASRQCKG

SEQ ID NO: 179989 - protein, 149 aa, Glycine max
  Coding DNA Sequence Number=SeqID_63211
  Gene Ontology: Cellular component=mitochondrion
  Homolog annotation: Hit_ID=Q9SIV6; Match level="QueryCoverage=57%, HitCoverage=37%, E-value=3e-29, Identity=76%"; Hit description =Expressed protein
  Pfam annotation: Domain name=DUF1640; Domain location=29-146; Score= -7.3; E_value=0.00015; Accession=PF07798.2; Description=Protein of unknown function (DUF1640)
  Subcellular localization annotation: CTP_CleavageSite=51; ConfidenceScore=5.58e-01
MAAIRRRVWQLSSIAGFGASRSEVSSSLSSSQRAIFDPFSVSGTRHFSQVVKSNRKHLFLVDTLALVRRLEGEGVPSKQAEAITAAITEVLNDSLENVSQSLVSKAQMQKIEMMQESNLSKFKAEVQSSQGLILVVNMLGLNERFACCL

SEQ ID NO: 179990 - protein, 63 aa, Glycine max
  Coding DNA Sequence Number=SeqID_63212
MVKYRVNEFPIASHFPGTATGHRQSSSDLSGRQTHHQEHPQTIYQMSSMAPPSDTRRALTRIS

SEQ ID NO: 179991 - protein, 93 aa, Glycine max
  Coding DNA Sequence Number=SeqID_63213
  Homolog annotation: Hit_ID=Q9I747; Match level="QueryCoverage=98%, HitCoverage=56%, E-value=7e-17, Identity=46%"; Hit description =Protein hcp1
  Pfam annotation: Domain name=DUF796; Domain location=4-93; Score =43.9; E_value=5.6e-10; Accession=PF05638.2; Description=Protein of unknown function (DUF796)
MAIDMFLKVDGVTGESKDSNHTGWTDITSFTWGASQPGNMAVGGGGGAGKVNFADLSVDALIDKSTTAILKYCSSGKHLSKVELSICKAGGQQ

SEQ ID NO: 179992 - protein, 500 aa, Glycine max
  Coding DNA Sequence Number=SeqID_63214
  Gene Ontology: Mol. function=hexokinase activity; Biological process =glycolysis
  Homolog annotation: Hit_ID=UPI00005F72E3; Match level="QueryCoverage =99%, HitCoverage=99%, E-value=0.0, Identity=79%"; Hit description =COG3517: Uncharacterized protein conserved in bacteria
  Pfam annotation: Domain name=DUF877; Domain location=23-494; Score =1176.4; E_value=0; Accession=PF05943.2; Description=Protein of unknown function (DUF877)
MSNSPQQQNALQTTETFSSDEFSALLNKEFRPKTDQAKEAVENAVKTLAQQALENTVTVSSDAYRTIQALIAEIDEKLSQQINQIIHHDDFQKLEGAWHGLHYLVNNSETDEMLKIRFMSISKQELGRTLKRYKGVGWDQSPIFKKVYEEEYGQFGGEPFGCLVGDYYFDHSPQDVELLGEMARISAAAHCPFITGTAPTVMQMESWQELANPRDLTKIFQNTEYAAWRSLRESEDARYLGLVMPRFLARLPYGIRTNPVDSFDFEEQTDGSNHNGYNWSNAAYAMAANINRSFKEYGWCTAIRGVESGGAVENLPCHTFPSDDGGVDMKCPTEIAISDRREAELAKNGFMPLVHRKNSDFAAFIGAQSLQKPAEYHDADATANARLAARLPYLFACCRFAHYLKCIVRDKIGSFRERDEMERWLNDWVMSYVDGDPANSSQETKSRKPLAAAEVSVEEQEDNPGYYAAKFFLRPHYQLEGLTVSLRLVSKLPSLKSNEN

SEQ ID NO: 179993 - protein, 71 aa, Glycine max
  Coding DNA Sequence Number=SeqID_63215
MGLECVSPEQMAVWASQRVAVVNGGIVPSQHLSRHCRWRNTYVVNSVGGSTMETDPLRELSEKGPLYVNSL

SEQ ID NO: 179994 - protein, 127 aa, Glycine max
  Coding DNA Sequence Number=SeqID_63216
  Subcellular localization annotation: CTP_CleavageSite=21; ConfidenceScore=5.24e-01
MKSQSSHRTVSHFGYVFKTPSSVYAPGRPRFVLKLFAKGVCYGHGCRQKNWREACSAICNGEIGVELAWMPQVGMARYVHVGNTIAAGENPATREQVSPILLARQVLLARTLHECSVAGGRFQCCRG

SEQ ID NO: 179995 - protein, 71 aa, Glycine max
  Coding DNA Sequence Number=SeqID_63217
MDSPTIGSCETKARAQGSCETKVHQLGHMALARPRALAMTLSTCKNLTLKRVSNSVKEEESSVKRGRKSFV

SEQ ID NO: 179996 - protein, 117 aa, Glycine max
  Coding DNA Sequence Number=SeqID_63218
MSFLNSHHISVQVALSFYVVCVSFGVSHYYLFFLFIHTVAIYPSAEGRCGAHGCVFQGRRTHGVATNVYWRKVSEKLERCGLRTLIVKGSGVFFTHEEGCFPRSYVFLNCDEEIRPT

SEQ ID NO: 179997 - protein, 45 aa, Glycine max
  Coding DNA Sequence Number=SeqID_63219
MEGPSHGLGGVKVVGGKGDGKLEELERGWLLWGHECYGGVGLARG

SEQ ID NO: 179998 - protein, 343 aa, Glycine max
  Coding DNA Sequence Number=SeqID_63220
  Gene Ontology: Mol. function=oxidoreductase activity; Cellular component=cytoplasm; Biological process=flavonoid biosynthetic process
  Homolog annotation: Hit_ID=Q9SB32; Match level="QueryCoverage=95%, HitCoverage=92%, E-value=3e-89, Identity=49%"; Hit description=SRG1 -like protein
  Pfam annotation: Domain name=2OG-FeII_Oxy; Domain location=186-286; Score=161.2; E_value=2.7e-45; Accession=PF03171.10; Description=2OG -Fe(II) oxygenase superfamily
KGGTNQCKVPERYVRPDIDPPIISNKDSLPQLPFIDLNKLLAEEVKGPELEKLDLACKEWGFFQLINHATSIELVEDVKKGAQELFNLSMEEKKKLWQKPGDMEGFGQMIDKPKEEPSDWVDGFYLLTLPSYSRKPHLFPNLPLPFRENLEVYCKDMRNLANNMYVLIGKALGTEPNEIKESLGESGQAIRINYYPPCPQPENVLGLNAHTDASSLTILLQGNEVEGLQIKKDGTWVPVKPIPNAFIVSLGDVLEVVTNGIYKSSEHRAVVNSQKERLSIATFSGPEWSASIGPTPSVVTPERLALFKTIGVADFYKGYLSPQHCGKSYINNVLRIQKENIKG

SEQ ID NO: 179999 - protein, 32 aa, Glycine max
  Coding DNA Sequence Number=SeqID_63221
MAASKSQVLILYANPGQLLAIMGPSGYFSRVA

SEQ ID NO: 180000 - protein, 97 aa, Glycine max
  Coding DNA Sequence Number=SeqID_63222
MSKRLKEDWARAAEEGPKVLMNLRTHLLLEVASPFIFLLLHSAAIKIQEAKDSIDEEDPWPTSSKGATSRLMTEATSTQRQCVNVVMDSFASSQGNK

SEQ ID NO: 180001 - protein, 200 aa, Glycine max
  Coding DNA Sequence Number=SeqID_63223
MYGRFYKIKYEGLHLLCLTCGKFVTIMRVVQIEGKMTLGMERRKMHNLIQRKGTLLNNPLLKDLGQFLKSQGELGNLLKRKKMSQLMGTSVTWGVGIIPYKTMRKQLLRKSMKEKNELMMNNEKILRKVVVEGIMVITLGNNEKQKMPKEIAQLVNNTNKEEGGTPMEITHEFPTEVPMHEAQCLDENSKVPQHAPRPPV

SEQ ID NO: 180002 - protein, 110 aa, Glycine max
  Coding DNA Sequence Number=SeqID_63224
MSVVIILNMPRRMLEQIRITKNRFPNSIPLLEKACWESIGSFNGDFQSWSYSGRQRRRGERRRHPLGNKPWKEKLHHQESALDKKLREEGSMEEENERERERERESGMEN

SEQ ID NO: 180003 - protein, 95 aa, Glycine max
  Coding DNA Sequence Number=SeqID_63225
  Gene Ontology: Mol. function=catalytic activity; Biological process =metabolic process
MNAKRRENMVGVLPKRKILMRYGESQGNWDTTAYTIIPDCDIQSTVQGMAQFLRAGEHLHRVIGSDGCFPDWRVQFYMSPTPAPDRRSVSSDGVS

SEQ ID NO: 180004 - protein, 426 aa, Glycine max
  Coding DNA Sequence Number=SeqID_63226
  Gene Ontology: Biological process=electron transport
  Homolog annotation: Hit_ID=Q8TPZ1; Match level="QueryCoverage=64%, HitCoverage=5%, E-value=8e-09, Identity=23%"; Hit description=Cell surface protein
MTQLLVFLVLVVLVATFSSFVSAYHLLSKPLLRDDGRIYVCSHDNFFAFESNGTIAWIMHLDYKCNLGTAPVHGGHGKIYLVADNRILVISYGNIGTSEPEAEVFFGPGPGHVAEAEIIGLSVSTLGSTIYINVKNRGLFAYQSRGHLLWSVEPVLYQFGYRQGCRKNLTNCYFASVPLLDHCEGSIYISNTEGELYCLSVRSRYFRWIQDFSSLDKNFTITLGNNGHLYVTVPAKALVLALDVFSGNVLWQRSIGPLSKVDSAPVVDSNGWISIGSLDGFLYSFSPTGVLKKFSRMNAENSIIQVGPFLDCSGFAIYSSQIEMEGKISHTIGEYTVVSAIQPKAALFTMLVPATGSIYWSESYPGHVSTLFSKSDLSQFVMNEEILLAFLAASRLLLLNQKMRSWTLSSGLSKNVDHSFKEVQVG

SEQ ID NO: 180005 - protein, 115 aa, Glycine max
  Coding DNA Sequence Number=SeqID_63227
  Subcellular localization annotation: CTP_CleavageSite=64; ConfidenceScore=5.19e-01
MENRNDTFPPTLRFDCGNFVDVVGDFTIAFQMSMPPFKVQGNSTNVVSNITLPSSAPNGRYKTTVSTKGKEIINDSTAIGLKSRMCYLVVMGDVGAYIVVEDFHNAIWKMKEYDM

SEQ ID NO: 180006 - protein, 543 aa, Glycine max
  Coding DNA Sequence Number=SeqID_63228
MGYELQVLDCRSCYSGVTTLAISTKLSREDALFILQAKPDVPCGSSSHSLLLHRCHLRSGHVLETQYVGEEVILGVFISDSLTEETRHETFDSGSSSFERLLDLCHINEGSSWACERVLPSSVALEEEPILVTTILPSSPLVATERGDCGIVRVSAWSRRSHSTRTALAEVGQPKRLLQNNSPGLRGLGSNSPSKLLSMHPARAFECGTFPASSQQLGNGLLIQGLRDRCGGGWVVTDSDPTRFKSFDEDLLPLVERVDKAILEQLPLVKQVRPASGDVSHSALKPLLLWLLPTPNMPPSVLAKRKHDDGAGVSGRNKLKAIFIPRVLKQASGLMPGSTRPSLCSTQGPPSVSLVSVSLPTVATAPVPLAAPIVTPPSTTVTPLLSVGVVTMSTSKILPLSSSTSLVPTSAILLSMPPSSSSRLRVSLDHDYTSCDTNFVSSFDKNLIRSVGEALSKVASLENEVAKWSFNARTMWRVEHPKVVNATIALAKDRLKELESKLEEPELKMSKEREANKELEEELLAFKKEAMEQHEKGFYKAIR

SEQ ID NO: 180007 - protein, 127 aa, Glycine max
  Coding DNA Sequence Number=SeqID_63229
MGKTNYSFQYAKQKNMTMSHTLSDTSSSESSSEGETSMLEDMDSSTKGKAKTPIVSLERLHPPNLSQKNDDLGHFHRRQFLWGVGLPKGNGGVQRFPRARRRLALKCKGRRELDCKTHPSSRDRREI

SEQ ID NO: 180008 - protein, 128 aa, Glycine max
  Coding DNA Sequence Number=SeqID_63230
  Homolog annotation: Hit_ID=Q9FKW7; Match level="QueryCoverage=79%, HitCoverage=30%, E-value=3e-27, Identity=57%"; Hit description =Similarity to nucleolar protein
MTKSPPCCSSSSLSSLEFSMEEEHAVKAPLSDAFLQFLETNGLDPSIYTAIDSTPRYIRLQRLKSGFESCIEEVEAEVKCKLEKLEWLLGFYSLPPHIQIAGSRAYREGKIYGIDVAFGAVVMAALNI

SEQ ID NO: 180009 - protein, 69 aa, Glycine max
  Coding DNA Sequence Number=SeqID_63231
MLGNWLPEFPKEEARQLKGSLLQHNIYSKKLFSFVRITQAMVAAPQPLKLPPFTEIPLNACGHHMTVLR

SEQ ID NO: 180010 - protein, 749 aa, Glycine max
  Coding DNA Sequence Number=SeqID_63232
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=91%, HitCoverage=91%, E-value=1e-166, Identity=45%"; Hit description =Protein kinase; Type I EGF
  Pfam annotation: Domain name=EGF_CA; Domain location=292-335; Score =25.4; E_value=0.0002; Accession=PF07645.6; Description=Calcium binding EGF domain
  Pfam annotation: Domain name=Pkinase; Domain location=419-689; Score =164.4; E_value=3e-46; Accession=PF00069.15; Description=Protein kinase domain
  Pfam annotation: Domain name=Pkinase_Tyr; Domain location=419-689; Score=141.9; E_value=1.7e-39; Accession=PF07714.7; Description =Protein tyrosine kinase
  Pfam module annotation: Pfam domain module=EGF_CA::Pkinase::Pkinase _Tyr; Domain location=292-335::419-689::419-689
MKAMQMQSITILLLTALAVAADQALPGCPNSCGSVSQIPYPFGIGKSSVTGENCFLEDQLELTCRDSTLYRGNGNVQILNITLDGKMDMLAFVSKVCRKESLGGVETEGNEPSLTTPAFAISSEDNKFVSVGCDTNGYLNSYRNGAKSSVGCLTRCNSEASVQIMQRDGNCTGIGCCQVDIPPGMMNITIQAFSFNNFNSSSDFNNCSYSFVIKNDNYTFSMDHLKGLPFQKAPFVVDWTVGNQTCFNSTSKTDYACKSNSYCEDSAIRKSYRCKCKEGYEGNPYHPDGCQDILECTNGRNNCARDEYCRETLGSFQCFCPEGLIGNGTKEDGECRQKQRNDVFTKVAIGGGVGLIALFMGISWVYLIKQKRKVLKLKEKFFQQNGGIILRQQLSTRKDSSQSTTIFTAEQLEKATNYFDEKLVIGKGGYGTVFKGFLSDNRVVAIKKSKIVDQSQIEQFINEVIVLSQINHRNVVKLLGCCLETEVPLLVYEFVNNGTLFDYLHNEHKVANVSWKTRLRVATEVAGALSYLHSAASIPIIHRDVKTANILLDDTYTAKVSDFGASRLVPLDQTELATIVQGTFGYLDPEYMQTSQLTEKSDVYSFGVVLVELLTGEKPFSFDRSEEKRSLTVHFLSCLKGDRLFEVLQIGILDEKNKQEIMDVAILAAKCLRLRGEERPSMKEVAMALEGVRRMEKHPWTNKSQNFQETQYLLHEAYSTREHGDSSDLQSTGYDSLRNLELIDFGDGR

SEQ ID NO: 180011 - protein, 601 aa, Glycine max
  Coding DNA Sequence Number=SeqID_63233
  Gene Ontology: Mol. function=transferase activity; Cellular component= intracellular; Biological process=metabolic process
  Homolog annotation: Hit_ID=Q1SZV4; Match level="QueryCoverage=82%, HitCoverage=65%, E-value=6e-33, Identity=23%"; Hit description =Pentatricopeptide repeat
  Pfam annotation: Domain name=PPR; Domain location=186-220; Score=9.1; E_value=0.62; Accession=PF01535.11; Description=PPR repeat
  Pfam annotation: Domain name=PPR; Domain location=221-255; Score =10.0; E_value=0.48; Accession=PF01535.11; Description=PPR repeat
  Pfam annotation: Domain name=PPR; Domain location=259-293; Score =12.7; E_value=0.23; Accession=PF01535.11; Description=PPR repeat
  Pfam annotation: Domain name=PPR; Domain location=294-327; Score=1.6; E_value=4.8; Accession=PF01535.11; Description=PPR repeat
  Pfam annotation: Domain name=PPR; Domain location=328-362; Score =16.9; E_value=0.075; Accession=PF01535.11; Description=PPR repeat
  Pfam annotation: Domain name=PPR; Domain location=363-397; Score =18.7; E_value=0.02; Accession=PF01535.11; Description=PPR repeat
  Pfam annotation: Domain name=PPR; Domain location=398-432; Score =34.5; E_value=3.6e-07; Accession=PF01535.11; Description=PPR repeat
  Pfam annotation: Domain name=PPR; Domain location=433-467; Score =44.4; E_value=3.9e-10; Accession=PF01535.11; Description=PPR repeat
  Pfam annotation: Domain name=PPR; Domain location=468-502; Score =31.5; E_value=2.9e-06; Accession=PF01535.11; Description=PPR repeat
  Pfam annotation: Domain name=PPR; Domain location=503-537; Score =30.1; E_value=7.8e-06; Accession=PF01535.11; Description=PPR repeat
  Pfam annotation: Domain name=PPR; Domain location=538-572; Score =16.9; E_value=0.075; Accession=PF01535.11; Description=PPR repeat
  Pfam module annotation: Pfam domain module=PPR::PPR::PPR::PPR::PPR::PP R::PPR::PPR::PPR::PPR::PPR; Domain location=186-220::221-255::259 -293::294-327::328-362::363-397::398-432::433-467::468-502::503 -537::538-572
  Subcellular localization annotation: CTP_CleavageSite=50; ConfidenceScore=5.43e-01
MNTQFCRTPPHHVHAPIIPTSHFPSLYTVSPSHPRFFFHANFSASPTPILEEEPSSNTPIIHVVDVNFDVQQQYSKPEPENLNEFLCGLFEDPKTKELAFDYYQRLKERPEFRPEKPTLKHVIRYLVSLKSWDSILSVSDDFKVYHVLPDRATCSRLVKFCIEHRKFRVAEALLDVFKSDSKVAFMAFSSAMRSYNKLHMFRNTVLVFERIRSSNVVLDSRGYLHIMEAYSKLNECEKVVQLFREFESRKLRGPTCLAQIYEILCESLARCGRASEALDYFREMTKKGISEYSIYSKLIYSFASLGEVDVAEELVREAKGKTTIKDPEVYLKLVHMYIEEGLLEKTLEVVKEMEDADVKVSDCILCTVVNGFSKKRGFSAAVKVFEELISKGNEPGQVTYASVINAYWRLGQYSKAEEVFLEMEQKGFDKCVYAYSTMIVMYGRTGRVRSAMKLVAKMKERGCKPNVWIYNSLIDMHGRDKNLKQLEKLWKEMKRRRVAPDKVSYTSIIGAYSKAGEFETCVKLFNEYRMNGGLIDRALAGIMVGVFSKVGQVDELVKLLQDMKTEGTRLDQRLYQSAWNAFKDAGLQLQARWMKESFLVT

SEQ ID NO: 180012 - protein, 66 aa, Glycine max
  Coding DNA Sequence Number=SeqID_63234
  Subcellular localization annotation: CTP_CleavageSite=44; ConfidenceScore=5.21e-01
MCNFSWAKRASTTKHSFSALSVKEESGRASISRSCAKREISALSAAVVINQAQRTTGAKLKPTYSR

SEQ ID NO: 180013 - protein, 35 aa, Glycine max
  Coding DNA Sequence Number=SeqID_63235
VQRARIQLRVPEYGWTTQKRLKPEVLEYRECGIYF

SEQ ID NO: 180014 - protein, 82 aa, Glycine max
  Coding DNA Sequence Number=SeqID_63236
MEGGMLTNLGCQHRGSKRIQFDVSRNLVSAHQLIQHVPEKAFNTEAVISPSKPISKTHYLEEENHRRQTNHVEANAPQIKLA

SEQ ID NO: 180015 - protein, 63 aa, Glycine max
  Coding DNA Sequence Number=SeqID_63237
MAKLKSNGIVGLVEARIEVQLGNCFVTSKTAKEILLSVNYEGTKDIKLRKSYHSDETKKASTW

SEQ ID NO: 180016 - protein, 51 aa, Glycine max
  Coding DNA Sequence Number=SeqID_63238
HEPLKMHGVSTCSFQVGDISNLERELKIDQMQATEKQNLGMFSQSELDLFM

SEQ ID NO: 180017 - protein, 104 aa, Glycine max
  Coding DNA Sequence Number=SeqID_63239
MATVRVGVGFCLPHPRPRLPISLLAPAPEIDGGVYLHPIPVPDEGRRGGFGDGFGAGIENPIPDPEPEFGYREKPDPDPGQLRFSLSKSGRVWGGPHGFGSRCH

SEQ ID NO: 180018 - protein, 292 aa, Glycine max
  Coding DNA Sequence Number=SeqID_63240
  Gene Ontology: Mol. function=protein binding; Biological process =defense response
  Homolog annotation: Hit_ID=Q1SW22; Match level="QueryCoverage=99%, HitCoverage=42%, E-value=3e-35, Identity=32%"; Hit description =Disease resistance protein; AAA ATPase
  Pfam annotation: Domain name=NB-ARC; Domain location=122-292; Score= -106.5; E_value=0.0017; Accession=PF00931.13; Description=NB-ARC domain
MAETAVSLAGQHALSKILEAVKMLRDLPKEVRDITDELESFQDFINDADKMAEAEEDDGRRHRIKERVMRLREAAFRMEDAIDEYNISCEDKQPDDPRCAALLCEAVDFIKTQILRLQSAYKIQDVKSLVRAERDDEVVGLDGPRGILKNWLTKGREKRTVISVVGIPGVGKTTLAKQVYDQLCKEKKEDRPKDVSTIELLTEEVRNRLCNKRDEKVAEYCRKSSFVEVHKLEKPLTEEESLKLFCKKAFQYNSDGDCPEELKDISLEIVRKCKGLPLAIVAIGGLLSQKDE

SEQ ID NO: 180019 - protein, 99 aa, Glycine max
  Coding DNA Sequence Number=SeqID_63241
MVPPKEIATIIYHNGHIVDDPLQGSMYTYVNPIFFYVSRSITFTQFIRKINNHLPARATEQVAQLLFRVPISFHLGQTCFISAQLFDNDDLRGGMETIV

SEQ ID NO: 180020 - protein, 198 aa, Glycine max
  Coding DNA Sequence Number=SeqID_63242
  Gene Ontology: Mol. function=nucleic acid binding; Cellular component= mitochondrion; Biological process=DNA integration
MEKHAVLPSFESTNEAQLEGYVVKGSEEKVYKLHKALYGLNQAPRAWYNIIDGYFCSQATKRVLRCLKDITQLGIWYKLNDNKNLLGYVYSDWARNLDAMKSTTGYVFSLGSGMFSWNLEKQEIVAQSIAEAKYVATTNQAIWLKKILFDLGVEQLKAIGIYCQNLSTIAIIENSVQHGKTKHIQVKFHVIHEVVKNC

SEQ ID NO: 180021 - protein, 75 aa, Glycine max
  Coding DNA Sequence Number=SeqID_63243
MSEIEDVQEHMKVDMEAMKGQMATMMEGMMIVAASIATEVDPTHSSSLNQVNPPVSDMVGQGGEALGSTGSPHVV

SEQ ID NO: 180022 - protein, 189 aa, Glycine max
  Coding DNA Sequence Number=SeqID_63244
  Homolog annotation: Hit_ID=Q84VH5; Match level="QueryCoverage=85%, HitCoverage=27%, E-value=2e-67, Identity=72%"; Hit description =Envelope-like protein
HQIAKEITAKQVQHWPKKGKLSTGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELERLIKRLSDNGIDDGEAAEEEEDAAEDTESDDDDSDATP

SEQ ID NO: 180023 - protein, 89 aa, Glycine max
  Coding DNA Sequence Number=SeqID_63245
MAINSWGSGLDGGGCMNDNQFMGLRIRFVGGGCMNENQFMGLWTWGLDGGRCMNNNQFMGLRIRFDGGGCMNSTRQSIRGAPDSMVEDE

SEQ ID NO: 180024 - protein, 169 aa, Glycine max
  Coding DNA Sequence Number=SeqID_63246
MYPFLISVNNPSRCTLYLEREESKEFSDCVVFNSLTREKGDTKEFKRLVLRSFGKGRRETQKESRRLVLRSFGKGRRETQKESRRLVLGEFFLAKGEENEKMNSTSFQGLENQNTLESFWHKEEEEVQRDSRLVKDCIRLIENCVLKSKSKPCFYRPFMSGLEDHLEEL

SEQ ID NO: 180025 - protein, 33 aa, Glycine max
  Coding DNA Sequence Number=SeqID_63247
MRLHYYQASRRPNMTTDRPLLFMAHINPGGICA

SEQ ID NO: 180026 - protein, 172 aa, Glycine max
  Coding DNA Sequence Number=SeqID_63248
ETKGASGNRLPACVIDYTEGWVTGNRLPGCVIDYQRRKALRYPFYLHIVMAAQLIRDRVEMECLEGAWETFEGNTRCRFWGTIRFTATSLVHPDEPARDAAAHGGVDTTHASTISSSGASPSDRGERHPRKTPRRIWRSYPPEPAVDALDFLEGDEDPLLEVDSPEEVMSAS

SEQ ID NO: 180027 - protein, 150 aa, Glycine max
  Coding DNA Sequence Number=SeqID_63249
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAI

SEQ ID NO: 180028 - protein, 111 aa, Glycine max
  Coding DNA Sequence Number=SeqID_63250
FFRKCASSGILPDEPLLPESSRKRFSGSLPEEVFFRKTFGYFRKNTSSGNFPEKVLPELPEEPLTVHNKTKAKKKATYLESKWVQGLSEKLAEKKLVGEERREEAFAEETQ

SEQ ID NO: 180029 - protein, 136 aa, Glycine max
  Coding DNA Sequence Number=SeqID_63251
MASLSSCSSSIQIKSSPIDGDILWMQPKHVSEHVWNEKSDRKLYIRRAVPIYQGQEEIPEEIIPLLHQSGLRVDGTPLIGQTNFDWAELCEELLGVRPQEGELQGSVVKLSWLAHHFSQINNHDGNVEQLQRFTRA

SEQ ID NO: 180030 - protein, 53 aa, Glycine max
  Coding DNA Sequence Number=SeqID_63252
MTVKKRLSFELQKVAVGLSSKFSKALVHNIFHSAYFGKKALEAAKRNNLCIES

SEQ ID NO: 180031 - protein, 73 aa, Glycine max
  Coding DNA Sequence Number=SeqID_63253
MKGGEHKYGFNNNKHEKPEKVRVVDDETDDKHELFEVLRMPSRCVFFKVFMSFLHHSTFSCHSFPDSLKDYSE

SEQ ID NO: 180032 - protein, 136 aa, Glycine max
  Coding DNA Sequence Number=SeqID_63254
  Gene Ontology: Mol. function=nucleic acid binding; Biological process= DNA integration
  Homolog annotation: Hit_ID=Q1RSN0; Match level="QueryCoverage=86%, HitCoverage=17%, E-value=8e-15, Identity=41%"; Hit description=Zinc finger, CCHC-type
MTSLMKKIQGLQALHGATLKEGASLNRSPLFVGEHFSFWKKKMKIFIQSIDPSAWNAIFKGPFIPTKEANGELVPKECDEMKDDEKRKVQDNQKAKNILTFGLSSDEFFHTARCKGAKVQSKFRICLKSLMKAQWM

SEQ ID NO: 180033 - protein, 62 aa, Glycine max
  Coding DNA Sequence Number=SeqID_63255
MARVPNGRKWRPNFEKKEKYVEKFMSKGNMKKMLIHIKQKEYGTPGNGFPNQGNKKSGKATE

SEQ ID NO: 180034 - protein, 179 aa, Glycine max
  Coding DNA Sequence Number=SeqID_63256
NGVVRVPRKCWRKGQRPWKIKANGLSFIDILALLIFGVVLFPNMEGLVDLAVIDAFLAFHHGKESPVIAILAMIRSSCEGCPMRGVPSDESITPFIARGFSDHNARDRELRGSSNGIIGGYHKWLRVRTQGLDWLPNLKTVRDDEVKASEESDEVQALKAELERAWVVEEKFKSIAIKV

SEQ ID NO: 180035 - protein, 423 aa, Glycine max
  Coding DNA Sequence Number=SeqID_63257
  Gene Ontology: Mol. function=zinc ion binding; Cellular component =integral to membrane; Biological process=ubiquitin cycle
  Homolog annotation: Hit_ID=Q1SZZ2; Match level="QueryCoverage=66%, HitCoverage=90%, E-value=1e-78, Identity=53%"; Hit description=Zinc finger, RING-type; RINGv
  Pfam annotation: Domain name=PHD; Domain location=214-259; Score=2.2; E_value=0.034; Accession=PF00628.19; Description=PHD-finger
  Pfam annotation: Domain name=zf-C3HC4; Domain location=215-256; Score= 38.7; E_value=2e-08; Accession=PF00097.15; Description=Zinc finger, C3HC4 type (RING finger)
  Pfam module annotation: Pfam domain module=PHD::zf-C3HC4; Domain location=214-259::215-256
  Subcellular localization annotation: CTP_CleavageSite=74; ConfidenceScore=5.68e-01
MKPVPNEPTCLTYMMSSRSSLTLCHSSSPSAASPATSSVKVCHKMSLSLIIPSRSNHLSGENKFMRTTLLNDISCEARDSEIIVGRCKEEEEREEGNGWDPLVLLLLGVIADLNPDPNGMKKAPYNTPPALIAFTLTVLVLCFVAFSIVYMCKYCFSSVIHTWAFQRTPSGSLIRLTPHRSPPRGLDPDLLQVFPTFPYSSVKDLRKDQKYGLECAICLLEFEDDNVLRLLTLCCHVFHQDCIDLWLRSHKTCPVCRRDLDSPPPDETQKANEGVVVMSTSGEIRIDVTEGQDCGGGDDNDGNPRQEHEREHEHEHGYGNHEVMIHQQGEQMFARSHSTGHSIVLIRGEGDEGKDDDKYTLRLPEHVLRVRHNNKHNCTRSCASYKDIAKLVAPPAAAAPCSNCGFVQPVPPSSTSSPDHTRK

SEQ ID NO: 180036 - protein, 163 aa, Glycine max
  Coding DNA Sequence Number=SeqID_63258
  Gene Ontology: Mol. function=nucleic acid binding; Biological process= transport
  Homolog annotation: Hit_ID=Q8H6Q8; Match level="QueryCoverage=55%, HitCoverage=2%, E-value=6e-20, Identity=52%"; Hit description=CTV.20
  Pfam annotation: Domain name=MP; Domain location=11-163; Score=16.1; E_value=1.6e-05; Accession=PF01107.9; Description=Viral movement protein (MP)
MDDWNIPEIPQDQLYVPETIKDKHNFDYIIKTVENNIPLGQDVGEEFHLLSKNSIYEHSRKYKYLHIGCVQVAIKPLIDMGIDAAVLMCLRDIRHNQFEDSLIGTVETSLGQGPIYFNCYPNKTVSLMDRNILDSLFLNIHFHGLDMKEGSIPAALIYRIQYK

SEQ ID NO: 180037 - protein, 111 aa, Glycine max
  Coding DNA Sequence Number=SeqID_63259
MKEPKPTNITQHLLDRFVVHPRRVIEDVMVKVMVEVKLGRLTLRLGDEKPHRSVGKEDPLERNIILKDHHGRGIRNENRRDDKTILALGYGVDDHTRGSFHERIITPFEVG

SEQ ID NO: 180038 - protein, 380 aa, Glycine max
  Coding DNA Sequence Number=SeqID_63260
  Gene Ontology: Mol. function=nucleic acid binding; Biological process= regulation of transcription
  Homolog annotation: Hit_ID=Q1S3P4; Match level="QueryCoverage=99%, HitCoverage=100%, E-value=1e-127, Identity=62%"; Hit description =Zinc finger, CCCH-type
  Pfam annotation: Domain name=zf-CCCH; Domain location=169-195; Score =28.5; E_value=2.3e-05; Accession=PF00642.15; Description=Zinc finger C-x8-C-x5-C-x3-H type (and similar)
  Pfam annotation: Domain name=zf-CCCH; Domain location=247-273; Score =48.9; E_value=1.7e-11; Accession=PF00642.15; Description=Zinc finger C-x8-C-x5-C-x3-H type (and similar)
  Pfam annotation: Domain name=zf-CCCH; Domain location=93-118; Score =31.6; E_value=2.8e-06; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=169-195::247-273::93-118
MDFARDGNVVQIITGGGGGGGGGESWSGDQADWATEDEYRFWNNNNSGGDSETTPSNSNYEGRSSEPPSKKSRNSSQEGSSSNRSKAIGKMFFKTKLCCKFRAGTCPYITNCNFAHSIEELRRPPPNWQEIVAAHEEEKAVMIEPPREEFQIPTVGSTTFSGEMMQRSYKGRHCKKFYTEEGCPYGDSCTFLHDEQSKNRESVAISLGPGGYGGGGGGGGGVGGGASGGNGGANAAGNGPNSKPSNWKTRICNKWEMTGYCPFGNKCHFAHGATGESLPGNACNTSFTFQWIYDWPYGENRDAASAVAGDTNKGVPSKASADNVVAAVTLVAHSDVYHIGVPSQRPSSMVIQRPGQRAHQKWKGPDKISRIYGDWIDDIE

SEQ ID NO: 180039 - protein, 58 aa, Glycine max
  Coding DNA Sequence Number=SeqID_63261
MERDCSTTHGDYSEFASILTSIGATELNPTLVCIQHKYGVIFNDPVYAYSICRIRYSM

SEQ ID NO: 180040 - protein, 143 aa, Glycine max
  Coding DNA Sequence Number=SeqID_63262
MRLHCHQASRRPSMTTDQPPLPIFPWTRIKWLDSKEKSPQWSRQLSQPTIRREGKARLKGASSKREKHARVATNVYSRKMLGKPKRGMPISKKRVREMFTRGEVMQSYPARALDRKLQVDWARDAREGPRVLMSLRVDFGPMG

SEQ ID NO: 180041 - protein, 111 aa, Glycine max
  Coding DNA Sequence Number=SeqID_63263
  Gene Ontology: Mol. function=nucleic acid binding; Biological process= DNA integration
MPTCMTLQLADRSITRPYGVIEDVLVKVKHLIFPADFVVIDIEEDADIPLIRGRPFMSTASCMVDMGKKMLQMGIEDQKISFDLFHEDRDHPSQNVCLKVHVMEERRHEKK

SEQ ID NO: 180042 - protein, 370 aa, Glycine max
  Coding DNA Sequence Number=SeqID_63264
  Homolog annotation: Hit_ID=Q5G8X3; Match level="QueryCoverage=52%, HitCoverage=75%, E-value=4e-10, Identity=25%"; Hit description=Gp16
  Pfam annotation: Domain name=Big_2; Domain location=286-364; Score =90.5; E_value=5.2e-24; Accession=PF02368.8; Description=Bacterial Ig- like domain (group 2)
FSMTPAMYERVRNYFVDAGLTTGFIVQLLAWDDTTKLTDAFIVFRPNGGTDIRNDLGSDHYVLVDVISAKDKRRAAAEKAQEIINYVEQNDITDECLGLIQNLGNVPAPILTEEGRLVHMQGCANDFGKLIGKVAVLRMAYGCPDAVPALSEWKRLGAMTTKGLDYSMNTINSEADDSKGLVENLVNNMDITISGEGEARKRDKSTEIGAWRMGKYIFDEVQAGRQPTLWVRFDFAGEDAGTYIMGYFNTTSWSGDFGTNDIATFSGEWKVYDADTVVFEVADSIAATGVEVTPATASLVVGATQQLSGAVQPTDATNKAITWTTSAASIATVSSTGLVTAVSAGTATITATTADGDFTDTCAVTVTAAP

SEQ ID NO: 180043 - protein, 113 aa, Glycine max
  Coding DNA Sequence Number=SeqID_63265
  Subcellular localization annotation: CTP_CleavageSite=18; ConfidenceScore=5.01e-01
MALGGRRKYPSGANEPVDAQRLTSSSAPFVVLTREPGANEPVDTKRLTSSSAPFAIQGQRVRWQAEIPYGHPHLSSTEGNKCDDIRMMLVGRLSAMAKEGVVVVQLCRFQDTE

SEQ ID NO: 180044 - protein, 47 aa, Glycine max
  Coding DNA Sequence Number=SeqID_63266
ECPDLKLVSHGRKVTLIRRPVPEIEGLVAQRDQHLPPFGRRVNDHIG

SEQ ID NO: 180045 - protein, 183 aa, Glycine max
  Coding DNA Sequence Number=SeqID_63267
  Homolog annotation: Hit_ID=Q5G8Y3; Match level="QueryCoverage=88%, HitCoverage=45%, E-value=1e-09, Identity=28%"; Hit description=Gp6
MATNQNLILWPTISQKPKSPVIPRSKVDPTMSRKSVSKMERDIEDRYYAIKVALKALFDQRLTGREREGNSHNWHFLCHDNGEDMRLYQVNAGKFIYDMSAQELADLLEAVQGILDEYLLGGGEQNLWAMDYVVAEAQRGTLEAFNNLSQQSQVYASQTTLQQLLSSPGYLNQIAGGQADNVQ

SEQ ID NO: 180046 - protein, 126 aa, Glycine max
  Coding DNA Sequence Number=SeqID_63268
EEQGIKENSPNKKIEEAKEHHLDEDALIPHDVSFVGACRPGIFFINGVLCFLRSDCSGMEKEKDDCSGRRRKRERRRHFKEKMSLEEAHHHRRPWIRAWRKKEMNEGRGKEEHEILCFKRALKSEV

SEQ ID NO: 180047 - protein, 66 aa, Glycine max
  Coding DNA Sequence Number=SeqID_63269
KKKEGVETRVVITERAGRTKSVSYLCFPLISDERYLAPFVAQYVKSRDVPKIKRKQAYAIRENSVM

SEQ ID NO: 180048 - protein, 99 aa, Glycine max
  Coding DNA Sequence Number=SeqID_63270
  Subcellular localization annotation: CTP_CleavageSite=51; ConfidenceScore=5.00e-01
MTPILKVTPFLKMSSGRASLNPLPRPLPPRKRENACLRKHDCIDSLFEDTTITYVRGICFNNFECLQNWEIQIFYGLNFELDILDYLGVNIKPRRRILS

SEQ ID NO: 180049 - protein, 326 aa, Glycine max
  Coding DNA Sequence Number=SeqID_63271
  Gene Ontology: Mol. function=D-alanine-D-alanine ligase activity; Cellular component=cytoplasm; Biological process=peptidoglycan biosynthetic process
  Homolog annotation: Hit_ID=UPI00005F9308; Match level="QueryCoverage =99%, HitCoverage=89%, E-value=1e-129, Identity=69%"; Hit description= COG1181: D-alanine-D-alanine ligase and related ATP-grasp enzymes
  Pfam annotation: Domain name=ATP-grasp; Domain location=140-322; Score=-14.3; E_value=1.6e-06; Accession=PF02222.12; Description=ATP -grasp domain
  Pfam annotation: Domain name=ATP-grasp_3; Domain location=140-323; Score=-42.9; E_value=0.011; Accession=PF02655.5; Description=ATP -grasp domain
  Pfam annotation: Domain name=CPSase_L_D2; Domain location=140-326; Score=-108.8; E_value=0.0029; Accession=PF02786.7; Description =Carbamoyl-phosphate synthase L chain, ATP binding domain
  Pfam annotation: Domain name=Dala_Dala_lig_C; Domain location=140 -326; Score=299.6; E_value=5.9e-87; Accession=PF07478.3; Description =D-ala D-ala ligase C-terminus
  Pfam annotation: Domain name=Dala_Dala_lig_N; Domain location=4-139; Score=219.9; E_value=5.8e-63; Accession=PF01820.11; Description=D -ala D-ala ligase N-terminus
  Pfam annotation: Domain name=GARS_A; Domain location=139-318; Score= -112.4; E_value=0.018; Accession=PF01071.10; Description =Phosphoribosylglycinamide synthetase,
  Pfam annotation: Domain name=RimK; Domain location=138-325; Score= -67.3; E_value=0.033; Accession=PF08443.2; Description=RimK-like ATP -grasp domain
  Pfam module annotation: Pfam domain module=ATP-grasp::ATP-grasp _3::CPSase_L_D2::Dala_Dala_lig_C::Dala_Dala_lig_N::GARS_A::RimK; Domain location=140-322::140-323::140-326::140-326::4-139::139 -318::138-325
MAKQRVGIVFGGKSAEHEVSLQSAKNILEAIDKNKYDVVLLGIDKQGEWHLNDASGFLLNADNPALIALNRSGENVALVPGSRAEQLITRQQAQPLSQLDVIFPIVHGTLGEDGSLQGLLRMANLPFVGSDVLGSAVSMDKDFTKRLLRDAGLKVAPWLSVTQTQRAALDVQAVIARFGLPLFIKPANQGSSVGVSKVTQPDEFDAALDLAFRFDRKVLIEQGISGREIECAVLGNEAPEASPCGEIVVHDAFYSYDTKYISESGAQMVVPADISAEASEAIRAVAITAFHALECFGMARVDVFLTDTGDIIVNEVNTLPGFTNIS

SEQ ID NO: 180050 - protein, 527 aa, Glycine max
  Coding DNA Sequence Number=SeqID_63272
  Gene Ontology: Mol. function=ATPase activity, coupled to transmembrane movement of substances; Cellular component=integral to membrane; Biological process=proteolysis
  Homolog annotation: Hit_ID=Q0BAW8; Match level="QueryCoverage=96%, HitCoverage=65%, E-value=1e-154, Identity=53%"; Hit description=ABC transporter related
  Pfam annotation: Domain name=ABC_membrane; Domain location=182-451; Score=38.2; E_value=2.8e-08; Accession=PF00664.13; Description=ABC transporter transmembrane region
MMDQKQNAVEQDARSVARIETTVDDTLLKSVAWICKHYKREKSEEALVAGLPKATLLSPSQAMTALENAGITGGMVERRLQDLPEQLMPMILLRQNGGGCILLSRRIHTNEENQRELRFQLIMPEVSDKAVEMSLAELNEIYAGFAVMAKPAAVLDERASEMLPEVKGHWLFSTLWRYRRYYRSAAIAAVLINVLALSSIFFTMNVYDRVVPNQAFVTLWSLAIGVTIAMIFEAITRFVRAHLLDMAGKKADLVLGSMLFRQALSIQMEHKPASSGTFANQIREYESVRDFVASATLAAISDLPFILMFVGVIFFISGPLAIIPLMMIPLIIIVSAAIQWPLARIMKENLRDASLKQGVLIESVEGMETLKAVGGEAHMQRRWENFSALQSANSMKSKRYSTLATGVVTFLQQFQTVMLVVAGVYLINAGTFTMGAMIATVMLASRATGPLGQVIGLAVRYQQAKAALTSLNKLMEMPVDRDSSKTYLTDPPLTGEISLSNVSFSYPAPPMKPNPEILKDISLTIKA

SEQ ID NO: 180051 - protein, 392 aa, Glycine max
  Coding DNA Sequence Number=SeqID_63273
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=8e-42, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEGYSTLTFRGLCALAFRGQHALAFRGLRVLALRGKHALAFRRLHVLAFRGLHALTFKGMHALAFRGLHVLAFRGLHTVAFRELHVLTLRGQHALAFRRLHTLAFRGPNAFAFRGQHVQTFRGLHALAFRGLHALAFRGLHTLAFRGIQVVIFRELHALAFKGTLTFRGLCALAFRGQHALAFRGLRVLALRGKHALAFRRLHVLAFRELHALTFKGMHALAFRGLHVLAFRGLHTVAFRELHVLTLRGQHALAFRRLHTLAFRGPNAFAFRGQHVQTFRGLHALAFRGLHALAFRGIQVVVFRGLHALTFKGLHALAFRGLHALAFRGLHVLAFRGMHILTFRGLHVLTAARPHLQKATCPRLPRAKRPRLQRAARPRLQMVARLSL

SEQ ID NO: 180052 - protein, 73 aa, Glycine max
  Coding DNA Sequence Number=SeqID_63274
MDKSLKVGEDEWMERERRSTKFCASNEGLRATMHHQKRKTLDKASLLSSESETQHDHKSTSTSYSSHRPVYRA

SEQ ID NO: 180053 - protein, 84 aa, Glycine max
  Coding DNA Sequence Number=SeqID_63275
  Subcellular localization annotation: CTP_CleavageSite=48; ConfidenceScore=5.30e-01
MSAFLEATVKLFMQIASMNSATLRHATRGCVASATGDSTDVATCNGVLAMQGGVAGQTSASPRVSGTAFAGEPAFAVQLKTPGP

SEQ ID NO: 180054 - protein, 608 aa, Glycine max
  Coding DNA Sequence Number=SeqID_63276
  Gene Ontology: Mol. function=RNA-directed DNA polymerase activity; Cellular component=chromatin; Biological process=chromatin assembly or disassembly
  Pfam annotation: Domain name=Chromo; Domain location=558-608; Score =26.2; E_value=0.00011; Accession=PF00385.14; Description='chromo' (CHRromatin Organisation MOdifier
  Pfam annotation: Domain name=rve; Domain location=300-439; Score =59.5; E_value=1.1e-14; Accession=PF00665.16; Description=Integrase core domain
  Pfam module annotation: Pfam domain module=Chromo::rve; Domain location=558-608::300-439
MGSKSTLRLMRTLGPFLGSLAQSTWSLLANALAGLLLEFTDVFQEPSGLPPCRVGHDHKIPLMQGANPINKRPYRYAKQQKDIIDGLIQDYLKDLNKEIVKNKFPIPLVEDLLDELYGTRLGPTIKLEAIEEFLGSCSKRSISRIEAKASSITSFGPTRFFQGICGGGGCFWIQQLDSSMLSRIQQSWQKDPILQQLVSDLKNNPSSHKHYTWVRNKLRRKGKLVIGSDSQLRQDILSWIHASACGGHSGRDATLQKMKNMVYWIGMSKNVKFFVFQCATFQRSKHDTAASPGLLQPLPILEHVWQHITMDFIEGLPFSFGKQVIFIVVDRLSKATHFMALLHPYTVADVAQCFLDSVFKLLGFPDTITSDRDPIFLSIAYHPQTDGQSDMVNGCLETYLRCMCSDFPAHWSKWLPLAEWWYNSTYHNTIKASPYEIVYGQAPPIHLPYLLGEFKIALVDRSLQKYEEMSFQIGDLVYVKLHAYRQVSVQARTNAKLAPKYYGPFPVEDKIGVVAYKLKLPLGSMVHNVFHVSQLKKFNGTTTVGNFSPSPLLDTSQKEPATIIDRMTVKRGNHVVTKVLVQWKHQLPEDATWEFFYDLKQKFPHFNP

SEQ ID NO: 180055 - protein, 321 aa, Glycine max
  Coding DNA Sequence Number=SeqID_63277
  Gene Ontology: Mol. function=RNA-directed DNA polymerase activity; Cellular component=chromatin; Biological process=chromatin assembly or disassembly
MAENTRSQASLREMEEHLSSRMESRFGELAASMQQTIHIMFQQRRQDSPTTNNPPRGLENLPSWNEYQILLPNCFGDVCEDPMANLMKLRQTGSIIEYHEEFDSIVSRVDLSDEHQLSCFLGGLKQEVQMIVQMFQPNYVRKAYSLAKMYESSFSNTQARPFVKNQKSSFVPKPPLLPNPPRSTNPLTINPSTKPQKPKHLTPKYMAERRSKGLCYFCDEPFTPEHGLTHKRLQIHVLEIEDEEEGPGPQQPDANVVTEPDSEPLISVNALIGVSNFRTMRVTVLGIEWLVTLGDMTWNFNKLTMEFDGSLLVELLWRLDL

SEQ ID NO: 180056 - protein, 970 aa, Glycine max
  Coding DNA Sequence Number=SeqID_63278
  Gene Ontology: Mol. function=cellulose synthase (UDP-forming) activity; Cellular component=membrane; Biological process=cellulose biosynthetic process
  Homolog annotation: Hit_ID=Q2IB41; Match level="QueryCoverage=99%, HitCoverage=100%, E-value=0.0, Identity=60%"; Hit description =Cellulose synthase 3
  Pfam annotation: Domain name=Cellulose_synt; Domain location=184-965; Score=1548.4; E_value=0; Accession=PF03552.5; Description=Cellulose synthase
  Pfam annotation: Domain name=PHD; Domain location=36-85; Score=6.9; E_ value=0.012; Accession=PF00628.19; Description=PHD-finger
  Pfam module annotation: Pfam domain module=Cellulose_synt::PHD; Domain location=184-965::36-85
MEASTGLFAGTPNSNELVVIQGHDEPKPVKNLDGQLCEICGDSVGLTVDGDLFVACEECGFPVCRPCYEYERREGTQVCPQCHTRYKRTKGSPRVLGDEDEDDVDDIEHEFKHEEMLQGNKTHRDSDVGLAKVNGELPISSNSVEEPGAKLDDKEKVDEWMLHQGNLWPETDASDDPVKAMKEPLSRKVPIPSGRLSPYRMMVVARLLLLLLFFQYRIFHPVPDAIGLWFISVTCEIWLALSWMIDQLPKWFPIDRETYLDRLSIRFEPENKPNMLSPIDIIVTTVDPIKEPPLVTANTVLSILALDYPADKISCYVSDDGASMLTFEVLQETAEFSRKWVPFCKKFSVEPRAPEKYLTEKIDFLKDKLQSTYVKERRTMKREYEEFKVRINALVAKSMRVPPEGWTMKDETPWPGNNSKDHPSMIQVLLPHNVGNELPCLVYTSREKRPAFQHHNKAGAINAMLRVSAVLNNAPFVLNLDCNHYVNNSKVVREAMCFFMDIQLGNGIGFVQFPLRFDSLDRNDRYANKNTVLFDINLRCLDGIQGPAYVGSACIFRRKALTGFDSPKASKRPSMVQVHSKQDENGEEASKTAAATDEDKELLKSENKFGMSTIFMNSSWTEEGGVDPSSSQEALLKEAIHVMNSRYEDRTLWGYEVGLSYGSIATDTLTSMKMHCGGWRSVYCMPKRDPFRGTAPINLTERLNQVLRWAVGSLQILFSSHCPLVYGLNGGRLKGLQRIAYINSTVYPFTSIPLLIYCTIPAICLLTDKFITPSVGTFASLIFIALFISIFASAILELRWSRVSLEEWWRSQQFWVIGSVSANLFAVLQGIMGALPLSSRVNKNFSIVSKAPDEVEFRELYAIRWTALLIPPTTIIIINLIGIVAGFTDAINSGEHSWGALLGKLFFSLWVIVHLYPFLKGLMGRQNRTPTLIVIWSVLLASIFSLVWVRVDPFVLKTKGPDVKQCGISC

SEQ ID NO: 180057 - protein, 288 aa, Glycine max
  Coding DNA Sequence Number=SeqID_63279
  Gene Ontology: Mol. function=helicase activity; Cellular component =membrane; Biological process=viral genome replication
  Homolog annotation: Hit_ID=Q9FHV5; Match level="QueryCoverage=98%, HitCoverage=22%, E-value=2e-67, Identity=43%"; Hit description =Helicase
  Pfam annotation: Domain name=DUF889; Domain location=68-288; Score =140.3; E_value=5.4e-39; Accession=PF05970.5; Description=Eukaryotic protein of unknown function (DUF889)
  Subcellular localization annotation: CTP_CleavageSite=59; ConfidenceScore=5.15e-01
GVYFLYGYGGTGKTFVWKTLSSAIRSTGGIVLTVASSGIASILLPGGRTTYSKFAIPVPATKNSTCNIYQGSDLAKLLHITKLIIWDEAPMCHRYNIEALDKSLQDIMHNGNPFGGKVIVFGGDGKLAEPNDGYGEITIPNEFLIKDFQDPIQAIVEATYPYILHNYSNGDLLQKRVVLAFTKDVVDKINDYVLSLIPGEEKEYCSADSVDKSDELLSPAFGVLTAEFLNSLKISGIPNHKLIIKVGTPIILLRNLDQADGLCNGTRLIVTRLGSSVVEAAIITGPNI

SEQ ID NO: 180058 - protein, 66 aa, Glycine max
  Coding DNA Sequence Number=SeqID_63280
  Subcellular localization annotation: CTP_CleavageSite=45; ConfidenceScore=5.13e-01
MWDSVGECGCQGSCFQQISGGRRKRRAISGRQTKRIGRARSLNDRSMMKEAGMQRLPRGLPRSGHP

SEQ ID NO: 180059 - protein, 88 aa, Glycine max
  Coding DNA Sequence Number=SeqID_63281
MEYRSPGSKTTKVSKKGHINATIRLPGQGFMPLALLELSAELVILCDVEVNIPLGEDVPRMDVLLITLPSDLGDESHRVIWFLRSGGG

SEQ ID NO: 180060 - protein, 209 aa, Glycine max
  Coding DNA Sequence Number=SeqID_63282
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSMAGRIQESTAVTEGHDPAPLPLRHLGACLAAYFCWAGGYIIYLTFIFAWLRDHGLSWQQGIAVIKLIDTVDLEGGPGTSFCSL

SEQ ID NO: 180061 - protein, 81 aa, Glycine max
  Coding DNA Sequence Number=SeqID_63283
MSQNFTDFLTMGVKFLEAVKRRLHVIIQWSPDEIRAINSWGSRLNGGGCMNNARQSIHGTPDSMMEDARTALDNQFVGLRT

SEQ ID NO: 180062 - protein, 72 aa, Glycine max
  Coding DNA Sequence Number=SeqID_63284
MAQPPPRERTLREMARPDFTYESLCIQYPDEYFPYVLKIGLIHLLPKFHGLAEGVTKDWAILPCSKVHHKPG

SEQ ID NO: 180063 - protein, 64 aa, Glycine max
  Coding DNA Sequence Number=SeqID_63285
MKLRVMVARPGELLLHPEVSWLAQASWEVKIRTLILFERSSYSTGQLEKTKEVKPRKHEDIKVL

SEQ ID NO: 180064 - protein, 220 aa, Glycine max
  Coding DNA Sequence Number=SeqID_63286
MLKDVSDANRIRPFSITRVMPMDLLIKEISSSGQRGSWDLGELASGDYPKFDALIWREKFIELTLLFLTSFETMLFELRAGDRCTMYLYVVITPDCHPHKNVRPSCAWVDSHLQQPTFQEHVIEHPWILFTWINNYHYSYTLEEEEELVDLPSLQDKVVKVYKNVGDFINNEDLTPFEITFYWGVFDEKISGEAMLSSDEEWDSSGNESDPSEDYFPFLM

SEQ ID NO: 180065 - protein, 124 aa, Glycine max
  Coding DNA Sequence Number=SeqID_63287
  Homolog annotation: Hit_ID=Q9LW03; Match level="QueryCoverage=99%, HitCoverage=89%, E-value=9e-12, Identity=41%"; Hit description =Arabidopsis thaliana genomic DNA, chromosome 3, P1 clone: MSJ11
MAVSGTVIVLALRLQRSFLAIQFPVHEISHPSTPILRSCISSVRNKREKKRVHFADDVVDSCGDGEEFRRQQRVNRNFWCSKSESKVRKNCEGKSDVRGMPANRVALYNGILRDRVAQRMTYSY

SEQ ID NO: 180066 - protein, 185 aa, Glycine max
  Coding DNA Sequence Number=SeqID_63288
MKVVEEDAKKEAKKKAMITEVLVDPTISSALQEDGEQVVSPLESNATKTNEVVQTCQHEPTSKQIDTLNEASSMQKEVPIAVVVFSCKSNNVPINFVAPSSLLEDRVQAVLDLALIRIYNKLNKTCWEGHKGIEGINKNIPLRLFSLRRRSTCSCLYYILSLSDQSATRGTTSNYETMVISRNQC

SEQ ID NO: 180067 - protein, 401 aa, Glycine max
  Coding DNA Sequence Number=SeqID_63289
  Gene Ontology: Cellular component=integral to membrane; Biological process=autophagy
  Homolog annotation: Hit_ID=Q9SUD4; Match level="QueryCoverage=56%, HitCoverage=90%, E-value=8e-71, Identity=54%"; Hit description =Senescence-associated protein-like
  Pfam annotation: Domain name=Tetraspannin; Domain location=137-380; Score=138.2; E_value=2.2e-38; Accession=PF00335.10; Description =Tetraspanin family
MDLMVVYLDDERCAVEDAARKFERLGNHAMERVRGWCGMNSESKPLLFPKIIFLRHQAPPCSHTGSQSPLSWHQSSAGGTSPPPATRSDARLFWEEALMECNLNERRKTESEVVEENEDGNGVKKTVRGRRSSECKVVRISLCEKEDVLSLEQQPGRVAEPALLPPVDTHSGNRRVAAQASGNGMREMAGEAPHRLLGACCRLSCLLWLYLFVMFILIIVVSAFTVFAFVVTNKGAGEVVSNRGYREYRLGDYSNWLQNRVTNPHTWNRIKSCLQSAKLCDKFETQFANDSAQQFYAENLSALQSGCCKPSNDCNFAYQGPSVWNKTDGVNHSNPDCNAWDNDSNVLCFNCESCKAGFLQNLKTDWKKVTIVNVIFLVFLIIVYSVGCCAFRNNMRGNWKY

SEQ ID NO: 180068 - protein, 107 aa, Glycine max
  Coding DNA Sequence Number=SeqID_63290
MKQIASRKTISINIPLATIARSHMDPSMDVDSPFKAHSNQSSQSHLAYVEYSTIGGIFAQMYALNQAITYPPSLHTSRTIDILMVHDRYCPRLPLKDEGKKRLQGLL

SEQ ID NO: 180069 - protein, 95 aa, Glycine max
  Coding DNA Sequence Number=SeqID_63291
MYDTAKINEVLIYLTISSVVHEDEVPEVSYIASNAAKANEVIPTGPSEPVSNLVAPSSLIVDNVQARLDMALVKQKEETQTMVNEAQEKQYENTR

SEQ ID NO: 180070 - protein, 194 aa, Glycine max
  Coding DNA Sequence Number=SeqID_63292
  Pfam annotation: Domain name=zf-CCHC; Domain location=110-127; Score =13.3; E_value=0.0064; Accession=PF00098.13; Description=Zinc knuckle
METISYNIESSRESGLHVPSGAHWNLEECEGYNRSAKTLNEKLLKKEDLKDQPQDVIKHCEAIDTLKSTLTTFVSRSESLDNLIRYYRCLIDRSSNVYEGIIYVHDEDIVVCYVCGKVEHMTSKFRNRSRKGASNAFKTTKRGPKKIWVPKEKIIHVVDVLGSRNKTPIMVPGQWLLTTHDRKKVYGPMLDSLS

SEQ ID NO: 180071 - protein, 179 aa, Glycine max
  Coding DNA Sequence Number=SeqID_63293
  Gene Ontology: Mol. function=DNA binding; Biological process=DNA integration
  Homolog annotation: Hit_ID=Q1S3H4; Match level="QueryCoverage=65%, HitCoverage=20%, E-value=9e-22, Identity=44%"; Hit description =Integrase, catalytic region
MANFKAVGIIPKDLTWQQRKKFFHDARFYIWDDPYLFKVGVDNLLRQCVTSEEAKGILWHYHNSPCGGHYGNEYILVAVDYVSKWVEAVATPRNDAKTVASREQRKIQLLELEEMRLIAYESSRLYKERVKVYHDKKLLKRDFKPRQQVYDSLSASCLLAKHSIPVLSPASIKPIHGFN

SEQ ID NO: 180072 - protein, 150 aa, Glycine max
  Coding DNA Sequence Number=SeqID_63294
MVVPKSKKMQRQAESNKEQAVPLGVEFRRRTTAVRGGHRWLWVVEKKLGTLGKDFGRKKEKGMDVFQGYTKNNICNSRERKRFSHARCHIADCNGQIVDVYPVNLQTKFLDDPTVNKCRRAFLPRQLQVASLRGFLEKLPHKASLRSFLV

SEQ ID NO: 180073 - protein, 55 aa, Glycine max
  Coding DNA Sequence Number=SeqID_63295
MRNRFCKLCSVSATPGTGYFGKCKKCERNLADVAGSLTVQSLRTLTGTITLAPWR

SEQ ID NO: 180074 - protein, 59 aa, Glycine max
  Coding DNA Sequence Number=SeqID_63296
MAKHLRQGSFFIDLILIATDMISNGNGGNNGGYHISNDDDNHNDDHDIGGESNDDNSDG

SEQ ID NO: 180075 - protein, 194 aa, Glycine max
  Coding DNA Sequence Number=SeqID_63297
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=80%, HitCoverage=49%, E-value=1e-43, Identity=67%"; Hit description =Matrix metalloproteinase MMP2
  Pfam annotation: Domain name=Peptidase_M10; Domain location=12-167; Score=-19.5; E_value=1.2e-05; Accession=PF00413.14; Description =Matrixin
MTTFSGLSFELNGDGVLYTISNNYDSHLSSMFSEMLIQPYPTQHEKGFQRCLQEVGAGHHRGFEAHGDNLRQCRHQGRVQNIQQYLGPGDIRLKGAIWSLPSENESLSWEDGVLDLESAAMHQIGHLLGLDHSNKEDSVMYPNVLPWQQRKVELSVSDMENIQRHYTNGISGHSGRWGVLLMNILSLGFAYELL

SEQ ID NO: 180076 - protein, 117 aa, Glycine max
  Coding DNA Sequence Number=SeqID_63298
MDWSRRIRNNRNIGRRYGFILKGSTHGLKGLQFIINKLPTRNNKYGLKFQGCPLGITSAGSSFQQYNYCMGDWFCVAGCGFGFGVIWHLLLFLGSGDNLSIKVHASDRVGVSSGVTG

SEQ ID NO: 180077 - protein, 40 aa, Glycine max
  Coding DNA Sequence Number=SeqID_63299
MEKGTSLPMEKGFKILLFPIIDSLGNPLRIFLHVVSELVL

SEQ ID NO: 180078 - protein, 123 aa, Glycine max
  Coding DNA Sequence Number=SeqID_63300
  Gene Ontology: Mol. function=nucleoside-triphosphatase activity; Cellular component=chloroplast; Biological process=nucleotide -excision repair
  Homolog annotation: Hit_ID=O98447; Match level="QueryCoverage=68%, HitCoverage=10%, E-value=2e-26, Identity=70%"; Hit description=ClpC protease
MQEENVNIMLPSLAGLTTSKPLLGIFYSCRLVVKFEGATTLDEYRKHIEKDPALERRFQPDETIQILKGLRERYEIHHKLRYTDVQLSHLNVLLPFRDRFLSDKAIDLIDEAGRLSSPSSTGT

SEQ ID NO: 180079 - protein, 55 aa, Glycine max
  Coding DNA Sequence Number=SeqID_63301
YGICDENDHGSNMILYDVLSITVVVEVTMTIIMTMAIGGGCGDSYDSCDGNDHDG

SEQ ID NO: 180080 - protein, 126 aa, Glycine max
  Coding DNA Sequence Number=SeqID_63302
MKPCGSVGKGQNFAFPIRSNGAELCKGRIVRSRVNLSGDWNFMGGSRIIVKPTATRLLLHYPKRGQMKVSFFHFSELLTGELGDFAIRSLCFKLTQWSAVILTLGKFPCILIYINISLVEAVSSSI

SEQ ID NO: 180081 - protein, 133 aa, Glycine max
  Coding DNA Sequence Number=SeqID_63303
  Gene Ontology: Cellular component=chloroplast envelope
  Homolog annotation: Hit_ID=Q01BV2; Match level="QueryCoverage=39%, HitCoverage=78%, E-value=2e-07, Identity=40%"; Hit description =Homology to unknown gene
MESSIPYVVLSILYAYLLYLSWTPETVRLIFASKYLLPELPGIAKMFSSEMTLASAWIHLLVIDLFAARHVFQDGLKNQIETRHSVSFCLFFCPIGILTHVITKAMTKPATKEGHGTLYLSQGGPKGIAMAGN

SEQ ID NO: 180082 - protein, 108 aa, Glycine max
  Coding DNA Sequence Number=SeqID_63304
  Homolog annotation: Hit_ID=Q9FF27; Match level="QueryCoverage=80%, HitCoverage=35%, E-value=3e-21, Identity=56%"; Hit description =Arabidopsis thaliana genomic DNA, chromosome 5, P1 clone:MXI10
MAICVSGSHTLFVNRSNLKTAAVMSREKKMRAQYDLKQGKSRNFHELPSGLSMEVIVQKGAEKNTNVEYPPMVFVHVSYYAARCWAEHWLPFFSSSGHDGYAISLLGQ

SEQ ID NO: 180083 - protein, 88 aa, Glycine max
  Coding DNA Sequence Number=SeqID_63305
MTTLKDFITKHNVPHDVPDESLEASSDDDDADDIPEKPQAKSKKTKLQNVPTYSVMEARLCFTVHKFSVVFFCLSLKIQDTNAGYNGV

SEQ ID NO: 180084 - protein, 110 aa, Glycine max
  Coding DNA Sequence Number=SeqID_63306
MEDHVVKRYQELMKESSRMSLFDLRKLNASLPVPSVTNCPFEILVMDAKDDFIVDTEGLVETAKFYDVSPVSVEAVAHDMMLDVSWEKGAKVILSWLKGLEKCSKLQGRQ

SEQ ID NO: 180085 - protein, 47 aa, Glycine max
  Coding DNA Sequence Number=SeqID_63307
MTKAPPSNAETTALHGSVRLLKSKEGEECEKEVKAPCCCHHGATRKR

SEQ ID NO: 180086 - protein, 129 aa, Glycine max
  Coding DNA Sequence Number=SeqID_63308
MYPFISMKLPFYPELVKAFYSNLEIQEDSLISEVYGIKMVIDQSLFFELTQLSSDGVPFEGTLDDEWKFDFSISDARQMVCTNQADMIGRLIAGSLAFECHIMHFLIVRILLPRSSNLAQVSEEDLTIM

SEQ ID NO: 180087 - protein, 88 aa, Glycine max
  Coding DNA Sequence Number=SeqID_63309
MVEFGGERGIRVRAIKFVIFVHHVFEVVVIGDKDEGVEVFVGELGGELREEVRELNRVVDNEDLGLNNSISHELGEDSLESRYHESKR

SEQ ID NO: 180088 - protein, 175 aa, Glycine max
  Coding DNA Sequence Number=SeqID_63310
  Gene Ontology: Mol. function=RNA-directed DNA polymerase activity; Biological process=RNA-dependent DNA replication
  Homolog annotation: Hit_ID=Q1S4N5; Match level="QueryCoverage=61%, HitCoverage=29%, E-value=1e-24, Identity=44%"; Hit description =Peptidase M, neutral zinc metallopeptidases, zinc-binding site
MWVSRERFPADFRREEKENSDIRQEDDKEKREGKTLTRPVSMEEVKQIVFSMSPCKAPSPDGFQQIFSRTYWDIVSIEVRELISTTYTTGLVYRLCPSMYSLIDPFHSSFIPNRSTTDNTFVAQEIVHRHKKKGRTDYLFFKIDFEKACNRVNLISSEPLFYMQNLWFPELFAIK

SEQ ID NO: 180089 - protein, 48 aa, Glycine max
  Coding DNA Sequence Number=SeqID_63311
MDFECRELQCGHRGHVELHSSVRGAIVAIHHVTEVLAGAEGLGQTLHR

SEQ ID NO: 180090 - protein, 74 aa, Glycine max
  Coding DNA Sequence Number=SeqID_63312
MDQLKRLSIPSEILRFFNLACHPRLGHPTRSVHLPPMNIQYILSQPTLRREGDTRLTDASSKKGKCAESPPTFI

SEQ ID NO: 180091 - protein, 66 aa, Glycine max
  Coding DNA Sequence Number=SeqID_63313
  Subcellular localization annotation: CTP_CleavageSite=45; ConfidenceScore=5.06e-01
MRSAKFRLAQGTVTLFSNFTPQRGIGGGIVFCGGFFSNGAEEYVMGSVESQGFRGVDERFGECFSC

SEQ ID NO: 180092 - protein, 303 aa, Glycine max
  Coding DNA Sequence Number=SeqID_63314
STAGDLIPIVLEINATCRRRNAEKNRKFLQDLEAAATPEEKARSSEVSSRFPIPGKSHIDLIEEVIMAEEPRRVTLEDYCQVCCNFSPALHNQREAKRWLHSFKGNSLKTWDKVVEKFLKKYFPEFKTLKTPEEAMDLIENMAASDISILKDRSHIPTKKGLLELTSQDALLAQNKLLSKELEALTETLTHNSGCCIPNEEPVYEANYMGNQPRQNFNAVPVGQLAKQLADRLSSSFSANTEKNPKDECKAVMTRRRMPIQADESKAEEKVEGYKQQLAAEPTLEPVSDFVELEEVVEDEDDQ

SEQ ID NO: 180093 - protein, 227 aa, Glycine max
  Coding DNA Sequence Number=SeqID_63315
EGGGVVNGGQGHGSGFGAGGGVGGIGGGGGGGGGGGGGVGNGGQGHGSGFGAGGGVGGIGGGGGGGGGEGGGVGNEGQGHGSGFGAGGGVGGIGGGSGGMSGMGGGGGGGGGGGGGNGWQGHGYGSGFGGGTSNGGMGGGGGGGSGGGIGNEGYGHGNGFGAGIGMGVGGDGGKEGDYKGSNNSKGGSNDHGVNNGFGIGFGMGLGFGFGIGSNGAKVTNQGDVNDP

SEQ ID NO: 180094 - protein, 146 aa, Glycine max
  Coding DNA Sequence Number=SeqID_63316
  Gene Ontology: Mol. function=ubiquitin-protein ligase activity; Cellular component=ubiquitin ligase complex; Biological process =protein ubiquitination
  Homolog annotation: Hit_ID=Q1SEL7; Match level="QueryCoverage=87%, HitCoverage=19%, E-value=7e-07, Identity=29%"; Hit description=Zinc finger, RING-type; U box
MVKEETTFGKNNFVVAIFGLLLRRKNHVIVLSTGAVSVLVNTLASPGNANLVTDSLDILVALVESVEGAYALLRVEALPLVAKILQSATSRSGEDVLAKETSIMSSLYSLLTDGTLHAAKKARALINVILKFNEKRFSGTVGSSVS

SEQ ID NO: 180095 - protein, 192 aa, Glycine max
  Coding DNA Sequence Number=SeqID_63317
  Gene Ontology: Mol. function=magnesium ion binding; Cellular component=chloroplast; Biological process=metabolic process
  Homolog annotation: Hit_ID=Q5SBP3; Match level="QueryCoverage=97%, HitCoverage=32%, E-value=2e-40, Identity=47%"; Hit description=R -linalool synthase
  Pfam annotation: Domain name=Terpene_synth; Domain location=1-162; Score=114.8; E_value=2.5e-31; Accession=PF01397.11; Description =Terpene synthase, N-terminal domain
MALLNSSDPIKILKMIDTIQRLGIEHHFKEEINVQLGKLGDWDVTQDLFGTALQFRLQRHNGWPSCSDVFKKFLDKSGTFKESITNDIWGMLSLYEASYLGAKGEEVLQQAMDFSKAHLHQSLPHLSPELRKLVAKALTLPRHLRMGRLEARNYMEKYSQATNQIPALMELAKLDFAMVQSMHQKELAEISR

SEQ ID NO: 180096 - protein, 221 aa, Glycine max
  Coding DNA Sequence Number=SeqID_63318
  Gene Ontology: Mol. function=magnesium ion binding; Cellular component=chloroplast; Biological process=metabolic process
  Homolog annotation: Hit_ID=Q6USK1; Match level="QueryCoverage=97%, HitCoverage=38%, E-value=6e-60, Identity=50%"; Hit description =Geraniol synthase
  Pfam annotation: Domain name=Terpene_synth_C; Domain location=1-167; Score=49.4; E_value=1.2e-11; Accession=PF03936.6; Description =Terpene synthase family, metal binding domain
MEQLPEYMKICYMALFNTTHEIAYKIQKEHGQTVVACLKRTWIDIFEAFLKEAKWFNNGYIPTFKEYLDNGVISSGSYMALVHATFLIGDSLSKETISIMKPYPRLFSCSGEILRLWDDLGTSREEQERGDNACSIQCLMTENNLSDENVARKHIRQLIQNLWPELNGLAMTTTALPSSVMKASLNMARTAQVIYQHGDDQNTFTVDDYVKTLILTPSSNY

SEQ ID NO: 180097 - protein, 140 aa, Glycine max
  Coding DNA Sequence Number=SeqID_63319
  Pfam annotation: Domain name=zf-CCHC; Domain location=67-84; Score =21.0; E_value=0.00034; Accession=PF00098.13; Description=Zinc knuckle
MTTKGIALKALSSIQEESDKEDLNEIEEYDDFRLFVKRFNKFLRNKGNQRRSNINRKKKGEDSSLAPKCYECDQPGHLRFDCLIFKRRMEKSDKRNFKEKKEKKACITWEDNDMDSSSDSENEIINLDLMAKDYESGEEN

SEQ ID NO: 180098 - protein, 33 aa, Glycine max
  Coding DNA Sequence Number=SeqID_63320
MEQNPENKVKCQIVDIMEELSASESPTNSSAQV

SEQ ID NO: 180099 - protein, 334 aa, Glycine max
  Coding DNA Sequence Number=SeqID_63321
  Gene Ontology: Mol. function=hydrolase activity, hydrolyzing O -glycosyl compounds; Cellular component=vacuole; Biological process =carbohydrate metabolic process
  Homolog annotation: Hit_ID=Q6S9W0; Match level="QueryCoverage=99%, HitCoverage=96%, E-value=1e-118, Identity=64%"; Hit description=Endo- 1,3-beta-glucanase
  Pfam annotation: Domain name=Glyco_hydro_17; Domain location=32-334; Score=524.5; E_value=1.1e-154; Accession=PF00332.9; Description =Glycosyl hydrolases family 17
MSVSAILLLVEILSSIGVLEFTAAAPLVAPIVGICYGINGNNLPSKQEVVDMFKSRGIPRMRIYSPDEEIIQALRGSRIELVMDVAGDTIQSLTDPNVAADWVHRYITSYSQDVNFKYIVVGNEVHPNYDLAPYILPAMTNIQNAISSANLVTKVSTAIDTTLVTNSYPPNNSVFTADASPYIGPIINFLVKNEAPLLANLYPYFAYVNNQKDIDLHYALFTQQGTNDIGYQNLFDAMLDSIYAALEKIGAPNLEVVVSESGWPSAGGDGALVDNAHVYYFRLIKHAYSGSGTPKRPGRPIQTFLFAMFDENQKPGAEVERHFGIFNPDKSPKY

SEQ ID NO: 180100 - protein, 47 aa, Glycine max
  Coding DNA Sequence Number=SeqID_63322
MVNGLDKYNGVGHGSMDIGIPCIESLPSKNGKVEHHISEDKTYKPEP

SEQ ID NO: 180101 - protein, 90 aa, Glycine max
  Coding DNA Sequence Number=SeqID_63323
MDKCQRRSPQCGCSHGSAGNFDTRRKKKNDRVQAQGERRRTIGFKLGFYKTDVNNGILTSVLKKPMLTKSTYLQKCHRAFVNIGFSYNRC

SEQ ID NO: 180102 - protein, 144 aa, Glycine max
  Coding DNA Sequence Number=SeqID_63324
  Gene Ontology: Mol. function=DNA binding; Cellular component=nucleus
  Homolog annotation: Hit_ID=Q1SIZ3; Match level="QueryCoverage=88%, HitCoverage=67%, E-value=2e-16, Identity=40%"; Hit description =KNOX1; KNOX2
  Pfam annotation: Domain name=KNOX1; Domain location=28-67; Score=9.4; E_value=0.075; Accession=PF03790.4; Description=KNOX1 domain
  Pfam annotation: Domain name=KNOX2; Domain location=91-142; Score =30.3; E_value=6.7e-06; Accession=PF03791.4; Description=KNOX2 domain
  Pfam module annotation: Pfam domain module=KNOX1::KNOX2; Domain location=28-67::91-142
MEARQIGENGSGRKGVEESDVEIKENEEVLKKIIASHPLYEVLIQSHINCLKTLVSVLDGSIIFGKVGLSEAGEFDATSEAWNKLVNSKSKATPSPNTSELDHFMEAYCMALSKLREAIEEPTKETNAFIRATYLQLKELNELN

SEQ ID NO: 180103 - protein, 189 aa, Glycine max
  Coding DNA Sequence Number=SeqID_63325
PVYPLQGHHICPEKGKANWEHLLANMVEASVNWFPRWKEGRVGVLSSCEGFSNIPLMGMRGCINYNLILAIRQLGYPMRRASAMQRKDRELTGSSNGIIGNYHKWLKTKTQELDWLSKLKASIEEEAKTPKESEEVQALKVELERAQEVKEKFKTTAIKVQKECNKLRGVNVATVEALERETKRARKEE

SEQ ID NO: 180104 - protein, 65 aa, Glycine max
  Coding DNA Sequence Number=SeqID_63326
MTDVINGAVLVLQLAKAAQLVTLKGASSAALRIAIAKNAETLCYMLNLNCALQSAISDLTTFAPT

SEQ ID NO: 180105 - protein, 101 aa, Glycine max
  Coding DNA Sequence Number=SeqID_63327
MIDQTSAAEFESVGGVLQHRAHLGPSGSFNRKQPARLAKQGYFWRKPPARLGELSGNLLPYFGYKRVWEAIGKGSTPWESIFHLKLVKRRKKKKIKAEALP

SEQ ID NO: 180106 - protein, 168 aa, Glycine max
  Coding DNA Sequence Number=SeqID_63328
MRIDEFCVLYHSGRISWVVNAQRQILRLLSFRSSESSDFASWVINEQRQILRPLSFRNNKLGETNYGHSAHLFAIQRRSCPVARRDKLWSFCVSPPRLDHVQQNAETNYGYSVSCINQKEQIRQYQDDVSVLIIFKFLEVLLAGRFTGRMVFHLNEISVLSLLPFYLQ

SEQ ID NO: 180107 - protein, 134 aa, Glycine max
  Coding DNA Sequence Number=SeqID_63329
MAGMSEYTHIYEYLVRKFGSVLPLSDFQCVILCTLNCAPSQLHPRLSMPLSSYVKGSTKLQLSIALLKLHSDEVVLRDYICNFIPITDTEDHLHQGYKQKMKLQAETVGKPFAEGSSSLLFGASSSLVFVVPNP

SEQ ID NO: 180108 - protein, 123 aa, Glycine max
  Coding DNA Sequence Number=SeqID_63330
MVECAGWLSPKSGWYFSRDEGDDQRIQATIWASSSAYLESSYLANSLVDPHESDLHDIRGSDDKRVIFDVDVGRKGALSIVYFDDVQDFSGSEVGNEEVRDGEFDGEIGDEIGGEVLADTEYD

SEQ ID NO: 180109 - protein, 116 aa, Glycine max
  Coding DNA Sequence Number=SeqID_63331
MEGLITQCAEYVKKFGLEMSPSSGCCYEIKNADTPCLCQHFTKALLEFIDIQKDIYILRMYNVRGLTQPQKLAQGTWIISNTPPHAKHFLNLMREKQMVGACHHKARASGSVVLGS

SEQ ID NO: 180110 - protein, 102 aa, Glycine max
  Coding DNA Sequence Number=SeqID_63332
MELDWVCTGYAWMSRLLILALQMKLHYTYFCVRGSIMECQKVKDFMKAIDEQFETSNKVLASTVMARLSSMKLIGVKGVRKHIMEMRDLSAQLKSLEVDISK

SEQ ID NO: 180111 - protein, 293 aa, Glycine max
  Coding DNA Sequence Number=SeqID_63333
MWVERLVFVFVVVVHAFSGLGFGAIGGRFWCYNLWSQNMCWGTHEVFFMYAGGDKSLLLDIDEDKKCNLPPPIVEELENEGIVIQPVNEANAAGVPQKNPGSKTMKKAKLSSSRSVKAQPSGMATSLAQLASQSTSEAQSPSQAASQAVTRLSFESAKSTKLGTGAPTKMVRKSERSTPIQNVFLTRIDSLKKFLELTKGQSINNVSQQQGDRRVEDKAKGTSFVVQVEGTSTWVVVTENKRGYISCGSVQVEGTSTWLFKENKGRYIPCGSLLVKDFTRLKRNLKDRRSLGD

SEQ ID NO: 180112 - protein, 178 aa, Glycine max
  Coding DNA Sequence Number=SeqID_63334
  Gene Ontology: Mol. function=nucleic acid binding; Biological process= DNA integration
  Pfam annotation: Domain name=zf-CCHC; Domain location=33-50; Score =18.5; E_value=0.00088; Accession=PF00098.13; Description=Zinc knuckle
MSKGTLTVTHNNGKKEKKEKKHIPPIAKIKKESTCFSYKKKGHMKKNCYKYKTWLGKKGYSFSFVSFEYNMIDIIHDTWWIDSGSTIHISKTMKGFSSQRQPSKGMDVFKVFKAIVKKQCEKQIKIVRLDRGGEFYGKYIENGQAPGPFAKFLQEHGIVAQYTMPGSSDQNGTSKRRN

SEQ ID NO: 180113 - protein, 112 aa, Glycine max
  Coding DNA Sequence Number=SeqID_63335
  Gene Ontology: Mol. function=nucleic acid binding
  Homolog annotation: Hit_ID=Q1SKZ9; Match level="QueryCoverage=75%, HitCoverage=19%, E-value=6e-24, Identity=47%"; Hit description=Zinc finger, CCHC-type
MGDKPIPAPKSKIDLIEHKLARIEFEGGFEILDIGNGYFMVMDEGPWMLFNHYLTVQHWTPKFLSPTIKAEKTFIWIRFPGLNLLYYDENILLALVETIGNPVRVDSNMKDI

SEQ ID NO: 180114 - protein, 87 aa, Glycine max
  Coding DNA Sequence Number=SeqID_63336
MELLTQVGFLGIAQNTFFLYDNNLISTLVEHWRPKTYTFHMLVGVFCRVYPLTVVTMVLMGGGWVQWSWRYRGEATAWKGKDKNEIL

SEQ ID NO: 180115 - protein, 195 aa, Glycine max
  Coding DNA Sequence Number=SeqID_63337
  Gene Ontology: Mol. function=sequence-specific DNA binding; Cellular component=intracellular; Biological process=DNA metabolic process
  Homolog annotation: Hit_ID=Q5W9E7; Match level="QueryCoverage=77%, HitCoverage=23%, E-value=3e-42, Identity=57%"; Hit description =Endonuclease
MILKLMQGFFGTGSEPEDLTKKGKRTKGTKRYMPQRNSVAYALLITLYRGTSSGNEFMHKQELIDASEASGLSRVPIAPEKGKGKPGHFGSSSRDWYSGWSCMKTLIAKGLIVKSSCPAKYMLTQEGKEAARDCLARSGMAESIEMSSSVEIPSCMDNQNLLDVELNGHDLESEVLSPLTQQKKPIDVPLDCLER

SEQ ID NO: 180116 - protein, 124 aa, Glycine max
  Coding DNA Sequence Number=SeqID_63338
  Homolog annotation: Hit_ID=Q5W9E7; Match level="QueryCoverage=40%, HitCoverage=7%, E-value=1e-08, Identity=52%"; Hit description =Endonuclease
MGYSKEHIIGAFTEVSKSHPNKDVSSLWPAVLCHLREEQVYGSQPESQRSRDLIVKDSRAVSLHVRNICSHDIPPFTLRACSSAVWFDPFAKIDLLFILCVLSNRRGAPLQVPVRLERGSQAGQ

SEQ ID NO: 180117 - protein, 211 aa, Glycine max
  Coding DNA Sequence Number=SeqID_63339
  Gene Ontology: Mol. function=sequence-specific DNA binding; Cellular component=intracellular; Biological process=DNA metabolic process
  Homolog annotation: Hit_ID=Q5W9E7; Match level="QueryCoverage=87%, HitCoverage=21%, E-value=9e-34, Identity=47%"; Hit description =Endonuclease
  Pfam annotation: Domain name=ERCC4; Domain location=84-170; Score =31.6; E_value=2.1e-06; Accession=PF02732.6; Description=ERCC4 domain
MQNPNKDELVSKLNILNVPPLSLGERFEDAYDVVLILDDREQFATQGSRSRKIIENIRSQFKIQIEVFSLCGNSIIGNEQKIGRERRKEGFFYSDEQKGNSRGRILLQGEVRRLPVGDGIWIARHKTLNSEYVLDFIVERKKTNDLCSSIRDNRYKDQKLRLLNFGEDIIQWLLYNLKACHTDIASSFPTSQSNCSLLEVWAEEADISCGR

SEQ ID NO: 180118 - protein, 238 aa, Glycine max
  Coding DNA Sequence Number=SeqID_63340
  Subcellular localization annotation: CTP_CleavageSite=17; ConfidenceScore=5.36e-01
MTTPPSSLPPPESAPLSSSPKKTRKATQLRSLATKPVGMERLVVHVDPFARKVDGPHKKKLRTYLGIISRYKIEFDIPEASNQRTKKKILKTSRRDPSWEDVRKKAQAIQKVNTAPHVLSHGGTIIDPPSPIRRHVKWKLARTKKSREMTSEVAQEIVDRIQSAQGSFVAHGHQDVLTTAIGQPEHSGHICTVGASLTIRQYFGPDSKSSRTSTSITPKELELLAQKIRDQLEYQMQS

SEQ ID NO: 180119 - protein, 71 aa, Glycine max
  Coding DNA Sequence Number=SeqID_63341
MNVEFTERCLLWSLLEWGFNDIQGSKFKATTKWIPIKYFTNPTPLEPERLKAIRIQWARCYLKVKNKTLGV

SEQ ID NO: 180120 - protein, 69 aa, Glycine max
  Coding DNA Sequence Number=SeqID_63342
MDEHQQNWKEMANIMMKIHKESDELFNTVHVTDQPYGEVGRSFAIRWKNELEPMWHLLLIEAVPESNKH

SEQ ID NO: 180121 - protein, 169 aa, Glycine max
  Coding DNA Sequence Number=SeqID_63343
  Homolog annotation: Hit_ID=Q9ZU94; Match level="QueryCoverage=45%, HitCoverage=28%, E-value=7e-09, Identity=40%"; Hit description =Expressed protein
MITKDDDKGDDKKLKGQSKNNSRYILCGTSRGYIYLGLTENKRGYLSCGSVLVEGTSTRFKENKGGYIPCGSLPVKGFLQVTRSNKAEVVELGDRMRHAARALVVGEVAVTLEEAIDDIEGCGDNEVVVVGKGNGVDEGGEERVEGVFIGETQHELGLGENLDDNDRDS

SEQ ID NO: 180122 - protein, 145 aa, Glycine max
  Coding DNA Sequence Number=SeqID_63344
MLLYFDWLLMKHIKDKLILTNNGYDENVTIKLCLAGEPEEVIKARSMYFDWLSLEHIRDELILNNDGYDENVIVESCLASEPVCLRRSTTPITPQMKAINTIVMKKTHISRKRPQTEGANYEYIQINFDEGHQANLARSDGKIAH

SEQ ID NO: 180123 - protein, 77 aa, Glycine max
  Coding DNA Sequence Number=SeqID_63345
MAPVKLAIQLSSHWHWRFGGVSPLALAKHVTWRWGGVTNMAGDYLLNKGFASGSGGITFSPIKRPYTNEWKQAVRNL

SEQ ID NO: 180124 - protein, 59 aa, Glycine max
  Coding DNA Sequence Number=SeqID_63346
MAFNRRDEFNAFQTHPNDLEFTGVFSPAIEKIVVLDFPSNLVKAPAWDEVGLFFTRTGK

SEQ ID NO: 180125 - protein, 142 aa, Glycine max
  Coding DNA Sequence Number=SeqID_63347
  Gene Ontology: Mol. function=sequence-specific DNA binding; Cellular component=intracellular; Biological process=DNA metabolic process
  Homolog annotation: Hit_ID=Q5W9E7; Match level="QueryCoverage=98%, HitCoverage=21%, E-value=4e-51, Identity=69%"; Hit description =Endonuclease
CFTTEILEGFDVQRTSGLGDTLRKYGYLTQAISQYYKSEIFEDNVKGSGACPPFDEFIKRCQDLEKTTVSDVFAMQLMQVPQVTEEVAMAVLDLFPTLFSLARAYSLLDGDGCAQEEMLRRQSNSVINAVASRNIFQFVWGS

SEQ ID NO: 180126 - protein, 128 aa, Glycine max
  Coding DNA Sequence Number=SeqID_63348
MGWFGLVNGWGWLVHFATPTCRLWELLGAPSKIAVAPSNFLEFPKYPLMFPRKNLFPPLMLQLWKNLLPCHLMEELLPQEATEEGSSVVANYNYGRTFFFTVVTLTAVFRVISRKNFFRRKPRKNLLS

SEQ ID NO: 180127 - protein, 88 aa, Glycine max
  Coding DNA Sequence Number=SeqID_63349
  Subcellular localization annotation: CTP_CleavageSite=25; ConfidenceScore=5.38e-01
MVSFVQDNSLSGGNRLPTSIMSSCRCQRPQVDPNFVRGLSFANVLSPASRIELFDTSYHARRKIIQCFGEECKKYPRGGKKDHFRLFF

SEQ ID NO: 180128 - protein, 105 aa, Glycine max
  Coding DNA Sequence Number=SeqID_63350
MVRKESETCKVGKITLTFNSVMQDSAPSKIAGAPSNYVIGQNCPCLKNAILNCGRTFFRRKPRKKILPQLKITTAQETSSMDSCRRTSSAISHGRRFSRCCYFQL

SEQ ID NO: 180129 - protein, 902 aa, Glycine max
  Coding DNA Sequence Number=SeqID_63351
  Gene Ontology: Mol. function=RNA-directed DNA polymerase activity; Cellular component=chromatin; Biological process=one-carbon compound metabolic process
  Pfam annotation: Domain name=Chromo; Domain location=828-875; Score =24.4; E_value=0.0004; Accession=PF00385.14; Description='chromo' (CHRromatin Organisation MOdifier
  Pfam annotation: Domain name=rve; Domain location=527-683; Score =109.3; E_value=1.2e-29; Accession=PF00665.16; Description=Integrase core domain
  Pfam annotation: Domain name=zf-H2C2; Domain location=468-509; Score =12.6; E_value=0.0077; Accession=PF09337.1; Description=His(2)-Cys(2) zinc finger
  Pfam module annotation: Pfam domain module=Chromo::RVT_1::rve::zf -H2C2; Domain location=828-875::99-268::527-683::468-509
MATQRVAALFHIHLQEPGPVTFPTSIPPPIHRLLQKYSPLFQPPESLPPPRPTDHAIHLEPNTKPVNVRPYRYPYFQKHEIERQVEDMLRRQLIRPSRSPYSSPVLLVKKKDSTWRFCVDYRALNEVTIKDRFPLPTIDELLDDLGHSSWFSKLDLAQGFHQIRMVDSDIPKTAFRTHQGHYEYVVMPFGLCNGPSTFQATMNDLFRPFIRKFVLVFFDDILIYSRDFQTHLDHLERVLQTLQQSHFHLKASKCIFGQRRIEYLGHFVSIRGVEPDPSKLQAMQQWPTPTSPRQIRGFLGLTGFYRRFVKNYARVAKPLTRLLRKDQFAWSTEAQSAFDDLKAAMTSTPVLSLPDFTIPFVVETDASGAGMGAAGHSNVVADALSRRAEDDNTAAMYSILSIPHPKFLEDLKRELASSVEFNALKKRVTDDPQQHPAFTLRDDLLLYKGRIWINSSSSFIALLLEEFHKSLLGGHMGLAKTLSRIQQSFYWEGMHQDTQKFIKQCVDCLQTKYVPQKPAGLLQPIPPPSRPWEDLALDFITGLPNSQGATVIMIVVDRFSKGAHFGSLPSHFTAHTVAQLFIDSVCKLHGFPRSLISDRDPIFISRFWKELFRLCGTKLRMSTAYHPQTDGQTEVLNRVLEQYLRSFVHHKPTQWGKFLSLAEWCYNNTCHSSTNLSPFEVTYGKPPPAIINYLPGSSSVEAVDFLLSSRQHLFETLRQKLERTQAKMKTLADTHRRDTNFNIGDWVYVKLRPYRQTSIADKYQKLGKRFFGPYQITDSIGKVAYRLALPPSAKIHPVFHCSKLKLHQGPITTDHLLPPTSWDNNPVIEPLTILDHKWDINDPPQLLVLVQWASLQPKDSTWENWAELKTQYHLEDKVFFDDMRNDSTAASRPKRATKKPLD

SEQ ID NO: 180130 - protein, 294 aa, Glycine max
  Coding DNA Sequence Number=SeqID_63352
MARVAKVVKILAQELDRVKQNRNGVVGIPRKRLEERAEAWADQGDKENPIIVVLDDAYDTFDLRCEKSSVRIVYCTPALYVWLVSHVFHHEGMVGASVSWFPRWKEGGTKVLCSCEGFPNVPLMGTRGFNEGNAKILQRIHKAWNIVERKDKELMESSNGVIDGYHKWLRSRMQGTAWLPKLKGLSGKEPEVLEESEEVQVMKVEFAMQDGTLFDVSIIMRKIPKWDGQRVILELFLTPGLPRLASGSLGPPNSLGINQVPSFPINKREEGLKKGLSFQTLKEFSEIEEEKKKK

SEQ ID NO: 180131 - protein, 102 aa, Glycine max
  Coding DNA Sequence Number=SeqID_63353
MERLDLEEMSVVKGEPLAISSVLQLLTLLATDDAMVYIKSSPGGIIVEKDVCGASDGGGDYHQLDESQRLLLDVMTTQMQRLLNCNNEKLYRRIEGLENQLN

SEQ ID NO: 180132 - protein, 113 aa, Glycine max
  Coding DNA Sequence Number=SeqID_63354
  Gene Ontology: Cellular component=nucleus; Biological process =regulation of transcription
MNGEDRGKYLTHTLNTCAKFIESGSFMSADIGLDYIAHIASLYGDAMQRVATYISIGLAFQVLKNLHGVPKSINLPTTMSTSEEQLVKSHAIAEAMEAEEVIHIIDLDASDAA

SEQ ID NO: 180133 - protein, 180 aa, Glycine max
  Coding DNA Sequence Number=SeqID_63355
  Gene Ontology: Mol. function=nucleotide binding; Cellular component =chromosome; Biological process=chromosome organization and biogenesis
  Homolog annotation: Hit_ID=Q9FJL0; Match level="QueryCoverage=89%, HitCoverage=17%, E-value=4e-43, Identity=48%"; Hit description =Chromosome condensation protein
HEGASEAFEDAQKHMKSISETIKSKTASISQINSDIEKRKHEASEAHQIEEECIKEQDELIPLEQSARQKVAELKSVLDSEKSQGSVLKAILKAKETKQIEGIYGRMEKQVDLLLKLKKNVSTLEGVPRLFDLVKVQDERMKLAFFAALRNTVVAKDLDQVSCTFVAGCFILMINIKDPS

SEQ ID NO: 180134 - protein, 204 aa, Glycine max
  Coding DNA Sequence Number=SeqID_63356
  Homolog annotation: Hit_ID=Q27JA0; Match level="QueryCoverage=66%, HitCoverage=74%, E-value=2e-32, Identity=51%"; Hit description =Dirigent-like protein pDIR12
  Pfam annotation: Domain name=Dirigent; Domain location=19-186; Score =165.5; E_value=1.4e-46; Accession=PF03018.5; Description=Dirigent -like protein
MAAPLQFFFLFTLTLFSSSFSEQSHIELPSNNNNPNPNPLQKLSNLHFYYHDIRDNENPTIVQIVDTPKNVPNGFGSTFVMDDAMTEGPELSSKHVGRAQGLFGLASLQDLGMFMLTNFAFTEGAYAGSTLSMLGRNPISEQNRELPIVGGTGVFRFATGYAIANSVNSVSTPQHFVVEYNVTPFVVRPWEYVCLVAPRVRSSK

SEQ ID NO: 180135 - protein, 254 aa, Glycine max
  Coding DNA Sequence Number=SeqID_63357
  Homolog annotation: Hit_ID=Q45W75; Match level="QueryCoverage=55%, HitCoverage=67%, E-value=2e-35, Identity=53%"; Hit description =Disease resistance-responsive family protein
  Pfam annotation: Domain name=Dirigent; Domain location=80-253; Score =155.1; E_value=1.9e-43; Accession=PF03018.5; Description=Dirigent -like protein
MDGDEEHAFAVLLVLNSRESHSARAPRVATDNIKYRNIIDSKQTKTKSISTNKCFIGIRWHATMVVPLRHFLVFSLTLISIIFHTHGAFSEQSIIKLPTDQPRVEKLTHLHFFYHDILEGKNITVVKIIEPSASEVREATGFGTTFMMDNVLTEGPELSSKHVGRAQGLFGLASLEDRGMVMLINLAFSEGEYAGSTLSMLGRNPVQDTVREMPIVGGTGVFRFAKGYAIAKSLWEISDNEHFVVEYHVTVSHP

SEQ ID NO: 180136 - protein, 75 aa, Glycine max
  Coding DNA Sequence Number=SeqID_63358
  Homolog annotation: Hit_ID=Q27JA5; Match level="QueryCoverage=75%, HitCoverage=30%, E-value=2e-10, Identity=54%"; Hit description =Dirigent-like protein pDIR7
MASLLSLLFACHLIVSITLSILGRNPALENVREIPIVGGSGIFRCARSSIVFTTYMYNADFGAAIVEYNVSILHV

SEQ ID NO: 180137 - protein, 67 aa, Glycine max
  Coding DNA Sequence Number=SeqID_63359
MAKFGTPSSVDMVAIVGDVDGDGVDVGIGDSPRASIEDGNGLPSVGGVDDIGATSANLIGIDTLDED

SEQ ID NO: 180138 - protein, 87 aa, Glycine max
  Coding DNA Sequence Number=SeqID_63360
MVSFNPFAAARLRSGFAFFLFRLVPPHDWPSRGWRVDHEELAFICEPHNLFVKREEEMLEEVESFGYWIGKREEERRKMRNGREIWL

SEQ ID NO: 180139 - protein, 139 aa, Glycine max
  Coding DNA Sequence Number=SeqID_63361
  Gene Ontology: Mol. function=nucleic acid binding; Cellular component= nucleus; Biological process=DNA integration
  Homolog annotation: Hit_ID=Q1S3Z1; Match level="QueryCoverage=80%, HitCoverage=10%, E-value=1e-17, Identity=36%"; Hit description =Integrase, catalytic region; Zinc finger, CCHC-type
MGAINSKGFSCWVEGKVMQIRGKRKFMVMQGTKQGNLYILQRSIVTGSISVVSQFGSHVSNGLSDNSLWHLCMDILSNRGLCRNHKMKFPKVVHIAKPMLNYIHSEYWGPSKVPSLGGARYFLSTIDDYSRMTWVFMMK

SEQ ID NO: 180140 - protein, 123 aa, Glycine max
  Coding DNA Sequence Number=SeqID_63362
MTFIGPPNEGRYITKEHLDELNSILLELCDIDVKMEDKDLKMVLLTSSPPSYENFVSCLSVGKDSIILEEVKEKKKKGKGGKKRKIDLKDIYIYCKKIDHGSETVQRKQNKIMLLLLFKMAPY

SEQ ID NO: 180141 - protein, 298 aa, Glycine max
  Coding DNA Sequence Number=SeqID_63363
MGEIEEVQERMKAYMEAMIEKIATMIEAMMSMKKIMEVNAAAVAATSVIAKVDPTPPSGLNQINHPTLDMVGRGGKELGSTGDPHFVQVQNKHAFPPYSLPPNYTPPNVSHTPDENVDSSAPIPIESQQPQSDHAHVSQPMGETREVPHHNLADFEPRLGYATEGQTVGGVPLPNTLEGPQFCPQPPPLRFAVRRVPPAMVEREKFDHIEERLKAIERGGDYAFANMAELCLVPDIVIPPKFKVPDFDKYKGTTCPKNHLKVYCRKMGTYSKDEKLFQKSKYCFKVQRLNDSLHFSKF

SEQ ID NO: 180142 - protein, 262 aa, Glycine max
  Coding DNA Sequence Number=SeqID_63364
  Homolog annotation: Hit_ID=Q9FNA2; Match level="QueryCoverage=31%, HitCoverage=17%, E-value=7e-18, Identity=60%"; Hit description =Polyamine oxidase
MAWLAAQLEFANDDTLIHIKLIKHITRIMEQSNRQKEAKNGNRSCLSAAIIDVVSHIGVFEEASSKAEFNDVVSRIGVIREAGPKLRFSDEFPNKIGLFPTNFDNPSGYDLDGYIVEVFLLDPVADVVYSLQDYEVFTLFSTNTFVMEIPFTKENSYLLIFKNEDVEIGRIIMTMVLTEDTDIDNDDRGARGRIHEMEEKIEECGREKEKNNEEYKMGACTSKAKVVGNESSRVEHDSTRLDSIRNDLTHRLTRVRYDPLFL

SEQ ID NO: 180143 - protein, 122 aa, Glycine max
  Coding DNA Sequence Number=SeqID_63365
  Gene Ontology: Mol. function=ubiquitin-protein ligase activity; Cellular component=ubiquitin ligase complex; Biological process =protein ubiquitination
  Homolog annotation: Hit_ID=Q2HVY1; Match level="QueryCoverage=99%, HitCoverage=29%, E-value=2e-41, Identity=68%"; Hit description=U box
  Pfam annotation: Domain name=U-box; Domain location=5-80; Score=72.1; E_value=1.8e-18; Accession=PF04564.6; Description=U-box domain
MDEIEIPAHFLCPISLQLMRDPVTVCIGITYDRENIERWLFSCKNNTCPVTKQCLLDHGLTPNHTLRRLIQSWCTLNASLGVERIPTPKSPIDKTHCETPHRSKKVPREASQVPHKASIRCL

SEQ ID NO: 180144 - protein, 82 aa, Glycine max
  Coding DNA Sequence Number=SeqID_63366
MVCVFHSGGSCASIIPSMTKCQRLMLSELVVRWRESLHATWLKGSFPSAPRWISNVLSRFGRIYSRWCSSVYSSMNGGGVYL

SEQ ID NO: 180145 - protein, 147 aa, Glycine max
  Coding DNA Sequence Number=SeqID_63367
  Gene Ontology: Mol. function=RNA-directed DNA polymerase activity; Cellular component=intracellular; Biological process=RNA-dependent DNA replication
MSREIEESIAQVVTKNVGLFAWSTLDMLGINPKFHNHRLAIYLEARPIAQRKRKLNTAKMCTNYTDLNKACPKDSYPLSSIDHLIDGASKFSSSIPMCKQDEEKIAFMTDTDNYCYLVMPFSLKKVEATYQRFMDKIFVNHLGKKSM

SEQ ID NO: 180146 - protein, 163 aa, Glycine max
  Coding DNA Sequence Number=SeqID_63368
MAQISHQLNNINTQPILALLITHHPINQEHLIIHKRPPLNYPIPNTTLNTDQNTNQGRKFPAKKPIEFTPILVSYANLLLYLLNNIMVALTLVKVPQPPFFQRYNSNTTCAYHGGVSGNSIEHCMTLKHKVQNLIDAVTCAPELISKSVQLDSAHSIRLVRVS

SEQ ID NO: 180147 - protein, 96 aa, Glycine max
  Coding DNA Sequence Number=SeqID_63369
MVLMVEINIRPLESALIKKRNVSLNLMQKIKRKTGKLKEDQWFKKIELHHSHATHAWWSPKHHCNEDTHPNPSYGNDSSPGCRDGARVKSFWGPCS

SEQ ID NO: 180148 - protein, 197 aa, Glycine max
  Coding DNA Sequence Number=SeqID_63370
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=P24095; Match level="QueryCoverage=83%, HitCoverage=29%, E-value=1e-40, Identity=64%"; Hit description=Seed lipoxygenase
  Pfam annotation: Domain name=Lipoxygenase; Domain location=1-192; Score=-258.8; E_value=1.9e-05; Accession=PF00305.9; Description =Lipoxygenase
MGLDGSVPGFSSPSSHSALVLTIEYDNDSVFGVSFISIEYSMEMSSAVYKNWVFTAQALPTDLIKRGLAVDDHTSPHGLRLVIKDYPYVVDGLEIWDAIKTWVQEYVNLYYSNDKAVEKDTKLQAWWKEVMEKVMEMLSRHSSDEIYLGQRDTPNWTSDQNAKDFFETFTKTLVEIEKKILERNNNQELKRKETKQH

SEQ ID NO: 180149 - protein, 79 aa, Glycine max
  Coding DNA Sequence Number=SeqID_63371
  Subcellular localization annotation: CTP_CleavageSite=21; ConfidenceScore=5.03e-01
MGLTNFVLTVAGVSAVVLLLRSDVKQSASIFRRNVKHIRNWLEEESAASSKESGELMASGNTHLFSANVDDDLDGDDAS

SEQ ID NO: 180150 - protein, 213 aa, Glycine max
  Coding DNA Sequence Number=SeqID_63372
MGCWNIVDCNRGWSHFPQAHEGERKLWVLPLSMKIVRRTWWIVPKRRKVSEEGRPDNVRRLMWGRLVLVMESGVIVVIAEAFLFTESYFIRGALNIWWFWLGVGVVQLPEEGILVEVLVPLGESPNVGANLDSSACKKSDQEVMNPLRYIHRYQLKAVPSSDGVFELIHGGLPGCMVSHGDGDGGRSDQCYVQGRGEREKAALVRGKAPPEYE

SEQ ID NO: 180151 - protein, 166 aa, Glycine max
  Coding DNA Sequence Number=SeqID_63373
  Gene Ontology: Mol. function=RNA-directed DNA polymerase activity; Biological process=RNA-dependent DNA replication
  Homolog annotation: Hit_ID=Q1RW99; Match level="QueryCoverage=60%, HitCoverage=15%, E-value=2e-19, Identity=43%"; Hit description=RNA -directed DNA polymerase
  Subcellular localization annotation: CTP_CleavageSite=73; ConfidenceScore=5.24e-01
MSVSGVAAIIFTPSKMFQWIFPEPMSGGQMRNWSKSGGPKVQFCLVNTILTAKNLVLIPIKGSSSPSMLPSIRQKLLASLRSFSNALLRVCLSVTLMALFGGTLEKLNVGEFSEMIKLSLKPLKQLMRSSGIHFGSNVTWLSSSKLFKTIIWSRGSSESNGLIVFI

SEQ ID NO: 180152 - protein, 621 aa, Glycine max
  Coding DNA Sequence Number=SeqID_63374
  Gene Ontology: Mol. function=RNA-directed DNA polymerase activity; Cellular component=chromatin; Biological process=chromatin assembly or disassembly
  Pfam annotation: Domain name=rve; Domain location=437-593; Score =95.4; E_value=1.7e-25; Accession=PF00665.16; Description=Integrase core domain
  Subcellular localization annotation: CTP_CleavageSite=55; ConfidenceScore=5.06e-01
MTDYTSFVMKFNHLGQPVELRADVTNGPAGFNISSLTPDSNRVNFSAIPLVPLTRNQTRPTTTSSSPDPYNLSFAPSVSTSLPDSNQPSTTMGSSPSNQSSSINCPDELGYASWFSKLDLRQGFHQILMHEPDIEKTAFRMHHGHYEYRVMPFGLDSLSSHLQHLELIFQTLVREQFYLKHTKCLFAQNQLEYLGHVVSSKGVEPEPSKVQAVAAFNQLKEAMTSALILALPNFAKPFIVRTDASGTTMGVVLMQLNHPIAFFSKAFRPRLLHASTYIRELHAIVTAVRKWRQYLLGRSFTILTYHKSLRELMTQVIQTPKQHYYLSKLLGFDYTIQYKFGSSNVIADALSRVPSESGGQLLLLLVPQLDFLDDFHRTLQASSKFQAQLSEIHTNPSAYPDFHIHNDLLLFKGRVAKTTHRLESNFYWTNLQQDVKRFVRECSDLSMDFITHMPPSQGFTVILVIVDRYSKGVHLGALPINFSAFKVASLFLDLVCKHHGFSRSIVFDRDPVFLSSFWREIFRISGTRFRMSTAYHPQTDGQTEVMNRVLEQYLRSFAHSQPATWFRYLVLAEWSYNTSLHSSSGFTPFEVIYGKPSPTLPQYLPGMTNNEAVDSLVSSRQ

SEQ ID NO: 180153 - protein, 89 aa, Glycine max
  Coding DNA Sequence Number=SeqID_63375
MDTTTTTPFKYHLLEASSKPFFKKTTLTSFHKHDESETTSLISLQPQRITYGSNAFQDYFDDAKESRLKQVPKNQESSKFQESRFKIQE

SEQ ID NO: 180154 - protein, 56 aa, Glycine max
  Coding DNA Sequence Number=SeqID_63376
MLSLCGGRLPLYMGVEDQRGVSGKAMKEGRLWDWEMPNGLWWSWAWKHKEVQKVIS

SEQ ID NO: 180155 - protein, 84 aa, Glycine max
  Coding DNA Sequence Number=SeqID_63377
MVNLIDQTEKANWWWKKGLHFERPWVEIDWMMWQQAVGGWGGGDLVVELKNTSNFAKLKFGKDMMIGDGAKPNQIVGDALFKEI

SEQ ID NO: 180156 - protein, 104 aa, Glycine max
  Coding DNA Sequence Number=SeqID_63378
MDQSWMNESHMSPAYEEGVEQFLQFASEKNMQRGSQSEPFDVEMEDRLEDMICDLGQESFQQVHTSMYDTLQSDSKKPLYSGCNNSLTLLSTVLSLVNVKAKYG

SEQ ID NO: 180157 - protein, 405 aa, Glycine max
  Coding DNA Sequence Number=SeqID_63379
  Pfam annotation: Domain name=Transposase_23; Domain location=325-395; Score=-12.2; E_value=0.025; Accession=PF03017.5; Description =TNP1ENSPM transposase
  Subcellular localization annotation: CTP_CleavageSite=51; ConfidenceScore=5.51e-01
MATPPSSPPAPPLTNSTSHSPFTMKRTRKAIWLRSLATRPIGAERPLFHVDLATRKADGSRRKKLRTYLGIVARDKVDVTYENWKQVPVAQKDLIWEDIQKWALAAGKDSVDDVVCKKYDISKEKWTQFCQSRRDPLWEDVQKKAQAIQKQNTAPHVLCCGSYEFLENKLMEEKKKKQLEEAAKFGSTDTLIDPPSPVRRHVKWKMTRTKKIGQMISEAAKEIADKIDVLTAAIGRPEHPGRVCVARADVTIKQYFGLTPRTSRTSSSIASEDLEQLMQKIRDQLEDSIIEKGLALPPEPEVGLSTARVSTKESCMYPSGNDPDTGDSEKWGLYIKENPPRLVALGRLYEGSTTIHDIHLRNDQVKVGVEEVRDADAPIPVPTQEVQLVGHTLNTFVACPTHLLN

SEQ ID NO: 180158 - protein, 361 aa, Glycine max
  Coding DNA Sequence Number=SeqID_63380
  Gene Ontology: Mol. function=RNA-directed DNA polymerase activity; Biological process=RNA-dependent DNA replication
LPNKDPYTHLATYIEICNTVKIVGVPEGAIRLNLFSFSLASEVKRWLHLFKGNSLRKWEEEAGCALCGGAHESGSCMNQEEASKEVNYIANQNFQGYNQGGNVGYHPGGNGQLAKQLAEKPNGQFVTNTKKNPKEECKVVLTRSIRKEGLEKEMRIEEVEKDERVKEARKEALSVPVRDIPYPLMPMYSKFLKDLPTKKNKYINNENIVVEENYSAVTKRILPQKFKDPGSVTIPCSIKTMLVGKALIDPGASINLMPLSMCRRIGNLKIVPTRMILQSADHSIKRPYGVVEDVLVKEDTEIHLILGRPFMLTANYVVDRGNDNLEMSVKEQKVSFNLFDSTTLTSIDDISFTKGTIDPNP

SEQ ID NO: 180159 - protein, 219 aa, Glycine max
  Coding DNA Sequence Number=SeqID_63381
MCALQGMIPLSAIDGYRLKSLSETLSLSVIVINMSKTIRVACLVRNSQLFKPFLLPSSVFFLPTLPKLFSLPHTLIHSCSHAFTFSVLLLPSAFILTLPTCTLGLSLASLTECFANGGAKRPTVGLAPNCGLSVEWPPRNVKPPPVDLRLQNQPGIPPDSPLRWLGIDIKIIFIFRTFFQRGTSKLAYTDYDEFLEELEKRHWDRKLTRLAKKNIEWPW

SEQ ID NO: 180160 - protein, 83 aa, Glycine max
  Coding DNA Sequence Number=SeqID_63382
GKEGEACHPARPGELGYFLQKAPPSGGTSWKAQVGLVVQQCSLLTSGMLWNFTYRATMGAKYLEAVKQRLHAIKQWSPDEIRL

SEQ ID NO: 180161 - protein, 434 aa, Glycine max
  Coding DNA Sequence Number=SeqID_63383
  Gene Ontology: Mol. function=protein binding; Cellular component =integral to membrane
  Homolog annotation: Hit_ID=Q4K3M9; Match level="QueryCoverage=79%, HitCoverage=24%, E-value=6e-52, Identity=36%"; Hit description=Rhs family protein
  Pfam annotation: Domain name=PAAR_motif; Domain location=101-130; Score=23.3; E_value=0.00087; Accession=PF05488.3; Description=PAAR motif
  Pfam annotation: Domain name=PAAR_motif; Domain location=187-216; Score=34.5; E_value=3.6e-07; Accession=PF05488.3; Description=PAAR motif
  Pfam module annotation: Pfam domain module=PAAR_motif::PAAR_motif; Domain location=101-130::187-216
MDKHAARQGDDIIHSSIFADITSIVAEGAVYAAMGAIVAGVATVAAPLVGVGALAAVGSSCLLSGIIAGAVANVAGITDDISAAADGIGDMLFPPSPAGVIASGSDNVIINGLAAARAAGELTAGDTPPPEAQSAGFFADYAGKLLAVADQFAGAMWQPTIASAAAGTSPLEQDKVACEKHSGPQYLAEGSKSVFINGQPAARAKDRTTCGATISDDVSANVIIGGETLTVRDIKSGKQPGLALAMIGLSLIRGRPGQILKNMPCALAMAGGGMLADMSINAIFSALHPVHAATGVKVLNDDAERDFSLPGRFPLRWQRSYNSLTQRAGLFGRGWSTVFDSYLTLEGNQATWFDDNGRELRFALPGEKEVLYSISEGLMVRRNAHGDVAIADDDGAVWRLYKPTARNPQLLRLASLSDEYGNALEMGWDELSRL

SEQ ID NO: 180162 - protein, 48 aa, Glycine max
  Coding DNA Sequence Number=SeqID_63384
MGFPLPAVIYPAENLSAFVIRSPLRRFCVLFFGGKDEDSFHGPRFKVA

SEQ ID NO: 180163 - protein, 322 aa, Glycine max
  Coding DNA Sequence Number=SeqID_63385
  Homolog annotation: Hit_ID=Q1S175; Match level="QueryCoverage=36%, HitCoverage=43%, E-value=7e-28, Identity=41%"; Hit description=MtN19- related
  Pfam annotation: Domain name=SURNod19; Domain location=1-255; Score= -93.5; E_value=2.1e-08; Accession=PF07712.3; Description=Stress up -regulated Nod 19
MGLRSIAAKGHVGIKSFDVELVDQEGNSIPSYETYLHHGFAIKYHENITMSPNPKIESQGTTSNILKPYAIEQGNPTKIKNGYEEKWLLNIMAIDTRGAQDKKPSTECRCDHMNLSKDFHNVTRDIHKQPLSTNYKGEYTIPTNDGGESLHAQKANIAIEKRGYLIYGTANMHSGVVNVTLYGQGFAVIAGALLDALPPLGEDVIVALTDILKLPLMDKSNGCSFSSISSIAVFSSAVFVVSLILVRLLYVLYCSSKPLSKRASKPFSTLIILGSGGHIAEMLNLLAVLQKGRFNPRFYIVVATDNMSLQKAQLLENSLAAE

SEQ ID NO: 180164 - protein, 71 aa, Glycine max
  Coding DNA Sequence Number=SeqID_63386
EQAAKEATATANKKAFEAKFGNCSEDILAARELAASSTEAVEKSRKVRGVHVRGYGVHVRFIVIDHFLAST

SEQ ID NO: 180165 - protein, 293 aa, Glycine max
  Coding DNA Sequence Number=SeqID_63387
  Homolog annotation: Hit_ID=Q8W3I7; Match level="QueryCoverage=41%, HitCoverage=8%, E-value=1e-34, Identity=67%"; Hit description =Putative DnaJ domain containg protein, 3'-partial
MVCSWVMLFCAVSDRTFSFIVYLPYSSVIFTHHVAPNIKEVDSEFEATDDPDALALEVYDPPPSSEYVSRIELELLRTRKAFAQALDDRRYAEDQAVKWQHLIVDFFYKKLVVGKLQEVLPLLEVQCVPFLVPIDLSSDSDSFGEEFFRKLDEDFATAKQKGEKNCILWGQAFLSGEPSIVEAAALHKAIVTRNPKAMVCLYIFCTGVWSIFNWATLFCHPCPSSISWWEETAVSISLPLAKRSVLGGLLPKSLLYVLERSGPAAFAAAMVSDSDTPEIIWTHKMRAENLIRQ

SEQ ID NO: 180166 - protein, 69 aa, Glycine max
  Coding DNA Sequence Number=SeqID_63388
MIADAEEKGLITPGQQLYSQFRSIFCLLPFLKSWTLLKGFQRHIFNLEGFFNLGALRRKNNIHYTQESH

SEQ ID NO: 180167 - protein, 63 aa, Glycine max
  Coding DNA Sequence Number=SeqID_63389
  Homolog annotation: Hit_ID=O64852; Match level="QueryCoverage=90%, HitCoverage=17%, E-value=4e-15, Identity=57%"; Hit description =Putative SF16 protein
MSIEGQAVQNLLNEGWCDSRGTLEDIKTKIQMRQEGAFKRERAMAYSLAHKQCRATPSLFPHF

SEQ ID NO: 180168 - protein, 109 aa, Glycine max
  Coding DNA Sequence Number=SeqID_63390
MDVDGESIPEKVIINSTKAHSNNEQKRVELEELERIQFAIEHGAELVSLLLKNEVVLQQEEKGDVGPHILDPKMQQLKLDKLNLVKLWKQGFLGIDPLYYPIGKHFPKK

SEQ ID NO: 180169 - protein, 49 aa, Glycine max
  Coding DNA Sequence Number=SeqID_63391
MGRTRTRRVSKCYKEGYEIEASILQSLCKVHFSLYRYYFTNPNDENMPK

SEQ ID NO: 180170 - protein, 73 aa, Glycine max
  Coding DNA Sequence Number=SeqID_63392
VYGHKMKRNIEERFWRIFGKCQGEMNNSYIKSQEHNGLRKGITQGTSLTWLCEGGGKPMVCMTYLRMDDPNLV

SEQ ID NO: 180171 - protein, 71 aa, Glycine max
  Coding DNA Sequence Number=SeqID_63393
MEFIDIPMVGRTFTWYRAGDILDLCPMILKHKMFNWGPKKFRVLNAWLNEDEFNMFVRKAFVFRSTSMKGI

SEQ ID NO: 180172 - protein, 156 aa, Glycine max
  Coding DNA Sequence Number=SeqID_63394
  Gene Ontology: Cellular component=mitochondrion
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVP

SEQ ID NO: 180173 - protein, 87 aa, Glycine max
  Coding DNA Sequence Number=SeqID_63395
HQLPSCSKGVKQVWVELGVKEVEIEVEMLEKVKILVAWDEKMVEVKIEFDFEGIKGGCFLGFFHWSKDLGLKDVGGGSFHETNIISL

SEQ ID NO: 180174 - protein, 115 aa, Glycine max
  Coding DNA Sequence Number=SeqID_63396
MEQLVPMLFTWLIYFIRKQLISIFGFMKKNLCDAMMSTRLAALGYQSSLCQTGPRFRDCNHIVEIVFVEIVFATYPLRSKKSRKGKSPEKGTPRALLLFLLLPEFVFVANWAALP

SEQ ID NO: 180175 - protein, 122 aa, Glycine max
  Coding DNA Sequence Number=SeqID_63397
  Gene Ontology: Mol. function=oxidoreductase activity; Biological process=protein modification process
  Homolog annotation: Hit_ID=Q1RVE5; Match level="QueryCoverage=53%, HitCoverage=12%, E-value=2e-26, Identity=90%"; Hit description =Ubiquitin family, putative
EPGQTGGGTGMQYDSAFFLFLFSTRNYAQLVLFGIFFVSMALHWQFKLLGYHVRSSAGPMNNLGLEMLSSMFGGLGAGSLAVPNRSNEPPEQLYATQLSQLQEMGFFDTQENIRALIATSGN

SEQ ID NO: 180176 - protein, 523 aa, Glycine max
  Coding DNA Sequence Number=SeqID_63398
MQNSELVMKIDATIMATASSPIQGSHGVGEKALCLSPQLEIKSGGDDAVVAPKGDEEVDQKPTLVGIDHKRKASTEIDPFCESDPDSCHGSKHLNSPPVSTPIVEQEQQVDEEMLPLEVGDDNEKMEEDKGVSDGGPLEMDSDQNKGEGLIMNSPNNVEEEKVETEAIESMNVEPEGNKGKNKEGTVNSPSNVVVEEEKVETNATESMNVEPKGDKGTPHGGEGIVNSPSDVEKEKVETDHAAMNVEHDGDKGTSHGRHFELDLNRRVEEIVNSPSYVETETTKVETEAIESVDVKPQGNNGMPRVVRLLGIDLNLEADQGNNGMPRVVRLLGIDLNLEADHQGMMQHSSNDVERETTRVQPEIGHKGMPHECHSLLDLNKGKQMVEHDSVDQNIEVEPYVAENIEVNCAIEKMVQMGVELLCDLNEEADPFSDENEIEAEPAANAGLKKKTEVESCGADKVEVEQCAEENNEEEDDDGVEMEKREVVLALPAVIENDEVETSPPRDYVIDLNKTPPGYNDEN

SEQ ID NO: 180177 - protein, 255 aa, Glycine max
  Coding DNA Sequence Number=SeqID_63399
MQNQNPSEDDSTKKSPSSPSDDTSHPTNNNNNPQGESLVMKTVWQVLEELGGSGDDSDGDSGFGDGAPVAVAVGGGGDDNGDGDGSVGGGATVAMEKSDDDSDNNGDNSGSNLAVAVVVGGGDGSGSSGVGATVTVSVAVSGGGGNHGGGSSGGGGGGPVAVSVAVGGGSTVVESVVVSTEGVQGRKRKTSIVRDPPTGRPTCPLCQKEFPTWKGAFGHMRAHPDRDYRGFFKPPVFGSPSSTQDQPPRDDKGNN

SEQ ID NO: 180178 - protein, 65 aa, Glycine max
  Coding DNA Sequence Number=SeqID_63400
MYRTRRLWMTKGADNHKVPPHVIVLAVSGLQKVQITISGLACPLLTKGADDDVSLCVLPDSESDG

SEQ ID NO: 180179 - protein, 360 aa, Glycine max
  Coding DNA Sequence Number=SeqID_63401
TTSPITCGVPYGYPHLLSSRDGKSDDMRGYLMVIRTFCHLETVSPMTYGGASEPVDTQRLTSSTVPLASRYEESDDMWGYLMVIRIFCHPGTTSPMTYGVPSEPADTQRLMSSSVPLSSRYEESDDIDDQSDDMQGYLMVIRTFCHPETASPMTCRGASEPVDTQRLTSSSAPLSSRDDESDDMRGYLMVIRIFCHPETVSPMTYGGASEPVDTQRLTSSSAPLSSRDEEFDDMRGYLMVIRTFFHPETASPMTCGGASEPVDTQRLTSSSAPLSSRDDESDDMRGYLMVIRIFCHPETTSPMTYGGASKPVHMQRLMPSSAPLSSRDDESNDIWGYLSVIGTSCQLEASESIDTQRLTS

SEQ ID NO: 180180 - protein, 949 aa, Glycine max
  Coding DNA Sequence Number=SeqID_63402
  Gene Ontology: Mol. function=nucleic acid binding; Cellular component= nucleus; Biological process=DNA integration
  Homolog annotation: Hit_ID=Q1T010; Match level="QueryCoverage=96%, HitCoverage=85%, E-value=1e-175, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=397-560; Score =156.4; E_value=7.4e-44; Accession=PF00665.16; Description=Integrase core domain
  Pfam annotation: Domain name=zf-CCHC; Domain location=250-267; Score =27.7; E_value=2.7e-05; Accession=PF00098.13; Description=Zinc knuckle
  Pfam module annotation: Pfam domain module=RVT_2::rve::zf-CCHC; Domain location=661-889::397-560::250-267
MDEKRGEKECIRDIIIVEHCCKHVVLAVVNAIPGNLPVFDGKGYEDWCVKMNAILGFQELDEIVRDGFQEPSKNPTAEQEDLHRENKRLDCKARVLFHQCISTNVFQKISKAATSKQAWDILQQVYGNTGRTKKVKLQSLIRQYELLSMIEHKTIVLKTLKPNFDHIVVAIEESKDLENMTMEELQNSLEAHEQQEEEDIEEVEVVIEMQKHKVLLPKSIFLEAIQMSNSRGGNSFRSRGGKRLIDRRKIQCYNCDKFGHFAHECWQIGNNNAHSKCKKNDQAHLAQEEDGSDSDQVLLMVTTSSKEDCSSWYLDTEYSNHMTGNRDWLVDFNPNVTTSVRFVNNSTILAEGIGKQLLEKGFTMEMQGNHIEIFDDKQRLVLKAPLSRNRTFKAPQRAKQPLGIVHSNVCGPFDTPSIDGNRYFLTFVDEFTKKIWIYMLKEKCAVFSLFVKFVKSIERQSELKLKILRIDGGCEYNSKEFKEFCEAKGIEHEVIASYTPQHNGLAERRNRTLLDMARCMLKGKGLPNCYWGEVVTTTTYILNRCSTKRLQSVTPEEAWTGDKPTVNHLRIFGSLSYRHIPDERRKKLDDKIEALILVGYHPTSAYKLYSPLNPRAKDVNPASSMQPPIRRSQRSRFPSTRRADYELYSNSSISNASEMDAMKEELDAIEKNRTWELVDLPYNKHPIDKQGIDYTEVYAPVARMETIRLVIVIASSKNWTICQLDVKFAFLNGPLEEEVYILQPPGFEIKGKEHKVYKLLKALYGLKQAPRAWNMVIDNFLSKQGFVKCTVEFGVYVKETQHKNLLFVCLYVDDLIITGDVDEEIEQFKEKMKLEFNMTDLGILHYFLDFEFMHTQKGIFLHQRKYTGEVLKRFNMENCNIVTVPVMPNLKLTEELDEKPVDATLFKQIIGSLRFLCNNRPDISYGVGLLRRFMSNPRAPHMTAAKHIL

SEQ ID NO: 180181 - protein, 302 aa, Glycine max
  Coding DNA Sequence Number=SeqID_63403
GYLTVIRTFCQPEESEPVDKQGQTSSSAPFVNLGQASPDDESDDMWGYLMVIRIFCHPETTSPMTYGGASKPVHMQRLMPSSAPLSSRDDESNDIWGYLSVIGTSCQLEASESIDTQRLTTEDESDDMRLYLMVIRIFCHPETSSPMTYGGTLWLSAPFVNQRQARPMTCGSTLWCLHLLSSRDGESDEMWGKPADTQRLTSSFVTLSSRDDESDDMRGYLMVICTFSYPETASPMTWRVPYGYPHLLSSRDGESDDMQGASQPVDTQRLTSSSAPLSSRDDESDDMRGYLMVIRIFCHPET

SEQ ID NO: 180182 - protein, 32 aa, Glycine max
  Coding DNA Sequence Number=SeqID_63404
MGFDRAMAWSVAENTAIGPHKCCYADANARPQ

SEQ ID NO: 180183 - protein, 156 aa, Glycine max
  Coding DNA Sequence Number=SeqID_63405
  Gene Ontology: Mol. function=protein serine/threonine kinase activity; Cellular component=chloroplast; Biological process=protein amino acid phosphorylation
  Homolog annotation: Hit_ID=Q10NC1; Match level="QueryCoverage=66%, HitCoverage=32%, E-value=5e-18, Identity=44%"; Hit description =Protein kinase APK1B, chloroplast, putative, expressed
TGITESTSVNGGISSINSNNMVFPRVETGNLKEFNFADQKAATKSFKSDALLGEGGFGKDYNAKISDFGLAKLGPSGEDSHVSTSIMGTYGYAAPEYIATGLRALDKNRIIEQQNLIEWAKSSLSDKRKLKSIMDERIEDVLDTLERIEAIKDTTK

SEQ ID NO: 180184 - protein, 98 aa, Glycine max
  Coding DNA Sequence Number=SeqID_63406
MSFRTCGKAWAEQMRKMSDQKNACALLVTGKLGGVDGDPVLRGTRIRATWGCVSSVEGGQLWMSGTWRYVAGVRRPWGRQVGCYCPKPSLTNPDPTWA

SEQ ID NO: 180185 - protein, 92 aa, Glycine max
  Coding DNA Sequence Number=SeqID_63407
MVVIIKKGKNVNHAGFDDAEKNSLNNDCHHQKMGEYESCRLKEEKVQVVDVSLSELHASFSVLGNPRRGSFRDMLTQRTAISPSELFVSSRT

SEQ ID NO: 180186 - protein, 249 aa, Glycine max
  Coding DNA Sequence Number=SeqID_63408
  Gene Ontology: Biological process=regulation of transcription
  Homolog annotation: Hit_ID=Q8RYX0; Match level="QueryCoverage=46%, HitCoverage=25%, E-value=2e-17, Identity=44%"; Hit description =Pentatricopeptide (PPR) repeat-containing protein-like
  Pfam annotation: Domain name=RWP-RK; Domain location=120-171; Score =101.4; E_value=2.7e-27; Accession=PF02042.6; Description=RWP-RK domain
MAAPPLLQVLNLLSFSILFPITSTKNPKLKMIPNLLDDLHVIYKLDRKEEDSDIAQDYTGEERQGNSNNCQPSWKVFPVLDQDLNCLPYEDDESESLDNETDVESSPGLLAKKKRAPSDLVAKISLSDLVKYFGMPIVEASRNLNVGLTVLKRKCREFGIPRWPHRKIKSLDSLIHDLQEEVKSQELEDREAALAVAKRQRMLESEKENIEKKPFMDIQSETKRFRQDVFKRRHRARAVGKHNSTVSST

SEQ ID NO: 180187 - protein, 148 aa, Glycine max
  Coding DNA Sequence Number=SeqID_63409
MKGYSEPLWHLEAEPHKQQIECGHDHTSSIGVGVGVTSLSDEIKSPEDGILMGSFGVMDLHPARVFFFFGKKGWDDWLIKLLFLLDSVTTYPSVGRRRETHGCVFQGRKTHGVATNVYLRKMLEKPKSGSMNFKYERFGSLFYTRGRY

SEQ ID NO: 180188 - protein, 612 aa, Glycine max
  Coding DNA Sequence Number=SeqID_63410
  Gene Ontology: Mol. function=Rab escort protein activity; Cellular component=Rab-protein geranylgeranyltransferase complex; Biological process=intracellular protein transport
  Homolog annotation: Hit_ID=Q8LLD4; Match level="QueryCoverage=97%, HitCoverage=97%, E-value=1e-138, Identity=46%"; Hit description=Rab escort protein
  Pfam annotation: Domain name=GDI; Domain location=1-559; Score=-67.8; E_value=5e-13; Accession=PF00996.9; Description=GDP dissociation inhibitor
MTEPQDPFSYPPIDPVNFDLIIVGTALSESVIAAAASAVGKTILHLDPNSFYGSHFASLSLHDLTSYLTSPHSLPSAATAAASSDSDDIVVVDLVHQPLCTDAETATYDESAFLSENSRKFNIDLGGPRALFCADKTIDLLMKSGAAQYLEFKGIDESFVYEANAGLANVPDSRGAIFRDKKLSLKEKNQLMRFFKLVQQHLDDTQEEKIPKEDLEIPFVSFLEKMKLPPKIKSYSPFLFTTMLDYDQDNNEVCEELLKTKDGIDCLAQYSSSVGRFPNAPGALLYPIYGEGELPQAFCRRAAVKGCIYRASPGAAVKLCLGDLLVMGSNPETASLHMQGRKHGSAIMLSCLAFPGSFFLKARRVVVVLRMPVVSLLMDKVTGSYKGVRLASGQDLYSHQLILDPSFTIPSPLSLSLGDFPSERLQMLSQRDIKGMVARGICITRSSIKPDVSSCSVVYPPRSLYPEQVTSIKALQIGSNLAVCPAGTFILYLSTLCNDADEGKKLLKAAMNALLTLPVSGNSESIPSVQSDSEDIKPIVLWSAFYIQKLIMSKFEFISSTPTPDGNLNYNALLDATEKLFNQMYPNEEFFPKATSPEDPTDEDDNGLTLDS

SEQ ID NO: 180189 - protein, 91 aa, Glycine max
  Coding DNA Sequence Number=SeqID_63411
MKVDIRWNMTIPLVDQDNIEHKRQKKLARTIADKDKALETFDLAKKYRALSGSRWATSRPGSKPNNKRKKKKLSPKSNRQRKIMKSLNPLL

SEQ ID NO: 180190 - protein, 766 aa, Glycine max
  Coding DNA Sequence Number=SeqID_63412
  Gene Ontology: Mol. function=binding; Cellular component =intracellular; Biological process=metabolic process
  Homolog annotation: Hit_ID=Q6Z0F9; Match level="QueryCoverage=97%, HitCoverage=91%, E-value=1e-116, Identity=29%"; Hit description=PPR -repeat protein-like
  Pfam annotation: Domain name=PPR; Domain location=121-155; Score=4.9; E_value=2; Accession=PF01535.11; Description=PPR repeat
  Pfam annotation: Domain name=PPR; Domain location=188-222; Score =17.9; E_value=0.036; Accession=PF01535.11; Description=PPR repeat
  Pfam annotation: Domain name=PPR; Domain location=287-321; Score =33.0; E_value=1.1e-06; Accession=PF01535.11; Description=PPR repeat
  Pfam annotation: Domain name=PPR; Domain location=322-356; Score=2.5; E_value=3.7; Accession=PF01535.11; Description=PPR repeat
  Pfam annotation: Domain name=PPR; Domain location=357-391; Score=8.8; E_value=0.68; Accession=PF01535.11; Description=PPR repeat
  Pfam annotation: Domain name=PPR; Domain location=491-525; Score =27.5; E_value=4.7e-05; Accession=PF01535.11; Description=PPR repeat
  Pfam annotation: Domain name=PPR; Domain location=592-626; Score =44.1; E_value=4.7e-10; Accession=PF01535.11; Description=PPR repeat
  Pfam annotation: Domain name=PPR; Domain location=627-661; Score=7.9; E_value=0.86; Accession=PF01535.11; Description=PPR repeat
  Pfam annotation: Domain name=PPR; Domain location=663-697; Score =14.5; E_value=0.14; Accession=PF01535.11; Description=PPR repeat
  Pfam annotation: Domain name=PPR; Domain location=726-760; Score =16.4; E_value=0.086; Accession=PF01535.11; Description=PPR repeat
  Pfam annotation: Domain name=PPR; Domain location=86-120; Score=36.9; E_value=6.8e-08; Accession=PF01535.11; Description=PPR repeat
  Pfam annotation: Domain name=TPR_4; Domain location=662-687; Score =11.3; E_value=1.7; Accession=PF07721.5; Description=Tetratricopeptide repeat
  Pfam annotation: Domain name=TPR_4; Domain location=725-750; Score =5.1; E_value=9.1; Accession=PF07721.5; Description=Tetratricopeptide repeat
  Pfam module annotation: Pfam domain module=PPR::PPR::PPR::PPR::PPR::PP R::PPR::PPR::PPR::PPR::PPR::TPR_4::TPR_4; Domain location=121 -155::188-222::287-321::322-356::357-391::491-525::592-626::627 -661::663-697::726-760::...
  Pfam module annotation: Domain location=86-120::662-687::725-750
MIRHAAFDPEVASKVCSVIEPFLLSLAKTSNPITLRYCNQIHAKLIVSQCISQTHLTNTLLSLYAKFGHFHHAHLLFDQMSHRNVVTWTTLISSHLRTGSLPKAFEMFNQMCALNERPNEYTFSVLLRACATPSLWNVGLQIHGLLVRSGLERNKFAGSSIVYMYFKSGSNLGDAFRAFHDLLERDLVAWNVMIFGFAQVGDLCMVRRLFSEMWGVKGLKPDDSTFVSLLKCCSSLKELKQIHGLASKFGAEVDVVVGSALVDLYAKCGDVSSCRKVFDSMEEKDNFVWSSIISGYTMNKRGGEAVHFFKDMCRQRVRPDQHVLSSTLKACVELEDLNTGVQVHGQMIKYGHQSDCFVASVLLTLYASVGELVDVEKLFRRIDDKDIVAWNSMILAHARLAQGSGPSMKLLQELRGTTSLQIQGASLVAVLKSCENKSDLPAGRQIHSLVVKSSVSHHTLVGNALVYMYSECGQIGDAFKAFDDIVWKDDGSWSSIIGTYRQNGMESEALELCKEMLADGITFTSYSLPLSISACSQLSAIHVGKQFHVFAIKSGYNHDVYVGSSIIDMYAKCGIMEESEKAFDEQVEPNEVIYNAMICGYAHHGKAQQAIEVFSKLEKNGLTPNHVTFLAVLSACSHSGYVEDTLHFFALMLNKYKIKPESEHYSCLVDAYGRAGRLEEAYQIVQKVGSESAWRTLLSACRNHNNKEIGEKCAMKMIEFNPSDHVAYILLSNIYIGEGKWEEALKCRERMTEICVKKDPGSSWLI

SEQ ID NO: 180191 - protein, 199 aa, Glycine max
  Coding DNA Sequence Number=SeqID_63413
  Gene Ontology: Mol. function=nucleoside-triphosphatase activity; Cellular component=membrane; Biological process=proteolysis
  Homolog annotation: Hit_ID=Q5TDF0; Match level="QueryCoverage=91%, HitCoverage=62%, E-value=7e-22, Identity=37%"; Hit description=Novel protein
  Pfam annotation: Domain name=DUF265; Domain location=45-199; Score =70.4; E_value=5.8e-18; Accession=PF03266.5; Description=Protein of unknown function, DUF265
MAGPGKCFLVTGPPGVGKTTLIMKVFESLKVNPSLKLQGFYTREIRRAGQRVGFEVVTLDGRTAPLASIDISTPESLRWPNVGKYKVDVASFESLALPELQEIGLLNILPTILLSLQMWYDALQLFRCIFKLKNFVPYCPEALRYAKVKEDTDLFIIDEVGKMELFSSSFFPAVLRVLESNIPVLASIPVPKFGRDIPE

SEQ ID NO: 180192 - protein, 183 aa, Glycine max
  Coding DNA Sequence Number=SeqID_63414
MSIFYSNHVQAQVWDIDKKLLPDVYIVKEEITCFSVIQHSLFMYIGFSNGNMSVLMLDQEPWHVVLMKYTIPWPVVLLNEHTESRTIKMEHHLSEGCIDMEIISTSSKHRQNYFILLGKSGHVYQYDDNLIERYPLQNQSKSTPSLPKEVVVKLPLADSSITTAKFISNNPNLFTSEDEVLWL

SEQ ID NO: 180193 - protein, 429 aa, Glycine max
  Coding DNA Sequence Number=SeqID_63415
  Gene Ontology: Mol. function=transferase activity; Cellular component= proton-transporting two-sector ATPase complex; Biological process=DNA integration
  Homolog annotation: Hit_ID=Q1S0E3; Match level="QueryCoverage=97%, HitCoverage=49%, E-value=1e-89, Identity=41%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
  Pfam annotation: Domain name=rve; Domain location=18-166; Score =110.4; E_value=5.1e-30; Accession=PF00665.16; Description=Integrase core domain
  Pfam module annotation: Pfam domain module=RVT_2::rve; Domain location=212-425::18-166
NGLPQIKNPQAVCERCLVSKQPRSTFGSYVPSIANEFSKKLWTYPLKAKSEVFDTFKVFKILVEKQLGKSLKIIRTDGGGEFTSGEFENFCRDNGIIHEITTPYTPQHNDVAERRNRTIMNMVKSMIKGINLSLSFWAEAVETATYILNRCPTQNSVSLVPEKVWSDEAIPHGEGNAEQNIEQIRSGRMRRMPTRLKDYHMFPNSAITIEDAMNEEIRAIERNKTWDLVTLPIGKTPIAVKWVYKTKLKLDDSIAKHKARLVVKRFMQKEGEDYSEIFAPVARFETVSKDKVYRLRKALYGLKQALRAWNKTIDSFIHGEDFKKCTVEHGIYVKATKDGGVLLICLYVDDLLITGSNSIEIEKLKDNLKSKFEMSDLGLLSDFLGIEFAETKDGIVMHHKKYIKEVLKRLNMDQCNKAASGMLKIRLPQ

SEQ ID NO: 180194 - protein, 60 aa, Glycine max
  Coding DNA Sequence Number=SeqID_63416
MADQESAHEETTHGPNYTPSYSPSAHAPSATPNESIVAPEVEETTDNLEGTIEKGKSRLK

SEQ ID NO: 180195 - protein, 863 aa, Glycine max
  Coding DNA Sequence Number=SeqID_63417
  Homolog annotation: Hit_ID=Q10S87; Match level="QueryCoverage=67%, HitCoverage=65%, E-value=2e-79, Identity=35%"; Hit description =Expressed protein
LEAPRNSLDLQVQTPKNYCPEGKLPYNYQVEEKGRSENNRYSNVGSMKKLINEELSKQSSTRQNAPSLVARLMGIDTMPLDTKYVVPSDKKISENMGKRSSVNGVNRRVSVSWGSSNFNSSSQMDFDSLYKDIGDEDDGWNRSFGEPRPREHPQEEELQKFKKEFEAYQAARFLECSKVVEIGSAPRQLLAQENLNKEKVMHNDSVLQRAAARKLADLDSHSFKMPPDSYGSEYHGNMMDLIPAMQRRTFPPRSRTLSRDFEESLLMKSCNKLDMSSSPTRIVILKPGPDSIRNHEENWTISSGTIQGRNSIEDFLEEVKERLKCELQGKIVKKGSVVRGSGIETPYNEKPSDPKLIARHIVKQVRESVTRDTDTTLLHSESTGSYKSEMQFNGPSSPEFFSRDTRRFLSKRLRNVVRREAHADIPEGKSMSLALDNHKARLKPAENIKKYASNWEISKEDTSIQTGSFRHELDENIFLHKELSPRNLVRSLSAPVSHSGTSFGKLLLEDRHILTGAQIRRKLEAVETMSVDVKKRKNDRFNIKERVSNFRYNLALRGRLFGRRVQSMVESHGNEFGPFVRDATSGPTVLMNCGERHENSTEVPPSPASVYSSAHEDIWRQTEYLSPISTPDVSSRDDNVVPQVFRDISSGLNELRRQLNQLESDGLEDLTMKQEPAESELDQLENPAESYIRDLLVASGLYFGSWDKSLLRGDTFAKPIGNSVYEEVEESHKKLVKENDESCIKDQNESKLDHKVLLDLLNEALPVVLGPPLTLSRFRRKLSNPSMLPPSGKELLKLVWDIIRVSFYPPSDISTNSLDTLVAQHLGSIPWSGLINDEINILERDIECLITDDLVEELTKDMF

SEQ ID NO: 180196 - protein, 105 aa, Glycine max
  Coding DNA Sequence Number=SeqID_63418
DEAGRYKQRLLECSGGKTPDLALQAQTYKKRGAHGRGRRHKGRGHDRVAKDNPERNNETQEHFKLSKMIGHFSSECQYPIHNQNNGRQGNEANMAKEADSEDDVL

SEQ ID NO: 180197 - protein, 267 aa, Glycine max
  Coding DNA Sequence Number=SeqID_63419
  Gene Ontology: Mol. function=mismatched DNA binding; Cellular component=chromosome; Biological process=response to DNA damage stimulus
  Homolog annotation: Hit_ID=Q69MM0; Match level="QueryCoverage=86%, HitCoverage=20%, E-value=5e-65, Identity=50%"; Hit description=DNA mismatch repair protein-like
  Pfam annotation: Domain name=MutL_C; Domain location=49-189; Score =7.9; E_value=7.7e-05; Accession=PF08676.1; Description=MutL C terminal dimerisation domain
MTFEQKNDKLANIQSQNNILDISSGFLHLAGDSLIPETISKKCLEDAKVLHQVDKKFIPVVAGRTLAVIDQHAADERIRLEELRQKVLSGEEKAITYLDAEQELVLPEIGYQLLHSYSEQIKDWGWICNIHAQNSESFRRSLDILNRPQMAVTLIALADTDGSSTIPPSVLRVLNLKACRGAIMFGDSLLPSECSLIVEELKHTSLCFQCAHGRPTTVPLVNLEALHNQIAKLRLMNERSSDEWHGLHRHKVCIERAAQRLNFARGI

SEQ ID NO: 180198 - protein, 96 aa, Glycine max
  Coding DNA Sequence Number=SeqID_63420
MHPNHVSISSLKQQSKNKGKEHKLEHEYEARARTEHDGMGRAPPDQELGNGEVERDNNSEGCNEAMASMTASARATVRESKRATTRESTRFKVMRV

SEQ ID NO: 180199 - protein, 238 aa, Glycine max
  Coding DNA Sequence Number=SeqID_63421
MGELAIPWNFLVTDSARPAPVREEFIPKQVPPEVGTSGIQGEEAVTIGEVGPIDYGIAIAREEVATQGVVVSDGVVADHEIIIVQGASIVVPEKEGNNNGSAEILILQPNLTSNDWRLLVVQGATAVAHNALVDEVVDEVGDGESLSGAETTPQQELYMVLCGEQQERNDIALVSKLWSDHVEDTYDLEKSSPQQQQEQIPFQTILSKCQKKRLRQKTKPIAIGAVSYNLHGSPKSIA

SEQ ID NO: 180200 - protein, 275 aa, Glycine max
  Coding DNA Sequence Number=SeqID_63422
MAFGANIIQRRIIEVITKDSDFLVRPLSEENCLPPDSCYSALRIGSSGSDDQLLNFEWHPVHQIPSSQASALGVCHTTDIEDELGEISRYYKRIHHTKHFDDREADCRFSYNMSRNANQHRRASSFANIGFNFDVAGDCGEIFNRLVDRPDFGDIHSSKRSDILNEEPDWLLSKSCIKSCKRPNKNKGKRDRFRNSTLEENLERSRRSFSAPPFHRSKRRFFSLNHPSEMIAKRQIGRVSNPAFNHQEASNFKYPQQSPVALHQSTEDFLLQEFK

SEQ ID NO: 180201 - protein, 327 aa, Glycine max
  Coding DNA Sequence Number=SeqID_63423
  Homolog annotation: Hit_ID=Q69MM0; Match level="QueryCoverage=19%, HitCoverage=5%, E-value=5e-13, Identity=52%"; Hit description=DNA mismatch repair protein-like
MDMFMFEKNQIPYACVLLALTWLDVNSQFVCKGPVHKLVSQLANRLEHLNSWNTDKEFRSKKRTRCQPCPAYLLNLSCPRSLYDLAFEPSKTHVKFKDWTPILNFIEKAIKQFWEENVACVDPSNEATYMVEDQQEKADVNIISAVSDMSKFRNQNRKDCLDLFFSTSDNLIEDDYHQSKREDVDYFGATMFKVQQSKGDFLLQTGYSGNLLDGSYAKCNSTVMRKHNSLLMHDSNSLLEGDNFFYGEIPAVESFNIDVPFDAPSSSHGRRFHKVEADVINESFEDDLLYNSCSGYGYDVKINGDLQQPFLKRCSMLGSILHEKALF

SEQ ID NO: 180202 - protein, 173 aa, Glycine max
  Coding DNA Sequence Number=SeqID_63424
  Gene Ontology: Mol. function=mismatched DNA binding; Cellular component=chromosome; Biological process=response to DNA damage stimulus
  Homolog annotation: Hit_ID=Q69MM0; Match level="QueryCoverage=86%, HitCoverage=10%, E-value=1e-13, Identity=39%"; Hit description=DNA mismatch repair protein-like
  Pfam annotation: Domain name=HATPase_c; Domain location=19-158; Score= 6.9; E_value=0.016; Accession=PF02518.16; Description=Histidine kinase-, DNA gyrase B-, and HSP90-like ATPase
MASIKPLPEAVRSSLRSGIFLFDFTRVVEELVFNSLDARATKVSVFVSTRSCYLKVVDDGSGIPRDELELVGERYAVKLCLGDLLVMGSNPETVSLHIQGLFAGNCDKNIWKAQWISKSIEGGDNFLCFIQGDINHIIASIDARKEVGTTARVYGILQSSFSSSFLSQKIVAI

SEQ ID NO: 180203 - protein, 176 aa, Glycine max
  Coding DNA Sequence Number=SeqID_63425
  Gene Ontology: Mol. function=protein serine/threonine kinase activity; Cellular component=cellular_component; Biological process =protein amino acid phosphorylation
  Homolog annotation: Hit_ID=O81783; Match level="QueryCoverage=89%, HitCoverage=23%, E-value=1e-21, Identity=41%"; Hit description =Protein kinase - like protein
MSCSSSSGSEEGDEGFDSYRKGGYHAVRVADQFAAGRYIAQRKLGWGQFSTVWLAYDTKTEIIWLLDVDCHYGSMNLRFLILLSMCHKMKSMHVGVAENGEWSSQNVTTWFHMDDDLSSYVALKIQKSAAQFAQAALHEIELLSSIADHNPTNSKFVIQLIDHFKHTGPNGQHLCM

SEQ ID NO: 180204 - protein, 389 aa, Glycine max
  Coding DNA Sequence Number=SeqID_63426
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q9SD02; Match level="QueryCoverage=89%, HitCoverage=94%, E-value=1e-119, Identity=65%"; Hit description =Protein phosphatase 2C-like protein
  Pfam annotation: Domain name=PP2C; Domain location=94-348; Score =278.3; E_value=1.5e-80; Accession=PF00481.12; Description=Protein phosphatase 2C
MAAEEATCFTCEAAIMSGVGGGCPCPRGNSECSMEDLNGDTVGNLNQNAAKPPRDHSVMRHCSSSSWSAEPESNINIVGLKSSTEEKPDFLVVLRSGCCSDKGPKQYMEDEFICADILSECVDLREDLPSPAAFYGVFDGHGGVDAASFTRKNILKFIVEDAHFPCGIKKAVKCAFVKVDLAFRDASALDSSSGTTALIALMLGSSMLIANAGDSRAVLGKRGRAIELSKDHKPNCTSERLRIEKLGGVIYDGYLNGQLSVARALGDWHIKGSKGSKSPLSSEPELEEIVLTEEDEFLIIGCDGLWDVMSSQCAVTMVRTELMQHNDPTTCAKVLVSEALQRNTCDNLTVVVVCFSKDPPPKIEIPRSYRRRSISAEGLDLLKGVLNGR

SEQ ID NO: 180205 - protein, 261 aa, Glycine max
  Coding DNA Sequence Number=SeqID_63427
  Gene Ontology: Mol. function=chromatin binding; Cellular component =chromatin; Biological process=chromatin assembly or disassembly
  Homolog annotation: Hit_ID=Q1SAV4; Match level="QueryCoverage=69%, HitCoverage=47%, E-value=9e-43, Identity=49%"; Hit description =Integrase, catalytic region
MAYHPQTDDQTKVLNRVLKQYLRSFTHDQPHHWYKFLSLAEWSYNTSVYVNTNFSPFEVTYGKPSSSLPPYLQGSSTMEVVDTILTSRAAIHSVLQRSLQKYQASMKTQADVHRRDLEFAIGDWVYVKLRPYRQTLVQPTYSKLSKCYYGLFLVQARIGFITLPHFLLPILTITPLSNHHSSWLGRWTTPPLHPPNRPKEEKAQVANDSLSAADPLSECHPLSEAYNLLSGLGNPKRGLVRDVLAQRATNSPNKVVVPSCA

SEQ ID NO: 180206 - protein, 143 aa, Glycine max
  Coding DNA Sequence Number=SeqID_63428
  Gene Ontology: Mol. function=chromatin binding; Cellular component =chromatin; Biological process=chromatin assembly or disassembly
  Homolog annotation: Hit_ID=Q1SAV4; Match level="QueryCoverage=66%, HitCoverage=33%, E-value=8e-27, Identity=69%"; Hit description =Integrase, catalytic region
MEKTQILFEDSVKNLGLIVSLGVVSHTHAKLSATQAEQFSPEGWGRGSRCVPFEYISTTTMIVVKPLETGNLVMKSMDKSSQIVEGMGKGCNKPAGLQKEENLEGAEAAVSLSLDHVLSEHQPLSETSARLTSKGNLGDNMPR

SEQ ID NO: 180207 - protein, 753 aa, Glycine max
  Coding DNA Sequence Number=SeqID_63429
  Gene Ontology: Mol. function=monooxygenase activity; Cellular component=mitochondrion; Biological process=electron transport
  Homolog annotation: Hit_ID=Q84VG6; Match level="QueryCoverage=70%, HitCoverage=99%, E-value=0.0, Identity=37%"; Hit description =Pentatricopeptide repeat-containing protein
  Pfam annotation: Domain name=Aa_trans; Domain location=498-750; Score= -158.4; E_value=0.065; Accession=PF01490.8; Description=Transmembrane amino acid transporter protein
  Pfam annotation: Domain name=PPR; Domain location=106-140; Score=5.7; E_value=1.6; Accession=PF01535.11; Description=PPR repeat
  Pfam annotation: Domain name=PPR; Domain location=176-210; Score =29.6; E_value=1.1e-05; Accession=PF01535.11; Description=PPR repeat
  Pfam annotation: Domain name=PPR; Domain location=242-276; Score =41.6; E_value=2.7e-09; Accession=PF01535.11; Description=PPR repeat
  Pfam annotation: Domain name=PPR; Domain location=277-311; Score =14.5; E_value=0.14; Accession=PF01535.11; Description=PPR repeat
  Pfam annotation: Domain name=PPR; Domain location=312-346; Score =42.5; E_value=1.4e-09; Accession=PF01535.11; Description=PPR repeat
  Pfam annotation: Domain name=PPR; Domain location=347-381; Score =41.5; E_value=2.8e-09; Accession=PF01535.11; Description=PPR repeat
  Pfam annotation: Domain name=PPR; Domain location=382-415; Score =19.0; E_value=0.017; Accession=PF01535.11; Description=PPR repeat
  Pfam annotation: Domain name=PPR; Domain location=452-486; Score =18.3; E_value=0.027; Accession=PF01535.11; Description=PPR repeat
  Pfam annotation: Domain name=PPR; Domain location=487-521; Score =38.1; E_value=3.1e-08; Accession=PF01535.11; Description=PPR repeat
  Pfam annotation: Domain name=PPR; Domain location=522-556; Score =42.4; E_value=1.6e-09; Accession=PF01535.11; Description=PPR repeat
  Pfam annotation: Domain name=PPR; Domain location=557-591; Score =30.8; E_value=4.7e-06; Accession=PF01535.11; Description=PPR repeat
  Pfam annotation: Domain name=PPR; Domain location=70-104; Score=10.4; E_value=0.44; Accession=PF01535.11; Description=PPR repeat
  Pfam module annotation: Pfam domain module=Aa_trans::PPR::PPR::PPR::PP R::PPR::PPR::PPR::PPR::PPR::PPR::PPR::PPR; Domain location=498 -750::106-140::176-210::242-276::277-311::312-346::347-381::382 -415::452-486::487-521::...
  Pfam module annotation: Domain location=522-556::557-591::70-104
  Subcellular localization annotation: CTP_CleavageSite=35; ConfidenceScore=5.45e-01
MRKLWKAFAYPTSSPTHFLRRFQFQTHSSSSSAPSQEHVSQLILDQKSASEALEYFRWASTVPNFVHSQSTYRALIHKLCTFRRFDTVKQLLDEMPHSLGAPPGDDIFITIIRGLGRARMTRTVIKVLDLVYKFHGSPSLKIFNSILDVLVKEDIDMAREFYRKSMMASGVEGDDYTFGILMKGLCLTNRIGEGFKLLQLIKSRGVAPNTVVYNTLLHALCRNGKVGRARNLMNEMEDPNDVTFNILISGYCKEGNSVQALVLLEKSFSMGFVPDVVSVTKVLEILCNAGRTMEAAEVLERVESMGGLLDVVAYNTLIKGFCGAGKVKVGLHFLKQMENKGCLPNVDTYNVLISGFSESGMLDLALDLFNDMKTDGIKWNFVTFDTLIRGLCSEERIEDGFSILELMEESKEGSRGHISPYNSIIYGLLKKNGFDESAEFLTKMGNLFPRAVDRSLMILEHCKKGAIEDAKRVYDQMIDEGGIPSILVYNCLVHGFSKQGNVREAVELMNEMIANNCFPIPSTFNAVITGFCRQGKVESALKLVEDITARGCVPNTETYSPLIDVLCRNGDLQKAMQVFMQMLQAHGPPHALRHRLPHPPQTRISLLLAAKSIVMVEDVFVFVKNKPDLKIFGGLSVFFYGIGVAVYAFEGIGMVLPLETEAKDKKNFGYLAFGEETKDIITTNLGPGVISVLVQLGLCVNLFFTFPIMMNPVNEVGDGVGHKLGGAFGAQFCGRSWGGGVFFGMGQLRFLGL

SEQ ID NO: 180208 - protein, 73 aa, Glycine max
  Coding DNA Sequence Number=SeqID_63430
MVWRSLIVEELLDFEDPANRILAIEMRNHWRFRGRGVDGESNKMIKDEVHLDAFNGYLSGVVFWHGTELRTEL

SEQ ID NO: 180209 - protein, 697 aa, Glycine max
  Coding DNA Sequence Number=SeqID_63431
  Gene Ontology: Mol. function=ionotropic glutamate receptor activity; Cellular component=integral to membrane; Biological process=ion transport
  Homolog annotation: Hit_ID=Q84W41; Match level="QueryCoverage=92%, HitCoverage=68%, E-value=0.0, Identity=54%"; Hit description =Glutamate receptor 3.6 precursor
  Pfam annotation: Domain name=ANF_receptor; Domain location=47-410; Score=284.2; E_value=2.5e-82; Accession=PF01094.18; Description =Receptor family ligand binding region
MIKAWLLVLMVLSNGFFSNGDGMHNSTIPDFVNIGALFSFNTSVGRSIKIAIEAAVEDVNSDPTILGKTKLNLSLQEDSKYRGFLSISEVLQVMARRTVAIIGPHSSVTAHVITHIANELQVPLLSFSALDPTLSSLQFPFFIRTCHSDLYQMTAIADLVNYHDWKDVIAVYLDDDNGRNGIGALGDKLAERRCRISYKAPLSPDASMEEITNVLVQVALAESRVIVVHANTQFGPKLFSVAKNLGMMGTGYVWIATAFLSALLDINSPLSPDSLDDIQGVLTPRMYIPDSQLKRRFASRWKNLTSGNTANAHLGLSFLPLYAYDTVFVLARALDAFFKQGNQITFSTDSKLSSLHGDNLNLEALKIFNEGNLLRSNIYEVNMTGVSGPFKYTSDRNLVNPAYEIINVVGTGTRRIGYWSNYSGLSVVPPETLYSEPANLSRENQKLFPPIWPGNTGERPRGWVFPNNGRLLKIGVPKGVSYKEFVSQIKGTDMFEGFCIDVFLAAVNLLSYAVPYKFVAYGDGKSNPSMTELVRLITTGVSIMPITFFVEFECFKEFDGAVGDIAITTERTRMVDFTQPYIESGLVVVAPVRKSESNALAFLAPFTPNMWCVTAIFFILVGAVVWILEHRVNDEFRGPPKKQVVTVLCFGYYVCNLFVLHLAVSASSLSFVTSIVKVAASLRLIKLLLSTMQGKIQ

SEQ ID NO: 180210 - protein, 66 aa, Glycine max
  Coding DNA Sequence Number=SeqID_63432
MENLGTEEKWRKWSPELAKRIVNAKIIVVVYNSTRQQRDDVNSEDCLLTQEWWVGFWNRIYIHTHH

SEQ ID NO: 180211 - protein, 77 aa, Glycine max
  Coding DNA Sequence Number=SeqID_63433
MAGHASVDSPAIGSCETKVAMTHAKLGHVFALEETRTLLLHWLGQSEACSRSHALQSTCNDTQHLQKFDTEESNKVV

SEQ ID NO: 180212 - protein, 237 aa, Glycine max
  Coding DNA Sequence Number=SeqID_63434
  Gene Ontology: Mol. function=ionotropic glutamate receptor activity; Cellular component=integral to membrane; Biological process=ion transport
  Homolog annotation: Hit_ID=Q9C8E7; Match level="QueryCoverage=97%, HitCoverage=23%, E-value=5e-60, Identity=52%"; Hit description =Glutamate receptor 3.3 precursor
  Pfam annotation: Domain name=Lig_chan; Domain location=1-154; Score= -61.1; E_value=6.7e-07; Accession=PF00060.17; Description=Ligand -gated ion channel
ELNIDESRLVPLTTPEEAAKALRKGPENGGVAAYIDERAYTDIFLSSRCDLTVIGQEFTRNGWGFIIPTANVNGLYYWAFPRDSPLAVDLSTAILQMIDSGDLQRIHDKWLLSSACLSQGAKFEVERLQLKSFWGLYMICGLACLLALFIYLIQIWRQYHKHYVSEELHSTDGQNIGSKSSHLKTFLSFVDEKEETFKSRSKRRKMERISYRNSEGSLSISSNQGYASRRSECASEV

SEQ ID NO: 180213 - protein, 675 aa, Glycine max
  Coding DNA Sequence Number=SeqID_63435
  Gene Ontology: Mol. function=endoribonuclease activity, producing 5' -phosphomonoesters; Cellular component=endoplasmic reticulum; Biological process=protein amino acid phosphorylation
  Homolog annotation: Hit_ID=Q1SZQ5; Match level="QueryCoverage=96%, HitCoverage=68%, E-value=0.0, Identity=64%"; Hit description=Protein kinase; PUG; Quinonprotein alcohol dehydrogenase-like
  Pfam annotation: Domain name=Pkinase; Domain location=250-566; Score =136.8; E_value=6e-38; Accession=PF00069.15; Description=Protein kinase domain
  Pfam annotation: Domain name=Pkinase_Tyr; Domain location=250-566; Score=-31.6; E_value=1.6e-10; Accession=PF07714.7; Description =Protein tyrosine kinase
  Pfam annotation: Domain name=Ribonuc_2-5A; Domain location=571-665; Score=100.4; E_value=5.5e-27; Accession=PF06479.2; Description =Ribonuclease 2-5A
  Pfam module annotation: Pfam domain module=Pkinase::Pkinase _Tyr::Ribonuc_2-5A; Domain location=250-566::250-566::571-665
MNVAEFKARLICQHNENPSGRDSFDAEDGYVVDRGLDFAMPYACWDMKLNEVYRQRKNFLLHPADPGRLSGIYQENIMLPFHTSELMLPSQPDMDGFILGQGGNMMLPLPISNSLPSLQQKLDFCESNDNVAMLPWPLMEISTQEEVDPKKVIEWSTTLPLILFTIFLGFFVFYHYLVVTNKDQNRELNSRSLPPKKKKARKSVKNNITIDNRQDKPMSSAEEDKLARKETNTDTYTQMQVDGRRIGKLFVSNKEIAKGSNGTIVFEGTYEGRVVAVKRLVKAHHDVAHKEIQNLIASDRHPNIVRWYGVECDHDFVYLALERCTCNLDDLIHMYSDISENPTICEDQYSNFFKNARIDTRNDMRYLWKANGFPSPLLLKLMSISIIGERRKGSIVNVVLDLRWYRLTAPIKKRDVVSGLVHLHELGIIHRDLKPQNVLILKEKSLCAKLSDMGISKRLLEDMSSLGHTVTGCGSSGWQAPEQLVQGRQTRAVDLFSLGCVLFFCMTGGRHPFGERLERDFNIVKNQKDLFLVEFIPEADDLISCLLNPNPDLRLTAIEVLHHPLFWSSEMRLSFLRDVSDRVELEDREIDSDLLKALESIAPLALGAKWDEKLDPDFITNIGRYRRYKYDSVRHLLRVMRNKLNHYRELPQEIQPSTSTLTADNDGDNVDDWLP

SEQ ID NO: 180214 - protein, 56 aa, Glycine max
  Coding DNA Sequence Number=SeqID_63436
MASGASWTSEKFPKTLGGELNKMGVQIAIFKFSNLGPFRTFLKLGYLRKKQPRSPG

SEQ ID NO: 180215 - protein, 66 aa, Glycine max
  Coding DNA Sequence Number=SeqID_63437
MATKGWSFVGASMVEEEEENGNPFKMHRLQKFWVEISRMSHLALRIHLKLVRKIVSVKKIQAEALP

SEQ ID NO: 180216 - protein, 86 aa, Glycine max
  Coding DNA Sequence Number=SeqID_63438
MPRAQNSIAHHSAYFGKRALEAARGAAFVEIPRFCKLIIVRNLNEAELKLSLTRGICGLSFGSKYVVTIMLLGLTLVQQEGSEDKA

SEQ ID NO: 180217 - protein, 146 aa, Glycine max
  Coding DNA Sequence Number=SeqID_63439
  Homolog annotation: Hit_ID=Q1SZQ5; Match level="QueryCoverage=62%, HitCoverage=9%, E-value=3e-19, Identity=52%"; Hit description =Protein kinase; PUG; Quinonprotein alcohol dehydrogenase-like
  Subcellular localization annotation: CTP_CleavageSite=51; ConfidenceScore=5.46e-01
MKCRVSIFLLSLILLFFFFFFFFFSLSASQSQQLSLPSLPAPSLKPATALVAALDGTMYLVDSVSGRVFWSFSTGSPIYHHSYRAPINDPEDNNVTGLIECGDDWELIVHDARFETLRINCKLCCFNPYRNKGGSIDIWIQKRHYV

SEQ ID NO: 180218 - protein, 419 aa, Glycine max
  Coding DNA Sequence Number=SeqID_63440
  Gene Ontology: Mol. function=sulfotransferase activity; Cellular component=integral to membrane; Biological process=transport
  Homolog annotation: Hit_ID=Q1SZN9; Match level="QueryCoverage=99%, HitCoverage=100%, E-value=0.0, Identity=81%"; Hit description=Auxin Efflux Carrier
  Pfam annotation: Domain name=Mem_trans; Domain location=9-411; Score =373.0; E_value=4.6e-109; Accession=PF03547.8; Description=Membrane transport protein
MGFLELLEVASLPVIQVLLISALGALMATQYFDNLLSPDIRKALNKIVFLIFTPSLVFSSFAKSVSLDDMISWWFMPVNVGLTFLIGGIIGWILVKLLKPNLKVEGLIIAACSSGNMGNLPIVIIPAICDEKGGPFGARDICRNNALSYASFSMALGGIFIWTYTYQTVKSRSLKFKALEAAEIVKVPNKDFDANAETHLLKDNDSEDTTIEVPTSTYIGDTENQIIVDQDQSNVSKKTESSWHRMVEVMSHLLAELVSPPAIATFFGFLFGAVAWLRNLIIGDNAPLRVIQDSLQLLGNGTIPCITLLLGGNLTQGLKSSSVKPLTLTSIIIARLFLLPVIGLFIVRAAANLGLLPVDPLFQYVLVMQYAMPPAMNISTVAQLFEVGNEECSVILLWTYTAAAIALTAWSTFLLWLLS

SEQ ID NO: 180219 - protein, 59 aa, Glycine max
  Coding DNA Sequence Number=SeqID_63441
MTIPYSDRAVWVEYQHTLQAAKRLKKKKIESKIMEVLCFSLAVGDAAQLTIADLDCDCI

SEQ ID NO: 180220 - protein, 110 aa, Glycine max
  Coding DNA Sequence Number=SeqID_63442
MKNKKRSALSRCKTEERARSTRLASTVALSALINLNERTKRVLVVLSAWLPVNVVPCPHQGKRPTGTLPALPQRLLDTGTQEAQMGPGAYTPTREENRCGSGERVLFEPL

SEQ ID NO: 180221 - protein, 98 aa, Glycine max
  Coding DNA Sequence Number=SeqID_63443
MTQSTFPPILLFPNSISASGKGGTSFREEKFEELVAVAFDFEDKRTREVLTEKIAQLNSAIDGVSAQLRPDEDSNEIAVNSEEIEIPISDESEIEVNK

SEQ ID NO: 180222 - protein, 68 aa, Glycine max
  Coding DNA Sequence Number=SeqID_63444
  Subcellular localization annotation: CTP_CleavageSite=38; ConfidenceScore=5.27e-01
MPLILGNTGSGSTSQVKKWNMNSTRWEGQKQKSKRGVKRKVLWGNKRVVSKIANTEPDTCEQRETPAL

SEQ ID NO: 180223 - protein, 435 aa, Glycine max
  Coding DNA Sequence Number=SeqID_63445
  Gene Ontology: Mol. function=nucleic acid binding; Cellular component= intracellular; Biological process=DNA integration
  Homolog annotation: Hit_ID=Q1RWN2; Match level="QueryCoverage=98%, HitCoverage=32%, E-value=1e-108, Identity=45%"; Hit description =Peptidase S8 and S53, subtilisin, kexin, sedolisin; Integrase, catalytic region; Zinc finger, CCHC-type
  Pfam annotation: Domain name=zf-CCHC; Domain location=245-262; Score =20.7; E_value=0.00038; Accession=PF00098.13; Description=Zinc knuckle
MSTIEKFVQPAIPRFDGHYDFWSMTMENFLRNKELWQLVEDGIPTLGATPTEAQRRSAAEANLKDMKVKNYLFQAIEREILETILDKSTSQAIWRSMQQKYQGSTRVKRAQLQALRREFELLIMKDGEKIDTYLGRTLSVVNKMKANGEIVDSSTVVSKILRSLTQNFNYVVCFIEEANDLSTLSLDELHGSLLVHEQRMQSFQPDEQVLKVTHDDRLGASRGRGRGSRGRGRGRGRQPFDKALVECFQCHKLGHFQYECPGVEKQAHYATFEDATEAEDEILLVAYEEMTQSVQREDWFLDSRCSHHMTGNKQWFTEIHEEGLNKNVKLGNDTTLNVAVRGSIQVQINDVTHVISDVYYVPELKTNLISLGQLQEKGLAILIQNDTCKIFHPDRGLIIHTNMRGNLMFYVSASMTSQHPQCFQAEDDSDKATLL

SEQ ID NO: 180224 - protein, 302 aa, Glycine max
  Coding DNA Sequence Number=SeqID_63446
MGGSWCGSAKMPTKVSRRERMTDGVFRSVVGDWVEDSWAGLGMGVMWYKAEMLRGNGAQQFQPLHPQDNIGTTEKVEETSDAGLDEVVGAPSINQDNHVMIGDGAIETKCLWSRGERGSGGGLVSNWSRVGGSTSGSTIMRAMSSGNNLLKGSLGAEGLAGNGGKTGETSWHNSSKRPDTKQLSRNGGSEAYDPFCEALIFSEIVIHRSSLLQLKQGALWIIVEGWGDLGEEDEGHKVFKDGVNFRVEGGLGLGKGGLCLGEVGVALGKAGDRLLEAVSGGSTRVMLRHDRQQVEPVVTAIN

SEQ ID NO: 180225 - protein, 898 aa, Glycine max
  Coding DNA Sequence Number=SeqID_63447
  Gene Ontology: Mol. function=nucleic acid binding; Cellular component= chromatin; Biological process=DNA integration
  Pfam annotation: Domain name=rve; Domain location=35-198; Score =165.2; E_value=1.7e-46; Accession=PF00665.16; Description=Integrase core domain
  Pfam module annotation: Pfam domain module=RVT_2::rve; Domain location=403-659::35-198
MVIGLPSLKTPKTICTICLVGKQHRDVIPKQSSWRALMKLQLIHADICRPISPASHSNKRYILSFIDDHSCKTWIYFLHAKSETFNAFKSFKACVEKEAGTHIVCLRTDRGGEFNSKEFLDFCNQHGISRQLTTAYTPQQNGVVERKNRTIMNVVRAVLHDKQVPKSFWSEAVRWCVHVQNRSPTSAIDQGTLEEVWSGVKPHVDYFRTFGCVAHAHIPDQKRSKLDAKSQQCILLGVSDETKAYKLYDPITKKVIVSRDVVFEEDKSWNWDAHVDGGTTPALDWGDKDVEEIETAESASQQITVSHDQPVTLKPTSNSAPADSPVEGRATRTRRQPLWMSDYETNLSVEEESLLAMMITDSEDPQSFEEVYMSQHLREMMITDSGDPQSFEEAYTSQHWREATNVEMKAIEKNKTWELVNLPDSVKPIGVKWIFKTKFNEHGQIEKYKARIVAKGYAQQYGINYIEVFAPVARLDTIRVLLAVAAQRSWEEFQLDVKSAFLHGELQEEVYVQQPIGFIKKGRENHVYRLKKALCGLKQVPQTWYSKIKAYFAREKFVRCSSEHTLFMKKVHDNVLIVSLYVDDLIFTGNCKDICEEFKSSMQLEFDMTDLGKMRHFLGIEVIQSKAGIFICQRQYAREVLALFNMIECNSVRNPIVPGTTLSKDDEGASVDAIKFKQAIGSLMYLTVTRPNLMFRVSLISRYMTNPKESHWAATKRIFKYLKGTIEHGLFYQKGKKIGLSAYSDSNYAGDLDDRRSTSGSVFMMGTAAVSWASKKQPVASLSTTEAEYIAATSCACQCIWLRRILEHLGLEEKEATEILCDNKSTIQLSKNHVLHGRSKHIAVRFHFLRDLVNDQVVQLKYYNTNEQVAGMMTTAVKLDQFEKFRHMLGVVKVTEIS

SEQ ID NO: 180226 - protein, 67 aa, Glycine max
  Coding DNA Sequence Number=SeqID_63448
MYGVLQELSMQRGFIPALPLLPLNWTRLTLSLLLLGSKFHEERDWLGRRAHVIDELLVKKLNLSLTW

SEQ ID NO: 180227 - protein, 103 aa, Glycine max
  Coding DNA Sequence Number=SeqID_63449
  Gene Ontology: Mol. function=RNA-directed DNA polymerase activity; Cellular component=chromatin; Biological process=RNA-dependent DNA replication
MELEKQVATMLNVGLIQPSHIPFSSPVLFVKTMDGSWRYCIDYRALNAITVKDCFLMPTIDELLDKLGHASWFSKLDLCQGFHQIRMTEEDIPKTAFQTHHDH

SEQ ID NO: 180228 - protein, 131 aa, Glycine max
  Coding DNA Sequence Number=SeqID_63450
MATLSSFITTPKNPKTHFLSGDYFHHHHHHHHHHHCHCPKGEKYIIWAPKDVTCHPHNSDHLMSGDAGLGKLIQHPLSSDFPGNLIFRLMSGSSFMSMDKCFLKISTSGHFTDFSLRAKATSNQPLVIRAG

SEQ ID NO: 180229 - protein, 105 aa, Glycine max
  Coding DNA Sequence Number=SeqID_63451
MPQLHKPKSCSGVNSCYPLLVLGLNIYDEIGEVNEDNGFFDYSVSLLTYPVVYVGWSKYMTFVIDYKNKRSNEWEGIGIFTLSNVKYLLLEIRSGKRELFNSKML

SEQ ID NO: 180230 - protein, 380 aa, Glycine max
  Coding DNA Sequence Number=SeqID_63452
  Gene Ontology: Mol. function=binding; Cellular component=spliceosome; Biological process=nuclear mRNA splicing, via spliceosome
  Homolog annotation: Hit_ID=Q9FMF9; Match level="QueryCoverage=98%, HitCoverage=30%, E-value=1e-99, Identity=51%"; Hit description =Nuclear protein-like
  Pfam annotation: Domain name=SF3b1; Domain location=276-379; Score =121.6; E_value=2.3e-33; Accession=PF08920.1; Description=Splicing factor 3B subunit 1
MASVDPEIAKTQEERKRMEQQLASLTSVTFDTDLYGGSDKGSYLTSIPANEDDENLDAMDNEVARKLASYTAPKSLLKDMPSAPDSDNDIGFRKPQRIIDREDDYRRRRLNQIISPERHDPFAAGEKTPDPSVRTYADIMREEALKREKEETLKAIAKKKKEEEEAAKDAPPQQQQKRRNRWDQSQDDGGAGAAAAAKKAKTSDWDMPDTTPGRWDATPTPGRVTDATPGRRNRWDETPTPGRVADSDATPAGGATPGATPAGMTWDATPKLSGMATPTPKRQRSRWDETPATMGSATPLPGATPAAAYTPGVTPVGGIELATPTPGALQGSITPEQYNLLRWERDIEERNRPLTDEELDAMFPQEGYKVLDPPCFVCAH

SEQ ID NO: 180231 - protein, 150 aa, Glycine max
  Coding DNA Sequence Number=SeqID_63453
  Homolog annotation: Hit_ID=Q9AVH2; Match level="QueryCoverage=31%, HitCoverage=16%, E-value=3e-20, Identity=97%"; Hit description =Putative senescence-associated protein
MARHKVTRTHTHTHSRRHKGEEGLGRDGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 180232 - protein, 143 aa, Glycine max
  Coding DNA Sequence Number=SeqID_63454
MEWYFSNSIPFLIMQGPQTTCTKEENTSNPNIVPNEDQKPSHHSSAFSISQQQPYSNIDNLPHSFALTLVEFVSNLFGANLGMPEATYAYMQSMYPSYHHNDANNSSLCAALGSFTPPSFNLNISQDMDESLQQTADNGQNAT

SEQ ID NO: 180233 - protein, 270 aa, Glycine max
  Coding DNA Sequence Number=SeqID_63455
  Gene Ontology: Mol. function=sugar porter activity; Cellular component=integral to membrane; Biological process=carbohydrate transport
  Homolog annotation: Hit_ID=Q1SZN1; Match level="QueryCoverage=99%, HitCoverage=32%, E-value=7e-89, Identity=72%"; Hit description=Sugar transporter superfamily; Major facilitator superfamily MFS_1
  Pfam annotation: Domain name=Sugar_tr; Domain location=1-253; Score= -155.8; E_value=0.054; Accession=PF00083.14; Description=Sugar (and other) transporter
MESSARARSQACINCWSRTSNTSTELCHEDQYPMRKLFFSLSCTLSYIFIPPNLIEAAGINGFLYYAPQILEKAGVGDLLSNLGLSSASASFLVNIITTFCMLPCIAIAIRLMDISGRRSIMLYTVPILIVCLLILVIKQFFQINSVVDAAITAISVVVYESVFCMGFGVIPNIICAEIFPTSVRGICISLTSLTYWGCTLIVTLIFPYLLQLLGLTGVFGLFVVGCIISWIFVYLKVPETKGMPLEVIIEFFAIGAKPGTDPAALGIKG

SEQ ID NO: 180234 - protein, 43 aa, Glycine max
  Coding DNA Sequence Number=SeqID_63456
MGCPNRCYCNNYCKSTNWNKKVIATQANQSLYGSATNSTTNIA

SEQ ID NO: 180235 - protein, 232 aa, Glycine max
  Coding DNA Sequence Number=SeqID_63457
  Gene Ontology: Mol. function=RNA-directed DNA polymerase activity; Cellular component=chromatin; Biological process=chromatin assembly or disassembly
MEKVYHKPFDKGIVLLGDIVPAIKDLCLPIGLREIDGAHTELGATKLEEFTPKFANKDRVAIKNHATGETVNNNKNNGIVIGLRKACDEIKGKVLPMVGADQLVASELVKEGELRDKKYQALVVQTGKSVYNHIMSSDVVLDRIIVSHELRDKLVVQVSVYRRHEILEALMAQAKHGKNFLLKKAMGWLDCMRKTPITTPEASVSKTNGKAKSERAKTKASVMARFKESKAC

SEQ ID NO: 180236 - protein, 70 aa, Glycine max
  Coding DNA Sequence Number=SeqID_63458
MATRGGHRWSWVVEEDFLGFLGGVLREEDIKIISLSKLVSLSENPFLTLSVTFRTGAISSRVGICVKCDN

SEQ ID NO: 180237 - protein, 277 aa, Glycine max
  Coding DNA Sequence Number=SeqID_63459
  Subcellular localization annotation: CTP_CleavageSite=61; ConfidenceScore=5.21e-01
MAMNRQMNGASVVFMSSLENHELPPNSSSNSSMVGIGNLSQIVIAFKARKSTQQRQRHWGQGMKGKGWGGQDSQGGWEWSSTEVLSLINDMVDNKMVPLNGNRNSRSEVQAINDEVVTHHDPALLTEILVGGVVGQCIKTDLWMWHFLVGLLGGAIIHISDFFLDDEQEETSLPAMIGAKLLITVWGRGVAGEDGTREWVGAIADDRGGGRGFVGNRAPQLMAKNVIGQTFEVVEVLRDHATLGELEKGILRGGEEGVGVKVTSWVRMESTLKAKSD

SEQ ID NO: 180238 - protein, 452 aa, Glycine max
  Coding DNA Sequence Number=SeqID_63460
  Gene Ontology: Mol. function=sugar porter activity; Cellular component=integral to membrane; Biological process=carbohydrate transport
  Homolog annotation: Hit_ID=Q1SZN1; Match level="QueryCoverage=99%, HitCoverage=63%, E-value=0.0, Identity=75%"; Hit description=Sugar transporter superfamily; Major facilitator superfamily MFS_1
  Pfam annotation: Domain name=MFS_1; Domain location=11-347; Score =56.7; E_value=7.8e-14; Accession=PF07690.6; Description=Major Facilitator Superfamily
  Pfam annotation: Domain name=Sugar_tr; Domain location=6-424; Score =33.7; E_value=6.3e-08; Accession=PF00083.14; Description=Sugar (and other) transporter
  Pfam module annotation: Pfam domain module=MFS_1::Sugar_tr; Domain location=11-347::6-424
MMEVVIVAIAATLGNLLMGWDSSTIAAGMTYIKKEFVLDATLEGLIVSMSFIIGTVVTIFSGTVCDLVGRRPMLITSSIMFFLSGLVMLWAPNVVIVLLARIIDGVAIALAVTLTPLYISEVAPADIRGQLNTLTQFACSGGMFLAYILVFSMSLSDSPSWRLMLGVIFIPAVAYFLLAVFYLPESPRWLVSKGRLLEAERVLKRLRGIEDVSGELALLAEGLSPGGEATSIEEYVVAPASELLVNQEAEKDYIKLYGPNDEGVTMVAQPVNGQGSMISRSMLSQQGSFGTLTGGGLKDPIVTLFGSLHENTLPESGGSRSMLLHNANSIFSIGETSSPFGTSDNLHAPLMSFQGGAGEKDRAYGSKDILGMRSNSSLRSNSSLVHGNAVDAPKNTNIGGGWQLVYKSADGAGGGKREGLQRVYLHADTAALSHSQHVSFVSTSGYDIPIDG

SEQ ID NO: 180239 - protein, 145 aa, Glycine max
  Coding DNA Sequence Number=SeqID_63461
  Gene Ontology: Mol. function=oxidoreductase activity; Cellular component=mitochondrion; Biological process=metabolic process
  Homolog annotation: Hit_ID=Q9LRE9; Match level="QueryCoverage=97%, HitCoverage=28%, E-value=2e-56, Identity=76%"; Hit description =Cytosolic aldehyde dehydrogenase
  Pfam annotation: Domain name=Aldedh; Domain location=1-145; Score= -251.7; E_value=6.8e-05; Accession=PF00171.12; Description=Aldehyde dehydrogenase family
MSYAGAADKIHGDVLKMNGDFHAYTLLEPIGVVRHIIPWNAPTLSFFTKVSPSLAAGCTMVLKPAEQTPLSALVCAHLAKLAGIPDGVVNVVSGFGPTAGAAISSHMDIDAFSFSGSVEVGRELMQAVAMSNLKPVSLELGDKSH

SEQ ID NO: 180240 - protein, 172 aa, Glycine max
  Coding DNA Sequence Number=SeqID_63462
  Homolog annotation: Hit_ID=Q948P6; Match level="QueryCoverage=19%, HitCoverage=13%, E-value=8e-08, Identity=85%"; Hit description =Ferritin-3, chloroplast precursor
MQDPIRITLTVVDDDDDLEPEEAEEKGSEENRTGEKVSREALEVKKELDLVPPVPQASLTGQKYTDDSEATINEHIKEREAGIKADPEIDAFMKGVAYLDWIFVPTLIPLSITESGIWIALTYYTIGFAPSASRGPWGPLSPILENNAITDNTHGDLFLPHLVILVQYCWDV

SEQ ID NO: 180241 - protein, 372 aa, Glycine max
  Coding DNA Sequence Number=SeqID_63463
  Gene Ontology: Mol. function=identical protein binding; Cellular component=cytoplasm; Biological process=negative regulation of enzyme activity
  Homolog annotation: Hit_ID=Q1SBZ8; Match level="QueryCoverage=95%, HitCoverage=46%, E-value=1e-124, Identity=62%"; Hit description =Protease-associated PA; Peptidase S8A, bacillopeptidase F
  Pfam annotation: Domain name=PA; Domain location=1-66; Score=17.1; E _value=0.0056; Accession=PF02225.12; Description=PA domain
FKGKTVLCDLGNIPMAEKGFAVKSAGGVGLVLGTVENDGEEQATEPTNLPTIVVGIEATKAIKKYLLYDPKSMATIVSQGTKVGIEPSPVVAEFSSRGPNLLTPQVMKPDLIAPGVDILGAWTRHKGPTDYKEDHRRVDFNIISGTSMSCPHVSGIAAIIKSVNPNWSPAAIRSALMTTAYSTYTNGKSLIDSATNKSSTPFDIGAGHVNPVLALNPGLVYDLTTTDDYLHFLCALNYTPKRIESVARRKYKCDPHKHYNVADLNYPSFSVVYKTNNPTIVKHTRTLTNVGVAGTYNVSVTLDIPSVKIVVEPNVLSFNQNENKSYTVTFTPSGPSPSTGFGFGRLEWSNGKNIVGSPISIYFEPPGVIGNS

SEQ ID NO: 180242 - protein, 94 aa, Glycine max
  Coding DNA Sequence Number=SeqID_63464
MVISIGEPDTPNKTVKQLGNWVKSKQNKHKLCSEKPYTHNQYQSSYSLLTPSKFNKNHSSFADTNHSRGQSLDLGRENTASSSARNSDIDHALS

SEQ ID NO: 180243 - protein, 100 aa, Glycine max
  Coding DNA Sequence Number=SeqID_63465
MADFRGGFLKKRHRIAVAWRVGNGGAMAVMAVMAASWPDLTQPYSVIHPKAQPSPPTKSAPSRVPPAPSRNAPQSARSHDTPCTQNAANSDYLWRRRAPA

SEQ ID NO: 180244 - protein, 189 aa, Glycine max
  Coding DNA Sequence Number=SeqID_63466
  Gene Ontology: Mol. function=RNA binding
  Pfam annotation: Domain name=zf-C2HC_plant; Domain location=20-75; Score=80.2; E_value=6.7e-21; Accession=PF07567.3; Description =Protein of unknown function, DUF1544
MAEPSSDAATASATRKNKADPGWKYCHSLVEGDTNTIVCNFCGKITKGGITRAKQHLIGKSGNVAACKKTPPNVVEELKEYMATKKSRTTYSTSGSGNMANIRDFEFGEPIGCDESEEDEFADSCNAAASVKTKRGTKKGPMDKFCKNPENAINRRKMEMLRQMNIRESLDKNDVSEGASTYCSLLVPS

SEQ ID NO: 180245 - protein, 168 aa, Glycine max
  Coding DNA Sequence Number=SeqID_63467
  Subcellular localization annotation: CTP_CleavageSite=24; ConfidenceScore=5.40e-01
MGSRGFLIHNQSSSVQSNLSLGFSSSHASPPPRSDPLVPLQLMEPQTENGNLDVESDDDEDKEVKEFLILGDSMCLKRRRDCDSSSSSFAAKRVSIEPDLDARKAVVRAWGCQPLYIGVVDGDHAMPMDMVIVGDERGSFDFVHKSGNDSRIICSKRGNIEDVALVFA

SEQ ID NO: 180246 - protein, 119 aa, Glycine max
  Coding DNA Sequence Number=SeqID_63468
  Gene Ontology: Mol. function=nucleic acid binding
  Homolog annotation: Hit_ID=Q1SHC9; Match level="QueryCoverage=98%, HitCoverage=34%, E-value=5e-13, Identity=28%"; Hit description=Zinc knuckle, putative
MKLSTNGGNVPAQLLVLDGKNWERWHIQMKALFEFEDVMEVVKNGVAAEPTEPATEAFDSMTMEENEKIVDFFAQVKVVINQMATQGETLTDGKICEKITRSLLEKYDYIVCAIEESKE

SEQ ID NO: 180247 - protein, 193 aa, Glycine max
  Coding DNA Sequence Number=SeqID_63469
MKIPAFHPARTAALRELRGLEELFQAYNICYYTAAKIAELGFFVGTSSSANATASKPSSELNDAALKMTTSSAWILKIVGYENMYGSRIKALDNLVEEFIGNNQLTFEELNSENLKLQKKVEKKENSKRRKDDHNLTQKSKDKKFWNRQNIERVFDPAVKSSNFTARSNVSPYAPPLITMDNDDGISYTGSVT

SEQ ID NO: 180248 - protein, 379 aa, Glycine max
  Coding DNA Sequence Number=SeqID_63470
  Gene Ontology: Mol. function=nucleotidyltransferase activity; Biological process=RNA processing
  Homolog annotation: Hit_ID=Q8GZ55; Match level="QueryCoverage=90%, HitCoverage=80%, E-value=2e-14, Identity=31%"; Hit description =Putative poly(A) polymerase
MADLRSLKLETVIPAQMSFKEDPARLGLSLSRETEAAMWKYSSLVKSLDKNKIMIELNYMLSYGAAEPSLHLLWKFKLLEFLLPVHAAYLDEQAIKEDAPASNMLMAPIQLNLFGFQIFVPKKAGKLASAIFKMLASDVEFYKTERRKNSKINYGMLGKGHLSEIAFVLGKIVLETMSSGTVGDGEDSEAGQCHLKTEGTKEIAQSQLPDLVNHEVAAMNGEGHLLSIPNSECRQGKSKKRKLVKNRCIAKKKMSSGNQELSEKFEYKENKEEQQKLVKLSQKVDMSTEDSLPKKKNDHRKQLISDRKKITSANKSFLHQAKHMKTDEDSTCMPSQSTVSENHQVIANSNIDVNAKTTNESNLKKKKKGLSLVEMFKGK

SEQ ID NO: 180249 - protein, 126 aa, Glycine max
  Coding DNA Sequence Number=SeqID_63471
  Gene Ontology: Mol. function=hydrolase activity; Biological process =metabolic process
  Homolog annotation: Hit_ID=Q3R3C2; Match level="QueryCoverage=59%, HitCoverage=25%, E-value=9e-28, Identity=77%"; Hit description=PP -loop
  Subcellular localization annotation: CTP_CleavageSite=68; ConfidenceScore=5.58e-01
MEPMSAVISFPIPCRVPSRAPPAIRAWPSASSTSWPSACAASCRRRRRAVRAGGGEPGPEAAGLPRARAAGVPGRAGRAVPHHRAGHLFGGQPGHSGRQDDVLAVLAAAWWCAVQIRRKPGLHLDR

SEQ ID NO: 180250 - protein, 114 aa, Glycine max
  Coding DNA Sequence Number=SeqID_63472
  Gene Ontology: Cellular component=chloroplast
  Homolog annotation: Hit_ID=P03938; Match level="QueryCoverage=57%, HitCoverage=50%, E-value=1e-11, Identity=78%"; Hit description =Hypothetical 14 kDa protein ycf68
MGAGHARSRYLNRKEGDAEGGASDWSEVVTRRIDGAIQVRSNVDPTFSSLVGSGRSGGDHHGSSLLENSYIPYQYMDSYLSSTGLGLASMEKNGAPNNVSSQTKNYEIAPFILG

SEQ ID NO: 180251 - protein, 83 aa, Glycine max
  Coding DNA Sequence Number=SeqID_63473
MVAEKTIEAKGSRHHSAFHGIQANMRNWDWVWVWVWGLHISWESGGGGNWERGCGETYVPQRQSWSYVSGSLAKAVAYVNVEG

SEQ ID NO: 180252 - protein, 153 aa, Glycine max
  Coding DNA Sequence Number=SeqID_63474
  Gene Ontology: Mol. function=RNA-directed DNA polymerase activity; Cellular component=chromatin; Biological process=chromatin assembly or disassembly
MTEAPILVSPDFSIAFTVETDAFALAMGAVLMQNSHPISYYSKVLCPRLQCAFAYVRELHAITVAVRKWRHYLFGHTFTILTDYRSLKELVSHAIQTPGQQIYLSKLLGYDYVIQYKSSPQNIVVDTLSRLPTSEAAQLYSLSMPNFVFLDQL

SEQ ID NO: 180253 - protein, 318 aa, Glycine max
  Coding DNA Sequence Number=SeqID_63475
  Gene Ontology: Mol. function=chromatin binding; Cellular component =chromatin; Biological process=chromatin assembly or disassembly
  Homolog annotation: Hit_ID=Q1SAV4; Match level="QueryCoverage=89%, HitCoverage=98%, E-value=1e-68, Identity=41%"; Hit description =Integrase, catalytic region
  Pfam annotation: Domain name=Chromo; Domain location=254-305; Score =17.8; E_value=0.0078; Accession=PF00385.14; Description='chromo' (CHRromatin Organisation MOdifier
MGVAKTFLRLHHNFDWPHIHDDVHRLVSQCVVCQQMKYETKKPVGLLQPFPVPSSVWEDVSLDFIMGLPPFHRFTTILVVVDHFSKGAHFGAFPPHNSAYKTAMLFLDMQYLRAFVYDRPSQWFRFLYVVEWSYNTSVHSGIGLSPFEVIYGKSSPSIPHYILSDTLAATDAHRRDVEFAIGDWVYVRVRPFRQTSLVLAYTKLTKRYYGPFQLPSSSRIHPTFHVSLLKLHHGPPLTQPAVLPPSSIDNHRIIEPLHILDWKWDYSSSPPTKLVLVQWNGLAQEDTTWEPLAKLRDSYNLEDKVVFGEGGDDSNSNH

SEQ ID NO: 180254 - protein, 574 aa, Glycine max
  Coding DNA Sequence Number=SeqID_63476
  Gene Ontology: Mol. function=protein binding; Cellular component =intracellular; Biological process=small GTPase mediated signal transduction
  Homolog annotation: Hit_ID=Q8RX50; Match level="QueryCoverage=96%, HitCoverage=98%, E-value=0.0, Identity=62%"; Hit description=PSR9
  Pfam annotation: Domain name=LRR_1; Domain location=267-288; Score =11.8; E_value=1.8; Accession=PF00560.23; Description=Leucine Rich Repeat
  Pfam annotation: Domain name=LRR_1; Domain location=290-311; Score =17.1; E_value=0.066; Accession=PF00560.23; Description=Leucine Rich Repeat
  Pfam annotation: Domain name=LRR_1; Domain location=313-334; Score =17.0; E_value=0.068; Accession=PF00560.23; Description=Leucine Rich Repeat
  Pfam annotation: Domain name=LRR_1; Domain location=336-357; Score =18.6; E_value=0.022; Accession=PF00560.23; Description=Leucine Rich Repeat
  Pfam annotation: Domain name=LRR_1; Domain location=359-380; Score =7.7; E_value=10; Accession=PF00560.23; Description=Leucine Rich Repeat
  Pfam annotation: Domain name=LRR_1; Domain location=382-403; Score =9.7; E_value=4.4; Accession=PF00560.23; Description=Leucine Rich Repeat
  Pfam annotation: Domain name=LRR_1; Domain location=405-426; Score =10.4; E_value=3.3; Accession=PF00560.23; Description=Leucine Rich Repeat
  Pfam annotation: Domain name=LRR_1; Domain location=428-449; Score =13.3; E_value=0.9; Accession=PF00560.23; Description=Leucine Rich Repeat
  Pfam annotation: Domain name=LRR_1; Domain location=476-497; Score =15.4; E_value=0.21; Accession=PF00560.23; Description=Leucine Rich Repeat
  Pfam annotation: Domain name=LRR_1; Domain location=499-520; Score =1.5; E_value=1.5e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=267 -288::290-311::313-334::336-357::359-380::382-403::405-426::428 -449::476-497::499-520
MECWNSVDGVVEEIMRIHRSLPARPGIDEVEAARGLIGNVEKEDQARLEAIARQSKGVDVPEELFMVLQEMQRNVLYYQSKEQKREAVKLLDLDNVHSLFDELIQRASKCVASPSAKTSYSNGSASSVSTSLSKNSVSNSVSVGGFDKPPLAPTAAAATTTTSRKFNVEKERSELVTRDDSYVKKAKSSFYSNGYGFEPTIPSKASILDSSLKPTSTAGQDGDKLSLIKLASLIEVSAKKGTRDLKLQNKLMDQVDWLPDSIGKLSSLVTLDLSENRIMALPATIGGLSSLTRLDLHSNRITELPDSVGNLLSLLYLDLRGNQLTLLPASFSRLVRLEELDLSSNQLSALPDSIGSLVRLKILNVETNDIEELPHSVGSCSSLRELRVDYNRLKALPEAVGKIQSLEILSVRYNNIKQLPTTMSSLTNLKELNVSFNELESVPESLCFATSLVKMNIGNNFADMRSLPRSIGNLELLEELDISNNQIRVLPESFRMLTRLRVLRAEENPLEVPPREIAEKGAQAVVQYMDELVEKREKKDVKAQPLKQKKSWAQICFFSKSNKRKRDGVDYVKT

SEQ ID NO: 180255 - protein, 217 aa, Glycine max
  Coding DNA Sequence Number=SeqID_63477
  Pfam annotation: Domain name=DUF296; Domain location=51-168; Score =18.0; E_value=1.6e-05; Accession=PF03479.5; Description=Domain of unknown function (DUF296)
  Subcellular localization annotation: CTP_CleavageSite=28; ConfidenceScore=5.17e-01
MNGKMGQQSDAAPPPFTSTPGGSNPLIPAAMGMSDDVLKTKALEEGSENSFWASVVLVDCNEDILQKLIPYAADSEIFILGATGEVSYVELVNPQEAPVENTVLQGNFEISAIEGNIVWPGNDDNNKKSQVTVLVSGTDGQIRGGPVRSLIAKSSIKVFVSTTSKHDTHNMASEEYYPRENDEVPLFQFQDQAERMAEIVDQIYKTTLKELNNQTNI

SEQ ID NO: 180256 - protein, 197 aa, Glycine max
  Coding DNA Sequence Number=SeqID_63478
  Gene Ontology: Mol. function=metal ion binding
  Homolog annotation: Hit_ID=Q69XV8; Match level="QueryCoverage=51%, HitCoverage=12%, E-value=2e-31, Identity=60%"; Hit description=Zinc finger CW-type coiled-coil domain protein 3-like
MKINNTLFFLQVAIINFQKYKFFILPPSIASESSPVNVAYEIDNTCSVDTHPRDYESAKDLKFPPRAEDHVNLFTAETCNEFQSRLPVKNFIRVDPSYLKTLGQVHSGWIFGGIAELVDNSRDAKATKMDIFVDLINLKKSGKDVPMLSVIDDGNGMNHAEVMKMVSFGHKQSDKDDKDHIGKFGVGFKVCLLNSAA

SEQ ID NO: 180257 - protein, 361 aa, Glycine max
  Coding DNA Sequence Number=SeqID_63479
  Homolog annotation: Hit_ID=Q1RYY9; Match level="QueryCoverage=91%, HitCoverage=98%, E-value=4e-19, Identity=26%"; Hit description =Immunoglobulin/major histocompatibility complex
MNSCFPSPDLGTNVIVTREQYFNFHNIDRQLFARFVVVLGRDTSQSAHVMAFIMWLEKQCKDKKMMKNMLQWPDTMLDSLADEAMLVLNCIESHQFPYDDVVNDESLPLIKSIMQKNVVSLKYFYVNHVIIIGAVTRLLNNICVKAFTDIVQKVQYMKEQNLQIANIYEVGPCVKQVVCYTPMPSANIISHQVAILTPLWGEGSLVSWETNNNINPPAEAYDVANQIELNQNFNEVLAMLNQTSITTGTNDEKKEVQVPIDDRIIFMTFSKGYPISEPEVRDFITRRYGDIIEAFCMQDVVPPEQPLYARLVIRAEAIHIIDHFLESSNKVKLSINGKHAWARKYFRKGNKSLKEKSPMTS

SEQ ID NO: 180258 - protein, 63 aa, Glycine max
  Coding DNA Sequence Number=SeqID_63480
MATRLGSLVPMQQSRLEKEKIESNKWTANWVSDPDVTRFEVCLVGMRLLPSDTITTYQRTTMV

SEQ ID NO: 180259 - protein, 216 aa, Glycine max
  Coding DNA Sequence Number=SeqID_63481
  Gene Ontology: Mol. function=nucleic acid binding
AEKVVEVIPKDSTENNIEDMNVDGANGVGKVNNGANDDEVKEHDEDADFSDHFESDPDYVGMEFDIIKMFIEAVRDYTIFHARDLKWQATMKWVAKRVTDKLRVHPNLNHVETHEHLREHYGVYIDERKMFRAIKEAQSLVEGSIQLQCAKLWDYSHELTRNNEGSTAGCKPFIGLDGCFLKGYYVSHLLVVVGQDANNAFFVIAYVVVNVEDKDN

SEQ ID NO: 180260 - protein, 34 aa, Glycine max
  Coding DNA Sequence Number=SeqID_63482
MKDEINCSLSTPRVKQSSTNLEITQTPNVESALA

SEQ ID NO: 180261 - protein, 76 aa, Glycine max
  Coding DNA Sequence Number=SeqID_63483
  Gene Ontology: Mol. function=transferase activity
  Homolog annotation: Hit_ID=Q8LB28; Match level="QueryCoverage=67%, HitCoverage=24%, E-value=3e-14, Identity=73%"; Hit description=GSH -dependent dehydroascorbate reductase 1, putative
MDLVPVVLFDGKWVDDSNVIVGILKEKYPKPSLITLPEFASVGSKIFGSFILRLQECLSKYEGTDDRSTPQDRVEC

SEQ ID NO: 180262 - protein, 302 aa, Glycine max
  Coding DNA Sequence Number=SeqID_63484
  Homolog annotation: Hit_ID=P42795; Match level="QueryCoverage=27%, HitCoverage=49%, E-value=1e-24, Identity=74%"; Hit description=60S ribosomal protein L11-1
MTEVPSEKFIFLHLQTTLQKLHRLVTSDSDIACNLLISSNPKGRTVYLAVKTKGFNLSSYGETICTLANGDIEDELLHLYLPHWEERRHEEVDLVEGKLVQVADVYLEGEEDEVGEGEERVESGELGLAGRELVVDEHRDGGSGGVVGKEEGVFIADCDGVGVVTTRLVGLGNFLHRNLEEDSEDSSPIKVFLLMWGFNGKQRQLTAATGGLGTPLGAQRHSFSIGTALSAPFALSERTKVVIFKITTGVTGVTGGGEGWRREFAESEKVHGVAGVKDAEARVLLDLNQDLQEQLFAQEKEP

SEQ ID NO: 180263 - protein, 75 aa, Glycine max
  Coding DNA Sequence Number=SeqID_63485
MARWLGCFGLALKLLFNSEGLGIRPGVMDGAINISAVQAISAYLLFEKDCFAFQKHNRIEVDSFFTVIHTQFCVS

SEQ ID NO: 180264 - protein, 81 aa, Glycine max
  Coding DNA Sequence Number=SeqID_63486
MGEKGRVWGSRRARARWRATRRLKSRVMAIETVRPTEMAREKVRRNKARKRMLEKRSLRYNGGPVPVSLDDEFVADNVQRI

SEQ ID NO: 180265 - protein, 216 aa, Glycine max
  Coding DNA Sequence Number=SeqID_63487
  Homolog annotation: Hit_ID=Q5XM22; Match level="QueryCoverage=34%, HitCoverage=42%, E-value=7e-31, Identity=85%"; Hit description =Resistance-like protein HAAS-2
ADIICGHVAHAVWSEQERPDLKLVSHGRKVTLIGRPVPEIEGMVGATGLSPLIDCSVVTGDPGLVSAFVERGGNLLLTELLEVSAEEARAETALTRGAYVRLGWVRDIYEKRCQVRRWIVAARAYLLHLVGCTLFANKSATYVHVIHLVAFRDLDQSGGYAWGVAALVHMYDQLDEASRTTTRQIAGARSMSTSLVCTSASQMIHTRRRPHVLPGG

SEQ ID NO: 180266 - protein, 414 aa, Glycine max
  Coding DNA Sequence Number=SeqID_63488
  Gene Ontology: Mol. function=protein dimerization activity; Cellular component=nucleus; Biological process=regulation of transcription, DNA-dependent
  Homolog annotation: Hit_ID=Q0GPG7; Match level="QueryCoverage=90%, HitCoverage=81%, E-value=1e-174, Identity=86%"; Hit description=BZIP transcription factor bZIP96
  Pfam annotation: Domain name=bZIP_1; Domain location=123-188; Score =24.0; E_value=0.00035; Accession=PF00170.11; Description=bZIP transcription factor
  Pfam annotation: Domain name=bZIP_2; Domain location=125-175; Score =20.3; E_value=0.0065; Accession=PF07716.5; Description=Basic region leucine zipper
  Pfam module annotation: Pfam domain module=bZIP_1::bZIP_2; Domain location=123-188::125-175
MLLNEPSSYFYLKAFIFHIFPKKDPMFNQMKSNSQALGADIQFGALNKSIATSDINLSAAIAASQALVFQKDSQPTLASTSAGRENWGETNMADASPRTDTSTDDTEDKNQRPERDESSGSKDKSDQKVTLRRLAQNREAARKSRLRKKAYVQQLESSRLKLTQLEQELQRSRQQGIFISSTGDQAQSMSGNGAMAFDVEYARWLEEHNRQTNELRAAINSHAGDIELRTIVDNFMTQFDDIFRLKGIAAKADVFHILSGMWKTPAERCFMWIGGFRSSELLKLLLSQLEPLAEQQLMGIYNLQQSSQQTEDALSQGMDALQQSLSETLANGSPSSSGSSGNVANYMGQMAMAMGKLGTLEGFLHQADNLRQQTLQQMLRILTTRQSARALLAISDYFSRLRALSSLWLARPRE

SEQ ID NO: 180267 - protein, 425 aa, Glycine max
  Coding DNA Sequence Number=SeqID_63489
  Gene Ontology: Mol. function=RNA-directed DNA polymerase activity; Cellular component=extracellular region; Biological process=RNA -dependent DNA replication
MVKEEKLDLLCMQETKQQEVSSNLCKALWGRDDVSWINYPASLERIWANGDIPIVVNIYALCDLASKKRLWESILFERRRNTMEAWVLLCDFNDIRVLSERKGESSQNYGDLDRKVFNCFIEDMGLEDLPLIGRRFTWTRPIGKSMRRIDHMLVSKEWPFRFLNCWLEDRDFKTFVEEKWRDFNVIGRGAFVLKEKLKLLQKEIRAWNKNQFGDLNAKMKILQEKMRYLEVMINWIQNGDYNSKFYHAYVNARRRFNLIKDLKHEGRWVEEPREIEIKEAIWDCEGLKAPGSDTFNFKFFKEFWPQLKNDILLFVKELHMHGCFSRGANASFIALIPKVNEPHGLGEYRPISLVRSLYKIITKLLARRIKVVLPGVIDQRQSAFLEGRHLIHSTLPAFKVVDKARRKKKKCVIFKVDYAKAHDSV

SEQ ID NO: 180268 - protein, 57 aa, Glycine max
  Coding DNA Sequence Number=SeqID_63490
  Subcellular localization annotation: CTP_CleavageSite=30; ConfidenceScore=5.02e-01
MTGVDGWVSSGVGVEDASRRVSSSSPSTAAAATGSSEASSWATEAPPLPEGEGWAPS

SEQ ID NO: 180269 - protein, 88 aa, Glycine max
  Coding DNA Sequence Number=SeqID_63491
  Subcellular localization annotation: CTP_CleavageSite=55; ConfidenceScore=5.57e-01
MFLLSLRTMSLSFLSLLLCHFDLHNATPTRFSSPSLYNITSTSPSRTSLPFTMPSSMRNFKWDNHFILLHCKLDLNVWESDLLVDEVA

SEQ ID NO: 180270 - protein, 95 aa, Glycine max
  Coding DNA Sequence Number=SeqID_63492
MERPRMEEFLMVMRRWGLDLKEKEHCTHAIPTHHCVAHTTAPPPHVKCATPPLPIMGLSQDWAILNQLKTTRHMFLYPNHIEQASQSRAPNYSQQ

SEQ ID NO: 180271 - protein, 156 aa, Glycine max
  Coding DNA Sequence Number=SeqID_63493
MGDLVVGLVVLLSWLLVLSSSWVLLRVSPESSRGPFGFVLCQLAHLNFQIPNGCIHALLMGSCFLDELQQQFFYIGGLFLLIGALAGMRAWRLMSSPGCNPGICDLVCPYSLLLERYPVGLHIVQAHGFLRMWGILLPAKQKSGKNLPLVIAEVIC

SEQ ID NO: 180272 - protein, 220 aa, Glycine max
  Coding DNA Sequence Number=SeqID_63494
  Homolog annotation: Hit_ID=P49208; Match level="QueryCoverage=33%, HitCoverage=35%, E-value=4e-24, Identity=79%"; Hit description=50S ribosomal protein L1, chloroplast precursor
  Pfam annotation: Domain name=Ribosomal_L1; Domain location=93-214; Score=-101.5; E_value=0.0076; Accession=PF00687.11; Description =Ribosomal protein L1pL10e family
MAKEFVNGFVHQNGIAVITDNPPKVFENINPNSRSVPCMSIKADLKWPKEAWILGQDVSASIFVILVPALPLKPLKRDKTRSKRSLEIQQLRERKKEYDLKTAISLVKETSKTKFVETVAAYFRLNIDPKYNDQQLRATVRTTTGFEKSSDHDYARVLPRIFPLFKFVTMNRSRTTTRFEEDICVIQICHHEQVRTTTGFEEGFGRHMHKKFYSQDNHGI

SEQ ID NO: 180273 - protein, 80 aa, Glycine max
  Coding DNA Sequence Number=SeqID_63495
MCCRKNSSSATCGHGVGIACMKEETKRIKRKEKKIQKRKMEKEKIEGENTERENVIMEKTQEREERVMEKTHTVTSIKRN

SEQ ID NO: 180274 - protein, 307 aa, Glycine max
  Coding DNA Sequence Number=SeqID_63496
  Homolog annotation: Hit_ID=Q1T4X1; Match level="QueryCoverage=46%, HitCoverage=94%, E-value=8e-60, Identity=79%"; Hit description =Calcium-binding EF-hand
  Pfam annotation: Domain name=efhand; Domain location=116-144; Score =36.1; E_value=1.2e-07; Accession=PF00036.22; Description=EF hand
  Pfam annotation: Domain name=efhand; Domain location=41-69; Score =27.7; E_value=4e-05; Accession=PF00036.22; Description=EF hand
  Pfam annotation: Domain name=efhand; Domain location=5-33; Score =35.1; E_value=2.5e-07; Accession=PF00036.22; Description=EF hand
  Pfam annotation: Domain name=efhand; Domain location=78-106; Score =34.7; E_value=3.2e-07; Accession=PF00036.22; Description=EF hand
  Pfam module annotation: Pfam domain module=efhand::efhand::efhand::efh and; Domain location=116-144::41-69::5-33::78-106
MDQGELARVFQMFDRNGDGRITRKELSDSLKNLGITILEQDLSLMIEKIDVNGDGFVDMDEFGELYQTIMDEKDEEEDMKEAFNVFDQNGDGFITGEELSAVLCSLGLKHGKTIEDCKSMIKKVDVDGDGMVNYREFKQMMKAGGASITASLFLLLRSVISHVGSSSSFGSSHDPRVKLAGTSSVEEESVVIYESNGMTYGGFLSPNMRYHSGHNASLNFTDDLEDGFSELETPAGDGNECDDLLTSDYADLLSDDVEEPHKEKERPRRGRVESKLFHEIMNAQCTSLHLVLEKWLEEGNELTREEA

SEQ ID NO: 180275 - protein, 445 aa, Glycine max
  Coding DNA Sequence Number=SeqID_63497
  Gene Ontology: Mol. function=DNA binding; Cellular component =mitochondrion; Biological process=protein amino acid phosphorylation
  Homolog annotation: Hit_ID=Q1T4X2; Match level="QueryCoverage=89%, HitCoverage=61%, E-value=1e-167, Identity=71%"; Hit description =Pentatricopeptide repeat
  Pfam annotation: Domain name=PPR; Domain location=100-134; Score =23.0; E_value=0.001; Accession=PF01535.11; Description=PPR repeat
  Pfam annotation: Domain name=PPR; Domain location=169-203; Score =20.9; E_value=0.0047; Accession=PF01535.11; Description=PPR repeat
  Pfam annotation: Domain name=PPR; Domain location=271-304; Score=0.2; E_value=7.2; Accession=PF01535.11; Description=PPR repeat
  Pfam annotation: Domain name=PPR; Domain location=305-339; Score =10.4; E_value=0.44; Accession=PF01535.11; Description=PPR repeat
  Pfam annotation: Domain name=PPR; Domain location=340-374; Score=4.5; E_value=2.2; Accession=PF01535.11; Description=PPR repeat
  Pfam annotation: Domain name=PPR; Domain location=376-410; Score =11.7; E_value=0.31; Accession=PF01535.11; Description=PPR repeat
  Pfam module annotation: Pfam domain module=PPR::PPR::PPR::PPR::PPR::PP R; Domain location=100-134::169-203::271-304::305-339::340-374::376 -410
MSGLASHDNERLTNTKRKQEVWKEMEERIPNIQGCRGGRKIHVLHIEQLQMLSEWLESKKEFEFIERDYASRLDLIAKLRGLHKAEVYIETIPESCSREIMYRTLLANCVSQNNVKKAEEVFSKMKDLDLPITVFTCNELLFLYKRNDKKKIADLLLLMENEKIKPSRHSYSILIDTKGQSKDIGGMDQIVDRMKAQGIEPDINTQAVLARHYISAGLQDKVETLLKQMEGENLKQNRWLCRILLPLYANLGKVDEVGRIWKVCETNPRYDECLGAIEAWGKLNKIDEAEKVFEMMVKKWKLSSKTCSILLKVYANNEMLMKGKDLMKRIGDGGCRIGPLTWDTIVKLYVQTGEVEKADSVLQKAAQQSQMKPMFSTYLTILEQYAKRGDIHNSEKIFLRMKQADYTSKAKMYQVLMNAYINAKVPAYGIRDRLKADSIYPNRNL

SEQ ID NO: 180276 - protein, 539 aa, Glycine max
  Coding DNA Sequence Number=SeqID_63498
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1T4X3; Match level="QueryCoverage=91%, HitCoverage=55%, E-value=0.0, Identity=85%"; Hit description=IMP dehydrogenase/GMP reductase
  Pfam annotation: Domain name=Glyco_hydro_31; Domain location=56-525; Score=223.0; E_value=6.8e-64; Accession=PF01055.16; Description =Glycosyl hydrolases family 31
MGGPIDPIIVSRIGSNSILEFGFRSNSIDIYIIKAYRFKFFVHWSLQIHGNSVEGRILHGNSPCELIERSTESIGRLPELPEWIISGAIVGMQGGTDAVRHIWDELRTYDVPVSAFWLQDWVGQRETLIGSQLWWNWEVDAQRYWGWKELIKDLSSQNIKVMTYCNPCLALVDKKQNKRRNLFEEAKKLDILVKDSNGNPYMVPNTAFDVGMLDLTHPKTATWFKQILREMVDDGVRGWMADFGEGLPVDAVLYSGEDPISAHNRYPELWAKINRELVEEWKSSSLDKVKEDEDEGLVFFMRAGFRDSPKWGMLFWEGDQMVSWQTNDGIKSSVVGLLSSGISGYAFNHSDIGGYCTVNLPIVKYRRSEELLLRWMELNSFTTVFRTHEGNKPSCNSQFYSNHQTMSHFARSAKVYKAWKFYRIQLVKEAAQKGLPICRHLFLHYPDDECVHRLSYQQFLVGSEFLVVPVLDKGKKKVKAYFPLGESSSWIHIWTGKVFSKQGREEWVEAPIGYPAVFVKVGSQVGETFLNNLRSLGIL

SEQ ID NO: 180277 - protein, 80 aa, Glycine max
  Coding DNA Sequence Number=SeqID_63499
MVRRPWCSFTLDKVEEKKRCGDTESILSSHDGIDPWLNIFDAILPGKGPITRAMSKRFQEGWTRAAEEDHRVLMNLKVDF

SEQ ID NO: 180278 - protein, 71 aa, Glycine max
  Coding DNA Sequence Number=SeqID_63500
MSMKNLVRHRGVHDKTNHTLASQVTLTRMLQPCGIGTGLKEHSNRVTPKAYTPKSPSGPLPPDSGPTQGIL

SEQ ID NO: 180279 - protein, 334 aa, Glycine max
  Coding DNA Sequence Number=SeqID_63501
QVEPEPSVAVEGGEPAKKKKKKTKSSKEQGDNQPVDVQPPSTDIDGTEVEAAPSIAEMGNPVEQPDSPQEQPAVEVQQNVSAEEIPSCARTSPAPEADAVNVEEWGEGQGIGSSSPHGWAEVDDHHEPNQSDNTIPHESSQKSSSEGNFFDEDAIKEAEAGGSDIYPVSSTSKLSASIGIAEDTFIQMQNEDPAAALRLLLNTSQANTSSDKIPGASTPSDAEINSSVRQDSLLLKLSTEYARKDVLKSIEENPSAAFGHLNFLKKLHNPLTSDETLGKVIQIEAIIDQFASAVQKKRENGTRLDAQKQAHTLLLEKARAAQHEVERLTKEAKE

SEQ ID NO: 180280 - protein, 327 aa, Glycine max
  Coding DNA Sequence Number=SeqID_63502
  Gene Ontology: Mol. function=metal ion binding; Cellular component =integral to membrane; Biological process=ubiquitin cycle
  Homolog annotation: Hit_ID=Q5ICP0; Match level="QueryCoverage=74%, HitCoverage=87%, E-value=2e-33, Identity=38%"; Hit description=RING -H2 subgroup RHE protein
  Pfam annotation: Domain name=C1_4; Domain location=118-162; Score= -8.9; E_value=0.03; Accession=PF07975.2; Description=TFIIH C1-like domain
  Pfam annotation: Domain name=zf-C3HC4; Domain location=119-160; Score= 27.2; E_value=5.8e-05; Accession=PF00097.15; Description=Zinc finger, C3HC4 type (RING finger)
  Pfam module annotation: Pfam domain module=C1_4::zf-C3HC4; Domain location=118-162::119-160
MAEDGNNNDVPLHKFKDSNPNPEEFDAKGYSLSGKIMLSAIILLFFVVVLMLCLHIYARWYLRRARRRQLRRQRELRRTQLVFYNDDATPAAVSRGLDAAILATLPVFTFDPEKTGPECAVCLSEFEPGETGRVLPKCNHSFHIECIDMWFHSHDTCPLCRAPVERAPEPEVVVITVPDPVSETGSGENENRTGSSSSSSSVGLSKPKPSLVGVTIEVPPRDENFQNELQPSCDSSSSFRSPMSRMLSFTRMLGREKKGNVSPSSCGGGDCSSAAERGGERRSWEVIFLIMGEMPLLKWLWSWIVVLTLNWSMGDIENSYDFHYHTY

SEQ ID NO: 180281 - protein, 149 aa, Glycine max
  Coding DNA Sequence Number=SeqID_63503
MGEVEEVQEQMKADMEAMKEQMATMMEAMVSMKKIMEANAVAIAATSTIAEVDLTPPYGLNQINHLIPNMVGLEGKDLGSTDGPMMCKFRTSMPSRHMACLPTIHHPIWRTLPMRMSITLLPYSLRADNLVMYMSLNPWGRHMKFPTTI

SEQ ID NO: 180282 - protein, 98 aa, Glycine max
  Coding DNA Sequence Number=SeqID_63504
  Gene Ontology: Mol. function=transferase activity, transferring glycosyl groups; Biological process=sucrose metabolic process
  Homolog annotation: Hit_ID=Q00917; Match level="QueryCoverage=98%, HitCoverage=12%, E-value=2e-36, Identity=74%"; Hit description =Sucrose synthase
MCIYFPYSDRERRLTSLHGSIEKLVYGAEQNEEHIGLLNDKSKPIIFSMARLDSVKNITGLVECFGKSSKLRELVNLVVVGGYIDLQKSTDVEEMGEI

SEQ ID NO: 180283 - protein, 118 aa, Glycine max
  Coding DNA Sequence Number=SeqID_63505
MSPKASPSASLIKIGSDGFDLIERHYGRFRRNQVPPFEVPIIVNSNNPGASFGGANIDNKENPKPPRRNWAVLHTCTKYESTDLSKRKKKNMRVLKELVHMVVCIRFAAECLYVMIAL

SEQ ID NO: 180284 - protein, 135 aa, Glycine max
  Coding DNA Sequence Number=SeqID_63506
  Gene Ontology: Mol. function=sucrose synthase activity; Biological process=sucrose metabolic process
  Homolog annotation: Hit_ID=Q84T18; Match level="QueryCoverage=71%, HitCoverage=11%, E-value=5e-18, Identity=57%"; Hit description =Sucrose synthase
  Subcellular localization annotation: CTP_CleavageSite=41; ConfidenceScore=5.31e-01
MSSSSFLSHTLFPFCSVSLFQCFTQFLPFPIPCPLPDIFDRASSLRERVQDTLSRYRNEFISLLSRYVAGGKGILQPHDLLDEVEKLLEEDEDMQKLKDSPFVKELESAKEAIVLPPFVSIALPSKTWCLGVCSC

SEQ ID NO: 180285 - protein, 821 aa, Glycine max
  Coding DNA Sequence Number=SeqID_63507
  Gene Ontology: Mol. function=oxidoreductase activity, acting on the CH-CH group of donors; Cellular component=mitochondrion; Biological process=electron transport
  Homolog annotation: Hit_ID=Q67ZU5; Match level="QueryCoverage=100%, HitCoverage=87%, E-value=0.0, Identity=71%"; Hit description=MRNA, complete cds, clone: RAFL22-73-C24
  Pfam annotation: Domain name=APH; Domain location=42-366; Score =159.3; E_value=9.8e-45; Accession=PF01636.13; Description =Phosphotransferase enzyme family
  Pfam annotation: Domain name=Acyl-CoA_dh_M; Domain location=650-704; Score=73.9; E_value=5e-19; Accession=PF02770.9; Description=Acyl-CoA dehydrogenase, middle domain
  Pfam annotation: Domain name=Kdo; Domain location=44-214; Score= -83.8; E_value=0.05; Accession=PF06293.4; Description=Lipopolysacchari de kinase (Kdo)
  Pfam module annotation: Pfam domain module=APH::Acyl-CoA_dh_M::Kdo; Domain location=42-366::650-704::44-214
  Subcellular localization annotation: CTP_CleavageSite=62; ConfidenceScore=5.12e-01
MARNTADLATNFNVAHHFPHDSLLRYCSSHVSGFPHPPTHFTVSQFGHGQSNPTYLLEVGSYGSVVKRYVLRKKPPGKLLASAHAVDREFQVLHALGTHTKVPVPKVFCLCNDPTVIGTAFYIMEYLEGRIFLDPKLPGVTSQKRRAIYRATAKALASLHSANVDSIGLGNYGRRNDYCKRQDRKLNTDGCHKKLLQHNKIHENECCGDLKKVELSIWFFKKFDEALIPSFPHAHLLVLLLYRDTKRRIERWAKQYVASTSEGKPASNPKMFALIDWLRNQIPPEDSSGATGGLVHGDFRIDNLVFHPTEDRVIGILDWELSTLGNQMCDVAYSCMPYIADIGPEKVHEGIEHFGLPEGIPSLPEYLADYCSLARRKWPVAEWKFYVAFSFFRAASIYAGVYNRWVKVSKLVRDAVVVKVSRFRGNASGGERARHTEVLTNGLIDTAWKFIEHKSVLPQHPPSDANAQDYSKELPNGNDIQELSNQGKFVPNQKVLVLRNKLIKFMEEHIYPMENEFYKLAQSDSRWTVHPVEEKLKEMAKKEGLWNLWIPKLFLSIYQLDSAVRARNLLFDGSNNYHSSDANDLLLGAGLTNLEYGYLCEIMGRSLWAPQVFNCGAPDTGNMEVLLRYGNKEQLQEWLIPLLEGTIRSGFAMTEPHVASSDATNIECSIKRQGDSYIINGTKWWTSGAMDPRCRILIVMGKTDFNAAKHKQQSMILVDVKTPGIHIKRPLTVFGFDDAPHGHAEITFENVCVPAKNIILGEGRGFEIAQGRLGPGRLHHCMRLIGVAERGMHMMVQRAVSRRTFGKLIAQHGSFISDMAK

SEQ ID NO: 180286 - protein, 579 aa, Glycine max
  Coding DNA Sequence Number=SeqID_63508
  Gene Ontology: Mol. function=enzyme inhibitor activity; Cellular component=cell wall; Biological process=cell wall modification
  Homolog annotation: Hit_ID=Q9SC90; Match level="QueryCoverage=98%, HitCoverage=89%, E-value=0.0, Identity=61%"; Hit description=Pectin methyl-esterase PER precursor
  Pfam annotation: Domain name=PMEI; Domain location=52-206; Score =123.1; E_value=7.9e-34; Accession=PF04043.6; Description=Plant invertasepectin methylesterase inhibitor
  Pfam annotation: Domain name=Pectinesterase; Domain location=261-557; Score=647.3; E_value=1.3e-191; Accession=PF01095.10; Description =Pectinesterase
  Pfam module annotation: Pfam domain module=PMEI::Pectinesterase; Domain location=52-206::261-557
MADYDGKEQKRRFAVLGISSILLVAMVAAVAVTINRGGNKGEEGDDESRVQTAQRNNVEMICNSTEYKETCKKSLEKASSDENADTKELIKAAFNASAVELLNHIKNSTLYKELAKDNMTRQAMDICKEVFDYAIDGVQKSIETLDKFEFIKLSEYVYDLKVWLTGSLSHQQTCLDGFENTNTKAGEKMAKAMNASLELSSNALDMINFISGLIKDLNISSLVGNNRRLLSSKEEALVDGYPSWVSEGQRRLLGLSSIKPNATVAKDGSGQFATLTDALKTVPPKNAQAFVIYVKAGVYKENVNVGMDMTHVTVIGDGPKKTRFSGSLNYKDGVQTFNSATFAVNAANFMAKDVGFENTAGAEKHQAVALRVTADQAVFYNCQMDAFQDTLYVQSQRQFYRDCTITGTIDFIFGDAFGVFQNCKLIVRPPLPNQQCMVTAGGRNKVDSASGLVFQSCHFSGEPQVAQLTRKIAYLGRPWRPYSKVVIMDSQIDNIFLPEGYMAWMGSQFKETCIYYEYNNKGPGADTSQRVKWPGVKTITSVEATKYYPGRFFELVNSTERDSWIVDARVPYSLGSMAA

SEQ ID NO: 180287 - protein, 44 aa, Glycine max
  Coding DNA Sequence Number=SeqID_63509
MRRWTHIEYCVRARKVDEKVHFERRLSLRTENMPDNLSGAHILG

SEQ ID NO: 180288 - protein, 83 aa, Glycine max
  Coding DNA Sequence Number=SeqID_63510
MAAGEDIQAHFMAFGKLIKGKKQKIALGLGSRRGKGELVGLDGRTGIISQWDVYFHCNVKFGGRSNRILMMLECAGDVLHNQH

SEQ ID NO: 180289 - protein, 177 aa, Glycine max
  Coding DNA Sequence Number=SeqID_63511
  Gene Ontology: Mol. function=enzyme inhibitor activity; Cellular component=cell wall; Biological process=cell wall modification
  Homolog annotation: Hit_ID=Q9SC90; Match level="QueryCoverage=57%, HitCoverage=16%, E-value=6e-13, Identity=38%"; Hit description =Pectin methyl-esterase PER precursor
  Pfam annotation: Domain name=PMEI; Domain location=68-176; Score= -3.1; E_value=0.027; Accession=PF04043.6; Description=Plant invertasepectin methylesterase inhibitor
MGGHNNDHEQQRSFAIFIISSILLVATMPVAMAFGLNPNPVGLNTNPNPNPNPGGETNGETGHQSNVLSTHSSGITICQGTEYEEKCKQSLGNSLFVNTDPKKLIETQFKVAIGELVDNIINNSTLYKQIVTDERTRLAMDDCKEILGYAVDAIMKSTSLLIQFDFSKLMEIVYDLK

SEQ ID NO: 180290 - protein, 500 aa, Glycine max
  Coding DNA Sequence Number=SeqID_63512
  Gene Ontology: Mol. function=DNA topoisomerase (ATP-hydrolyzing) activity; Cellular component=chromosome; Biological process=DNA topological change
  Homolog annotation: Hit_ID=Q1T4X4; Match level="QueryCoverage=97%, HitCoverage=57%, E-value=1e-159, Identity=63%"; Hit description=DNA topoisomerase II
  Pfam annotation: Domain name=DNA_gyraseB; Domain location=332-500; Score=65.3; E_value=2e-16; Accession=PF00204.15; Description=DNA gyrase B
  Pfam annotation: Domain name=HATPase_c; Domain location=132-281; Score=115.3; E_value=1.7e-31; Accession=PF02518.16; Description =Histidine kinase-, DNA gyrase B-, and HSP90-like ATPase
  Pfam module annotation: Pfam domain module=DNA_gyraseB::HATPase_c; Domain location=332-500::132-281
  Subcellular localization annotation: CTP_CleavageSite=64; ConfidenceScore=5.77e-01
MAHVLLRRPPLLRVIMASRFITSSSFHMRLSSFPSSTLSKTRTSFPLRKFLAPCCSVPNAFTPRAFMSSISATEAFLKSESSTAYSSDQIQYGVSPVLPMTNFRQTTWLATFSVLEGLDPVRKRPGMYIGSTGPRGLHHLVYEILDNSVDEAQAGFASKIYVVLHADDSVSITDNGRGIPTDLHPVTNKSALETVLTVLHAGGKFGGANSGYSVSGGLHGVGLSVVNALSESLEITVWRDGMEYMQTYSRGKPVSILKCLVLPDERKDLRGTRVRFWPDKEVFTTAIQFDHNTIAGRIRELAFLNPKLTITLRKEDNDPEKVQYNEYFYAGGLVEYVKWLNTDKLYGYWVGSIVFFTCCIGINNSGLVSDSSPQLKNNKIKPIAVNWLLTSDLLFQKALHDVLSFRKETDGITVDIAFQWCEDAYSDTILGYANSIRTIDGGTHIDAMKASITRTLNSLGKKSKVIKEKDITLSGEHVREGLTCVVSVKVPNPEFEGQTK

SEQ ID NO: 180291 - protein, 474 aa, Glycine max
  Coding DNA Sequence Number=SeqID_63513
  Gene Ontology: Mol. function=microtubule binding; Cellular component =cortical microtubule, transverse to long axis; Biological process =cytoskeleton organization and biogenesis
  Homolog annotation: Hit_ID=Q2QLI6; Match level="QueryCoverage=51%, HitCoverage=43%, E-value=2e-77, Identity=66%"; Hit description =Expressed protein
  Pfam annotation: Domain name=Myosin_HC-like; Domain location=324-474; Score=71.0; E_value=3.9e-18; Accession=PF07058.2; Description=Myosin II heavy chain-like
MASSHIGNAGDADAKALKGRPKKPSDDFISLFHGSDPCLEEVRIPTGREKDRELGDALAEIKSLRNSERLKERGVEEQQQYIQQLGVTTNGDWEWQFQWRRLFLEGDIDIAAKFMEDIEGLTVQVQQQDIWIWEGDPSGSYTVGNAYMIVFSNESFNGKKLMDDALFFCRTWLKNMEEGFDIPFHSWSSNIRAEFCVQGGIRLYIFVLTDELIKVDEKLKAAEALLESKNLEIKKINEEKRAALAAQFAAEATLRRVHAAQKDDEMPPIEAIIAPLEAELKLARMEVAKLQDDNRALDRLTKSKEAALLEAERTVQIALAKASLVDDLQNKNQELMKQIEICQEENKILDKILRQKVAEVEKLTQTVRELEEAVLAGGAAANAVRDYQRKVQEMNEERKILEREVARAKVTANRVATVVANEWKDANDKVMPVKQWLEERKFFQACEQLRNCFCFVFCKLLGCFLQQMFTKYSC

SEQ ID NO: 180292 - protein, 249 aa, Glycine max
  Coding DNA Sequence Number=SeqID_63514
  Subcellular localization annotation: CTP_CleavageSite=6; ConfidenceScore=5.61e-01
MNSLPSAFHASSTNESGGPRIDYQALFASSSFSTFIRSPMNLLPSAVHVSSTFESGAPRIHCLAKFANSPFSSFIRSPMNSLPSAVHVSSTFESGAPRIDRLALFANSPFSTFIRSPMNLLPSVVHVSSTFESGAPRIDCLALFANSPFSTFIRSPMNSLPSAVHVSSTFESGAPRIHCLAKFASSPFSTFIRSPMNLLPSVVHVTSTFESGVPRIDCLALFRQFSILNFNSKPHELIAKGCSGVLHLQ

SEQ ID NO: 180293 - protein, 198 aa, Glycine max
  Coding DNA Sequence Number=SeqID_63515
  Gene Ontology: Mol. function=RNA-directed DNA polymerase activity; Cellular component=chromatin; Biological process=chromatin assembly or disassembly
EPSGLPPCRIGHDHKIPLMQGANPVKKRPYRDLNKATVKNKFPIPLVQDLLDELAGYNQVRMDASDVHKIAFKTYGGHFEYLVMPFGLTNAPAAFQGLMNSVFQHYLRRTHSLYAKKSKCYFGVDKVEYLGHFITKEGVSMDPSKIAAIQDWALPQNLKQLRSFLGIVAKEAFQELKQRLVATPVLALPDVNLTGRNV

SEQ ID NO: 180294 - protein, 41 aa, Glycine max
  Coding DNA Sequence Number=SeqID_63516
MGARDKSIMHKGNKNLDLVTDPMHAHSGPVLVQMMDPEKEE

SEQ ID NO: 180295 - protein, 74 aa, Glycine max
  Coding DNA Sequence Number=SeqID_63517
MESGANEPVDIQRITSSSAPFVIQGQQVRWQAEIPYDHPLLSSIEVNKFDGFYSRRLETYKLDDARDSSLLGGG

SEQ ID NO: 180296 - protein, 109 aa, Glycine max
  Coding DNA Sequence Number=SeqID_63518
MRCLRMSSYLPSLDDKCETKRCLRMSSYLSSLDDKGETKGVSSMGLLASSWKKVQITMRCFRVSSDLPSLVDKGETKRVSINGLVFLWLTKGADNHEVSSRVIGLAVSG

SEQ ID NO: 180297 - protein, 119 aa, Glycine max
  Coding DNA Sequence Number=SeqID_63519
  Subcellular localization annotation: CTP_CleavageSite=31; ConfidenceScore=5.21e-01
MLTETPLVSPSSSRDSKSDDMQRHFTVIRTRVNQRQASPLTHRDQHGRLPPSLKTQRLSIETTLVSLPSSRDKQSYTKRASTNKATYLSLKSDFGGDFGHFLEELLHRMELEEEVVQRA

SEQ ID NO: 180298 - protein, 236 aa, Glycine max
  Coding DNA Sequence Number=SeqID_63520
  Subcellular localization annotation: CTP_CleavageSite=28; ConfidenceScore=5.30e-01
MPLEKAPALPSQLTRIMTTTDNRAPSINSASRPSRDGHSSESGSSGYALMGAGPVDPLRCRCPQPVLRPPADLGGRSADFAQTTAGRRVQIMRTNMTTLTQIWMTLLLSNILPCDHKSDLPLPKCQLVYAILAQMSIHMAQLIADAIYQFAGTVPTRHPAPQQPGDDQQQAAGAPPPPLESTSNQLWRLERPYTWPTTEQFEATVACTGIGPRIKQDPPALVEVGTRLRMIRTWQT

SEQ ID NO: 180299 - protein, 105 aa, Glycine max
  Coding DNA Sequence Number=SeqID_63521
MYLSEFEDLVNRIVRLPPLFLLSCFISGLTPEIRRLQEEKLLDAHSLSQARPPTLVVPPPRPLSSVATPLLLVPAKTPSSVPLKRLSLEELASRRERCLCFNCEE

SEQ ID NO: 180300 - protein, 207 aa, Glycine max
  Coding DNA Sequence Number=SeqID_63522
  Pfam annotation: Domain name=Transposase_23; Domain location=121-191; Score=-7.2; E_value=0.0069; Accession=PF03017.5; Description =TNP1ENSPM transposase
MCFVHDSLKEQASQGSFVPHGRHNVLTAAIGRPEHPGHVHVARAGVTIKQYFGSAPWTSLTSSSMAIEELEHLTQQIRDRLKESITKKGLALPPEPEVGPSTAHVSTKKSYVGPSRNDPDTGDSDKCGLYIKENPPRLGSLGRVYEGSTTVHSIPLLHDQVKVGVEEVKDADAPVPVPTNEVNLVGQTLNTFLVWPTRNSVYWRCAY

SEQ ID NO: 180301 - protein, 116 aa, Glycine max
  Coding DNA Sequence Number=SeqID_63523
MEEKKPKVNEIKTKAKKIRNELKVSDWKTYPLKNEERIKNAKGVWDIWNSLPSPIYKKKGEKVAAQLTQIAQQCFFLASGMSRNFADYLTMNVKYLEAVKRRLHATKQWSSDEIRV

SEQ ID NO: 180302 - protein, 64 aa, Glycine max
  Coding DNA Sequence Number=SeqID_63524
MTTLVFACQSDFGSPNDEVTIGCLRMPPDSWVTVAKGRVVDKSRAFAPTYPQFAMRNSDLRSSC

SEQ ID NO: 180303 - protein, 142 aa, Glycine max
  Coding DNA Sequence Number=SeqID_63525
MSVLELYVEKDVAGGSMFHYANSVTSCKNNLSNNESEPPRNVSNLHGDEEDDDDDYLVSNSYIEESLDEDDSVDRISDTNDEVTDMIQPKEFKIHFGMMLCIITISTGVILMRRTFAVWRCHRVLMLGKNYMLAWILIVKMW

SEQ ID NO: 180304 - protein, 196 aa, Glycine max
  Coding DNA Sequence Number=SeqID_63526
MAKYDPEIVMEFCANAWPIKEGVMDKCSWRDNFVNTPKEEAKYQISVHVAQLISDAIYQFVGIAPPRHLVDPEKSNRALGFPALITGFCQFYGVPDQQQQLAADAPPSPPHQLSLESISAHMQRMELQMNEYIQHLANQQDPNPYPWPTLEQFRATDAWPGDRPNFQGGIGPTEAQGDEDRAEEDGDVANVIDFFL

SEQ ID NO: 180305 - protein, 237 aa, Glycine max
  Coding DNA Sequence Number=SeqID_63527
  Homolog annotation: Hit_ID=Q9FJ55; Match level="QueryCoverage=30%, HitCoverage=15%, E-value=4e-15, Identity=58%"; Hit description =Serine/threonine protein kinase
MDYVICMSYMDSKEDEVAINEEQEALPQRRKRHDDNGDVLKADNGSSQQRRCGTNQGRGSKKTKKEDETKKEATTRRTNEEEEHDGEPKADVEEEEKEVDTLKAMKDHMDMDSQIEKPFGDHDLKGSFCSHTANVFHGEIDLALGVSLSLNNVGVTHTVQYRDLVLDARQQTTFEDLLLVNYLDGNAFAMIGLASNEGGWEGRMDGGRKEVFVGENGREEARGAMVAATLGINKGRG

SEQ ID NO: 180306 - protein, 102 aa, Glycine max
  Coding DNA Sequence Number=SeqID_63528
MIIVRTRGLGRVLGRVIGKVIGREDNRDLDETPQRQRPKASARRQRKVATFAKDVPHVDDAVEEVFQQLEEAAVDDQDFPCGPCDTSVLTAYADHVAVIVWN

SEQ ID NO: 180307 - protein, 43 aa, Glycine max
  Coding DNA Sequence Number=SeqID_63529
MTDVEVPGSEAMFAGLGHFSQLSLKGRWLIYLTIETVIYHELI

SEQ ID NO: 180308 - protein, 57 aa, Glycine max
  Coding DNA Sequence Number=SeqID_63530
VSRICPLDLMMKYVQFQVKKRLSHEVPKVKKREISALSATGVFSQAQHKTGAKPEST

SEQ ID NO: 180309 - protein, 46 aa, Glycine max
  Coding DNA Sequence Number=SeqID_63531
MARAQNPTAHHSAYLRKRALEAARGATLAEIPRFSKHPSWGFLMNS

SEQ ID NO: 180310 - protein, 265 aa, Glycine max
  Coding DNA Sequence Number=SeqID_63532
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=6e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=97; ConfidenceScore=5.73e-01
MACSPLNMRTCSPLKARTCSPLKARTCSPLKVRTCSPLKARTCSFLKARTCSPLKVRTCSPLKARTCSPLKVRTCSPLKVRTCSPLKARMCSPLKVRASSPTKAKARTCCPLKVRTCSPQKVRACSPTKVKVKARMCCPLKARTCSPLKVRTCSPLKVRTCSPLKARMCSPPKVRACSPTKVKARTCCPLNVRTCSPQKVRACSPMKVKAKARMCCPLKARTCSPLKARTCSPLKVRTCSPLKVRTCSPLKARTCSLLKVRASSP

SEQ ID NO: 180311 - protein, 184 aa, Glycine max
  Coding DNA Sequence Number=SeqID_63533
HPGHVRVAGTGVTISQYFGQASRASSTSSPSINQQQLAYIIGGIKDDIRKQLQDEIRKEEQDEIRKEALEIQALLARVSTKGSCTGPEGSELLKELLNGDDDLMGLFVVVGQNTMLAGLGKVFENSSTIHNVRYENDVVKVQVVRTYMPHAEVPIPTSEVHYLEQAVGTFVAWPTHLVREVTNE

SEQ ID NO: 180312 - protein, 112 aa, Glycine max
  Coding DNA Sequence Number=SeqID_63534
  Gene Ontology: Mol. function=DNA binding; Biological process=DNA integration
  Homolog annotation: Hit_ID=Q0BXC8; Match level="QueryCoverage=91%, HitCoverage=26%, E-value=3e-11, Identity=36%"; Hit description =ISHne2, transposase
SRQAWCSGWRNEFNQEKPHEAHGQQPPAKIWTPSPRKWNGKVPEVGYPEGAKLYKVGEKGDLRLNGRTFLSAALRGEYVRFLEVDDGIDVILFDRLILAYYDRAEKRIIRID

SEQ ID NO: 180313 - protein, 136 aa, Glycine max
  Coding DNA Sequence Number=SeqID_63535
  Gene Ontology: Cellular component=periplasmic space
  Homolog annotation: Hit_ID=Q6D7B2; Match level="QueryCoverage=75%, HitCoverage=17%, E-value=2e-20, Identity=45%"; Hit description =Putative outer membrane assembly protein
MVRRAVARVSNRVSNDQPDDQGIEQLSGRISLKQGNVMLPDLQGGSSRLALQTHGNVDVVKQQLDVTINMILRGWQGDDRLAKVLNGQPIPLRMYGSWGNLQYSLPVDDVVRQQLQGEAKTRLNQWLDSQKSAPRQ

SEQ ID NO: 180314 - protein, 115 aa, Glycine max
  Coding DNA Sequence Number=SeqID_63536
  Gene Ontology: Cellular component=chloroplast
MVGAGLKKDLRVSRVVPGGSLNAFLFLLIGVISQRLAMGFLIWDPGEEDQAGPCEQLDALSPFNPLSEMWQKGKRIHGPTPSSPPRRNYEITPRTPSASRGRGPTIEPCSKSGTH

SEQ ID NO: 180315 - protein, 117 aa, Glycine max
  Coding DNA Sequence Number=SeqID_63537
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=77%, HitCoverage=19%, E-value=1e-35, Identity=87%"; Hit description=NADH -plastoquinone oxidoreductase subunit 2
MGGASSSILVHGFSWLYGSSGGEIELQEIVNGLINTQMNWVQAFPSPLLINGLLTYTKECGSFDKFLSLYLFLRCLDFSKLHGHAEEKCYSHSDQDITLLVQITIKVKQSQEQRIPL

SEQ ID NO: 180316 - protein, 198 aa, Glycine max
  Coding DNA Sequence Number=SeqID_63538
  Gene Ontology: Mol. function=transferase activity, transferring nitrogenous groups; Biological process=biosynthetic process
  Homolog annotation: Hit_ID=Q10MQ2; Match level="QueryCoverage=71%, HitCoverage=30%, E-value=6e-44, Identity=61%"; Hit description =Aspartate aminotransferase, putative, expressed
MGLFAKMKGKRIGFKGPQAVGQTIRNNLPQSETIESCSVAGPGFVNIVSWKKWIAQNIAYTKCGPGNNFFLNLSITPRIDLIFFCSPNNPIGSAASKQQLEQLVKFAKANGSIIIYDAAYAAYISDECPRSSFEIPGAKEGVTIEISTFSKFAGFIGVRLGWTVAPEELLYANGYPIIKDYDRIVCTCFNGASNIVQA

SEQ ID NO: 180317 - protein, 140 aa, Glycine max
  Coding DNA Sequence Number=SeqID_63539
MKRDIKRENDLEAEKSERGRRYRNGSAIMASVKVSFNFQNSLNPNEDCCQWSLTWTNIQTHIERDKQTQSTKQPQHMEINKNLKYEVPKEVDLMESRLGTAIGDYSKTKVAREGTKRKKKTQTWIEPLPHKGEEEESKRP

SEQ ID NO: 180318 - protein, 163 aa, Glycine max
  Coding DNA Sequence Number=SeqID_63540
MTLKEMVQKPFDLSKLRGSFVTSVYVLFLTTTHQLGLRVAFAKVLRMYLEWSAMWNMSLVISVLEGIYGVDAFSSSTYFSRGCHRRGLFLMMIFFAWGHLLRLPCYHVGGYEQGNAIFVQVGLFCMVNPLKWVACMIYFHDCKERKLKKKTDEESGIDVKNGL

SEQ ID NO: 180319 - protein, 103 aa, Glycine max
  Coding DNA Sequence Number=SeqID_63541
MRRLRGHEAEKQARRSKWQNGAVLAGNHTSKQRNVNILGTFNAKIYQNYHSGLGRLKQPSGFSKLKRDSQCKTVSNAPFCQLQPYVVPSKAKFLTIPIVMTST

SEQ ID NO: 180320 - protein, 186 aa, Glycine max
  Coding DNA Sequence Number=SeqID_63542
  Gene Ontology: Mol. function=nucleic acid binding; Cellular component= nuclear speck; Biological process=nuclear mRNA splicing, via spliceosome
  Homolog annotation: Hit_ID=O81127; Match level="QueryCoverage=54%, HitCoverage=55%, E-value=3e-38, Identity=73%"; Hit description=SRZ21
  Pfam annotation: Domain name=RRM_1; Domain location=4-68; Score=61.7; E_value=2.3e-15; Accession=PF00076.12; Description=RNA recognition motif. (a.k.a. RRM, R
  Pfam annotation: Domain name=zf-CCHC; Domain location=87-104; Score =32.8; E_value=1.2e-06; Accession=PF00098.13; Description=Zinc knuckle
  Pfam module annotation: Pfam domain module=RRM_1::zf-CCHC; Domain location=4-68::87-104
MSRVYVGNLDPRVSERDLEDEFRIYGVLRSVWVARRPPGYAFIEFDDRRDALDAIQALDGKNGWRVELSHNSKGGGRGGRGRGGEDTKCYECGEPGHFARECRLRIGSRGLGSGRRRSPSPYRRRRSPSYGYDRSSYSPRGRRSPRRRSISPPWGRNYSRSPPYRPRRDSPYANAYVYVQLSCSLL

SEQ ID NO: 180321 - protein, 391 aa, Glycine max
  Coding DNA Sequence Number=SeqID_63543
  Gene Ontology: Mol. function=transferase activity, transferring nitrogenous groups; Cellular component=mitochondrion; Biological process=biosynthetic process
  Homolog annotation: Hit_ID=Q5GWH6; Match level="QueryCoverage=68%, HitCoverage=64%, E-value=1e-126, Identity=83%"; Hit description=2 -amino-3-ketobutyrate CoA ligase
  Pfam annotation: Domain name=Aminotran_1_2; Domain location=174-391; Score=11.5; E_value=6.1e-08; Accession=PF00155.11; Description =Aminotransferase class I and II
VGVAVQQHIDVHALGDIHAVADQVIDLGLRVTRTKVHTRAPHAGIQANRAGVGETGLQGRILVGLRHTTEQAGSRRSGRSGTAPVHEFLTSLLLRCNMCRPWRCPSRAGRHAAMPGRISGFPVQSRAHAMTDASSALTRHYAEELDAIRAQGLFKSERIITSPQSAEITLEDGRKVLNFCANNYLGLADHPDLIQAAKDALDTHGFGMASVRFICGTQDLHKQLEKQIADFFGKQDTILYAACFDANGGLFEPLLGENDAIISDALNHASIIDGVRLCKAKRFRYANCDMADLEAQLQAADAAGCKTKLITTDGVFSMDGFIAPLDEITALAKKYNALVHIDECHATGFLGATGRGSAEVKGVLEKIDIITGTLGKAMGGALGGFTCASAE

SEQ ID NO: 180322 - protein, 238 aa, Glycine max
  Coding DNA Sequence Number=SeqID_63544
  Gene Ontology: Mol. function=helicase activity
  Homolog annotation: Hit_ID=Q337N5; Match level="QueryCoverage=99%, HitCoverage=19%, E-value=3e-44, Identity=32%"; Hit description =Expressed protein
MVHGPCGISRVESPCMKEGKCNHFYPKMFQSHTVLDANGYPVYCRRNNGHTIEKNGVIIDNSRKLVERLQFHLPCQHSVVYEGHDDIDDVLSKPSISDSKFFSWMNTNQNSVEGRSLTYAEFVSKFVYSKKKRCWHLRKKGYTIGRLLWVPPIIGELFYLRMMLTVCKGPTSFEDLRTVGNVQYPTYREACFAMGFLQDDKEFIEAIKEAKDWGSTHYIRKLFVLFLLTATMNKPKQV

SEQ ID NO: 180323 - protein, 75 aa, Glycine max
  Coding DNA Sequence Number=SeqID_63545
MNSFQKNVWDEMALKKLSAKRCRRDVAAEGTSAAHEFDSHRFRSAEHQQRFEAIKGWSFHRERRVQLREDEYTNF

SEQ ID NO: 180324 - protein, 82 aa, Glycine max
  Coding DNA Sequence Number=SeqID_63546
  Subcellular localization annotation: CTP_CleavageSite=44; ConfidenceScore=5.56e-01
MGEMLATQLTQASKVTSSRSNRLLEESSGGPKTSRIVQRCFLLSSGMSRNFTNCATMLPFELRHVTELHKLPDDGCQVPQNG

SEQ ID NO: 180325 - protein, 79 aa, Glycine max
  Coding DNA Sequence Number=SeqID_63547
MKNGEEHSRNWSRKCYESVTEGRSLPPNSPRRVQLAQASWWLSSEATLLAQASWLLLPYIIQWAQGLRNVPEWTILSLP

SEQ ID NO: 180326 - protein, 97 aa, Glycine max
  Coding DNA Sequence Number=SeqID_63548
MKPLFWETFLFFLPRVYGRRVDVLAQKGLRKARHDVCQGICSASGSGIWELMQSYPARALDRRLQEVSLAIRELLKEVFSKKLLKEVFSRKLLKEAT

SEQ ID NO: 180327 - protein, 46 aa, Glycine max
  Coding DNA Sequence Number=SeqID_63549
NRVDDHGDDKEGGSGAVGAPNGPWCRWAAAAEEVDEPFRFFDDSAI

SEQ ID NO: 180328 - protein, 44 aa, Glycine max
  Coding DNA Sequence Number=SeqID_63550
MEKEARQGECGYTALLVYVAIYRRWRYVIDYKDAVIDYRLSVLV

SEQ ID NO: 180329 - protein, 172 aa, Glycine max
  Coding DNA Sequence Number=SeqID_63551
  Gene Ontology: Mol. function=transferase activity, transferring hexosyl groups; Biological process=metabolic process
  Homolog annotation: Hit_ID=Q8S342; Match level="QueryCoverage=99%, HitCoverage=36%, E-value=2e-47, Identity=51%"; Hit description =Putative anthocyanidine rhamnosyl-transferase
MFPWLAFGHLIPSLELAKLIVQKGHHISFVSTPRNIECLPKLSPNLASFIKFVKLTLPKVDNLPENVEATIDVPYDVVQYLKKAYDDLEEPLTCFLKSSKVDWHFYDLILFWASTLASKLGIKSSFYNICTSPCVGFIVPPSVLMGDDPVRAKIKDFIVPPSWISFSTIVAY

SEQ ID NO: 180330 - protein, 80 aa, Glycine max
  Coding DNA Sequence Number=SeqID_63552
MSQSRPNEDEPIDATPISFCVSYDYDVNCGDVVGNPTNLNETPSLTQSSRPKRGRRSKLLPDEWMKNWEVERFDKVHNPI

SEQ ID NO: 180331 - protein, 79 aa, Glycine max
  Coding DNA Sequence Number=SeqID_63553
MVIDYMLKIQIQNLFQQLFLNPVLCKCLSFEAALLDSSLTSSKSCSMSYKVVAECANVMNEMVSDEGEMMGAGVTNLEE

SEQ ID NO: 180332 - protein, 89 aa, Glycine max
  Coding DNA Sequence Number=SeqID_63554
  Gene Ontology: Mol. function=transferase activity, transferring hexosyl groups; Biological process=metabolic process
  Homolog annotation: Hit_ID=Q8S342; Match level="QueryCoverage=83%, HitCoverage=15%, E-value=5e-16, Identity=53%"; Hit description =Putative anthocyanidine rhamnosyl-transferase
MVWNSKPRLGTIDEDYGLNSRVWEVKKMGYSIPKDERDGSFTSDAVANLIRLVMVEEEGRIYREKVKKVKDLCLNTFRQEKYINKLQHY

SEQ ID NO: 180333 - protein, 87 aa, Glycine max
  Coding DNA Sequence Number=SeqID_63555
MEVERYENEGIRIRRQKVKTQDKEESNRKTKEETKEFIVAQEKNKEAKAEVRNMLGAQGKSEAKDMRVIVEEFLSKAHYKQLHMFNP

SEQ ID NO: 180334 - protein, 110 aa, Glycine max
  Coding DNA Sequence Number=SeqID_63556
  Gene Ontology: Mol. function=transferase activity, transferring hexosyl groups; Biological process=metabolic process
  Homolog annotation: Hit_ID=Q8S342; Match level="QueryCoverage=98%, HitCoverage=36%, E-value=2e-12, Identity=46%"; Hit description =Putative anthocyanidine rhamnosyl-transferase
MVVDEGMVRQSRMSQCVVCGVWKQSETKSRLSHRNSSRFREIKTSIFLAVQNEKPVFLFMFLEDQGLNTKLLEEKKMRYLIPRDELDGSLTSDAVIDSIRLVMDEDEERI

SEQ ID NO: 180335 - protein, 222 aa, Glycine max
  Coding DNA Sequence Number=SeqID_63557
  Gene Ontology: Mol. function=transferase activity, transferring hexosyl groups; Biological process=metabolic process
  Homolog annotation: Hit_ID=Q8S342; Match level="QueryCoverage=90%, HitCoverage=90%, E-value=2e-34, Identity=53%"; Hit description =Putative anthocyanidine rhamnosyl-transferase
MFPWLAFGHLIPSLELAKLIAQKGHHISFVSTPRNIECLPKLSPNLASFIKFVKLALPKVDNLLENVEATIDVPYDVVQYLKKAYDDLEEPLTCFLKSSKVDWHFYDLILFWNCDIVGIKRCTEFKPKWFEVLENIYRKLVIPVLSHKAVGGVLTHSGWTSVVEMGYSIPKDERDGSFTSDAVANLIRLVMVEEEGRIYREKAWQREETGTGNAFPTPPCPR

SEQ ID NO: 180336 - protein, 69 aa, Glycine max
  Coding DNA Sequence Number=SeqID_63558
MDPNHVASQLPLEITVSGPTHGKILAQWLVGVHQGTRRAAPTSLGSSCHIHHATEVLDGAEGLSHALHG

SEQ ID NO: 180337 - protein, 93 aa, Glycine max
  Coding DNA Sequence Number=SeqID_63559
  Gene Ontology: Mol. function=transferase activity, transferring hexosyl groups; Biological process=metabolic process
  Homolog annotation: Hit_ID=Q8S342; Match level="QueryCoverage=65%, HitCoverage=13%, E-value=1e-11, Identity=54%"; Hit description =Putative anthocyanidine rhamnosyl-transferase
GEGANTLNAKAKTLEEGESKPTPNVDGLEFVAVQNEKPEFLLMFLEDQGLNTKLLEEKKMRYLIPRDELDGSLTSDAVIDSIRLVMDEDEERI

SEQ ID NO: 180338 - protein, 164 aa, Glycine max
  Coding DNA Sequence Number=SeqID_63560
  Subcellular localization annotation: CTP_CleavageSite=43; ConfidenceScore=5.37e-01
MATTQKSACAIKWRATVLIVATNQGIGCGFHSSRIVRPQFGIMVMRNFQSNTFRLEGFSSSESTWEDETFIKTYPTFNLMEKVVLGGEGNDMLLRETLSPNEVMEDNAHCGPVNETNSYPWSPSYLEGESLSQFTIQLVLSLVTVPPSKVKDLLKQCLTQMKDL

SEQ ID NO: 180339 - protein, 308 aa, Glycine max
  Coding DNA Sequence Number=SeqID_63561
  Gene Ontology: Mol. function=DNA binding; Cellular component=beta -galactosidase complex; Biological process=DNA integration
  Homolog annotation: Hit_ID=Q1SDN3; Match level="QueryCoverage=73%, HitCoverage=17%, E-value=7e-75, Identity=60%"; Hit description =Polynucleotidyl transferase, Ribonuclease H fold
MVLMVEAEVVEAIHLVEEVEAEAHKCALIITDQVYADASSVAFTLEQYKALLSLLQQTSQASSSHTTNKLVSSRKNGNSVKFKADGSIDKHKATLVAKGFTQTAGLDYIETFSPAVKMTTVRLVLSLAASQGWHLHQLDVNTAFLHGDLNEEVYMKVPPGLTVDNPTLVCKLQRSLYGLKQASIQWNAKLTSTLLDSGFQQSNVDYSLFTKRSPTGLTIILVYVDDLVLTGTDLAKIQQLNHSLDAKFSIKDLGMLKYFLGFEVARSNSDIALYQRKYCLNLLQDTGLLVAKPCSTPMDPILKLHKSS

SEQ ID NO: 180340 - protein, 102 aa, Glycine max
  Coding DNA Sequence Number=SeqID_63562
  Gene Ontology: Mol. function=transferase activity; Biological process= DNA integration
MAENADPIVNNAIVNNAALTNLLNPYYTHPNENPDVAIVAQVLSGGNYHSWSRAMLLALKTKKKVKFVDGSLPRPALNDPNFTLWDHCNTLVVSWLHHSLDP

SEQ ID NO: 180341 - protein, 63 aa, Glycine max
  Coding DNA Sequence Number=SeqID_63563
MMRMIIINHQNLIEERNGRSVETVMCEGHEGEDHGCGVPPLTSRSIQKEPIFFRNIHMTFILC

SEQ ID NO: 180342 - protein, 229 aa, Glycine max
  Coding DNA Sequence Number=SeqID_63564
  Gene Ontology: Mol. function=transmembrane receptor activity; Cellular component=membrane; Biological process=defense response
  Homolog annotation: Hit_ID=Q19PP0; Match level="QueryCoverage=91%, HitCoverage=13%, E-value=6e-44, Identity=40%"; Hit description=TIR -NBS-LRR type disease resistance protein
RSLYGLKQASRQWNVKLTSTLLDSGFQQSKADYSLFTKRSPTGLTVILVYVDYLVLTGSDLVEIQQLKHSLDAKFSIKDLGMLKYILGFEVARSNSGTSLISWMSKKQSIVSRSSSEAEYRALAQASCEAQWLLFLLKDLHIEHPKPVVLYYDNQAALHIAANPVFHERTKHIEMDCHVVRDKVQSGMIHLLPISTQEQLADILTKSLHVGPFNLIHSKLGMLDIHIPA

SEQ ID NO: 180343 - protein, 133 aa, Glycine max
  Coding DNA Sequence Number=SeqID_63565
  Homolog annotation: Hit_ID=Q10AC1; Match level="QueryCoverage=49%, HitCoverage=64%, E-value=7e-12, Identity=56%"; Hit description =Expressed protein
MEMEVALASGSGPHIEIVRQAQLGIDLLNLRTVDAHGLPLQPDGLHLSTPAQAHLGQMMANAFLQFVPSSNKNKGEGKRVIIRKTEEKGGRVTKEEDATRTKKDMGDAVTEAVEENVFTVRRWFGVGDGRRGW

SEQ ID NO: 180344 - protein, 155 aa, Glycine max
  Coding DNA Sequence Number=SeqID_63566
MRLNIRSEIGLITSCKCSQNTCNDIEYLQNFILKESKKLKRGRKRYIMNSIITVLYFNGRVYEDNDGVIFEGSKKAIQIKRGISFNALKKKLEIRFLVSGKYVALQICDDEDVETMIESFQQQQQMSVLELYVEKDVAGGSMFHAANSVTSCGRN

SEQ ID NO: 180345 - protein, 366 aa, Glycine max
  Coding DNA Sequence Number=SeqID_63567
  Gene Ontology: Mol. function=O-methyltransferase activity; Cellular component=intracellular; Biological process=lignin biosynthetic process
  Homolog annotation: Hit_ID=Q1SHV5; Match level="QueryCoverage=99%, HitCoverage=100%, E-value=1e-160, Identity=75%"; Hit description =Dimerisation domain, putative
  Pfam annotation: Domain name=Dimerisation; Domain location=38-88; Score=72.6; E_value=1.2e-18; Accession=PF08100.2; Description =Dimerisation domain
  Pfam annotation: Domain name=Methyltransf_11; Domain location=209 -299; Score=-1.8; E_value=0.082; Accession=PF08241.2; Description =Methyltransferase domain
  Pfam annotation: Domain name=Methyltransf_12; Domain location=209 -297; Score=18.7; E_value=0.011; Accession=PF08242.2; Description =Methyltransferase domain
  Pfam annotation: Domain name=Methyltransf_2; Domain location=98-342; Score=329.3; E_value=6.6e-96; Accession=PF00891.8; Description=O -methyltransferase
  Pfam module annotation: Pfam domain module=Dimerisation::Methyltransf_ 11::Methyltransf_12::Methyltransf_2; Domain location=38-88::209 -299::209-297::98-342
MGSNYEEILPLPKCSPHDEDNACLSAMQLSFSPMVYTAVLNAAIELNLFEIIAKANPPGMSASEVASKLPTQHKNLPKRLDRMLCLLASHSLLTCSTSTKEDGGVERLYELSPVGKYFVNDETTGSLALFSTFMNHGTLVDAFLNFKEILLDCDNGLYIKVHGMPIYQGIQSDPAWDHTFNKAMANICTREMTKILEIYTGFEGISLLIDVGGGVGQCLNMIIYKYPSIKGVNFDLPQVIQQAPTYPGIEHFEGDMFESVPKGDAILLKGILHNWSDENCLKILNNCYKALPENGKLVVVDFIMPEAVQSTEADKMVTSFDNLMFLDGGSERTEKEFLNLCKCSDFSSFQVVCRAFTALGVMEFYK

SEQ ID NO: 180346 - protein, 59 aa, Glycine max
  Coding DNA Sequence Number=SeqID_63568
MAVKEVVMTVIVLVTGTMPMLVVITTTMENFGDGGCDKGNGNDDDNDGSGCSGGSESVF

SEQ ID NO: 180347 - protein, 72 aa, Glycine max
  Coding DNA Sequence Number=SeqID_63569
MASLSESFLCTEIEESNCVELIIQVNLVRNEHLCLYIFIGTSMGISTTMEARTERERVRGGELDLRGVWTAL

SEQ ID NO: 180348 - protein, 250 aa, Glycine max
  Coding DNA Sequence Number=SeqID_63570
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8RZF8; Match level="QueryCoverage=98%, HitCoverage=63%, E-value=1e-80, Identity=54%"; Hit description =Lustrin A-like
  Pfam annotation: Domain name=DUF231; Domain location=93-248; Score =231.4; E_value=2e-66; Accession=PF03005.6; Description=Arabidopsis proteins of unknown function
MFIGDSVSLNQWQSLICLLRSSVPQTEILEQGDVNVSNYTFQDYGVSVIIFHSTYLVDIEEEKIGRVLKLDSLQSGSIWKEMDILVFNTWLWWYRRGPKQPWDYVQIGDKILKDMDRMEAFKLGLTTWANWVNAEVDTNKTKVLFQGISPSHYNGMEWNEPGVRNCSKEPQPISGSTYPSGLPAALFVLEDVLKNITKPVHLLNITTLSQLRKDAHPSSYNGFRGMDCTHWCVAGLPDTWNQLLYAAVTC

SEQ ID NO: 180349 - protein, 106 aa, Glycine max
  Coding DNA Sequence Number=SeqID_63571
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O22960; Match level="QueryCoverage=82%, HitCoverage=20%, E-value=4e-19, Identity=48%"; Hit description =Expressed protein
MRMHPWVFGVICLCQLLCVVNTGGGGHVKSNFKWQRSQEEQEHELSCNMYEGRWELDDSYPLYDSSTCPHIRKEFDCLKYGRPDQQYLKYRWQPNECDLPMYEFTS

SEQ ID NO: 180350 - protein, 51 aa, Glycine max
  Coding DNA Sequence Number=SeqID_63572
MVLPNEKSIKAEVATRNMLVAQGKSEAKYMRVIVEEFLSKAHYKQLHMFNP

SEQ ID NO: 180351 - protein, 125 aa, Glycine max
  Coding DNA Sequence Number=SeqID_63573
  Subcellular localization annotation: CTP_CleavageSite=43; ConfidenceScore=5.33e-01
MATTQKFACAIKWIATVLIVATNQGIGCGFHSSRIVRPQFGIMVMSNFQSNTFRLEGFSSSESTWEDETFIKTYPTFNLVEKVVLGGEGNDMLLRETLSPNKVMEDNAHYGPVNESESIIEMPQR

SEQ ID NO: 180352 - protein, 64 aa, Glycine max
  Coding DNA Sequence Number=SeqID_63574
GEGANTLNAKAKTLEEGESKPTPNVDGLEFVLVNTRFEGDKDNVTWQWMKEWLDNQECGSVLYV

SEQ ID NO: 180353 - protein, 145 aa, Glycine max
  Coding DNA Sequence Number=SeqID_63575
MDIGVSGNSALAIGIGGVLGSEGRPTMCIYCLHRHFSHYGFHSMLALDKMTQEMSQSDNFTKISANDIVGKVMGKDHTGHVHCLGLGGLRSVAFRSTTSYSGGGSSFSNSDSAENSRLKEEDEGSGQDGPTPRGGSSLDSIFHAT

SEQ ID NO: 180354 - protein, 57 aa, Glycine max
  Coding DNA Sequence Number=SeqID_63576
MAGICENEFLTQCSNVMMIQRLTILGSQFYWHRRLYILVTRSSLKNQLKGRLPLCGD

SEQ ID NO: 180355 - protein, 196 aa, Glycine max
  Coding DNA Sequence Number=SeqID_63577
MAVSDHAILCDRAHTPAKRILLELTLQDALLAQNNFLAKQLETLTKTLNKILQQLHAVQPAPSAIMQVEGCSIRGGTHELGACMNHDDTSKEGQGWRTHPRNQFNKDQWGPSNRPPNQGPNLYEQTTKLKDTLTQFMQVSMSNHKIMESTIKKLEIQVGQLAKQLAKKSTGNFVANTEKNPKEECKAVVTRSQDRD

SEQ ID NO: 180356 - protein, 105 aa, Glycine max
  Coding DNA Sequence Number=SeqID_63578
MMLSYNLRKGRWRLQFNRLKVQLNQTYSSSKWVQWDNSFMNKASTNGVATGEVYEVASGVTSGVGYASGCGSWAIGASPPPRGEGWTPGQTTWAINASMLMMGQC

SEQ ID NO: 180357 - protein, 161 aa, Glycine max
  Coding DNA Sequence Number=SeqID_63579
LVLFECCITLMLGKLGRIDGDPVLRETRIWATWEYVSLVGGGQQGMGETSYFYSLTTEWYLEICRGGQETLVTSGGVLLPKTKLDQSRPNPGIVVLCDIWVVVSGNRLPREAKGASGNRLPVCVIDYTEEWVTGNRLPEMKSLKIPLLIACSGYETHCAAA

SEQ ID NO: 180358 - protein, 68 aa, Glycine max
  Coding DNA Sequence Number=SeqID_63580
  Gene Ontology: Mol. function=DNA binding; Biological process=DNA integration
MVYGKTCHLLVELEHKAYWAMKFLNFNPTLVSEKKLQIAELEEMCLNAYTSSKHYKEKTKAYHDKKLV

SEQ ID NO: 180359 - protein, 266 aa, Glycine max
  Coding DNA Sequence Number=SeqID_63581
MARRDKYGHLPPLLKTPMSFDRDYFSLPLPFRAKRARLHVETNYGHPHPFCYPETIKFDGTQRQIMVIRTLFAIQRQSSPMAREDKLWSFAPFTIQRQSSLKACGDRHDNNCFNHCMLSKGNNDPHLHFEDDNVFSHYMLSKGNNDLHLHFEDDNVFSHCMLSKGNNDPRLYFKDDIVFSHCMLSKGDNDLHLHFKDDNVFSHCILTKGDNDLHLHPHPLSSRDNQTTGSPRQASGSPGPPKLLHGEVTSSPGRATFILNALFCYK

SEQ ID NO: 180360 - protein, 89 aa, Glycine max
  Coding DNA Sequence Number=SeqID_63582
  Homolog annotation: Hit_ID=Q6JA03; Match level="QueryCoverage=67%, HitCoverage=15%, E-value=2e-07, Identity=44%"; Hit description =Proline dehydrogenase
  Subcellular localization annotation: CTP_CleavageSite=47; ConfidenceScore=5.22e-01
MAIIIIASLQLSHKARQGKVAWSTTVERRRVVVGTEKKSFLRSWKLRSSTGGSTMEIGKGAGMQREGERGGYATLDSLRGIVIANNAPH

SEQ ID NO: 180361 - protein, 297 aa, Glycine max
  Coding DNA Sequence Number=SeqID_63583
MEMYIKSTQYRIWLIITTGDICILRLEAEWTNDDLTIIKINTKARYTLTWTEDVKLRIATTLTRHYDSFNMKDKESMDDMVDEVHLQNREHLQIKNSTALKSEETSFIRKEKKRLSKALKVKMQESDGSENSNKSIDDEVALIKLGHKKVECPHLKKKKYSRDKKKKSMMVTWDNSNSEKSSNSDNEEAKICLMADTEDECKKFDEKFKVSASENTDLKKSNKDLKKKNANSRREFEPGQEEVACFTNDFGKLLEISKTSTTLLKFHQHPHDKSGLGFEKGTAFSKSQFVSDKCDLC

SEQ ID NO: 180362 - protein, 267 aa, Glycine max
  Coding DNA Sequence Number=SeqID_63584
  Gene Ontology: Mol. function=nucleic acid binding; Biological process= DNA integration
  Homolog annotation: Hit_ID=Q1SAK3; Match level="QueryCoverage=81%, HitCoverage=16%, E-value=2e-17, Identity=25%"; Hit description =Integrase, catalytic region; Zinc finger, CCHC-type
  Pfam annotation: Domain name=zf-CCHC; Domain location=175-192; Score =14.2; E_value=0.0045; Accession=PF00098.13; Description=Zinc knuckle
MANNNNNGQFIFEGASLMRPPGFIGEDYPYWKDIMEIFSMKEKEFVEDMFGRLQVLINNPKDLGQTYTKAQINLKVLDNFPKVWEPKTTIIQEGIDLKNLSQDELQENKSSSKALKVQMAEFDGSDNSKESIDDEVTLMSKVFKQMMKKKGKFQHSSRRKVTRFKKKYKIQNNEIICFECKKLKHMKAKCLQLKKRRYFDDNKKKSLMVTWDNLDSENSSSSNDEKASICLMANTDEKVEVKTCFECDTSSNVSSDDEEDMSYDVLL

SEQ ID NO: 180363 - protein, 405 aa, Glycine max
  Coding DNA Sequence Number=SeqID_63585
  Gene Ontology: Mol. function=calmodulin binding
  Homolog annotation: Hit_ID=Q1S042; Match level="QueryCoverage=96%, HitCoverage=53%, E-value=1e-54, Identity=38%"; Hit description =Calmodulin-binding, plant
  Pfam annotation: Domain name=CaM_binding; Domain location=264-379; Score=168.0; E_value=2.4e-47; Accession=PF07839.2; Description=Plant calmodulin-binding domain
IDLEEDLKKSLDDAEIGIDATKERFLQEQKEGDSDEDHQSIVWSHEEMSIGSYCSDGEQDIADVDMYNSDSKTYDMEWEEERLHEFEQDEDADSSVYTEEDNSKVESSSGSSHDVSVTWLDDILGGYYEDFLVDETHKEANSEERTYFEEQPSGTSSSVLEDTNGSTETQENLTNTQDNGGEDEKHKDDDEASCNTKPLDEETIDNTQCQKMSGTCKIEETNENGYSISLENNDESNKGESQIELEDVSEKESNIASQDQDLLDKDQGKAKRFQQNTSCIDGKEENTCKNWKDGIRRKKGVEDDDDEMRKFNPKEPNFLSLVPEPGQKKVDLRHQMMDERKNSEDWMLDCALRQVVTKLAPARKKKVALLVEAFEMVLPAAAPKCETSVRNNNSSAFGHSGRIQA

SEQ ID NO: 180364 - protein, 79 aa, Glycine max
  Coding DNA Sequence Number=SeqID_63586
MRVMVLSYESLLGASSAKGRFGMESLEKLSLVEEEENGLIFHVKEELENQANVSLCLVGRFLMERTIKTNVMKDRMARI

SEQ ID NO: 180365 - protein, 339 aa, Glycine max
  Coding DNA Sequence Number=SeqID_63587
  Gene Ontology: Mol. function=calmodulin binding
  Homolog annotation: Hit_ID=Q1S042; Match level="QueryCoverage=97%, HitCoverage=41%, E-value=2e-46, Identity=40%"; Hit description =Calmodulin-binding, plant
MVQRKVPSKLGIQAEHVKSDKRLSNLKLLSSSHHQDGKNRGADMKKKMKKSRSIKLSDLEALQSSSSSSPSRRSLSLHTPTTTTSASPQKQQPLFRTVDGSPNYMKPTSSSHAKKELFLVSQRNTQPGSDFKNLPRKISSDSKAACVKKPAKALTRTSNSLSLVRTLTKTTSFKASRACSRKSTRAVMCAAPQRATCSSTLKDSKFPAYLMLSSGGTQSEGTSAMKVCPYTYCSLNGHHHADLPPLKSFVSARRHLLKTQKRVKLEALSPRRLKVPLETQKEDSDVEPNVFDAKPACDEIGIDIFIEIYANEKDAKPTAAEGMGRIIFSKRLRIMKIIA

SEQ ID NO: 180366 - protein, 195 aa, Glycine max
  Coding DNA Sequence Number=SeqID_63588
  Homolog annotation: Hit_ID=Q2HT93; Match level="QueryCoverage=95%, HitCoverage=30%, E-value=7e-18, Identity=29%"; Hit description=P -type trefoil
MELSQCLATLGESIGSLSLLVAGKTDLEDNQRKLKMQVKELRKFVVEAEVEPNFWFLPFDMVDLMWFGELALKFLQQEFQRCGACEKEDVKMLDGEVGRFKELICSSIKSLAEISSTNFVAKEVEKNNNSCDLEAGKSNGGEKEMKSQVVLSLSAVGFSLCACIRGTMEIEEALKELVQWENPSSEINSPGGNGG

SEQ ID NO: 180367 - protein, 55 aa, Glycine max
  Coding DNA Sequence Number=SeqID_63589
MSKMSSDEALALEEVHHPLLEDYCADGEEKEYFVRRAFAGHLGDLELAATSIAIN

SEQ ID NO: 180368 - protein, 252 aa, Glycine max
  Coding DNA Sequence Number=SeqID_63590
  Gene Ontology: Mol. function=drug transporter activity; Cellular component=membrane; Biological process=multidrug transport
  Homolog annotation: Hit_ID=Q9FR32; Match level="QueryCoverage=81%, HitCoverage=56%, E-value=7e-66, Identity=50%"; Hit description =Ripening regulated protein DDTFR18
  Pfam annotation: Domain name=MatE; Domain location=23-186; Score =51.4; E_value=3e-12; Accession=PF01554.9; Description=MatE
MECFHFSEPPKSSSLTGHHQHHILLASDSEMPSKEASLLGEAKLHLLADEREQDQTLSRRFWIESKKLWHILGMASALETLCGQAFGAKKYYMLGVYMQRSWIVLFICCIFLLPLYLFASPVLKLLGQPEELAELSGAVSIWMIPVHFAFAFQFPLQRFLQCQLKTAPIAWVSLVALVVHVFVSWLFVFKLQFGVVGAAATINFSWWVLTLGLFGYVVWGGCPHTWSGFSVEAFSGLWEFLKLSAAAGVMLW

SEQ ID NO: 180369 - protein, 125 aa, Glycine max
  Coding DNA Sequence Number=SeqID_63591
  Gene Ontology: Mol. function=hydrolase activity, acting on ester bonds
MEDHESQRKLRILCLHGFRTSSEILKQLVLRWPEPVLQKLNFVFLDGQFLAQGRSDVEGIFDPPYYEWFQANEDFTEYTNFEECLVYIEDYMLKNGPFDGLLGFSQEYCLQGAVLAAALLGLQAQ

SEQ ID NO: 180370 - protein, 53 aa, Glycine max
  Coding DNA Sequence Number=SeqID_63592
MALGTMAARPGELMLHPKVSWLAQKQRTLSPKKHKDKDIESYKRQKRLKSYKV

SEQ ID NO: 180371 - protein, 205 aa, Glycine max
  Coding DNA Sequence Number=SeqID_63593
  Gene Ontology: Mol. function=transferase activity; Cellular component= oxygen evolving complex; Biological process=DNA integration
  Homolog annotation: Hit_ID=Q1SXA8; Match level="QueryCoverage=65%, HitCoverage=10%, E-value=5e-34, Identity=48%"; Hit description=Zinc finger, CCHC-type; Polynucleotidyl transferase, Ribonuclease H fold
MQEELDQIQKNNVWKLVELLKGKKITRTKWFFRNKLDENGNVVRNKAILVAKGYSWKKVYCNMKLYQTDVKSAFLNGLIQEEVYVEQPLGFESDTLHHHVFKLNKALYGLKQAPRDWEDFILISFCDANYARGKVKRKNTSGSCHFIGRNLVRRICKKQASNSPSVEIISIHVEHFFDINELEKVGLKLNKTLLFYGARLFFKES

SEQ ID NO: 180372 - protein, 665 aa, Glycine max
  Coding DNA Sequence Number=SeqID_63594
  Gene Ontology: Mol. function=DNA binding; Cellular component=oxygen evolving complex; Biological process=DNA integration
  Homolog annotation: Hit_ID=Q1SXQ3; Match level="QueryCoverage=20%, HitCoverage=16%, E-value=2e-29, Identity=48%"; Hit description =Integrase, catalytic region
  Pfam annotation: Domain name=rve; Domain location=531-660; Score =31.8; E_value=2.4e-06; Accession=PF00665.16; Description=Integrase core domain
DEAGRYTKYVKELLKKFNMGDAKKVKTPMHPTIYLGLDKESTKVDETQYKEMIGSQLYLTTSRPDIIRESFRLESYCDADYVGDKVERKSTSANCHFIGGNLITWICKKQGSTALSTAKAEYTKAAINLLKDPIIGIRAKVTSLIPSGEIAEGEIVCQVVASIVPWQRPRAKIAKPTPVLAPKEAAIQSIIPKCVKTKATKANPKIGDKEWSISFSSNKESVTTSSLGMDTSSAVTRHQDATALASTWNLTTFNLADLELTFMDYFMLDRLHSQMYVCSCLLIWNAAKKKGFKLDFYEEIPSRQIKVEVNQIVWADTSNASSSSYDGSDNVDHHDFIQVLCPTWTYHFNDACACFTKDADIYSFIKRPISLLTILEETTYDLNKMEENEFKDHVTKLHDAQKERKSKMEEELASGATTKEKVMDDNIVHEIIIDLTNISVMNEVLMSSNIAIADEGALDAVIAYSTSLGPTTLNYTPPFVVSKDQVQEMIVVATPTLVAAPAPPILIHQPSPPEPTPPFIDQTPPHYLHHYLRNLHHHLKSKICYDGARYLLSIIDDYSKMTWVFMMKQKSKAFKCIMHWAILMKNQIGKTKKCFRTDNDLEFYSMEFNEFFKDEGIARQHIVCYTPRPNGVEPVNASCYLVNHSLSTTIDIRTPIEVWSNKPAK

SEQ ID NO: 180373 - protein, 162 aa, Glycine max
  Coding DNA Sequence Number=SeqID_63595
  Gene Ontology: Mol. function=nucleic acid binding; Cellular component= proton-transporting two-sector ATPase complex; Biological process=DNA integration
MSRVPYELPYLGKKHWQVMKRIFRYLKGTTDIGVVCYGDTSCALAGYSDSDYATDLDAKRSMAGYAFTIGHSLVNWKETLQPTVALSTTEENVIIFYDSLRAICLAKDQVHHERKKHMDIKYHFICSKKVDTRENLDDMFMKPIPRSKLIHCLDLLNIDYWK

SEQ ID NO: 180374 - protein, 85 aa, Glycine max
  Coding DNA Sequence Number=SeqID_63596
MTKARPKGIRKGKEGEACHPTLAGELGCILPKAPPSGGTSWKAQVGLNAIFTPYLLNTPPALFADFFSRNITELYEFCNDTSLMP

SEQ ID NO: 180375 - protein, 83 aa, Glycine max
  Coding DNA Sequence Number=SeqID_63597
  Subcellular localization annotation: CTP_CleavageSite=72; ConfidenceScore=5.26e-01
MVTKKVKKYEKMMTHLPSCKKLGQKMDRVTSLLRLLPNTFKTVDVLVTSSFTLTKMSWTMKEHTLRCPYRTRARARVMGEVME

SEQ ID NO: 180376 - protein, 91 aa, Glycine max
  Coding DNA Sequence Number=SeqID_63598
MLTSPRKVQVTMLVTACYRALSLTIVEGGVVDKSGAFAPTYPQFEMRNSDLRSSCESGVRLKESLSEDVDISGKGADDHIGLCLSIGLRVS

SEQ ID NO: 180377 - protein, 149 aa, Glycine max
  Coding DNA Sequence Number=SeqID_63599
  Subcellular localization annotation: CTP_CleavageSite=60; ConfidenceScore=5.52e-01
MASGASWTSEKFPKTLDHTFSVFLTFSSNKRWWRLLAPSSLGRCTREPRVALPLKEVVIPSESNSPPTNNLMSSFGYDSSSEDTEAISPTLMSHQSVLPEFQVLPRVDLVDLVSEDEEEELEEDTSFEEDPSMDEDDPFTESEFMDESY

SEQ ID NO: 180378 - protein, 49 aa, Glycine max
  Coding DNA Sequence Number=SeqID_63600
MARAVYSNSHVYIFDDPLSALDAHVARQERMTVNFESLIVGVAAYIPAL

SEQ ID NO: 180379 - protein, 228 aa, Glycine max
  Coding DNA Sequence Number=SeqID_63601
  Homolog annotation: Hit_ID=Q5N7Y3; Match level="QueryCoverage=75%, HitCoverage=44%, E-value=2e-75, Identity=72%"; Hit description =Putative lysine ketoglutarate reductase trans-splicing related 1
  Pfam annotation: Domain name=DUF707; Domain location=4-224; Score =272.4; E_value=8.7e-79; Accession=PF05212.3; Description=Protein of unknown function (DUF707)
MATIIWVPTNPRGAERLPPKIVKSESDFYLHRLWGMPYQDLSIKPKYLVTFTVGSDQKDNIDAAVKKFSENFTIVLFHYDGRASDWEKFEWSKRAIHISARKQTKWWYAKRFLHPDIVAPYDYIFIWDEDLGVEHFDAEEYLKMVRKHGLEISQPGIDPSSSFTWQMTRKRDSGEVHNSPAQVFHNHCHFCYITTALISYQHMLRSSSIEEVPYTVHTKAHQTSSYLF

SEQ ID NO: 180380 - protein, 219 aa, Glycine max
  Coding DNA Sequence Number=SeqID_63602
  Homolog annotation: Hit_ID=Q5TJC4; Match level="QueryCoverage=31%, HitCoverage=22%, E-value=7e-24, Identity=82%"; Hit description =Impaired sucrose induction 1-like protein
MATMMWSLERSDWDSVETRSDDAEVELALRVLEGCFLLHPQSTALAHQHNAIQVLMNILSTRGVLEQGACLDALISLIVDSSSNQMDVLIDVPLDAYEIVCLRVGVAVHNLGQFYLGQRKLEEAPYVAVSRSGQENLLQAPLLSRSNSMEASLAKDTSSNDVKNGQGFKGHSMLAPFTAGWQTTNLHSLVIEKSEGSYVYDINGKKYLDALAGLWATSL

SEQ ID NO: 180381 - protein, 1433 aa, Glycine max
  Coding DNA Sequence Number=SeqID_63603
  Gene Ontology: Mol. function=DNA binding; Cellular component =chromatin; Biological process=DNA integration
  Homolog annotation: Hit_ID=Q1S9T4; Match level="QueryCoverage=90%, HitCoverage=100%, E-value=0.0, Identity=72%"; Hit description =Integrase, catalytic region
  Pfam annotation: Domain name=GRP; Domain location=215-289; Score= -18.3; E_value=0.0054; Accession=PF07172.2; Description=Glycine rich protein family
  Pfam annotation: Domain name=rve; Domain location=561-723; Score =150.6; E_value=4.2e-42; Accession=PF00665.16; Description=Integrase core domain
  Pfam module annotation: Pfam domain module=GRP::RVT_2::rve; Domain location=215-289::934-1190::561-723
MAGSNPPSPPSSVTHPALTVPNITNFIKVKLDIEKSQYNTWSELFKIHARAYQVIDHIIPSSADDTRDISLKQTDPKLWSRLDAVVLQWIYGTISDDLLNTIIERDTTAEMAWNRLFEIFFDNKHSRALYLEQEFSRVQMEQFPNASSYCQHLKTLSDQLSNVGAPVSNERLVLQLISGLTDAYAAVGSQIRHGETLPPFYKARSMIVLEETAKAQKAATVTDNSAFLASQDVSTVNNSSQQNYNNTPNSTNHGGRGSDNTASNRGRGSNRGGRGNRGRGRNGGRNNRSQYYQYPQQQQWAVPPWAAPWQPWATPPCPYPTTPNWQHQSTPRQQGILGPKPPQAHMAATSANNAQPSYASTDIQAAMHTLSMAPPDDQWYMDTGATSHMTANGGNLTSYSNMSNNIIVGSGHNIPVIGRGNALIPNSHHPLTLHNVLHAPQLIKNLVSVRKFTIDNDISVEFDPFGFSVKDFQTGIILMRCDSSGDLYPLTSRPTTTYPSNFVALSKELWHNRLGHPGIPVFNSLQRNNFILCNKLPKHYFCHSCPLGKHTKLPFYESSSYTMMPFDIVHSDIWTSPVLSSGGHRYYALFLDDFTNFLWTFPIANKSQVHSIFIQFRAHIKTQFEREIKCFQCDNGKEYDNAHFHKFCELNGMTFRFSCPYTSPQNGKAERKIRTINNIIRTLLAHASLPSHFWHHALQMATYLLNILPNKKLALQTPTKILYQKDPSYSHLKVFGCLCYPLIPSVTRNKLQPRSTPCVFLGYPSNHRGYKCYELSSRKIILCRHVTFDENTFPFSALNAPPTSSYDFLDTSDTPFLKTDPTSSPLMTPTPNQHSPHPNTTPLPTPISLPNRTTTTPTSQHMPSSTSVPSSTQTTEPISSSSPSPPSPQMTTRAQHGIIKPRKLFNLHASASHSISPLPTNPINALQDPNWKMAMTDEYNALIENKTWDLVPRPTDANVIRSLWLFRHKKKADGSFERYKARLVGNGSNQQTGVDCGETFSPVVKSATIRTVLSIALSKSWGLHQLDVKNAFLHGNLNETVYMYQPAGFRNPQYPDYVCLLKKSLYGLKQAPRAWYQRFTDFVATLGFSHSICDNSLFTYHNGNDTAYILLYVDDIILTASSDTLRQSIMSKLSSEFAMKDLGPLSYFLGISVTRHSSGMFLSQHKYAEEIIERASMSSCKPVSTPVDTKAKLSGTSGNPYHDPSEYRSLAGALQYLTFTRPDISYVVQQVCLFMHDPRTQHMNALKRIIRYIKGTITHGLHLSPSSADKLTTYTDADWGGCPDTRRSTSGYCVYLGDNLVSWSAKRQPTLSRSSAEAEYRGVANVVSESCWLRNLLLELQCPIAKATLVYCDNVSVVYLSGNPIQHQRTKHIEMDIHFVREKVARGQIRVLHVPSRYQIADIFTKGLPLQLFSDFRDSLNIRPPPVSTTGVY

SEQ ID NO: 180382 - protein, 353 aa, Glycine max
  Coding DNA Sequence Number=SeqID_63604
TELERHNLHKCLTNLVDGSIHVALVKEFYANLDSSEGPSPKQARVRGHLVKIDADSLNTFLETPVVLAEGDTLPTYSRYCRLPSDPREIEAALCIPGRGFILNTEGHPGRILRKDLMTLAKVWSVLSYSNLAPTSHTSDPTVDRARLIFGLVSRMDMNIGALIFGQMTSIAQSNSSRLGFPTLITALCQAKGVVSDSLTFERLSPVINLAYIRKNCWNPNDLTVFIRGDKRARARPADLPSTSVAPTPASTSAAPSIPDQIDSQEDEGPIAQVPQHVEDASSEATVPEPFIVEEEAGETQVRQEVAATPERSREDPTTPILTLNTSPPATHVLHLTDEEDVQTQDTQDQSQEF

SEQ ID NO: 180383 - protein, 278 aa, Glycine max
  Coding DNA Sequence Number=SeqID_63605
  Gene Ontology: Mol. function=1-acylglycerol-3-phosphate O -acyltransferase activity; Cellular component=integral to membrane; Biological process=phospholipid biosynthetic process
  Homolog annotation: Hit_ID=O80437; Match level="QueryCoverage=91%, HitCoverage=51%, E-value=1e-119, Identity=82%"; Hit description =Glycerol-3-phosphate acyltransferase 6
  Pfam annotation: Domain name=Acyltransferase; Domain location=53-172; Score=21.4; E_value=4.8e-05; Accession=PF01553.11; Description =Acyltransferase
MFHEGRFVQRPTPLAALLTFLWLPIGIILSILRVYLNIPLPERIAWYNYKLLGIRVIVKGTPPPSPKKGQSGVLFVCNHRTVLDPVVTAVALGRKISCVTYSISKFTKIISPIKVVALSREREKDVANIKRLLEEGDLVICPEGTTCREPFLLRFSALFAELTDRSVPIAINTKQSVFYGTTVCRHKLLDPYFVFMNPMPTYEITFLNQLPKELTCSGGKSAIEVANYIQRVLAGTLGFECTNLTRKRKYAMLSGTLLSIIFSYIIFNYYHRHLRTSI

SEQ ID NO: 180384 - protein, 113 aa, Glycine max
  Coding DNA Sequence Number=SeqID_63606
MVIDAVVWKVVAGIDMGGVHKCEESMDGYNKIQTYISELLNPARALRNRLGVGGLIAEDKMLTVNFTKASNEMTKRHLKKLGMTYVDHEWIMAGEQQTIADVDMMEEEVEKET

SEQ ID NO: 180385 - protein, 47 aa, Glycine max
  Coding DNA Sequence Number=SeqID_63607
MMIMVTVATIMVVHATIIMVDISNDKNHGGRAEAIMVTTTTIMIVMC

SEQ ID NO: 180386 - protein, 351 aa, Glycine max
  Coding DNA Sequence Number=SeqID_63608
MERPVIHVDPLTVKADGPQRMKLRTCLGIVTCDKVDVTCNNWKQFPVTQKDMIWEDIQSDLTSKWALAHDKEGEDDKVCEKYGISKEKLNQFCQSHKDPSWEDVRNKAHTIQKQNTYPHMLSREGYDFLEKKLMEEKQKKRLEEAAQSGSIDTLVDHPSPIRWHMKWNMARTKKTGQITYEATKEIVDRIDSLEKQASQGSFVAHGRQDVLTTAIGQPEHPGCVRAVRAGVMIKNYFGPASRDSCISLSMAVEDLGPKCSCICNHRDSHCLLRLRVYEGSTTVHNVPLGNDEVKVGVEEVRDADSRVLVPSQEVAAGPAKPIDMSDPDIDPLYLITLTIPQLFLKVVACAV

SEQ ID NO: 180387 - protein, 150 aa, Glycine max
  Coding DNA Sequence Number=SeqID_63609
  Gene Ontology: Mol. function=methyltransferase activity; Biological process=metabolic process
  Homolog annotation: Hit_ID=Q6X0N8; Match level="QueryCoverage=76%, HitCoverage=11%, E-value=2e-30, Identity=67%"; Hit description =Putative spermine/spermidine synthase
MWDVAGDDIGSLDDCVHPLHLGSDYLFIIEVGIMSRAREWLFYSEGQWMVVRSSKAARLIMLPSKSVTLGLLGCRPLHSDTSMEEIQKDLSPLVTQLAPTENDNGAKIPSVSCTSCIFVIFYLFQAIFMMASEGIKERNIIHKVTSSLTG

SEQ ID NO: 180388 - protein, 69 aa, Glycine max
  Coding DNA Sequence Number=SeqID_63610
MEAMKEQMATMMESIMSMKRVIEVNTATAIAASTATKVCRNLPFGGKARRNVKMCLLMKKMCGVSTNVY

SEQ ID NO: 180389 - protein, 164 aa, Glycine max
  Coding DNA Sequence Number=SeqID_63611
MYKWELARKKLRKCSQQLALRHRCITEIMLGIKTQQTELQQTKKSCKISQNGVKEEKRPSHELLTSKRESKELHLAFGEGKSNRGMQRKVALGYSGLMKMEISWRIIWQHHFLWCKRSYKNPQKWKCSSQTLTMKTRAMFKPVVEINAEKESWRIMVRFFVDGI

SEQ ID NO: 180390 - protein, 43 aa, Glycine max
  Coding DNA Sequence Number=SeqID_63612
MKTKEIMKGPVRLRKEEGLQMTMREGEQIVQFSEESATKYVPH

SEQ ID NO: 180391 - protein, 123 aa, Glycine max
  Coding DNA Sequence Number=SeqID_63613
MLQLWKNLLPGHLTEEGSSLVVNYNNGRTFFREFLGRTSSVRSHRRRLFHSCNIKCGKTFFRAISRNKFFRRKSQKKVLPQLKITTAEEPSSVDSCGRRSFARSHGGRFFRCCYFQLQKNLLP

SEQ ID NO: 180392 - protein, 127 aa, Glycine max
  Coding DNA Sequence Number=SeqID_63614
MPSFRDLEQKWAPKVEALLGNNGGGRKEEEGCLCHMSPFEWSKKGPTFSFDCDPYSATKSEKNLTFETLKSCLGLRAVSLVPVPRVSLRPSGPVFESKQYICQNAQNKTPRVAQRLVLLNFKLHAKR

SEQ ID NO: 180393 - protein, 306 aa, Glycine max
  Coding DNA Sequence Number=SeqID_63615
  Gene Ontology: Mol. function=transcription factor activity; Biological process=regulation of transcription, DNA-dependent
  Homolog annotation: Hit_ID=UPI00006DBC1D; Match level="QueryCoverage =94%, HitCoverage=96%, E-value=1e-123, Identity=76%"; Hit description= COG0583: Transcriptional regulator
  Pfam annotation: Domain name=HTH_1; Domain location=12-71; Score =72.1; E_value=1.8e-18; Accession=PF00126.17; Description=Bacterial regulatory helix-turn-helix protein, lysR family
  Pfam annotation: Domain name=LysR_substrate; Domain location=95-303; Score=157.6; E_value=3.2e-44; Accession=PF03466.10; Description=LysR substrate binding domain
  Pfam module annotation: Pfam domain module=HTH_1::LysR_substrate; Domain location=12-71::95-303
MENRMSFDGRLLSGMSVLAAVVEAGSFSRAGEVLGLSASGVSRAISRLEQRLGVRLLDRTTRTLHLTSEGASLYERAAPHLEGIEEAANYVSGAAVTVRGTLRVSLNPLFSRYVLAAKLPLLRARYPHLELTILQQPDVGDLVAEGIDVAVRFGPQPPSTMTSRLLLQTRVLTVAAPDYLARCGRPTQPQQLTEHNCLQYIDPRSNKPFSWEFHRGTQRLTVATHGHLTTTDPDLMVQACVGGAGVAQVLALSVQHLIASGELVELFPDWPDETYPLFITRPSRRLAPAAVEAFLGFCLEICAEQS

SEQ ID NO: 180394 - protein, 179 aa, Glycine max
  Coding DNA Sequence Number=SeqID_63616
  Homolog annotation: Hit_ID=Q3JWK8; Match level="QueryCoverage=36%, HitCoverage=48%, E-value=4e-08, Identity=40%"; Hit description =Putative membrane protein
LVRAARRRAHCHAGGVRHHACQRPSRRVCLLRQRDAVSCPGERPVPGRAVTEASGGNVLFNFRAAGKRAPPGKRSLTSIIILYLAMLCGTAFLAFLPLICAMGAGYVASLAGCQLDEGNVHPCYILGEDRGQLLYELGVMGWFLLGTIPLGGILLLLATLTFIVQLVGYYRQTRAEGNR

SEQ ID NO: 180395 - protein, 89 aa, Glycine max
  Coding DNA Sequence Number=SeqID_63617
GQLAKQLADRSSSSFTANTEKNPKEECKAVMTRCRRAIHVDESEAEKKMEEHKQQLAPKAALEPVYDFVELEEINEDAKDNKEEETPIK

SEQ ID NO: 180396 - protein, 87 aa, Glycine max
  Coding DNA Sequence Number=SeqID_63618
MRWIYVRWEGEESRTKALSLWWPILTKGQYESNGGRPCCHSTTTTDHHCGNFPRWHLEHDGVRERTRGKKGKEGNCNHQMVSDWSYC

SEQ ID NO: 180397 - protein, 105 aa, Glycine max
  Coding DNA Sequence Number=SeqID_63619
MCVCSQIWKSELLNLMQHPMRCLVFKHEGEIVVSGASLETLALVRRGWWCCDSISGRTTGGGVSEGLEERSGMRQGVEWLRDEREQKGLVRNQYEGGSSFKPVVV

SEQ ID NO: 180398 - protein, 104 aa, Glycine max
  Coding DNA Sequence Number=SeqID_63620
MEFLNNQVYQWSVAPFNIIRNTRHMIALSFMDRLIHLCDECVDMLFWVRESIIMMDGQHLPSRWELSLHNLVSERMKLSVNICCSLDWLCDKGVPSHHIASVAS

SEQ ID NO: 180399 - protein, 90 aa, Glycine max
  Coding DNA Sequence Number=SeqID_63621
MKDITCDRDHEIEQDRSREHSRTHEATEAQRWDENTPLETWLQGVINTMTGGFAEERSSNSFLSEDIMARECYTTSLNIAKGKKVIELKE

SEQ ID NO: 180400 - protein, 109 aa, Glycine max
  Coding DNA Sequence Number=SeqID_63622
MSPTVSDICPQAPYQDSKTYHYVFSAYHPWRVICMQCMQEYGAQNPSRKIPWSILQRARETQGPPLVSPTDRHHRVSSTCHFVRGVYVRAQYLHCTQDSANPTFALADP

SEQ ID NO: 180401 - protein, 121 aa, Glycine max
  Coding DNA Sequence Number=SeqID_63623
  Homolog annotation: Hit_ID=Q9LKM6; Match level="QueryCoverage=29%, HitCoverage=11%, E-value=5e-09, Identity=75%"; Hit description =Casein kinase II alpha subunit
MVVSFFLTHLFLEVASPIIFLPSPFRYHDLQEAKDFIDKEDTRPTSSNGATSVLLSEYFFSSDQDDYEVVQKVGRGKYSEVFESININRNERCIIKILKPVKKKKFYSVPADCELSQAMML

SEQ ID NO: 180402 - protein, 116 aa, Glycine max
  Coding DNA Sequence Number=SeqID_63624
  Gene Ontology: Mol. function=protein binding; Cellular component =viral envelope
  Homolog annotation: Hit_ID=O24293; Match level="QueryCoverage=90%, HitCoverage=10%, E-value=1e-12, Identity=45%"; Hit description =Chloroplast inner envelope protein, 110 kD (IEP110) precursor
  Subcellular localization annotation: CTP_CleavageSite=34; ConfidenceScore=5.49e-01
MNPSTLTPSHTHRPLLLPSPFYSRRHRFRVSLPRCSSDAAAPSPPPPTPPQRPPKDLKGIELLVDKLSPPARLATSAVIVAGAAAAGYGLGSRFGGSRYAALGGSCCPRRCRRWLR

SEQ ID NO: 180403 - protein, 344 aa, Glycine max
  Coding DNA Sequence Number=SeqID_63625
  Gene Ontology: Mol. function=isoleucine-tRNA ligase activity; Cellular component=extracellular region; Biological process=tRNA aminoacylation for protein translation
  Homolog annotation: Hit_ID=Q7WKD5; Match level="QueryCoverage=99%, HitCoverage=36%, E-value=0.0, Identity=90%"; Hit description =Isoleucyl-tRNA synthetase
LRGHGQRIAVDLEQLAVGHGLRHGVEVGQVGQQEAQRVADAAVALDHALEDLVGDRQFARIVGGGDPQAQDLGAQRIGHLLRRDHVADRLAHLAALAVHHEAVREQRLVGRLAIQHAAGQQRRMEPAAVLVGAFQVEVGGPAQFGAVRAGEIAVLAAQHGGVGAARVEPHVQRVAVLFVLIGFVAQQLARVQRLPGLDAALLDALRDLFQQLGSARVQRAGFPVHEESHRRAPLALARQGPVRTVGDHGVQAGAAPGRVEGGGVDAGQRRFAQGRAAVLGLDVHAGEPLAGGAVDDGRLVAPAVHVAVLVLFHVHQRAGFLQGLDDLGVGVPDRQAAEQRQAVD

SEQ ID NO: 180404 - protein, 110 aa, Glycine max
  Coding DNA Sequence Number=SeqID_63626
  Gene Ontology: Mol. function=nucleic acid binding
MTLQLADRSITRPYRVIEDVLVRVKYFIFPADFVVMDISEDTDIPVILGRPFMLTASCIVDMGKRKLELGFEDQKIDFDLFVEDKPALEHNVCLQVMEGGQEVLKVGTKT

SEQ ID NO: 180405 - protein, 75 aa, Glycine max
  Coding DNA Sequence Number=SeqID_63627
MPTWAFQDVQQKAVPSGGSNPAHLGELGGNHLPLFPINRGKRAEQIRSTLLVSEIHLKLVRNIVSVKKIQAEALL

SEQ ID NO: 180406 - protein, 412 aa, Glycine max
  Coding DNA Sequence Number=SeqID_63628
  Gene Ontology: Mol. function=ATP-dependent DNA helicase activity; Cellular component=chromosome; Biological process=DNA repair
  Homolog annotation: Hit_ID=Q3N678; Match level="QueryCoverage=99%, HitCoverage=58%, E-value=1e-90, Identity=44%"; Hit description =UvrD/REP helicase
RRIEAHPRTGALQIVEVRERVEEITLRALPPAQPDLPFVVSPPLPDASAPLFATLSSEEALSIGVPADWVNDVLQASENRFFTLANHLPQEAAEALLEYAATGVLNRPKAVDTTPVTHPDAQRRFCILEGHEELAAALDQPFEKWAVFLHPSQRALVERDFAGPVRVVGSAGTGKTVVAVHRVVRILRADPTARVLLTTFSEPLALALKRKLNVLVADDLRLTERVVVSSFEQAAGELYALMTGRKAYLVNRDNLRGILSDTAAIAGSGRYPIRFLLSEWEHVIDAWQIDSAEAYALVPRMGRKNRLGAKQREELWSIFAEVRRQVRAKALMTSADLFSAVMRHFDNRDDKPYSHVVVDEAQDLGVAELRFLKAIVPDRADAMFFAGDIGQRIFQQPFSWKGIRIDVRGRPH

SEQ ID NO: 180407 - protein, 161 aa, Glycine max
  Coding DNA Sequence Number=SeqID_63629
GCINYNLVLAIRQLGYPMRGAPLEDELVLVISRGFDKTNVETLQKVRKAWEALRAELEQAQTVKERFNNNELKLRREERDQSRVDSLILKDELKACSRSKSSLSQRLCETETNMLAIITKYQEELNLAAAHEHRVADEYAQVYAKKKAIGRVIDSLHQEAT

SEQ ID NO: 180408 - protein, 290 aa, Glycine max
  Coding DNA Sequence Number=SeqID_63630
  Homolog annotation: Hit_ID=Q091R3; Match level="QueryCoverage=44%, HitCoverage=34%, E-value=3e-08, Identity=30%"; Hit description=Mina protein
  Pfam annotation: Domain name=Cupin_4; Domain location=40-285; Score= -87.7; E_value=0.0047; Accession=PF08007.2; Description=Cupin superfamily protein
MHDIFGAFVQSLNWNGRVPSLLSSILQHLVACFPIASDEQNILNFLNEVKDRLGCPIIYQQDIRAVKTERQSRKEMHYFRDFHSGCSKEPLYFTFDDVLKCGQAYKEGYTVALRGLEFCYQSIAAIADTLALMFGQPSVGANLYLTPPNSQGLIFGSKQWTIFSPPSQLLPHLYDNLLGSDINCTKAGRREFFLREGDLLYIPRGFPHEAYTSSAVSDGSPGFSFHLTLSIEVEPPFEWPPSRYSSNCVHSPEEGGLCPELLVGLSSNQCVSSIGCEWQTNMWSVADSKN

SEQ ID NO: 180409 - protein, 440 aa, Glycine max
  Coding DNA Sequence Number=SeqID_63631
  Gene Ontology: Mol. function=protein serine/threonine kinase activity; Cellular component=chloroplast; Biological process=protein amino acid phosphorylation
  Homolog annotation: Hit_ID=P27450; Match level="QueryCoverage=76%, HitCoverage=80%, E-value=1e-85, Identity=48%"; Hit description =Probable serine/threonine-protein kinase Cx32, chloroplast precursor
  Pfam annotation: Domain name=Pkinase; Domain location=125-405; Score =157.0; E_value=4.8e-44; Accession=PF00069.15; Description=Protein kinase domain
  Pfam annotation: Domain name=Pkinase_Tyr; Domain location=125-405; Score=121.1; E_value=3.1e-33; Accession=PF07714.7; Description =Protein tyrosine kinase
  Pfam module annotation: Pfam domain module=Pkinase::Pkinase_Tyr; Domain location=125-405::125-405
  Subcellular localization annotation: CTP_CleavageSite=94; ConfidenceScore=5.76e-01
MGNCWSHQSGSPGDHRNSNTAPNPNNQSGSIQFSAGLSNTRLIQNGNSTSLGRSSHSGGISRFFGPSSSNNYSTGNNTSTSLWGSETSQASRVRDEEEFPHGQILDVADLRAFTLAELKAATKNFRAETVLGKGGFGTVFKGLIEDRAAKKRGEGLTIAIKKLNSGSSQGIAEWQSEVNFLGRLSHPNLVKLLGFGRENSELFLVYEFMHRGSLDNHLFGRGANVRPLSWDTRLKVMIGAARGLNFLHSLEEKIIYRDFKPSNILLDTTYTAKLSDFGLARSVNSPDQTHVTTQVVGTHGYAAPEYIFTGHLYVKSDVYGFGIVLLEVLTGKRISGIMFLCEQTSLSDWLKSNLLNRGKIRSTMDAKLEGKYPSNLALQLAQLALKCIQAEPKVRPSMKEVVETLEHIEAANEKPADNTHNRKRVNLSRVVQQHGRPEGG

SEQ ID NO: 180410 - protein, 297 aa, Glycine max
  Coding DNA Sequence Number=SeqID_63632
  Gene Ontology: Cellular component=mitochondrial matrix
  Homolog annotation: Hit_ID=Q6YZC6; Match level="QueryCoverage=92%, HitCoverage=100%, E-value=4e-43, Identity=41%"; Hit description =Cation exchanger-like protein
MDDYMTYVNGPEEFLRFTFGMGISKTEVNLKRLLAAAPQQQNQAKLVHYVATLREQLEQLAEERAPEGLPRISKAVLNDYSEKIEAIASKLVNHVSDPPVPKKDFERNSVEENSSEIEETKQILLSSGLRRRPVLFYCCSSDSVDRPASSTEERAHKPAETDHISPVKLDAAAHAHIEKHRMLQDNLTDEMVVLAKQLKESSLMMSQSLQNTEKVSKLIFSFNPACLTAKRLYEMVMLNILDSTEKAIEHSLASTGRANVRATAIYSESSKTSCLTWLVMFVMTCVFVMVILLIRVT

SEQ ID NO: 180411 - protein, 157 aa, Glycine max
  Coding DNA Sequence Number=SeqID_63633
MTEARQKGVRKVNENENKSTQNKWGPPRVKYAYLGLWEFYGSITGCPGSPGIPFFNKTGAFQEVTKTHGLRKTPPFDFRHITEFSRIATFWRHVELVNKKTIASKVLGVKVVLSSDTIVKAIGCLHEGSTYQGKWEKNYDSRVTRALYWENSDKVND

SEQ ID NO: 180412 - protein, 75 aa, Glycine max
  Coding DNA Sequence Number=SeqID_63634
  Gene Ontology: Mol. function=protein serine/threonine kinase activity; Biological process=protein amino acid phosphorylation
MDANLEGKYPTNLALQLAQLALKCIQADPKVRPSMKEVLETLEQIEAANEKPADNIKWVTCSRVVQQHGWPEVVN

SEQ ID NO: 180413 - protein, 190 aa, Glycine max
  Coding DNA Sequence Number=SeqID_63635
  Gene Ontology: Mol. function=sequence-specific DNA binding; Cellular component=nucleus; Biological process=regulation of transcription
  Homolog annotation: Hit_ID=Q2PJS0; Match level="QueryCoverage=67%, HitCoverage=46%, E-value=2e-61, Identity=89%"; Hit description=WRKY65
  Pfam annotation: Domain name=WRKY; Domain location=74-134; Score =139.1; E_value=1.2e-38; Accession=PF03106.6; Description=WRKY DNA -binding domain
  Subcellular localization annotation: CTP_CleavageSite=40; ConfidenceScore=5.47e-01
TPPPLVYLLPCPPPPPHSCPPSPPTEVSPTERSAPPSSLPASLLSPHPTGKGVTTPPSLPEKPLPPLTAIAPREVDEYSWRKYGQKPIKGSPYPRGYYKCSSVRGCPARKHVERAQDDPNMLIVTYEGEHRHPQPRLPETAAGAGGTFAAHPGRSDPSIGFHGHNSNTRVEKKGWGEGKVKGEVQNGESE

SEQ ID NO: 180414 - protein, 86 aa, Glycine max
  Coding DNA Sequence Number=SeqID_63636
MLLLGWKVWREAERQKQDRVGLERRLENEKEKLSLWFWTLVVSLEVVDKPTTFEQLLLLYLRALAAASNNRRNRNCSDGHNWPKFV

SEQ ID NO: 180415 - protein, 225 aa, Glycine max
  Coding DNA Sequence Number=SeqID_63637
  Gene Ontology: Mol. function=sugar porter activity; Cellular component=integral to membrane; Biological process=carbohydrate transport
  Homolog annotation: Hit_ID=Q1T4L1; Match level="QueryCoverage=83%, HitCoverage=37%, E-value=5e-81, Identity=79%"; Hit description=Major facilitator superfamily
  Pfam annotation: Domain name=Sugar_tr; Domain location=1-225; Score= -86.0; E_value=0.00035; Accession=PF00083.14; Description=Sugar (and other) transporter
MAIAGAIVGAALGGWINDAYGRKKATLFADVIFTAGAIIMASAPDPYVLILGRLLVGLGVGIASVTAPVYIAEASPSEIRGSLVSTNVLMITGGQFLSYLVNLAFTGVPGTWRWMLGVSGVPAVVQFVLMLFLPESPRWLFVKNRKNEAVDVLSKIFDVARLEDEVDFLTAQSEQERQRRSNIKFWDVFRSKEIRLAFLVGAGLLKCFECGFGSYSIPPPPPPPQ

SEQ ID NO: 180416 - protein, 590 aa, Glycine max
  Coding DNA Sequence Number=SeqID_63638
  Gene Ontology: Mol. function=transporter activity; Cellular component= membrane; Biological process=oligopeptide transport
  Homolog annotation: Hit_ID=Q1T4L2; Match level="QueryCoverage=97%, HitCoverage=90%, E-value=0.0, Identity=78%"; Hit description=TGF -beta receptor, type I/II extracellular region
  Pfam annotation: Domain name=MFS_1; Domain location=47-519; Score =3.0; E_value=0.00023; Accession=PF07690.6; Description=Major Facilitator Superfamily
  Pfam annotation: Domain name=PTR2; Domain location=109-507; Score =318.0; E_value=1.7e-92; Accession=PF00854.12; Description=POT family
  Pfam module annotation: Pfam domain module=MFS_1::PTR2; Domain location=47-519::109-507
MEPGIENSVNSVNIEAIEVTGGNGHYTEQSGTSHEKIKGGWKTANILLANQALATLAFFGVGVNLVLFLTRVLHQESAEAANNVSKWTGTVYIFSLIGAFLSDSYWGRYLTCTIFQLIFVVGLGMLSFTSWRFLIKPAGCGNEETTCLEPSSLGVGIFYLSIYLVAFGYGGHQPTLATFGADQFDEKNEKHRDARETFFCYFYFALNVGSLFSNTVLVYYENSGMWTRGFLVSLASAVIALVSYLAGYQKYKYVKAHGNPVIRVVQVFVATARKWKVGSAKEDQLYEVDGPESAIKGSRKILHSNDFRFMDKAATITEKDAVHLKNHWRLCTVTQVEEAKCVLRMLPVWLCTIIYSVVFTQMASLFVEQGNVMNNEIGKFHLPAASMSVLDICSVLLCTGIYRQILVPLAGRLSGNPRGLTELQRMGVGLVIGMLAMLAAGVTEFERLKHVTPREKASSLSIFWQIPQYVLVGASEVFMYVGQLEFFNGQAPDGIKSFGSSLCMASMSLGNYVSSMLVYMVMRITARGENPGWIPNNLNVGHMDRFFFLVAVLNALDFVLYLLCARWYKSINLGDGDMESQEDKEMIGKV

SEQ ID NO: 180417 - protein, 781 aa, Glycine max
  Coding DNA Sequence Number=SeqID_63639
  Gene Ontology: Mol. function=ubiquitin-protein ligase activity; Cellular component=ubiquitin ligase complex; Biological process =protein ubiquitination
  Homolog annotation: Hit_ID=Q1T4L3; Match level="QueryCoverage=98%, HitCoverage=72%, E-value=0.0, Identity=56%"; Hit description=U box
  Pfam annotation: Domain name=U-box; Domain location=581-656; Score =45.7; E_value=1.6e-10; Accession=PF04564.6; Description=U-box domain
MASSLEELLAEEGFKGIRRVTRSRSSFHHGASSEPLYSLDGRFSVSSERVRTQRTKSDASQYQITSRQLKTDTHTATNRMSRDNLFSRDKMDQRLKNSSTDTDSGKGIDMPRNEITEVTEQEANIVKDNYSNQVSLKRGKEKNFNELVEEEDPVKDAKMHSRSSSIHMLGHSSETRKNIKPQKDSYTRSNSSRNKDSNHAMQAASSLALDQVAVQAVVSILNGYIKRFSKDVNFRSTLRGKCFSSLNLIEMEEENITETKVIRSLEQAIEAIDQTAEEPISTMYLKRTTMQLSIITGLSLNDFKYECTCGIPNYKLSACAHLYLSVARTVLLPELWEHLFSPQFSHLKAWYIKEAEFLEDAPSKTRKLKLLQKVYNEHLDSGTHVFAIYYKDWLTEGVESPPIPSIGIPSASVTGSQEGNSLGYSFESASSIDPLSPQPMVSKKLYDSMFGDSSKSRVYQVKDINDDDNLDNCMKGSCGSTIVRQTLTYESETVKFTDQDIEDFSIGVAIDTIKPHNGNSMTASEEWQKRNLVDDINNSFSMKTNLSSHSIDALSHEKASELVLKKPNKTSSTLEGSYFPSIPHEFICPLTGDLFEEPVTLETGQTFEREAIKAWFEKGNRTCPVTGNNLECVTMPFTNLILKRLIDNWKSERLDYLIDFSFQTVENLEELKLKKRDEAAVFKLESHFSSLKEEDKSTYAKHLISLGVLPFLFRRFEQGNVKEKSHVVSLLLNCIQVDSGCIYQIARSVNRKCLVELLHSKEATPTTNAIIFLTELLSMKR

SEQ ID NO: 180418 - protein, 267 aa, Glycine max
  Coding DNA Sequence Number=SeqID_63640
  Gene Ontology: Mol. function=ubiquitin-protein ligase activity; Cellular component=ubiquitin ligase complex; Biological process =protein ubiquitination
  Homolog annotation: Hit_ID=Q1T4L3; Match level="QueryCoverage=72%, HitCoverage=18%, E-value=4e-47, Identity=55%"; Hit description=U box
MKFSFCLAHLKTRTSFSLQVEPQKFGIYREVAVNAIAEALDASLNDEKGREKCCRALLILCSHFSSTGKIPTMTSILKQAGYNNDSLEVKPPGHEEEGQQLYVTISVSSEDEEKRGEELLKKLLESLIGDGESPFLKSISRCLDTNHLDLVRTCLITVTWLSSSLSSLFSAGLHLPAFLSIISQLKGILENGELELKTLASLSLLNFSKISGSPSSALLFPFLFLVAKNLSIFDMNLCENEGVKYIQKGDRYEHSSALSMHNLYDSV

SEQ ID NO: 180419 - protein, 62 aa, Glycine max
  Coding DNA Sequence Number=SeqID_63641
MDDNFCYKLYEHAHLFLLNISEIMNCSGIVSNSGEGEEQEAAITKANVPQESARFKPLFIYG

SEQ ID NO: 180420 - protein, 85 aa, Glycine max
  Coding DNA Sequence Number=SeqID_63642
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1T4L4; Match level="QueryCoverage=83%, HitCoverage=3%, E-value=1e-33, Identity=97%"; Hit description=IMP dehydrogenase/GMP reductase
MNQDNYMEEALKMRNLLQEFLKKHDGVRFPSILGLREHIFTGSVSSLAWFMSNQETSFVTIGQRLLANPLNIIWTEFWNKCASSF

SEQ ID NO: 180421 - protein, 106 aa, Glycine max
  Coding DNA Sequence Number=SeqID_63643
VNLTEPPPPPKAPPPEESSFHAAEDIQKPASSGEKPSETNDTNTNVASPKSLSWDHGLVLKVRWVFLGGGGGGDDWKVLPPEALWISINSKQPVGAWEANICCFQI

SEQ ID NO: 180422 - protein, 87 aa, Glycine max
  Coding DNA Sequence Number=SeqID_63644
MVVVATLVVVVVMTVVISDDGSNGGIDNNSNNNDNDDDNSQTVVTEETLIVVVIVVMWVVTMVVSAASDDCGGDNKGDISSNSTMTW

SEQ ID NO: 180423 - protein, 83 aa, Glycine max
  Coding DNA Sequence Number=SeqID_63645
MVPQKVKYWWKIISHGDMKRCAAGVGACCEGEESKDGYVPASRDDIESQSSTNVASKRVRQSTPDSGEILKARNGEEMNDANV

SEQ ID NO: 180424 - protein, 123 aa, Glycine max
  Coding DNA Sequence Number=SeqID_63646
MMEYPLQYREKGSIARDADVEGQASRKVSLQRYLEKRKDRGRLKGKKLTGITSSNFEMYLNLPVKVHASNGNSSRSSTSSPPQPRLPLVSSGSADNQLKVALPIDLNDKVSLQMFKNAKTLTR

SEQ ID NO: 180425 - protein, 250 aa, Glycine max
  Coding DNA Sequence Number=SeqID_63647
  Gene Ontology: Mol. function=oxidoreductase activity, acting on single donors with incorporation of molecular oxygen, incorporation of two atoms of oxygen; Cellular component=plasma membrane; Biological process=...
  Gene Ontology: Biological process=methionine biosynthetic process
  Homolog annotation: Hit_ID=Q8W108; Match level="QueryCoverage=97%, HitCoverage=97%, E-value=6e-81, Identity=60%"; Hit description=1,2 -dihydroxy-3-keto-5-methylthiopentene dioxygenase 3
  Pfam annotation: Domain name=ARD; Domain location=14-167; Score =292.9; E_value=6.1e-85; Accession=PF03079.5; Description=ARDARD' family
MVSSDKDPREDVLQAWYMDDSDEDQRLPHHKEPKEFVSLDQLAELGVLSWKLDADNHENDPELKKIREERGYTYMDVCEVCPEKLPNYEQKIKSFFEEHLHTDEEIRFCAAGSGYFDVRDRNEAWIRVWVKKGGMIILPAGIYHRFTLDESNYIKSKRFQSSRVWRANMYMPLPQGSGEVESMPSGSQAVLEWVALCCYLGLMNIALRFFVGEPVWTPYNRPNDHLPARQQYVKDFVEKDVSNHAVDAAA

SEQ ID NO: 180426 - protein, 108 aa, Glycine max
  Coding DNA Sequence Number=SeqID_63648
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1T4L4; Match level="QueryCoverage=55%, HitCoverage=3%, E-value=1e-21, Identity=81%"; Hit description=IMP dehydrogenase/GMP reductase
MRYPSLRVAYIDEVEEPVQDSKKKINKVYYSCLVKAMPKSNSPSEPEQNLDQTVRKFQLDGQQKFLQNEEIYIQKGTVKTRNVASLLCSGALYCQRLKLHSSSLWCSA

SEQ ID NO: 180427 - protein, 366 aa, Glycine max
  Coding DNA Sequence Number=SeqID_63649
  Gene Ontology: Mol. function=sequence-specific DNA binding; Cellular component=nucleus; Biological process=regulation of transcription, DNA-dependent
  Homolog annotation: Hit_ID=Q9LUH8; Match level="QueryCoverage=98%, HitCoverage=94%, E-value=1e-105, Identity=55%"; Hit description=Heat shock transcription factor-like protein
  Pfam annotation: Domain name=HSF_DNA-bind; Domain location=43-213; Score=256.6; E_value=5.1e-74; Accession=PF00447.8; Description=HSF -type DNA-binding
MDPHGQVKEEFLGESSSFCGGYDPQPILVVPQPIEGLHETGPPPFLTKTYDIVDDPSTNHIVSWSTGNNSFVVWDPQAFSITLLPKFFKHNNFSSFVRQLNTYGFRKVDPDKWEFANELFLRGQKILLKNIRRRKANHQSHAMQQQGVVEPCVEVGPFGLDGEVDRLRRDRQVLMVELVKLRQQQQSTKSHLQEMEGRLKKTEQKQQQMMNFLARAMQNPNFVQQLAQQKEYWRKELEEAFSKKRRRPIDQGPSNVVEVGGDDELLGCAEECSNFVKLEPQEYTAKVLEFEVPDLPLVLNLDEENIESQKRILEEDNIRLESRDKDIDEVFWQDLLNEGIEDHGVLGVEDVDVLANQLGYLASSPK

SEQ ID NO: 180428 - protein, 87 aa, Glycine max
  Coding DNA Sequence Number=SeqID_63650
MELMTDDHETQVTFLKRKKDNHKYPTVNPNPSLKMSWTVVLLFGNCQELSSVVRAAGDGLMPRGVSYIYDSTWSLKTQASNMHEMKN

SEQ ID NO: 180429 - protein, 686 aa, Glycine max
  Coding DNA Sequence Number=SeqID_63651
  Gene Ontology: Cellular component=integral to membrane
  Homolog annotation: Hit_ID=Q5ZBZ3; Match level="QueryCoverage=99%, HitCoverage=98%, E-value=0.0, Identity=60%"; Hit description =Putative dymeclin
MGSVPSTPRRGGAYSPETAEYLIGTFVGDTPFPLSSEFWQKLLELPLNVQWSTQRVQQACELLAKNNCHTRHLAKILFHLACCLQEYMSSSGALPLVYEKAFNAVYISSIFLKHLIESVQGENIQLYLSLEDNEDVQKDVLRDQTIENLVMRNVLSFIASVEVSPDTFLLHLELLNFMIIGMSTQLLCGPSPGPNDVNPFLDAAMAQDSSLVGAVVCRLLLNFMARSNVPSNRATYSILYDGNQSSVLQRVGSAAANIVLFPFSYLVSSSGEESKSPIADISIHVLLVLVHYHKCLVSEDYANHKSSTSDSLLKENPHFSDNPYCKALEHAIDCELDRVDIEGNAHSARHIKLPFASLFDTLGICLADEAAVLLLYSLLQGNSAFLEYVLVRTDLDALLMPILEALYNAPSRTANQIYMLLIILLILSQDSSFNASIHKLILTGVPWYKERLFHQTSLGSLMVIILSRTVQYNLSKLRDVYLQTTCLATLANMAPHVHRLSAYASQRLVSLFDMLSRKYNKLAERRDNKLHIAKGNSVEGNQPCRRYEIINAILTYALPRNPEVVYAIMHRQEVFQPFKNHPRFNELIDNIYTVLDFFNSRMDAQREDGDWSVHEVLQVIIVNCRSWRGDGMKMFTQLRFTYEQESHPEEFFIPYVWQLVLSHCGFSFNTGAINLFPVDLQTEVCI

SEQ ID NO: 180430 - protein, 111 aa, Glycine max
  Coding DNA Sequence Number=SeqID_63652
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1T4L4; Match level="QueryCoverage=91%, HitCoverage=5%, E-value=2e-42, Identity=85%"; Hit description=IMP dehydrogenase/GMP reductase
MFIQTPFHEELQIALVPFNYMLHHSVRGMMYYRKALELQAFLDMAKDEDLMEGYKAMENSDDNSRGERSLWTQCQAVADMKFTYVVSCQQYGIDKRSGSLRAQDILRLMTR

SEQ ID NO: 180431 - protein, 115 aa, Glycine max
  Coding DNA Sequence Number=SeqID_63653
  Homolog annotation: Hit_ID=Q1T4L4; Match level="QueryCoverage=88%, HitCoverage=5%, E-value=5e-54, Identity=93%"; Hit description=IMP dehydrogenase/GMP reductase
MAFELYGMLAGNVSPMTGENVKPAYGGEDEAFLRKVVTPIYNVIAKEAARSKKGRSKHSQWRNYDDLNEYFWSADCFRLGWPMRADADFFCLPAEKLVFDKSNRLSMHYKIQNHP

SEQ ID NO: 180432 - protein, 549 aa, Glycine max
  Coding DNA Sequence Number=SeqID_63654
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1T4L4; Match level="QueryCoverage=94%, HitCoverage=27%, E-value=0.0, Identity=89%"; Hit description=IMP dehydrogenase/GMP reductase
MYIIEIGILCHFIKRCATDVNLFSPTWTAVLDVILSWKAQWSMSLYVKLRYILKVVSAAAWVIVLSVTYAYTWDNPPGFAQTIKSWFGSGGSSAPSLFILAVVVYLSPNMLAAIFFLIPFIRRHLERSNYRIVMLMMWWSQIKPLVGPTKAIMSVKITTFQWHEFFPHARNNIGVVIALWAPIILVWVYFMDTQIWYAIFSTLFGGIYGAFRRLGEIRTLGMLRSRFQSLPGAFNASLIPEETNEPKKKGLKATLSRRFPEISSNKGKEAARFAQLWNQIITSFRDEDLINDREMNLLLVPYWADTQLDLIQWPPFLLASKIPIALDMAKDSNGKDRELKKRIAADNYMSCAVRECYASFKSIIKHLVQGEREIPVIEYMFDEVDKNIETDKLISEFRMSALPSLYAQFVELTQYLLNNDPKDRDNVVILFQDMLEVVTRDIMMEDQDQIFSLVDSSHGGTGHEGMLHLEPEPHHQLFASEGAIKFPIEPLTAAWTEKIKRLHLLLTTKESAMDVPSNLEARRRISFFSNSLFMDMPMAPKVRNMLSFS

SEQ ID NO: 180433 - protein, 88 aa, Glycine max
  Coding DNA Sequence Number=SeqID_63655
  Pfam annotation: Domain name=LisH; Domain location=45-71; Score=27.1; E_value=6.3e-05; Accession=PF08513.1; Description=LisH
MPATPPSNKGRISTLFAFTPRQVLLSNQTMKHTTDNGTPISEHKVLLHQSIARYLERSGFSKTLKKFLSEAHIEVGNIAELKLDYVKP

SEQ ID NO: 180434 - protein, 336 aa, Glycine max
  Coding DNA Sequence Number=SeqID_63656
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1SRM9; Match level="QueryCoverage=93%, HitCoverage=71%, E-value=1e-159, Identity=82%"; Hit description =Unnamed protein product; contains similarity to callose synthase catalytic subunit gene_id:F5H8.12
  Pfam annotation: Domain name=DUF605; Domain location=44-296; Score= -119.6; E_value=0.0054; Accession=PF04652.6; Description=Protein of unknown function, DUF605
MSSSRGGAGPSSEAPPPRRIMRTQTAGNLGESVIDSEVVPSSLVEIAPILRVANEVEKTHPRVAYLCRFYAFEKAHRLDPNSSGRGVRQFKTALLQRLERENDPTLKGRVKKSDAREMQSFYQHYYKKYIQALQNAADKADRLPLSPFSAQLTKAYNTANVLFEVLKAVNMTQSMEVDREIQAAVYALRNTRGLPWPKDFKKKKDEDILDWLGSMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHGCFDAFSAFAMKS

SEQ ID NO: 180435 - protein, 78 aa, Glycine max
  Coding DNA Sequence Number=SeqID_63657
  Gene Ontology: Cellular component=integral to membrane; Biological process=transport
  Homolog annotation: Hit_ID=Q9LIL4; Match level="QueryCoverage=65%, HitCoverage=24%, E-value=1e-19, Identity=84%"; Hit description =Coated vesicle membrane protein-like
MRSSKMWMVFMCLTVSFFARIESLSVTVNDVECVYEYVLYEGDTVSGNFVVVDHDIFWSSDHPGIDFTVSAISITFLI

SEQ ID NO: 180436 - protein, 151 aa, Glycine max
  Coding DNA Sequence Number=SeqID_63658
  Gene Ontology: Mol. function=ATP-dependent helicase activity; Cellular component=integral to membrane; Biological process=transport
  Homolog annotation: Hit_ID=Q9LIL4; Match level="QueryCoverage=93%, HitCoverage=66%, E-value=7e-68, Identity=85%"; Hit description =Coated vesicle membrane protein-like
  Pfam annotation: Domain name=EMP24_GP25L; Domain location=1-59; Score= 38.1; E_value=3e-08; Accession=PF01105.14; Description=emp24gp25Lp24 family
NLSDDLPKFVTTAAGNTVHSIKGTSGDKFSFKAPSHGMYKFCFHNPYSTPETVSFYIHVGHIPSEHDLAKDEHLDPINVKIAELREALESVTAEQKYLKARDARHRHTNESTRKRVVFYTVGEYLLLAAVSALQVIYIRRLFSKSVAYNRV

SEQ ID NO: 180437 - protein, 1286 aa, Glycine max
  Coding DNA Sequence Number=SeqID_63659
  Gene Ontology: Mol. function=protein serine/threonine kinase activity; Biological process=protein amino acid phosphorylation
  Homolog annotation: Hit_ID=Q5ZDE5; Match level="QueryCoverage=90%, HitCoverage=74%, E-value=0.0, Identity=45%"; Hit description=BWF1 -like protein
  Pfam annotation: Domain name=Beach; Domain location=338-570; Score =22.0; E_value=1.3e-18; Accession=PF02138.8; Description=BeigeBEACH domain
  Pfam annotation: Domain name=Pkinase; Domain location=127-782; Score=- 94.1; E_value=0.0059; Accession=PF00069.15; Description=Protein kinase domain
  Pfam module annotation: Pfam domain module=Beach::Pkinase; Domain location=338-570::127-782
MKCPVLRIFILKLEKRVLLAGRRRIRLQSEHEKSISGTADGESSGAQFILQYMPTRDKNCFINYVNEYILDSGEITTRSSDPGIGSSEDNNAVNVRITSSDDSESGKAFSGSTSCSHSGRFSCLRTITSLAPIARVGMSSYSTFQEVSTDFLCELIEDHVLESLDLFIEGKASGRDSVNFLSLIGLPSFEEDPFPGSLRHPNIAPVLAIFKTSDHVNVVLPKTPYNLESILHFNPNALKSNWNIIFLMYQLLSALSYIHGLGLSHGNICPSNIMLTDSLWSWLRLWNEPVLESNLTLQESERDNSKPARIGCCNVACRSYDLYADLKLSPTIDWQSCFHKWWRGELSNFEYLLILNRLAGRRWGDHTFHPVMPWVIDFSSKPDDSCDAGWRDLSKSKWRLAKGDEQLDFTYSTSEIPHHVSDECLSELAVCSYKARRLPLSVLRMAVRSVYEPNEYPSTMQRLYQWTPDECIPEFYCHAQIFKSIHDGMADLAVPSWAESPEDFIKLHRDALESNRVSFQLHHWIDITFGYKMSGQAAIAAKNVMLPISEPMMPRSTGRRQLFTQPHPIRHATTRTKRHGSNKYAKVWIQANEMHQETSLLSETAYLQELEQASTFSEQARHLNAYYHYPLNQTTGKNISSLGDPTTETFSESISKLSLIDRNYQVPYRMNLISFLQHMKEEDESSLGYPDLLLWKQKLSSSRLCSEDVARDIFSIGCLLAELHLCRPLFDPISLAIYLEDGTLPGFLQDLPPDIRLLVEACIQKDWTRRPSAKILLESPYFPKTVKSSYLFLAPLQLVAKDETRLHYAANLAKHGALREMGAFATEMCTTYCLPLIVNATTGYLRLKVSLLQDSFVREIWNRVGKQAYLETIHPLVLSNLYNSPDKSSAASASVLLISSSEELGVPITIHQTILPLVHCFGKGLCADGIDVLMVPLLKNVVRSFIDVSCMNKADPVQSWSALALIDCMMTLDGLVYFLTEEVIVKELLEDLCCIHIGVLMQKHMEIAVLQVAASTLFGICQRIGADLTALHILPKLKELFDELAFSQEISKGSTTVGRNLKVGKIKIGGDLHIESRMDLVLVLYPSFASLLGIEKLRQCCATWLILEQHLLRHHNWKSYVHLSCMLISKPPVLQWEYAGESSKNSSENFLARRPVIAQGFTSEYNPAKLLLNGVGWSIPQSQGRSAKNLIPQRRPFKVHQSPVAVHEGMSYQMNHEPWFWFPSPATIWDGPEFLGRVGVQKDELPWKIRASVIYSIRIGQGYKGTVQKWELSRTNCLSGYHGHEE

SEQ ID NO: 180438 - protein, 39 aa, Glycine max
  Coding DNA Sequence Number=SeqID_63660
MGGNIREGEDMECMENTRPVEEESCSNKVNEALEMVERL

SEQ ID NO: 180439 - protein, 946 aa, Glycine max
  Coding DNA Sequence Number=SeqID_63661
  Gene Ontology: Mol. function=ATP-dependent helicase activity; Cellular component=spliceosome; Biological process=mRNA processing
  Homolog annotation: Hit_ID=Q2QTY0; Match level="QueryCoverage=65%, HitCoverage=75%, E-value=0.0, Identity=71%"; Hit description =Superkiller viralicidic activity 2-like 2, putative, expressed
  Pfam annotation: Domain name=DEAD; Domain location=60-211; Score =109.5; E_value=1e-29; Accession=PF00270.19; Description=DEADDEAH box helicase
  Pfam annotation: Domain name=Helicase_C; Domain location=397-481; Score=47.1; E_value=6.1e-11; Accession=PF00271.21; Description =Helicase conserved C-terminal domain
  Pfam annotation: Domain name=ResIII; Domain location=59-207; Score= -39.1; E_value=0.087; Accession=PF04851.6; Description=Type III restriction enzyme, res subunit
  Pfam module annotation: Pfam domain module=DEAD::Helicase_C::ResIII; Domain location=60-211::397-481::59-207
MGSLKRKSPEEPSSSTLQPLHDCVHHVSYPDGYNNVHASSSSPTHTTTSEPAKNFPFPLDPFQSKSISCLENGESVMVSAHTSAGKTVVALYAIAMSLRNGQRVVYTSPIKALSNQKYREFKEEFSDVGLMTGDVTIDPNASCLVMTTEIWRSMQYKGSELTREVAWIVFDEVHYMRDRERGVVWEESIVLSPKNSRFVFLSATVPNAKEFADWVAKVHQQPCHVVYTDYRPTPLQHYLFPSGGDGLYLVVDEKGKFREDSFQKSLNALIPATEGDKKKENGKWQKGLVLGRSGEESDIFKMVKMIIQRQYDPVILFSFSKRECEFLAMQMAKMDLNGDNEKDNIEQIFCSAMDMLSDDDKKLPQARYFLNFGAPLPLFGAHYHCLCRLLSFSVSNMLPLLKRGIGVHHSGLLPILKEVIEILFQEGLIKCLFATETFSIGLNMPAKTVVFTNVRKFDGDKFRWISSGEYIQMSGRAGRRGIDERGICILMVDEKMEPSTAKNMVKGAADSLNSAFHLSYNMILNQMRCEDGDPENLLRNSFFQFQADRAIPDLEKQIKSLEEERESIVIEEESSLKDYFNLLEQHRALNKEIRDIVLSPRHCLPFLQPGRLVSLECTSSDEDLPLIFIEDQLTWGLVINFERVKSVSEDDASIKPEDASYIVDVLTRCVVRKDKIGKKSIKIVPLKEVGEPLVVSVPISQINTISSLRLYIPKDLLPLEARENTLKKVLETLTRFGEKGLPLLDPEEDMKIQSSSYKKASRRIEALESLFEKHEIAKSPLIKQKLKVFQRKQELTAKIKSIKKALRSSSALAFKDELKARKRVLRRLGRQQYGLSCQAVPFFLDVYIYVILNEINFNLVSELSSSAAVVRRRAAAVVAIFFRRQAGFGAPRKAQPNPTSRVTIRSLTRRHAPSPFVALTGAWPPRAVFPAPESGQTSAKRLVGAS

SEQ ID NO: 180440 - protein, 572 aa, Glycine max
  Coding DNA Sequence Number=SeqID_63662
  Gene Ontology: Mol. function=methyltransferase activity; Cellular component=cellulose and pectin-containing cell wall; Biological process=metabolic process
  Homolog annotation: Hit_ID=Q6EP94; Match level="QueryCoverage=91%, HitCoverage=80%, E-value=1e-177, Identity=53%"; Hit description =Dehydration-responsive family protein-like
  Pfam annotation: Domain name=DUF248; Domain location=54-570; Score =1017.2; E_value=5.6e-303; Accession=PF03141.7; Description=Putative methyltransferase
  Pfam annotation: Domain name=Methyltransf_11; Domain location=173 -268; Score=39.6; E_value=1e-08; Accession=PF08241.2; Description =Methyltransferase domain
  Pfam annotation: Domain name=Methyltransf_11; Domain location=432 -528; Score=7.0; E_value=0.011; Accession=PF08241.2; Description =Methyltransferase domain
  Pfam annotation: Domain name=Methyltransf_12; Domain location=173 -266; Score=8.6; E_value=0.073; Accession=PF08242.2; Description =Methyltransferase domain
  Pfam module annotation: Pfam domain module=DUF248::Methyltransf _11::Methyltransf_11::Methyltransf_12; Domain location=54-570::173 -268::432-528::173-266
MKNTPACLKIFSALLLLTSLLYILIAPSSPSIHENLQPQQLHFDFEFCPDNYTNHCPCQDPMRQRRFPKAKMFRKERHCPQSNQRLRCLIPTPTGYQTPFPWPKSKDTAWFSNVPFPKLVEYKKSQNWVRLEGNRFVFPGGGTSFPEGVDAYVNALKRLLPVPLESGDVRTVLDVGCGVASFGASLMDYDILTMSLAPSDEHQSQVQFALERGLPALLGVLSIHRLTFPSRSFDMVHCSRCLVPWTDYDGLYLREIDRILRPGGFWVLSGPPINWRVNYKAWETEPKVLKKEQNILEDLAMRLCWEKVAERDQIAVWQKHRDHISCMQKLKTRRSPKFCNSSESDPDAGWYTKMTACIFPLPDVKDVHEVSGGVLEKWPERLETVPPRVRNENDDGFLLKTYIEDNQTWKRRVSNYGVLLKSLTSGKYRNVMDMNAGFGGFAAAIVKYPVWVMNVVPFDAKSNNLGIIYERGLIGTYMDWCEPFSTYPRTYDLIHASGVFSMYMDKCDITDILLEMHRILRPKGAVIVRDHGNVILKVKEISDRIRWKGIVVAGEQDGAFHPEMIMVINNDD

SEQ ID NO: 180441 - protein, 171 aa, Glycine max
  Coding DNA Sequence Number=SeqID_63663
MVGEDSCNNKEVVEKVTCSSRMVAVIEMVVGMTCSSRKVEVMDFGGEEVAREVTCSSRKKVMMEMVGVVIYNSEGEEKVKVEGDSCSSKVDEMVLLGEEVEVEVEEIYSNMEEMMVMVEESSCSNKKVEQGICNNMMVVVEVVTYNSKEGMGVVRVKGVVENCNNMVCDKE

SEQ ID NO: 180442 - protein, 922 aa, Glycine max
  Coding DNA Sequence Number=SeqID_63664
  Homolog annotation: Hit_ID=Q948G6; Match level="QueryCoverage=86%, HitCoverage=84%, E-value=1e-75, Identity=40%"; Hit description =Putative epsin
  Pfam annotation: Domain name=ENTH; Domain location=23-146; Score =257.7; E_value=2.4e-74; Accession=PF01417.11; Description=ENTH domain
  Pfam annotation: Domain name=Mucin; Domain location=77-428; Score= -8.9; E_value=0.033; Accession=PF01456.8; Description=Mucin-like glycoprotein
  Pfam module annotation: Pfam domain module=ENTH::Mucin; Domain location=23-146::77-428
MKKVIGQTVRDLKREVNKKVLKVPGIEQKVLDATSNEPWGPHGSLLADIAQATRNPHEYQMIMSVIWKRINDTGKNWRHVYKALTVLEYLVAHGSERVIDEIREHAYQISTLSDFQYIDSSGRDQGNNVRKKSQSLVVLVNDKERIIEVRQKAAANRDKFRNSTAGGMYRPGSYSSSGAYGDRYDDDRYGSREEDRNGYGYGKEREWGNRDDDRHSRDGDRYGRDYEDRYGRDGYRDDDYRGRSRSVDYQYDTRSRSSDRDRYDDDGQHSSRGSNAKAEDQSLEARLERKLSEQNMGAPPSYEEAVSESRSPVHSERDVETSAAPAPRDSSPHVNDNPSQTSAPTGSFPVNNNPTEATTAASTAVSGAQETEATDDFFDPRGPASAAPATTSNVEMDLLGSLSDSSSSNALSLVPAASATAAPDANAGSTASFAAPPSGSNNFDQSFEDPFGDSPFKAFTSTETAPSQPQTYQSIEPSQSNGLNAETNSNFGFGDSFSVVPYSAPVSSDAQPFSTNSQFPSQDMSSSQPETDILADILPQAPLSEMHSQQNIPVPTDQFSQQPFSAPNGQPGQVQSSFSSPSSQYAQPPFSSHAGQPSLHAFSSPTGQHLQSPFASQGGQPAQSGGMYGGLHSQGGYPTMSPQSQNGYNGHMNSGNFGSTAAFPSHMAPQAPTGQLSQGTNFPHHGGSTAHTAPHLSSYSPTHQASQFNSQSFIGQQGNAAPYSSPITNQSFASNASQSNSLVSQPSKDKFETKSTVWADTLSRGLVNLNISGPKTNPLADIGVDFEAINRKEKRMEKPTTTAVTSTVTMGKAMGSGSGMGRSGAGSLRPPQNPMMGSGMGNGPGVGMGMGGYGGGMNASMGMGMGGMGGMGMGQGYQMQPPTGLPPGSNMPGNYNNSMMGSGSYGQQPYGSYGQQPYGGYR

SEQ ID NO: 180443 - protein, 261 aa, Glycine max
  Coding DNA Sequence Number=SeqID_63665
  Gene Ontology: Mol. function=protein-tyrosine kinase activity; Cellular component=membrane; Biological process=protein amino acid phosphorylation
  Homolog annotation: Hit_ID=Q1SP36; Match level="QueryCoverage=87%, HitCoverage=16%, E-value=1e-111, Identity=86%"; Hit description =Octicosapeptide/Phox/Bem1p; Protein kinase
  Pfam annotation: Domain name=Pkinase; Domain location=1-234; Score =101.1; E_value=3.2e-27; Accession=PF00069.15; Description=Protein kinase domain
  Pfam annotation: Domain name=Pkinase_Tyr; Domain location=6-234; Score=140.3; E_value=5.2e-39; Accession=PF07714.7; Description =Protein tyrosine kinase
  Pfam module annotation: Pfam domain module=Pkinase::Pkinase_Tyr; Domain location=1-234::6-234
MDPSENSITSEQERRRADFWNEAIKLADLHHPNMVAFYSVVLDGPRGSVATVTEYMVNGSLRNALQKNGRNLDKRKRLLIAMDVAFGMEYLHGKNIVHFDLKSDNLLVNLRDPHRPICKVGDLGLSKVKCQTLISGGVRGTLPWMAPELLNGSSSLVSEKVDVLSFGIVMWELLTGEEPYADLHYGAIIGGIVNNTLRPPVPESCDPEWRLLMERCWSSEPSERPSFSEIANGLRSMATKISPKGQNQQQQPAALQSQVQK

SEQ ID NO: 180444 - protein, 303 aa, Glycine max
  Coding DNA Sequence Number=SeqID_63666
  Homolog annotation: Hit_ID=Q40793; Match level="QueryCoverage=43%, HitCoverage=52%, E-value=4e-50, Identity=71%"; Hit description =Tyrosine-rich hydroxyproline-rich glycoprotein
  Pfam annotation: Domain name=Extensin_2; Domain location=19-303; Score=-106.2; E_value=0.0035; Accession=PF04554.4; Description =Extensin-like region
  Pfam annotation: Domain name=Pollen_Ole_e_I; Domain location=146-269; Score=127.8; E_value=3e-35; Accession=PF01190.8; Description=Pollen proteins Ole e I family
  Pfam module annotation: Pfam domain module=Extensin_2::Pollen_Ole_e _I; Domain location=19-303::146-269
YYKFPPPPLHHLHLLTTTSPHHHLHHHHHHHTTTSLLPHLRSHPAPTPYYYKSPPPPSPSPPPPYYYKSPPPPSPSPPPPYYYKSPPPPSPSPPPPYYYKSPPPPSPYPPHVPYYYKSLPPPSPKPPPYTPYPHPHPYHHPLIVKIVGKVYCYRCYDWKYPQKSHNKKHLKGATVEVTCEVGSKTIKAYGKTKSNGKYSITVEGFDYVKYGATVCKAKLHAPPKDSRCNIPTKLNEGTKLKVKSKDKYEVVLKAKPFAYAPEKSYDCEKPKPKPSPTPYHKPYYYNSPPPPSPSPHPHPPYYY

SEQ ID NO: 180445 - protein, 49 aa, Glycine max
  Coding DNA Sequence Number=SeqID_63667
MFDQVRRNGGSCRKRSRTKIIWSDKHVKFGRRGGLIYPFGNRHQQQCQD

SEQ ID NO: 180446 - protein, 50 aa, Glycine max
  Coding DNA Sequence Number=SeqID_63668
MEHIVQMKGRLKLNVTATNNGVAPESIIQIFSISEALKDRKLELLPTSHG

SEQ ID NO: 180447 - protein, 90 aa, Glycine max
  Coding DNA Sequence Number=SeqID_63669
  Homolog annotation: Hit_ID=Q1SMF0; Match level="QueryCoverage=83%, HitCoverage=14%, E-value=7e-09, Identity=38%"; Hit description =Tetratricopeptide-like helical
MILYFRKVFDTSDDVLHWAHSIAYDIGFVVVIMRSDTNIGNKGRISYVLIGCEKSGKYRAYNKNLVRTVIDSRKCGCPFKLLAKPVLGDG

SEQ ID NO: 180448 - protein, 159 aa, Glycine max
  Coding DNA Sequence Number=SeqID_63670
  Homolog annotation: Hit_ID=Q1SKD7; Match level="QueryCoverage=74%, HitCoverage=34%, E-value=2e-10, Identity=27%"; Hit description =Ankyrin
MAPRKLSSKRSRKDAAAAGTSAAPEFDSHRFRSAEHQQRFEAIKGWSFHRERRVHLRDDEYTDFQEEIARRRWTSLVTPMAKFDPDIVLEFYTNAWPTEEGVRDLRSWVRGQWIPFDADALRFCPDHCRETGADHVHQHDYLDPDMDDVAAQQHPAQRS

SEQ ID NO: 180449 - protein, 175 aa, Glycine max
  Coding DNA Sequence Number=SeqID_63671
MYDSLNDASKNTTKHLTGYIILLQCWIYEHSLQLPPLLPMRIIMRGNHVLVHGSMTLQCLRIISAWIDCHQIFPTRFLMTILSHPVIPSLSIKKNDNRWLQFSEYLTPAIHTTTTPETHAVAAANAVMPRHVVDVCQRISESLEHMISMRMIIVGIEAYTLTKHCLKLARGVTEQ

SEQ ID NO: 180450 - protein, 146 aa, Glycine max
  Coding DNA Sequence Number=SeqID_63672
MTKISYQIMIRTRGLRRTLGKVLGRDIGRQVSGDVEEFPQRRRPTTSGRRQQTTAVVAGDVDHADHNADEVHEEPQELVTDDVGANTKGFSGRPQDTSVLTNYVYHVAVRVWTREEHIGLKFASYGRKVEKFGRLAHEIEGIVAAT

SEQ ID NO: 180451 - protein, 144 aa, Glycine max
  Coding DNA Sequence Number=SeqID_63673
  Homolog annotation: Hit_ID=Q6CQF3; Match level="QueryCoverage=38%, HitCoverage=59%, E-value=2e-08, Identity=72%"; Hit description =Kluyveromyces lactis strain NRRL Y-1140 chromosome D of strain NRRL Y- 1140 of Kluyveromyces lactis
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKFLNRDVAADGNVRESGDVGGAPK

SEQ ID NO: 180452 - protein, 519 aa, Glycine max
  Coding DNA Sequence Number=SeqID_63674
  Homolog annotation: Hit_ID=Q8BSP2; Match level="QueryCoverage=15%, HitCoverage=13%, E-value=4e-13, Identity=53%"; Hit description=13 days embryo forelimb cDNA, RIKEN full-length enriched library, clone:5930412I10 ...
  Homolog annotation: Hit description=product:inferred: RIKEN cDNA 0610010J20
MTKGTSEPGGSGSGGFHAVHAERDLESNWEVNLAKKLEEYLLKICSGEITGEEEGHSPVNFAEAALLLQGSMQVYSRKVEYLYTLVLRALEFLSQKRMNTAQSHTTSQPSSADVLMPWAMHVLQSSQDQTCLGNWEWKEAKLDPTTRRLWGACDSVKDHIDGASVQPEESGPRAVTDEENDQFWGLDDIPVEEKNSLDATTGKVNLDHFIKPPANLVVLEGDCLDAGGDGGELESFLLSTTDLYQDFILLDTSDAIAVHEFLKSSKAATTQNDANRGTSARKSFLSPGHTGGSARRLSAAKSQGANNCSPKLNCGFNDENVRSSSPASAGLDDFNYGFDMDHGCDASRDSDNSDEDNDDPWKPLNPHEPGNLRVKPFRKVNTLKKNSINVRLPVSMNTLFPLAKLRGPISPELMEMWEMRHLVHERQRDSQAPLYEKLRQSLVNEGNETGGTFFNSEADNDDNEYDGGNPDFDMPDNAYMEEDLPSFSNEHEFDDAHVNPDEAVDLSQTSLEDLCRSHL

SEQ ID NO: 180453 - protein, 255 aa, Glycine max
  Coding DNA Sequence Number=SeqID_63675
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=2e-43, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHILAFKGLHALAFRGLRLFAFRGLHALTFGGLHVLTFRGQHALAFRRLHVLAFRGLHVLTFRALHVLTFRGLHTLAFRGLHVLAFRGLHSLAFRGLHALAVRGIHTLTFGGLHILTFRGQHILAFRGIHVLAFRALHVLTFRGLHTLAIRGLHTLTFGGLHVLAFRGLHVLDFRGLHALAFRGLHVLAFRGLHALAFRGLHVLGIKGIYVLTIRGLHLLACRGLHLLACRGLHLLAFRGLDIRAYRELKVPCH

SEQ ID NO: 180454 - protein, 46 aa, Glycine max
  Coding DNA Sequence Number=SeqID_63676
MMHAPNSTLRRNVGIVLSSSGPPGCARNSPPPIGDQPGSPKVFPTR

SEQ ID NO: 180455 - protein, 119 aa, Glycine max
  Coding DNA Sequence Number=SeqID_63677
  Gene Ontology: Mol. function=protein binding
  Homolog annotation: Hit_ID=P0A8D3; Match level="QueryCoverage=99%, HitCoverage=87%, E-value=2e-50, Identity=76%"; Hit description =UPF0178 protein yaiI
  Pfam annotation: Domain name=DUF188; Domain location=1-119; Score =173.2; E_value=6.4e-49; Accession=PF02639.5; Description =Uncharacterized BCR, YaiIYqxD family COG1671
MAIWVDADACPNVIKEILFRAAERTQTPLTLVANQSLRVPPSRYVRALRVAQGFDVADNEIVRLCEPGDLKGGAALNPRGERYSGATIRERLTMRDFMETMRASGVQTGGPDSLSQRDR

SEQ ID NO: 180456 - protein, 54 aa, Glycine max
  Coding DNA Sequence Number=SeqID_63678
  Homolog annotation: Hit_ID=Q9LZ20; Match level="QueryCoverage=63%, HitCoverage=6%, E-value=8e-10, Identity=77%"; Hit description=Amino acid transport-like protein
MTATATNLWRRWHWKARTKGDAEVAEGAASDGHVDDKLGVAEGGEEGAEADNDN

SEQ ID NO: 180457 - protein, 503 aa, Glycine max
  Coding DNA Sequence Number=SeqID_63679
  Gene Ontology: Mol. function=triacylglycerol lipase activity; Biological process=lipid metabolic process
  Homolog annotation: Hit_ID=Q9SIN9; Match level="QueryCoverage=75%, HitCoverage=79%, E-value=1e-142, Identity=68%"; Hit description =Putative triacylglycerol lipase
  Pfam annotation: Domain name=Lipase_3; Domain location=206-368; Score= 193.7; E_value=4.3e-55; Accession=PF01764.16; Description=Lipase (class 3)
  Subcellular localization annotation: CTP_CleavageSite=32; ConfidenceScore=5.63e-01
MASVTHPIPSSRTNNNHITFSQTKSLPFGQVSLPMKKKHDLSPLSHSIAATSSILGITSTSNSSHAHTSTLSKTITTKPTHTSTLSNFWREVQGCNNWENLLEPLHPLLRQEIIRYGEFVTASYKAFDLDPNSKRYLNCKYGKKRMLSEVGMSNSGYNITKYIYATPDININLPNITNSSSSGRWIGYVAVSSDEAVKRLGRRDILVTFRGTVTNQEWISNLMSSLTPAMLDPYNPQPQVKVESGFLSLYTSDESSASKFGLESCREQLLSEVSRLMNRYKGENDNLSISLAGHSMGSALAILLAYDIAELGLNKKSGSTEVPVTVFSFGGPRVGNSEFKHRCEELGVKVLRIANVNDPITKLPGVVFNENFRVLLGGRYEFPWSCSCYAHVGVELMLDFFNVQNPSCVHDLDTYISLLRRPNKRKRDGDGVNSLLEKATELLFNSQTMKTLPGFLTAYNYHDLLNSVSRDILCSWSDELLFGLVFLLLERVVQWKADTICKA

SEQ ID NO: 180458 - protein, 71 aa, Glycine max
  Coding DNA Sequence Number=SeqID_63680
MWVSRERFPADFRREEKEKSYFRQEDDKEKREGKSCWWEECKGGKQGKEFGSGETSLLLCESFNLRIEKGV

SEQ ID NO: 180459 - protein, 122 aa, Glycine max
  Coding DNA Sequence Number=SeqID_63681
  Gene Ontology: Mol. function=3'-5'-exoribonuclease activity; Biological process=RNA processing
  Homolog annotation: Hit_ID=Q6K293; Match level="QueryCoverage=50%, HitCoverage=25%, E-value=1e-15, Identity=65%"; Hit description =Putative exosome component 4
MGNTEVTAAVYGPREVRCEYSLANFSTGDRMRKSKEKLSKELITCIQTCPYVEDSAGGADVTLGILPKLDKVTLLQMDSKLPIDILENVMQLAIEGCKAIAIALITFVIILREVKTWFTFIS

SEQ ID NO: 180460 - protein, 268 aa, Glycine max
  Coding DNA Sequence Number=SeqID_63682
  Gene Ontology: Mol. function=protein-tyrosine kinase activity; Biological process=protein amino acid phosphorylation
  Pfam annotation: Domain name=Hin1; Domain location=71-213; Score =80.8; E_value=4.3e-21; Accession=PF07320.4; Description=Harpin -induced protein 1 (Hin1)
MEEPKPILQKPPGYRDPDSKPPPPPPRKPMLPPSFQPKPKRRSCCRICCCTFCLTILILILVVVIAAALFYLIYDPSLPEFHLDSFRVPKLNVTEAADGAYLDADTSARVEVKNRSGRMTWHFSQSQFTVSAENGDLNLGSTKVAGFTVKEKGVTGLKAETSVKELALNERQRRRIKSAVESKALVPSVEVRTKTGLGLGGWNSPSISVTIVCGDVTMRQLQKGDPPLCSITLLKCRKALRLREEDQQGTSRKPNIKIQQILISFEQW

SEQ ID NO: 180461 - protein, 149 aa, Glycine max
  Coding DNA Sequence Number=SeqID_63683
  Gene Ontology: Mol. function=isomerase activity; Biological process =carbohydrate metabolic process
  Homolog annotation: Hit_ID=Q1T3F9; Match level="QueryCoverage=92%, HitCoverage=70%, E-value=2e-66, Identity=83%"; Hit description =Galactose mutarotase-like
MGHSAAVWDYRAATEITKDWNGIHQIVLRTPRGASAQVCLHGAQVTSWRNEHGEELLFTSSKAIFKAPKAIRGGIPICFPQFGNCGSLELHGFARNRMWAIDDNPPPLPANDSSGKSFIDLVLKSSEEDMKGWPHRYELECHNTAAHGL

SEQ ID NO: 180462 - protein, 438 aa, Glycine max
  Coding DNA Sequence Number=SeqID_63684
  Gene Ontology: Mol. function=protein dimerization activity; Cellular component=nucleus; Biological process=regulation of transcription, DNA-dependent
  Homolog annotation: Hit_ID=Q0GPH1; Match level="QueryCoverage=99%, HitCoverage=100%, E-value=1e-176, Identity=76%"; Hit description =BZIP transcription factor bZIP78
  Pfam annotation: Domain name=MFMR; Domain location=1-201; Score =348.2; E_value=1.4e-101; Accession=PF07777.2; Description=G-box binding protein MFMR
  Pfam annotation: Domain name=bZIP_1; Domain location=293-357; Score =92.4; E_value=1.4e-24; Accession=PF00170.11; Description=bZIP transcription factor
  Pfam annotation: Domain name=bZIP_2; Domain location=293-347; Score =35.2; E_value=2.2e-07; Accession=PF07716.5; Description=Basic region leucine zipper
  Pfam module annotation: Pfam domain module=MFMR::bZIP_1::bZIP_2; Domain location=1-201::293-357::293-347
MGNSEEEKSTKTEKPSSPVTMDQANQTNQTNIHVYPDWAAMQAYYGPRVTMPPYYNSAVASGHAPHPYMWGPPQMTGMSNLLTYYFFQPMMPPYGPPYAAIYPHGGVYTHPAVPIGPLTHSQGVPSSPAAGTPLSIETPPKSSGNTDQGLMKKLKEFDGLAMSIGNGHAESAERGGENRLSQSVDTEGSSDGSDGNTSGANQSRRKRSREGTPTTDGEGKTEIQGSPISKETAASNKMLGVVPASVAGTIVGHVVSSGMTTALELRNPSSVHSKTSAPQPCPVLPAEAWVQNERELKRERRKQSNRESARRSRLRKQAETEELARKVESLNAENATLKSEINRLTESSEKMRVENATLRGKLKNAQLGQTQEITLKIIDSQRATPVSTENLLSRVNNSGSNDRTVEDENGFCENKPNSGAKLHQLLDTSPRADAVAAG

SEQ ID NO: 180463 - protein, 72 aa, Glycine max
  Coding DNA Sequence Number=SeqID_63685
MGYGGGGEEEKGARRRRSPRHHTRVVCAGGRIRRAYVYGIYGVVVVEVAICLFEREQRRTRAGQGIDLRVLC

SEQ ID NO: 180464 - protein, 100 aa, Glycine max
  Coding DNA Sequence Number=SeqID_63686
MYHPTAYVCVYYNGQICNTNEDITFVSNNTKTFMINKLFVVIFDNNNPPSNQHGSTSNLEDLSDGYETCWVKNHDSDTDSSSGPEESNMFPSHETIFKRD

SEQ ID NO: 180465 - protein, 166 aa, Glycine max
  Coding DNA Sequence Number=SeqID_63687
  Gene Ontology: Mol. function=small conjugating protein ligase activity; Cellular component=cytosol; Biological process=protein modification process
  Homolog annotation: Hit_ID=P35132; Match level="QueryCoverage=99%, HitCoverage=100%, E-value=2e-69, Identity=80%"; Hit description=SUMO- conjugating enzyme UBC9
  Pfam annotation: Domain name=UQ_con; Domain location=5-160; Score =264.3; E_value=2.5e-76; Accession=PF00179.16; Description=Ubiquitin -conjugating enzyme
MASKRILKELKDLQKDPPTSCSAGPVAEDMFHWQATIMGPPDSPYAGGVFLVTIHFPPDYPFKPPKFLTVTCRGGATSLKPNLTVAFRTKVFHPNINSNGSICLDILKEQWSPALTISKVLLSICSLLTDPNPDDPLVPEIAHMYKTDRSKYETTARSWTQKYAMG

SEQ ID NO: 180466 - protein, 106 aa, Glycine max
  Coding DNA Sequence Number=SeqID_63688
MRTCFSKEINFQLIRATYAFWMKDNVSIGEGEGNTGSNKDRRKSLKVYQSHTGQGLTFSPWVKVYDKLGFWLKACRTAGHDICQGLASGSGIKGVSYIISMIHMQQ

SEQ ID NO: 180467 - protein, 426 aa, Glycine max
  Coding DNA Sequence Number=SeqID_63689
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8PNZ1; Match level="QueryCoverage=77%, HitCoverage=50%, E-value=1e-51, Identity=39%"; Hit description=Two -component system sensor protein
  Pfam annotation: Domain name=HATPase_c; Domain location=83-190; Score= 112.6; E_value=1.1e-30; Accession=PF02518.16; Description=Histidine kinase-, DNA gyrase B-, and HSP90-like ATPase
  Pfam annotation: Domain name=Response_reg; Domain location=220-325; Score=35.8; E_value=1.5e-07; Accession=PF00072.14; Description =Response regulator receiver domain
  Pfam annotation: Domain name=Response_reg; Domain location=326-420; Score=39.8; E_value=9.5e-09; Accession=PF00072.14; Description =Response regulator receiver domain
  Pfam module annotation: Pfam domain module=HATPase_c::Response _reg::Response_reg; Domain location=83-190::220-325::326-420
NDLPEGRQKDSAALIHNAGQHLLKLINEVLDISRIESGDISMSMEVIVLNHLLEEAYHYLKTLEKVRDITIETHFEPALSVRADRQRLLQVILNLLANALKYGPENTSVAFSAYRQHGHIRVDVKDQGPGIPAALRSRLFTPFDRLGAERTVTEGTGLGLVLSKQLMDAMGGQIGVAEDQSLFWISLPEVVQTIQPPANPSVAAEAPLTRAVATTPAAKRHVLYVEDNHSNQALIEAIMSKHRHLKLHLAASVQESMVWLRDMQPDLLLLDLNLPDGSGESLIQHIQTSRADLQHIPIVILSADALPETIQRLNSLGITHYFTKPLNVAAFNHTTDPTKTMDLVNAFQPDLILLDLMMPVLDGFAVLDQLSHHVGAHEYLPVLVLTADATIATRRKALALGAKDFLTKPFDPMEAMLRVWILLETR

SEQ ID NO: 180468 - protein, 126 aa, Glycine max
  Coding DNA Sequence Number=SeqID_63690
MVAITLTKVHQPLFLREYDSNATCACHGEAPGHSIEHSRGLKRKVQGLIDEGWLKFEENLTMLNEMDKVDIFVPRPLTNASLLIQLSLECGCKPLVCLLKRPVLLSLDFQDRSIRDYSSCTLVGLP

SEQ ID NO: 180469 - protein, 35 aa, Glycine max
  Coding DNA Sequence Number=SeqID_63691
MVRSRDELTAEVTKVLRDEGEWRTGSRPTVVPSRR

SEQ ID NO: 180470 - protein, 83 aa, Glycine max
  Coding DNA Sequence Number=SeqID_63692
MAIFAISRVKLSLEARTSALEELGCEFGLLCCVISLISRYHSGQCGECVAAPFIVVYTIEGGTEQRYHGGGMEFVDATEIAVG

SEQ ID NO: 180471 - protein, 93 aa, Glycine max
  Coding DNA Sequence Number=SeqID_63693
MSKRLQEDWATAIEEGPRVLMNLRGKYLYLGACHSVWNSLVTRAYHHWGWGGVACAQQDDLDTCYPAFLGVSVVWECSGYFMTNGTTLHLRVK

SEQ ID NO: 180472 - protein, 86 aa, Glycine max
  Coding DNA Sequence Number=SeqID_63694
MPLLMHSLHQLSLHQQVMMPETFLERVAWPGDMPSFVGGCRNLPFNGKAMRDSRGRVSRKEYPRSRHQRLFEENVRKTGKDVIYEP

SEQ ID NO: 180473 - protein, 166 aa, Glycine max
  Coding DNA Sequence Number=SeqID_63695
MERPGSSSGTNLSKNTPKDGETWQLKWHESFKEYAQRWRDLAAQVAPPMTGKEMITIIVDTLPVFFYEKRWVFADERIEVGLKRGKFNHPAWMNGKIGENEEGENEGETHAVTAIPMRPSFPPIQQCHYSANNNPSPYLPPSYPQRPFLNQTTKPVYHTSNHGHHL

SEQ ID NO: 180474 - protein, 123 aa, Glycine max
  Coding DNA Sequence Number=SeqID_63696
MHENEWHGACLLFAPIWEPIGQYLGVSNNYSPTIHNSHGCFLEVSSLKIIILWRPNSQKVPSGVANCRNVPFCGRAKARLTDALSKGGKVRGVATNVYLWKTSGKPKETGQNENSKFGSCIYA

SEQ ID NO: 180475 - protein, 63 aa, Glycine max
  Coding DNA Sequence Number=SeqID_63697
MGQLRMSLHVLYLYAFSGFPPGISHLLGRIILSYLLGWGQNVDSRNQSRYLGTDASGDGVTTD

SEQ ID NO: 180476 - protein, 62 aa, Glycine max
  Coding DNA Sequence Number=SeqID_63698
MELWESYTSVVKYKLWESYTSVVLLSETAKHVAPLLASVQYGVVKSYTSVVLLGEGADNVAP

SEQ ID NO: 180477 - protein, 189 aa, Glycine max
  Coding DNA Sequence Number=SeqID_63699
  Gene Ontology: Mol. function=nucleic acid binding; Biological process= DNA integration
MGIYIHEKSEALDMFKIFKAKVENQHNKRIKNVQSDHGGEYYDRYNGSGEQCQGPFAKFLEESGIVPQYTMSGSPSMNVRNITFEEELVPIPIVAFENAKHDGDNGMVEDDPINFHQAMKNTNSQKWIEAMNEKYKSMQDNNRYKTRLVAKGYTQREMIDFKETFSPVSMKDTFRTLMTLVTQFDLEFH

SEQ ID NO: 180478 - protein, 217 aa, Glycine max
  Coding DNA Sequence Number=SeqID_63700
  Gene Ontology: Mol. function=nucleic acid binding; Biological process= DNA integration
MERQHSACLGCMDLDLALRTEQPIYLNDTSSSEEWRHFEKWDRSHHMSLMIIKRGILEAFKGTVSKGITNAKDFLDELEKQFAKSDKVETSTLLQYLISMKYNRKGNIREYIMKMSHIVSKLKVLKLQLSEDLLVHLVLISLPVQYIQFKEERLKHDITKSVNLGSTSMRKGKKRKRFEVGFLNYRKPTDVERYIYVGDGKSVEVEVIGHFRLLLGI

SEQ ID NO: 180479 - protein, 147 aa, Glycine max
  Coding DNA Sequence Number=SeqID_63701
  Gene Ontology: Mol. function=protein dimerization activity
  Homolog annotation: Hit_ID=Q9XIM5; Match level="QueryCoverage=50%, HitCoverage=16%, E-value=1e-11, Identity=44%"; Hit description=Ac -like transposase
MALKILGKFTKYWHKYCEILAIGAILDPLLKFGAIQFAYTKINPSTCEEKITYLRENIEKLFDEYVKEKSSDSKASISQQFSPPSQQVSYMDDEQVIDAFGGSLDVSSIGACRPRIFFINGFLCFLEDEWQRNGEGRERGDVTSRRI

SEQ ID NO: 180480 - protein, 65 aa, Glycine max
  Coding DNA Sequence Number=SeqID_63702
MRVAWMQQKQRCGIWGAQTKKGNRKLKGKSEKGRDKWLTNVYSRVMEWRVIKNRKMLNTDIIIDT

SEQ ID NO: 180481 - protein, 53 aa, Glycine max
  Coding DNA Sequence Number=SeqID_63703
MEYETTNTKKQVVSSDSEATLLSWAPHTPVSPSSIKHERKLGSEAINRTRSVH

SEQ ID NO: 180482 - protein, 399 aa, Glycine max
  Coding DNA Sequence Number=SeqID_63704
MGSDQAPSFKKRFYHVKVKNLELASLQKLGQRMGQVQRQAFSKLAPTIEEFKGILGCPLGGRKDTKEALGGEGGSSGQPRRVGSIDLLALLVIGTVLFPNIDGLVDLAAINAFIAYHHSKENPFIAILADAYDTFNLRCEKSSARIIYCYPMRGAPSEEIIVRGFSETNAKILQRVRKAWNKVERKDKELRGGLSGEEAEIPEKSEEVRALKAELERTRIVIEKLKVAVTRVRKECDELKDINMTTAEALERKTKKAQKEEWSRNKFRWALWGSSNELKLRKAERDKSRMESMVLEDKLKSCQRSKRSLTEQLSKIEENMLIIIYQYKEKVNLAASHGQILEDEQAKEAREGVIELLHKEAMKWMNRFALTLNESQELPRLLARAKAVADTYSAPDELH

SEQ ID NO: 180483 - protein, 185 aa, Glycine max
  Coding DNA Sequence Number=SeqID_63705
  Homolog annotation: Hit_ID=Q9LVU9; Match level="QueryCoverage=81%, HitCoverage=72%, E-value=4e-08, Identity=31%"; Hit description =Genomic DNA, chromosome 5, P1 clone:MNB8
MVSESENNKCSDDHVLTKLSFLISRPTMPPETLMSPPQNTISVPFKWEEAPGKPRHCHTESDPEDSTTAVKKTLELPPRLLFLLDSTNKVSDVDGPSPTTVLDGPYVGRAMSFTTSYRTPRANWNSNFGSSRWSGYKKFTTEDAEGSFDFSPHSCSSMPNVKITRVPRRGSFWVLSKQRSHMWNI

SEQ ID NO: 180484 - protein, 49 aa, Glycine max
  Coding DNA Sequence Number=SeqID_63706
MYNYICILAELAKALTHATAKKSFLDVSEKAKRCPFWLLPLKLKSVFEV

SEQ ID NO: 180485 - protein, 191 aa, Glycine max
  Coding DNA Sequence Number=SeqID_63707
MKKWGLTYHLDAWKDDELLDLLVDKSNSKMSRYLQYLTIHPYSEFSWCWWDDTIALRSSSNNEFSAGVTDTSTQTKLSSLRRNGRIYVYRISIIPTSVPNQLVFTRGKMDRHSTNNLIASIIKNVLYNALLPLTGRGIYEFTGPQIFQAFNGFPLDVKVIIRTQPEIIPNVDLLASPIRHPRPCLTTTHEE

SEQ ID NO: 180486 - protein, 74 aa, Glycine max
  Coding DNA Sequence Number=SeqID_63708
MGGESDPKLPFGYIKLDDEMASCAKINSPPLKALMRAMHQARFEVHNVGEVQGLRYTMWVSFKGQGKKFDGDRQ

SEQ ID NO: 180487 - protein, 80 aa, Glycine max
  Coding DNA Sequence Number=SeqID_63709
MDWETPTQVWDKIQDEFEGSNRVKFVRLLTLKKEFELMKMKDNESVKDDFGILVDVVNQMWLLVNYQASCARGKSFKSLY

SEQ ID NO: 180488 - protein, 69 aa, Glycine max
  Coding DNA Sequence Number=SeqID_63710
MRASGNRLPRGCNRLPGLERGLEHCGGLCLAFGNRLPALVTGNRLPEMKSLKILLLIACSGYETYCAAA

SEQ ID NO: 180489 - protein, 74 aa, Glycine max
  Coding DNA Sequence Number=SeqID_63711
MKRCCPKSPPAEADRAYPGRSLNLVGEDLLLGSDRCSNASRTRCLTTNQADRAFVHHPGKETNASNKNRCYINS

SEQ ID NO: 180490 - protein, 62 aa, Glycine max
  Coding DNA Sequence Number=SeqID_63712
MDELKDLIKKVAPAGIPPYGIHETQMVLLESNYWKKTGPIEILVVFSKPVMEMEDELSLSQN

SEQ ID NO: 180491 - protein, 223 aa, Glycine max
  Coding DNA Sequence Number=SeqID_63713
  Gene Ontology: Mol. function=porin activity; Cellular component=outer membrane; Biological process=cell adhesion
  Homolog annotation: Hit_ID=Q6KCW6; Match level="QueryCoverage=98%, HitCoverage=11%, E-value=3e-36, Identity=35%"; Hit description=YapH homolog
  Pfam annotation: Domain name=Autotransporter; Domain location=1-214; Score=26.7; E_value=8.3e-05; Accession=PF03797.9; Description =Autotransporter beta-domain
MLGNGRADSSVLSELTGYSAKGRVRGTALGVYGTWLQDAEGTGGAYVDAAMQFGRFDNRVQGIGLEPEHYDARVATASLEMGHTFNVWQGAGSSLYVQPQLQLTYADYRADRHVESNGTVIDHADAGGLSGRLGMRVFGHGTAAGNTVQPYLGVNWLRGSGTSTLQFNDDTLGADVPRNRYEVQAGAELKLGQRWGAWGGLSVQRGDHGYRNVGGQVGVRMAW

SEQ ID NO: 180492 - protein, 80 aa, Glycine max
  Coding DNA Sequence Number=SeqID_63714
MNRKHKSEEVSTSEQKSWYATEPNSQPVTRINSLHLVEPNVNKLFLKPKPNEINNYLILGCRRARVKTNLPLIWGRRILG

SEQ ID NO: 180493 - protein, 229 aa, Glycine max
  Coding DNA Sequence Number=SeqID_63715
MGRSALLVHPAEPVTAQPARVAADNVNPLLCYLLQPDAAHSQFTAVPQPAAESVSDDAFLLFAADGFAPSAALLQEVATLSHQRPELNCMLVSLAPRALSSGLQSSLQLFQQLQAQRLWQQNNYAVILRAALMKNAAPLVRIQDVMLAGLLNTQTVWLLDARAEHEVTTVNPPPSYQQFMTEYEKVTRLSHFIPERNRYRQSYLRSGLLQLVQQELNAETQFSNNVRHA

SEQ ID NO: 180494 - protein, 330 aa, Glycine max
  Coding DNA Sequence Number=SeqID_63716
  Gene Ontology: Mol. function=nucleic acid binding
  Homolog annotation: Hit_ID=Q1SPB9; Match level="QueryCoverage=72%, HitCoverage=45%, E-value=1e-40, Identity=41%"; Hit description =Transposase
MTFSTAFAYLEGEYLNNIVWALQWFWGLLMKVDALPKVIVTDKNLSLMRAVKTVFPDVTNLLRQFHIDKNMKAKCKTLVAKQYAWHYVMEAWGSLVDCPCESYFDEYLKNFEKDCSPWPMFVDYVCQTWVISHKEKFVKAWTNKVMHLGNTTTNTVESVHWSLKRFLQNNLGDICSVWEATNNKMTLQHTQIKASFETSTNVVGHVFKVTLYKKLLGMVSRQKPFTLWMSHEDYPRSSMYQGLCEAEVTITEEMETMSVATYPFAGERGEAHGCVFQRRKMRRVATNVICEKRWKNRREPIMKNIPDSGVVFTFEEGISTSHVCPKGQLP

SEQ ID NO: 180495 - protein, 149 aa, Glycine max
  Coding DNA Sequence Number=SeqID_63717
  Gene Ontology: Mol. function=RNA-directed DNA polymerase activity; Biological process=RNA-dependent DNA replication
  Homolog annotation: Hit_ID=Q1S7B8; Match level="QueryCoverage=93%, HitCoverage=22%, E-value=2e-21, Identity=33%"; Hit description=RNA -directed DNA polymerase
PSSKFSPQRGLRQGDPLAPFLFNIVAEALTGLVREACRKNLFRGFKVGSNSVDISILQYADDTIFFGEASMENVKALKAILRIPKKTSTFNLAMLGEWRWNLFHDEGQLWAKILVSKYRGWRGLEENGGDSFESLWWRDLKSIFQTTQQ

SEQ ID NO: 180496 - protein, 327 aa, Glycine max
  Coding DNA Sequence Number=SeqID_63718
  Gene Ontology: Mol. function=transferase activity; Cellular component= mitochondrion; Biological process=metabolic process
  Homolog annotation: Hit_ID=Q8S5U6; Match level="QueryCoverage=99%, HitCoverage=89%, E-value=1e-101, Identity=35%"; Hit description =Putative indole-3-acetate beta-glucosyltransferase
  Pfam annotation: Domain name=PPR; Domain location=11-45; Score=50.9; E_value=4.3e-12; Accession=PF01535.11; Description=PPR repeat
  Pfam annotation: Domain name=PPR; Domain location=116-150; Score =53.8; E_value=5.7e-13; Accession=PF01535.11; Description=PPR repeat
  Pfam annotation: Domain name=PPR; Domain location=151-185; Score =50.6; E_value=5.3e-12; Accession=PF01535.11; Description=PPR repeat
  Pfam annotation: Domain name=PPR; Domain location=186-220; Score =42.2; E_value=1.7e-09; Accession=PF01535.11; Description=PPR repeat
  Pfam annotation: Domain name=PPR; Domain location=221-255; Score =45.2; E_value=2.2e-10; Accession=PF01535.11; Description=PPR repeat
  Pfam annotation: Domain name=PPR; Domain location=256-290; Score =50.0; E_value=7.8e-12; Accession=PF01535.11; Description=PPR repeat
  Pfam annotation: Domain name=PPR; Domain location=291-325; Score =44.2; E_value=4.3e-10; Accession=PF01535.11; Description=PPR repeat
  Pfam annotation: Domain name=PPR; Domain location=46-80; Score=48.6; E_value=2.1e-11; Accession=PF01535.11; Description=PPR repeat
  Pfam annotation: Domain name=PPR; Domain location=81-115; Score=44.6; E_value=3.4e-10; Accession=PF01535.11; Description=PPR repeat
  Pfam module annotation: Pfam domain module=PPR::PPR::PPR::PPR::PPR::PP R::PPR::PPR::PPR; Domain location=11-45::116-150::151-185::186 -220::221-255::256-290::291-325::46-80::81-115
MKGSGLVADTVIYTILIDGYCRNGNVAEALAMRNEMVEKGCFMDVVTYNTLLNGLCRGKMLGDADELFKEMVERGVFPDYYTLTTLIHGYCKDGNMSRALGLFETMTQRSLKPDVVTYNTLMDGFCKIGEMEKAKELWRDMVSRGILPNYVSFSILINGFCSLGLMGEAFRVWDEMIEKGVKPTLVTCNTVIKGHLRAGNVLKANDFFEKMILEGVSPDCITYNTLINGFVKEENFDRAFVLVNNMEEKGLLPDVITYNAILGGYCRQGRMREAEMVLRKMIDCGINPDKSTYTSLINGHVSLDNLKEAFRFHDEMLQRGFVPDDKF

SEQ ID NO: 180497 - protein, 161 aa, Glycine max
  Coding DNA Sequence Number=SeqID_63719
  Homolog annotation: Hit_ID=O64527; Match level="QueryCoverage=24%, HitCoverage=24%, E-value=1e-09, Identity=67%"; Hit description =Uncharacterized protein At1g79260
  Pfam annotation: Domain name=DUF1794; Domain location=16-158; Score= -33.7; E_value=0.00024; Accession=PF08768.1; Description=Domain of unknown function (DUF1794)
MNAKTKSPAPETSSVVIHPALAPIFYLLSTWRAQGEGCFPTIDSFSYGEELHFSHSPNKSFTSHVPRGRSSGGRWKIATNVGEGESMQREEEDEATMSDQEKQTMEKGGRRVDLKSGKRNHFEGEVVSRGGGIDVAKMKCLSSESQSLENKSMAGDGRPWS

SEQ ID NO: 180498 - protein, 66 aa, Glycine max
  Coding DNA Sequence Number=SeqID_63720
MDLIVLINCIRALHYVSQLQTSGAGCDDGIAVFDWSYTWEQGLWPVECGGMLGSNFKVWNLNPMGF

SEQ ID NO: 180499 - protein, 133 aa, Glycine max
  Coding DNA Sequence Number=SeqID_63721
  Gene Ontology: Mol. function=protein farnesyltransferase activity; Cellular component=cytoplasm; Biological process=positive regulation of fibroblast proliferation
  Homolog annotation: Hit_ID=Q04903; Match level="QueryCoverage=85%, HitCoverage=27%, E-value=2e-56, Identity=86%"; Hit description =Protein farnesyltransferase subunit beta
  Pfam annotation: Domain name=Prenyltrans; Domain location=40-84; Score=41.8; E_value=2.4e-09; Accession=PF00432.11; Description =Prenyltransferase and squalene oxidase re
MEETSQIFAVSLCTSESSSSDFKNIAYKFINEWRAQEPLFHSIALQQYILLCAQEQEGGLRDKPGKRRDHYHTCYCLSGLSLCQYSWSKHPDSPPLPNLVLGPYSNLLEPIHPLFNVVLGRYREAHEFFFTES

SEQ ID NO: 180500 - protein, 2021 aa, Glycine max
  Coding DNA Sequence Number=SeqID_63722
  Gene Ontology: Mol. function=zinc ion binding; Cellular component =nucleus; Biological process=regulation of transcription, DNA -dependent
  Homolog annotation: Hit_ID=Q7F8S7; Match level="QueryCoverage=46%, HitCoverage=96%, E-value=1e-148, Identity=35%"; Hit description=PHD finger-like protein
  Pfam annotation: Domain name=C1_3; Domain location=1091-1120; Score =9.5; E_value=0.039; Accession=PF07649.3; Description=C1-like domain
  Pfam annotation: Domain name=FYRC; Domain location=442-503; Score =7.6; E_value=0.0031; Accession=PF05965.4; Description=FY rich C -terminus
  Pfam annotation: Domain name=FYRN; Domain location=212-259; Score =63.5; E_value=6.9e-16; Accession=PF05964.4; Description=FY-rich N -terminus
  Pfam annotation: Domain name=MBD; Domain location=64-163; Score=29.7; E_value=1e-05; Accession=PF01429.10; Description=Methyl-CpG binding domain
  Pfam annotation: Domain name=PHD; Domain location=1092-1140; Score =56.7; E_value=7.8e-14; Accession=PF00628.19; Description=PHD-finger
  Pfam module annotation: Pfam domain module=C1_3::FYRC::FYRN::MBD::PHD; Domain location=1091-1120::442-503::212-259::64-163::1092-1140
  Subcellular localization annotation: CTP_CleavageSite=32; ConfidenceScore=5.17e-01
HALGDNSFAANPFGALVTNSNFNNGNANGFEKASEVVTHAVRVGFEDILNHTQSITRSFEEALRDFVSERRGVLEEGWRVEFRQSVSNSELYAVYCAPDGKIFDSVYEVACYLGLTSGYNSIESELRSERSLPSLGGPPSRKRKSTRTTVANGSMENRGTSTNSNCKDPPCDGLNVECASARGNIPKPSEIGRKEDCHSCSQQSADGLPLQFKDFFVLSLGKVDGRPSYYDVNLIYPVGYKSCWHDKITGSLFTCEVLEGGDSGPIFRIRRCSCSEFPVPVGSTILSMSKLCQVVSQTNEGERKTNANMDLDYDEGLQMMLLDSCLPTENDILSCFPSCSIESRDMSDVLHPITSSVQDNASNSLADNLGFNGLGEILVEERSSFSAWRVISQKLVNACKDILKLKGTLKFYCNHVDKWDLRNGKSDTYCTSLDKFCGSLGSVGIPDVIYSDNDLEGIYVALGKWLEQDRFGLDVEFVQEVLEQLPSVQDSLQYELLNNRNNSSSLPTVENGFLVVEWRDGSKYQEEAVQALYGRSKKVTEKSIKESCHPPLGKPLCSRAPGELIGDIFQAWELLKRFHEILDLKEPLTLDELEKELINPWFDGSNFLEKSERDMDESQVFISLGADGNGRPLLSPRCEVDPSVSIESSHAFIHVETEAMKETAQVKLASFTYARCFGVALTKAHKSLLRVLIGELLSKVAALVDPNSEPGESRTRRGRRKDMDSAVPAKRTKLNMLPINELTWPELARRYMLAFLSMDGNLESAEITARESAKVFRCLRGDGGLLCGSLTGVAGMEADAQLLAEATKTIFGSLSRENDILTMEEEESNAKGAPEIFLANDGNVPEWAQMLEPVRKLPTNVGTRIRKCVYEALEKNPPEWAREILEHSISKEVYKGNASGPTKKAVLSVLVKVGGEGLQSNPNKSQKKKIVISISDIIMKQCRIVLRRAAAADDSKVFCNLLGRKLINSSDNDDEGLLGSPAMVARPLDFRTIDLRLATGAYGGSHEAFLEDVRELWNNVRVAFGDQPDLVELAEKLTQNFESLYNEEVVTYVQRFVEYAKLECLSAEMRKEVGDFIESTNEIPKAPWDEGVCKVCGIDRDDDSVLLCDTCDAEYHTYCLNPPLARIPEGNWYCPSCVVGKHATQNVTERTQVIGKRQSKKFQGEVNSLYLESLAHLSAAIEEKEYWEYSVGERTFLLKFLCDELLNSSLIHQHLEQCAELSAELHQKLRAHSAEWKSLKTREDILSTKAAKIDTFSLNTAGEVGLKEGFASLLSNTGKCLVQPHTAVDNPSNFGVFVDSLPSEEVTKDKYRFDSVDKSISVTNSDSDSQNMNSIDVEGQFRNVSGAVESQCTDKSPKSFPLPNHMPQETNGAGGASLVQGKNQKCEGKDIPTPVSYQQGMPVDVPQISVNESEPYHLELIAIKRDISLLQDSITSVASQLLKLSVRRECLGIDSIGRLYWASALPGGRSRIVVDASAALLHGRGMTFSRDYVEKFSVLQHCALSDKDSSLMSQPSNPLGNSSPWIAYETDVEIEELLGWLDDSDPKERELKDSIMLGPKSRFQQFINAQTEDRAKDQGNVSMPRNREKTVSNSLVTKATSLLEKKFGPFVEWDNSEVLKKQNRKTRTTNDEKLYRCECLEPILPSRKHCTHCHKTVASDIEFDGHNDGKCNAGLLAIEKNKDKNGSSKGRGNLKCDTLHEKFRADAETALTSVSGSSKLSSRLIKFSNEESTCPFNFEDICSKFVTNDSNKELVSEIGLIGSDGIPSFVPSVSPFVSEYTLSAQKDESIVGGVSIVSESRVSQGNTDGAGTCLDHKSGISTGKLAANESNKSNKSSLREQRDGKFSFCSPASVMGADGCCVVPSPSLRPLVGKASHILRQLKINLLDMDAALLAIALRPSKAVPDRRQAWRTFVKSAKTIYEMIQATFTLEDMIKTEYLRNDWWYWSSFSAAAKSSTLPSLALRIYSLDLAIIYEKMPNSSFTDSSEPSVIAEPKPLMNVDTEKSKASRKSTRKRKESDS

SEQ ID NO: 180501 - protein, 115 aa, Glycine max
  Coding DNA Sequence Number=SeqID_63723
MTSKSKFSVAEEEHVVPARSRGIKENPSRLHGTPLMTEEACGPKQPRRSLQRAYARSHHTPPDPTHYQSLYFEALSFGTKEEHRRDHLRRNLRSKIFRRAFVVCVCRQRTLCVSL

SEQ ID NO: 180502 - protein, 344 aa, Glycine max
  Coding DNA Sequence Number=SeqID_63724
  Gene Ontology: Mol. function=sequence-specific DNA binding; Cellular component=nucleus; Biological process=regulation of transcription, DNA-dependent
  Homolog annotation: Hit_ID=Q93XA3; Match level="QueryCoverage=65%, HitCoverage=99%, E-value=1e-91, Identity=77%"; Hit description =Homeodomain leucine zipper protein HDZ3
  Pfam annotation: Domain name=HALZ; Domain location=95-139; Score =69.1; E_value=1.4e-17; Accession=PF02183.8; Description=Homeobox associated leucine zipper
  Pfam annotation: Domain name=Homeobox; Domain location=40-94; Score =78.7; E_value=1.9e-20; Accession=PF00046.19; Description=Homeobox domain
  Pfam module annotation: Pfam domain module=HALZ::Homeobox; Domain location=95-139::40-94
MKAGRSMMSMEEASKRRPFFTSPDELYDEEYYDKQSPEKKKHRLSSEQVHLLEKNFEEENKLEPERKTQLAKKLGLQPRQVAVWFQNRRARWKTKQLERDYDVLKSSYDTLLSSYDSIMKENEKLKSEVVSLNEKLQVQAKEVPEETLCDKKVDPLPVDEDMAPIFSTRVEDHLSSGSVGSAVVDEGSPQVVVDSVDSYFPADNYGGCMGPVERVQSEQEDGSDDGRSYLDVFVASETENQNHEEGEALGWWTNMYYVGCIMWARGGKSESPIWLAWTPSSWSVLKPRYNLTPITEIFGPKDHHQASNEKAYRYHSTYLPNTPYIMDAANTYARANSTRAMHMN

SEQ ID NO: 180503 - protein, 302 aa, Glycine max
  Coding DNA Sequence Number=SeqID_63725
  Gene Ontology: Mol. function=RNA-directed DNA polymerase activity; Biological process=RNA-dependent DNA replication
NSRLAGWKARLLNRASRATLANNPWLHGKPSSNWVNWQTVRQSKKDGALGVRTTREANACGHVGKAYLGFDDLQGTCGGVSFRVGKGDTSIWFDGWSVNGHLCNRVDYVHIQDVCMTLRDIHAEVTWHWNMIATSISMDLNNEICSIFINDALPDTMIWDPSQSGTYYAIHGNLDVGSPITRTHQTLPMGNHKSLPTNAFRLHTHISTDSLCCRSSTWMCRNNTLTWIALIGCGVWQHPNLGVFFSIACWYIWKDQNEEIFDGWVRNSTSVVVLKEFPTNKSSPTIRHVGWLAPLHGFVKII

SEQ ID NO: 180504 - protein, 196 aa, Glycine max
  Coding DNA Sequence Number=SeqID_63726
  Pfam annotation: Domain name=C1_3; Domain location=84-117; Score=9.7; E_value=0.037; Accession=PF07649.3; Description=C1-like domain
  Pfam annotation: Domain name=PHD; Domain location=85-140; Score=35.3; E_value=2.1e-07; Accession=PF00628.19; Description=PHD-finger
  Pfam module annotation: Pfam domain module=C1_3::PHD; Domain location= 84-117::85-140
MELSDSTGGDRNLNAPPPLPPPHNNHNQDARSGLGIDLNEIPSPSSSFPETLPGSVTVDVVRSYHDNPAPPPGGPAALPRSGSSPCAACAKPSPAAGSHHQLVVCDGCERGFHLACAGIRGGGRQAASLDEWVCGECVAAGVKSKRWPLGVKQLLDINAPPPSDAEGDGGDDEVQLNPLRRFFSEDVGNEWYGLLV

SEQ ID NO: 180505 - protein, 350 aa, Glycine max
  Coding DNA Sequence Number=SeqID_63727
  Gene Ontology: Mol. function=structural constituent of cell wall; Cellular component=cellulose and pectin-containing cell wall; Biological process=protein amino acid phosphorylation
  Homolog annotation: Hit_ID=Q9LUI1; Match level="QueryCoverage=87%, HitCoverage=65%, E-value=1e-125, Identity=69%"; Hit description =Extensin protein-like
  Pfam annotation: Domain name=LRRNT_2; Domain location=44-83; Score =13.9; E_value=0.03; Accession=PF08263.3; Description=Leucine rich repeat N-terminal domain
  Pfam annotation: Domain name=LRR_1; Domain location=117-139; Score =8.5; E_value=7.4; Accession=PF00560.23; Description=Leucine Rich Repeat
  Pfam annotation: Domain name=LRR_1; Domain location=141-162; Score =9.3; E_value=5.1; Accession=PF00560.23; Description=Leucine Rich Repeat
  Pfam annotation: Domain name=LRR_1; Domain location=165-187; Score =10.5; E_value=3; Accession=PF00560.23; Description=Leucine Rich Repeat
  Pfam annotation: Domain name=LRR_1; Domain location=188-210; Score =7.2; E_value=13; Accession=PF00560.23; Description=Leucine Rich Repeat
  Pfam annotation: Domain name=LRR_1; Domain location=236-258; Score =7.7; E_value=10; Accession=PF00560.23; Description=Leucine Rich Repeat
  Pfam annotation: Domain name=LRR_1; Domain location=260-282; Score =9.9; E_value=4.1; Accession=PF00560.23; Description=Leucine Rich Repeat
  Pfam annotation: Domain name=LRR_1; Domain location=284-306; Score =12.4; E_value=1.4; Accession=PF00560.23; Description=Leucine Rich Repeat
  Pfam annotation: Domain name=LRR_1; Domain location=93-115; Score =3.5; E_value=65; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=44-83::117 -139::141-162::165-187::188-210::236-258::260-282::284-306::93-115
MASHSPNREGHYLNIVLFLAFLISIINPSQQDPSSPLPPLNPRLTKAYTALQAWKYKITSDPKNFTLNWCGPNVCNYTGIYCAPALDDPHIYTVAGVDLNHATISGSLPEELGLLTDLSLFHINSNRFCGSLPNSFDKLHLLHELDISNNQFSGPFPEVVLCIPNLKYLDIRFNNFHGNVPSRLFDVKLDALFINNNNFQFSLPENLGNSPVSVVVFANNDLKGCLPLSLVKMKGTLNEIIITNSGLTGCLPSEIGDLDKVTVFDVSFNKLVGELPESLGRMKRLEQLNVAHNMLSGEIPESVCMLPRLENFTYSYNYFCSESPVCLKLKEKDDTKNCIPYRPLQKSPDE

SEQ ID NO: 180506 - protein, 85 aa, Glycine max
  Coding DNA Sequence Number=SeqID_63728
MDVPLPMVLALLTDVVDCVLTQLAFDASLHHHPLHVRGSGPHERDHTHPRGRKKEKEKGHEFGTKMKKKKGKELLGRGRERGGEF

SEQ ID NO: 180507 - protein, 58 aa, Glycine max
  Coding DNA Sequence Number=SeqID_63729
  Subcellular localization annotation: CTP_CleavageSite=33; ConfidenceScore=5.35e-01
MVFTSAIGFLLLQTLSSATSDFLFPLSPLIAPLCGRVKFRGCVQRSGMWIGNMQTFSE

SEQ ID NO: 180508 - protein, 75 aa, Glycine max
  Coding DNA Sequence Number=SeqID_63730
MKILLMTHLSFNSEEKAITAITTLLDLKALLEGTSHYQTTQKALQLLQKGFKAGCSLERQRKRTAKDGGKGGKGG

SEQ ID NO: 180509 - protein, 59 aa, Glycine max
  Coding DNA Sequence Number=SeqID_63731
MAQAGGLELLLELFNVFGGFYLDDEIQITESSALTPILPVPVPSPPPSTSIVLYTGSVF

SEQ ID NO: 180510 - protein, 52 aa, Glycine max
  Coding DNA Sequence Number=SeqID_63732
MEQGNKGRMGSSKKGEEKENVRSKEEDDDVARHANTRNYQKKSLELRLRRIT

SEQ ID NO: 180511 - protein, 45 aa, Glycine max
  Coding DNA Sequence Number=SeqID_63733
MGLTLGRGGIRFHSIVYLVKTILLARRFRDLKKKRHHHGVGADAL

SEQ ID NO: 180512 - protein, 181 aa, Glycine max
  Coding DNA Sequence Number=SeqID_63734
  Gene Ontology: Mol. function=metal ion binding; Cellular component =integral to membrane; Biological process=ubiquitin cycle
  Homolog annotation: Hit_ID=Q7X843; Match level="QueryCoverage=53%, HitCoverage=34%, E-value=1e-13, Identity=37%"; Hit description=RING -H2 finger protein ATL3I
  Pfam annotation: Domain name=zf-C3HC4; Domain location=70-111; Score =27.3; E_value=5.6e-05; Accession=PF00097.15; Description=Zinc finger, C3HC4 type (RING finger)
MTVILTVVLLFVGFVFLVLLHVCFSERLFRRGSMVERGANVGRSMSIDDLEMLPCYDYVAKGNTSSPVDCAVCLENLITGDKCRLLPMCKHSFHAQCVDTWLLKTPICPICRCNAHSHSGNQVVGNNDYFVAPNSGSRESQSQQHDNMVLVQLRESLENVPSTNVDIENPTLGSHNLVREH

SEQ ID NO: 180513 - protein, 83 aa, Glycine max
  Coding DNA Sequence Number=SeqID_63735
MASSPPRASTLISAFLRLLRHYRNVASVNDEAVHPRVGGVVFGIGGNGGGGVIQGGRGGGGVREGKGTWESEREIGFWSNVVD

SEQ ID NO: 180514 - protein, 56 aa, Glycine max
  Coding DNA Sequence Number=SeqID_63736
MELTMTPNLGKVMNKHETYLNKAVMKVEPYETSKHSRCAEPVDEKHLFIETHGLSE

SEQ ID NO: 180515 - protein, 84 aa, Glycine max
  Coding DNA Sequence Number=SeqID_63737
RAFVKRDTQWLSARKKPEEDELSGSLSSPLQVIKRTASAHPLSDRSTLSQNPLMRAKRFRSLAFFLEKPLHARESGLGLKLLHV

SEQ ID NO: 180516 - protein, 109 aa, Glycine max
  Coding DNA Sequence Number=SeqID_63738
  Gene Ontology: Mol. function=DNA binding; Biological process=DNA integration
  Homolog annotation: Hit_ID=Q1RVB5; Match level="QueryCoverage=97%, HitCoverage=9%, E-value=7e-14, Identity=35%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MVCTRPDLSYVVSQVYVQPRQATFGSSEVDLKGDPSVVEYVDFDYASDLDDKMSTTWYVFALVGEPICWKSIVQSLLAMPTTEVGYMIVAKARKGVVWLTRLVKKLGIE

SEQ ID NO: 180517 - protein, 70 aa, Glycine max
  Coding DNA Sequence Number=SeqID_63739
MCYNVLQSKSLVRTCSNRKERRVFKKEFPGSKEYLRSTKLRQERGLRAIGQFELVYGRVEVEAARILDLA

SEQ ID NO: 180518 - protein, 165 aa, Glycine max
  Coding DNA Sequence Number=SeqID_63740
  Gene Ontology: Mol. function=peroxidase activity; Cellular component =vacuole; Biological process=response to oxidative stress
  Homolog annotation: Hit_ID=O23961; Match level="QueryCoverage=78%, HitCoverage=44%, E-value=6e-50, Identity=68%"; Hit description =Peroxidase precursor
  Pfam annotation: Domain name=peroxidase; Domain location=1-157; Score= 116.9; E_value=5.8e-32; Accession=PF00141.13; Description=Peroxidase
MRVVEKVSRTDTRMPASFVRLFFHDCFVQAHGPFLKFPLGRRDSLTANRTLANENLPAPFFNLTQLKAAFAVQGLDTTDLVALSAHCLFILDRLYNFSGTGRPDPTLDTTYNNCAKYAPKNYYSNVKVKKGLLQSDQELFSTPGADTIPIVNKFSGDQIAFLKLQ

SEQ ID NO: 180519 - protein, 284 aa, Glycine max
  Coding DNA Sequence Number=SeqID_63741
  Gene Ontology: Mol. function=hydrolase activity; Biological process =proteolysis
  Homolog annotation: Hit_ID=Q3BR89; Match level="QueryCoverage=88%, HitCoverage=42%, E-value=2e-25, Identity=35%"; Hit description =Extracellular serine protease precursor
  Pfam annotation: Domain name=Peptidase_S8; Domain location=73-283; Score=-54.6; E_value=0.00074; Accession=PF00082.12; Description =Subtilase family
MGQFRPAVLPCRFTTEGFVYEATHATLRATALCAPGPCHCPGAGQPGRHRPGPTGRSTGGDTVAPAQHRAGRTGRYPAGGRQRSQRGRPGVTIAIVDDGLQIAHPDLAANVAAVAGKNFANQSNNPSPSNPDRDNHGTMVGGIAGAVGANNLGVRGVASAATLKGFNFLASNAQGNSNSNIEYSWWDGAEVADVGVFNNSWGSSPGNPNLPLAYSQNDITAYEQAMSGTRGGRGGIYVKAAGNNHNNGARSDGTDICSADTKNRNTGCIPAGRDPRNNLFNVIT

SEQ ID NO: 180520 - protein, 276 aa, Glycine max
  Coding DNA Sequence Number=SeqID_63742
  Gene Ontology: Mol. function=receptor activity; Cellular component =outer membrane; Biological process=transport
  Homolog annotation: Hit_ID=Q5FQ11; Match level="QueryCoverage=89%, HitCoverage=61%, E-value=2e-28, Identity=31%"; Hit description=TonB -dependent outer membrane receptor
MVDRGNAVAGDLAGIVRNQFGQLTAGVGAAGLVRILRRGHVPGPRIIGIEDVGLPAQLADHVEGDVVVAPDLGLAVGQEHGEVTPGDVLLQLQVAAQEILRALALVLFGRYTLQVDQHFRAMLTELAALPGYGGDQRVVAAHALLHANAGRVLQVAQPVFQAAAVDAAGEYADRCATGADRDRADAIGNAHVHHAGAGKREEAVVVQRHAFEGDAHFVHAEAAHEQAGGGDIQAQPVGGGVAGARYLLQHGQAVVAGDHRVEVFGLDDVAVGADHL

SEQ ID NO: 180521 - protein, 300 aa, Glycine max
  Coding DNA Sequence Number=SeqID_63743
  Gene Ontology: Mol. function=potassium ion transporter activity; Cellular component=integral to membrane; Biological process =potassium ion transport
  Homolog annotation: Hit_ID=Q9M7J9; Match level="QueryCoverage=100%, HitCoverage=38%, E-value=1e-133, Identity=77%"; Hit description =Potassium transporter 8
  Pfam annotation: Domain name=K_trans; Domain location=22-300; Score =27.7; E_value=5.4e-22; Accession=PF02705.7; Description=K+ potassium transporter
MDLESVIHRNTIKEESWKTVLTLAYQSLGVVYGDLSTSPLYVYKSAFAEDIQHSDTNEEIYGVLSFVFWTLTLIPLLKYVFIVLRADDNGEGGTFALYSLLCRHARVSLLPNTQLADEHLTEYTMDNGTVPVNRKNVGLGLKNLLEKHRVLQRVLLVLALIGTCMVIGDGVLTPAISVFSAVSGLELSMSKEQHRYVEVPVACVILIFLFALQHYGTHRVGSLFAPVVLTWLLCISAIGVYNIFHWNPHVYEALSPYYMFKFLKKTQKGGWMSLGGILLCITGSEAMYADLGHFSQLSIK

SEQ ID NO: 180522 - protein, 67 aa, Glycine max
  Coding DNA Sequence Number=SeqID_63744
  Subcellular localization annotation: CTP_CleavageSite=58; ConfidenceScore=5.76e-01
MKNSINNFNNSIPSCNTNSTNRSSSNISTKFTRAILPPLKVIMSRTARQMRLCLVQFKSMMEDEKPW

SEQ ID NO: 180523 - protein, 78 aa, Glycine max
  Coding DNA Sequence Number=SeqID_63745
MVCTHNGGHFLQHGCNSGWLLKDNLLIQLVIKVTSPYENNLHHKENTTHAKDWDSVARKEKIEVNFQEIRIILNLPIL

SEQ ID NO: 180524 - protein, 61 aa, Glycine max
  Coding DNA Sequence Number=SeqID_63746
  Homolog annotation: Hit_ID=Q1SPQ1; Match level="QueryCoverage=82%, HitCoverage=9%, E-value=2e-07, Identity=52%"; Hit description =Polynucleotidyl transferase, Ribonuclease H fold
MEVRSSELEELVLEGFKEQTVVVGYNGIRQPVEMENLNIEMTSQVTSSKKSRFDRPATSVE

SEQ ID NO: 180525 - protein, 316 aa, Glycine max
  Coding DNA Sequence Number=SeqID_63747
  Homolog annotation: Hit_ID=Q84UR3; Match level="QueryCoverage=81%, HitCoverage=32%, E-value=2e-78, Identity=58%"; Hit description =Proline-rich protein family-like
  Subcellular localization annotation: CTP_CleavageSite=33; ConfidenceScore=5.40e-01
PPPPPPPPKKLVSKAAAPPPPPPPPPKAGREVPAKVRRVPEVVEFYHSLMRRDSHSRRDSASAAEVLATANARDMIGEIENRSTHLLAIKTDVETQGDFIRYLIKEVESAAFTDIEDVVPFVKWLDDELSYLVDERAVLKHFDWPEQKADALREAAFGYCDLKKLVSEASSFRDDPRQLCGPALKKMQTLLEKLEHGIYNISRMRESATKRYKVFQIPVDWMLDSGYVSQIKLASVKLAMKYMKRVSAELETGGGGPEEEELIVQGVRFAFRVHQFAGGFDVETMRAFQELRDKARSCHVQCHSQQQKLFCRSATC

SEQ ID NO: 180526 - protein, 198 aa, Glycine max
  Coding DNA Sequence Number=SeqID_63748
  Homolog annotation: Hit_ID=Q5VPC4; Match level="QueryCoverage=56%, HitCoverage=19%, E-value=8e-10, Identity=37%"; Hit description =Pherophorin-like protein
  Subcellular localization annotation: CTP_CleavageSite=58; ConfidenceScore=5.82e-01
MVAGKVRVAMGFQKSPAAPHTTPPPQKKQPPPASPSTTAKSSSHKSSFSRSFGAYFPRSSAQVQPRPPDVAELLRLVEDLRESESRLKTELLEHKLLKESIAIVPVLENEITARESEIERSRRRAEEAESENERLRKELQELKVKAEEEKNENERKIKALEEEIIEFKKTASFIGSNSSSNRTEALESHEQEEATQKL

SEQ ID NO: 180527 - protein, 206 aa, Glycine max
  Coding DNA Sequence Number=SeqID_63749
  Gene Ontology: Mol. function=ribonuclease H activity; Biological process=RNA-dependent DNA replication
  Homolog annotation: Hit_ID=Q1S700; Match level="QueryCoverage=64%, HitCoverage=41%, E-value=4e-18, Identity=36%"; Hit description =Ribonuclease H
MVTVDMVIPVHPSEEITPAMVIYLSKMFLSLASRTSVDHDKLWAMKHGYPNPLSCPVSDTETTSALINNKAISFHSAISLIVGKIRITSNVSSSCMNSSIQEFVISKLLGIFDHPRIADCISPVTWNPPLQGWVKCNNDGSAKGSPGLAGCGAIFRDHSANSLGCFSQNLGVNNSFFGKIMGAILAIEIAFNKGWLNLGWNVIQLW

SEQ ID NO: 180528 - protein, 99 aa, Glycine max
  Coding DNA Sequence Number=SeqID_63750
MVSDGVVDNPHSKVEEIQEFDGHRDSDTGRAKKDKKKRKKEEGEGCNQEEVYIISSVDDDCSKGMKKWIMEYHQSRPGLDVLQNQIDDFITAHEAKLEE

SEQ ID NO: 180529 - protein, 282 aa, Glycine max
  Coding DNA Sequence Number=SeqID_63751
  Gene Ontology: Mol. function=hydrolase activity, acting on ester bonds; Biological process=lipid metabolic process
  Homolog annotation: Hit_ID=Q5VMA7; Match level="QueryCoverage=99%, HitCoverage=99%, E-value=5e-67, Identity=47%"; Hit description =Putative CPRD49
  Pfam annotation: Domain name=Lipase_GDSL; Domain location=5-248; Score=122.2; E_value=1.5e-33; Accession=PF00657.12; Description=GDSL- like LipaseAcylhydrolase
MRPKIFLFGDSITQDSFAEGGWGASLANHFSRTVDVVLRGYSGYNTRWVLKVLEKVFAATQHGDGGINGAPVAITIFFGANDACLPDRYGAFQHVPLLEYKQNLHSIVSFFVMIEGTLENGEKGQTDNRNVICCKVCKQERILEEKRPSFTLEKQWPTTHILLITTPPIDEEARLRYPYAYNPQGLPERTNEAAGEYATACIAVAEECGVPVIDLWTKMQQCPDWRKEYLCDGLHLTQSGNRVVFEEVILKLREKGLSLEAMPVDLPLLADIDPNDPLKSFQ

SEQ ID NO: 180530 - protein, 124 aa, Glycine max
  Coding DNA Sequence Number=SeqID_63752
  Gene Ontology: Mol. function=electron carrier activity; Cellular component=anchored to membrane; Biological process=electron transport
  Homolog annotation: Hit_ID=Q9ZRV5; Match level="QueryCoverage=97%, HitCoverage=99%, E-value=4e-33, Identity=54%"; Hit description=Basic blue copper protein
  Pfam annotation: Domain name=Cu_bind_like; Domain location=37-116; Score=101.5; E_value=2.6e-27; Accession=PF02298.8; Description =Plastocyanin-like domain
MAQGRSSAATMLLLCMLVLYSEMVHAATYVVGDATGWAYNVNNWPNGKSFKAGDILEFKYSPFAHNVIQVDEFGYNTCIPTFNSRLFFSGDDHIQLAKGLNYFICGFPGHCQLHGMRIAVNATA

SEQ ID NO: 180531 - protein, 80 aa, Glycine max
  Coding DNA Sequence Number=SeqID_63753
  Gene Ontology: Mol. function=farnesyl-diphosphate farnesyltransferase activity; Cellular component=cytoplasm; Biological process=positive regulation of fibroblast proliferation
  Homolog annotation: Hit_ID=O24448; Match level="QueryCoverage=80%, HitCoverage=14%, E-value=5e-23, Identity=72%"; Hit description =Farnesyltransferase beta subunit
  Subcellular localization annotation: CTP_CleavageSite=22; ConfidenceScore=5.49e-01
MSPKAFAISVPHFPFWTLIDPGSATGSSTPLLCRENPSMMNSKITLSIFLTVARIRMVDMPGDQARQATIIIFCQFLFDY

SEQ ID NO: 180532 - protein, 85 aa, Glycine max
  Coding DNA Sequence Number=SeqID_63754
ANGGAEGHDALSMQGPSLFGFWDRLTAVLKANGGAEGDGVLPCKGLLCSVFFFRFGFYVALDGKKDGEAASEEVTNSYHVLRQIE

SEQ ID NO: 180533 - protein, 174 aa, Glycine max
  Coding DNA Sequence Number=SeqID_63755
  Gene Ontology: Mol. function=nucleic acid binding; Biological process= DNA integration
  Homolog annotation: Hit_ID=Q1SEE1; Match level="QueryCoverage=98%, HitCoverage=32%, E-value=2e-19, Identity=59%"; Hit description =Integrase, catalytic region; Zinc finger, CCHC-type; Peptidase aspartic, catalytic
MVENETMLKMKKLRTNNGGEYEDTKFKSLHVQSSLRKQFWAEAMNTTTYLINRGPLVPLEHRILEEVDDVPETLVIVSHQPEESMEDNRKPKNYEEAYQTINAGKWEHAIKDEMKIVASEELYLEQLDVKIVFLHGDLDEDIYMHRPEGFLDEGKKYMVCKLKKNLYGQKQAQG

SEQ ID NO: 180534 - protein, 307 aa, Glycine max
  Coding DNA Sequence Number=SeqID_63756
  Subcellular localization annotation: CTP_CleavageSite=3; ConfidenceScore=5.01e-01
MVLAGTPQPYCSPWVINGNSRVVNGSLQVIGGSSRTEGRYYPSLCKLSGDPNGSEMQLSGRECGVEKLECCVHGFKESIWEEDFPTKFSHRFVVSLCYTSLMGLIELSFAQPLIFADVVVIIEIDVLSSRLFVACVSFTVCLGRLETIMLTYTCGNDFQDYIDDAKESRVKQVPKNLESKSFKNQVSKNQDSRTIKFQDSRFKIQEQSSFKNQDSRTIKIKIQESREGSIKIRYILCGTSRGYIYLGCYTKNKRGYMSCGSIQVEGTSTWFFKENKGGYIPCGSLACKGFYKVDRNLKNRWLLGDWM

SEQ ID NO: 180535 - protein, 68 aa, Glycine max
  Coding DNA Sequence Number=SeqID_63757
MDRPKRLSPKEKMGGVATNVYLRKTLEKLKRRRSVDFENEGSGVVYARGRVLPWLLRSLRCDEELRPM

SEQ ID NO: 180536 - protein, 245 aa, Glycine max
  Coding DNA Sequence Number=SeqID_63758
MSEIEEVQEQMKADMEAMKDQMAAMMEAMLSMKKIMESNVVVVATTSAATEVDPTHPSGLNQVNPPFWNMSKNSFPLYGLPPNYAPPNAVQVPDENANHSTHPYLGHAIEGLAFGGVPQSNTSRGPQYHPQPQPLPFAMGKVPFAMVEREKFNHIEERLKAIEGIGDYPFPDMAELCLVLDVVVPPKFKVPDFDKDLVAQVAPPMVEREMITMIVDMLPVFYYEKMVGYTPSSFADLVFVGERIE

SEQ ID NO: 180537 - protein, 132 aa, Glycine max
  Coding DNA Sequence Number=SeqID_63759
  Homolog annotation: Hit_ID=Q1S9T9; Match level="QueryCoverage=37%, HitCoverage=4%, E-value=3e-08, Identity=53%"; Hit description =Peptidase S8 and S53, subtilisin, kexin, sedolisin; Integrase, catalytic region; Zinc finger, CCHC-type
METHLVLASYSYSDYVVDLDVWRFVTGCAFTIGNFLKGKDQVYHEKTKGIEIRYHFIRTKKRVEVHKVDARENPTDMFMKPIPRSNFMHYGPLELLFISTIECDVGVQEEEEVEESIVLEKEMKAQAKLSTQ

SEQ ID NO: 180538 - protein, 45 aa, Glycine max
  Coding DNA Sequence Number=SeqID_63760
MLRQSHMSEKDLAKAKDVTKQVKFKSSTIKNIIDQKQFEAPDEID

SEQ ID NO: 180539 - protein, 263 aa, Glycine max
  Coding DNA Sequence Number=SeqID_63761
  Gene Ontology: Mol. function=transferase activity, transferring glycosyl groups; Cellular component=endoplasmic reticulum membrane; Biological process=protein amino acid C-linked glycosylation via 2' -alpha-mannosyl-L-tryptophan
  Homolog annotation: Hit_ID=Q10BB4; Match level="QueryCoverage=87%, HitCoverage=95%, E-value=1e-116, Identity=87%"; Hit description =Dolichol-phosphate mannosyltransferase, putative, expressed
  Pfam annotation: Domain name=Glycos_transf_2; Domain location=13-182; Score=139.5; E_value=9.3e-39; Accession=PF00535.16; Description =Glycosyl transferase
MDGHHQKQKNKYSIIVPTYNERLNIGLIVYLIFKHLGDADFEIIIVDDGSPDGTQDVVKQLQQVYGEDRILLRARPRKLGLGTAYIHGMKHASGNFVVIMDADLSHHPKYLPSFIRKQSETGADIVTGTRYVKGGGVHGWNLMRKLTSRGANVLAQTLLWPGVSDLTGSFRLYRKSVLEDIISCCVSKGYVFQMEMIVRASRKGYHIEEVPITFVDRVFGSSKLGGSEIVEYLKGLAYLLAEVFSVSPLLGAKTPTVKFCSNY

SEQ ID NO: 180540 - protein, 457 aa, Glycine max
  Coding DNA Sequence Number=SeqID_63762
  Gene Ontology: Mol. function=nucleoside-triphosphatase activity; Cellular component=chloroplast; Biological process=chlorophyll biosynthetic process
  Homolog annotation: Hit_ID=P93162; Match level="QueryCoverage=99%, HitCoverage=99%, E-value=1e-176, Identity=74%"; Hit description =Magnesium-chelatase subunit chlI, chloroplast precursor
  Pfam annotation: Domain name=AAA; Domain location=147-409; Score= -32.4; E_value=0.06; Accession=PF00004.19; Description=ATPase family associated with various cellular activities (AAA)
  Pfam annotation: Domain name=AAA_5; Domain location=196-324; Score= -21.5; E_value=0.078; Accession=PF07728.4; Description=ATPase family associated with various
  Pfam annotation: Domain name=MCM; Domain location=200-435; Score= -236.3; E_value=0.019; Accession=PF00493.13; Description=MCM235 family
  Pfam annotation: Domain name=Mg_chelatase; Domain location=123-330; Score=-124.7; E_value=0.00021; Accession=PF01078.11; Description =Magnesium chelatase, subunit ChlI
  Pfam module annotation: Pfam domain module=AAA::AAA_5::MCM::Mg _chelatase; Domain location=147-409::196-324::200-435::123-330
  Subcellular localization annotation: CTP_CleavageSite=58; ConfidenceScore=5.77e-01
MASTFGASSITFLSSRYYSSQSLATDSPSLTTVQIFGRKFCGGGNGFHSVKGRSLFPVASVLATQLNSAQQCWIFTTFGKGLNTSHTHIGEVSKRIGIGYEYLKQIKAQKIAFTESQRPVYPFSAIVGQDEMKLCLLLNVIDPKIGGVMIMGDRGTGKSTTVRSLVDLLPEIKVVAGDPYNSDPEDPEFMGVEVRERVIKGEQLQVVSSKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDKNPKVFRDSYKAEQQNLQQQIASARSFLSSVQIDRNLKVKISKVCAELNVDGLRGDIVTNRAAKALAALKGRDKVSAEDIATVIPNCLRHRLRKDPLESIDSGLLVLEKFYEVFR

SEQ ID NO: 180541 - protein, 784 aa, Glycine max
  Coding DNA Sequence Number=SeqID_63763
  Homolog annotation: Hit_ID=Q8VQ99; Match level="QueryCoverage=68%, HitCoverage=22%, E-value=4e-08, Identity=20%"; Hit description =Serine-threonine rich antigen
MNFNLDGEFNKISSFKLDMSDLDFTCPAKKNSQSKDKKGEVSGSQEGKQDGFNFSFDFNDYWHRLGSFNFDSSFMKVVTTSNSSPRKKGVTTEGSDKEGGEMLKTNDDEGARASNDSTTVKSHASVRLETSKVETVVGSPGNLVSKQDGSVSKISSSGNLDMPMENQTLDINKHKSTEEIDQERDLPEKSNLTGSKSEQVINMASSQSVGESDSEQHTISDQHTNAFSSGTRVSNVSGDKQVVNDKTTYQFKKCDIQEVNDKATNVKSDSVDLQLEHSSPHHVTKSDSSVGEAITLGSSTQEGVTSDPQPEKSKPVVEKMMLMKDKKLQDLQSNMFSTPEGKRSLKQPSSTIGTKGSSLGNEKNIDILLGSITQARCVMLVITVIVIGLSMVECSFISLNRENFRSNDTKHGRKLVGDSLTDSSKLMRNAGVLLGSKDDLKSCSNTREGIVSDVSPCSGKLAGNKQSFFDEVNKSKTTFLEIGISTEDVSMLRSFGANRVLTTALHQKETNSLVSSGQSMDKWGITTSKNDHSIDSSDNQKSSTPFLKRKTIEKFFEHLKDSIPQASDADFTLLRPLKCISQSSPNSVVSFIGTSGKVTILNCRSSKESSEEVVGEETWGYLSVIIVNTRFFLSLHITQISFHESQVESMPNNLLYNHSTSGLKSSPVIKVTEVEIHDPLLMEDNNNVEKAEAYIKELEDICNMLKKKQDEAKELLVQAIVNDNNLLILDHPIHEEEISSHYFFYSFPSNHLRVDINAGYFLDICEHLKGTEVCFPVDAQGDSN

SEQ ID NO: 180542 - protein, 190 aa, Glycine max
  Coding DNA Sequence Number=SeqID_63764
  Homolog annotation: Hit_ID=Q0WNP8; Match level="QueryCoverage=71%, HitCoverage=49%, E-value=2e-39, Identity=63%"; Hit description =Putative SF16 protein
  Pfam annotation: Domain name=IQ; Domain location=55-75; Score=24.7; E_ value=0.00034; Accession=PF00612.17; Description=IQ calmodulin -binding motif
MGSGDWFKTIISSRKSKEGRSKKLKTKIYTRKKSNGLANGMKSENLESDGVSVETIAATRIQTAFRAYKARKYLHRLRGFTKLKIQTQGSSAKKQAVTTITYLHSWSKIQAEIRARRICMVTEDRIRRKIIHSQLKLEAKIHDLEVTCKANRWNGVVVLKPRRKSFQGYIKEKKQQSRGKEPWHMPSLIR

SEQ ID NO: 180543 - protein, 77 aa, Glycine max
  Coding DNA Sequence Number=SeqID_63765
  Gene Ontology: Cellular component=protein complex
  Homolog annotation: Hit_ID=Q9ZQ79; Match level="QueryCoverage=54%, HitCoverage=17%, E-value=1e-14, Identity=93%"; Hit description =Putative ankyrin
HVLKESEPLSLRPTNVGGSISNLFLQLYRVCGINVALLLIRHGADVDVEDKEGYTVLGRATHEFRPILIDAAKAMLE

SEQ ID NO: 180544 - protein, 341 aa, Glycine max
  Coding DNA Sequence Number=SeqID_63766
  Gene Ontology: Mol. function=ionotropic glutamate receptor activity; Cellular component=integral to membrane; Biological process=ion transport
  Homolog annotation: Hit_ID=Q8LGN0; Match level="QueryCoverage=90%, HitCoverage=32%, E-value=2e-47, Identity=35%"; Hit description =Glutamate receptor 2.7 precursor
  Pfam annotation: Domain name=Lig_chan; Domain location=55-317; Score =176.7; E_value=6e-50; Accession=PF00060.17; Description=Ligand-gated ion channel
  Pfam annotation: Domain name=SBP_bac_3; Domain location=79-275; Score= -69.0; E_value=0.0017; Accession=PF00497.10; Description=Bacterial extracellular solute-binding proteins, family 3
  Pfam module annotation: Pfam domain module=Lig_chan::SBP_bac_3; Domain location=55-317::79-275
MMEWKSYAAAIGDVTITEDRLKYVDFTASYAESGLSMIVTEEFKAPTWMFTKPFTWQMWLATGAVLIYTMVVVWYLEREPNPEFHGNLQSQISTALTFTFSSLFFAHREKIYSHLSRMVMVSWMFLVLILSSSYTASLSSILTVQRLQPTVTDIQILKNNNKKIGCDGDSFVRTYLETVEEFKPENIINIGSENSYDDAFKNNSIAAAFLELPYEKVYISKYCKGYYAFAINKKFGGLGFIFQKGSPVARDFSKAILRLLEDGTVKELEDKWLKPDGDCHNNSTSQGTESLRLESFWVLYVIYGAASTICFLLHTILSLKSRQTTRDEAREGNANPGEESR

SEQ ID NO: 180545 - protein, 295 aa, Glycine max
  Coding DNA Sequence Number=SeqID_63767
  Homolog annotation: Hit_ID=O22957; Match level="QueryCoverage=90%, HitCoverage=42%, E-value=1e-62, Identity=51%"; Hit description =Expressed protein
  Pfam annotation: Domain name=API5; Domain location=1-294; Score= -62.6; E_value=2.9e-08; Accession=PF05918.2; Description=Apoptosis inhibitory protein 5 (API5)
LPGERKVDLLRSLAEFSPYTTPQDSRQMLPSIVQLLKKYMTWKKTGEEMNFTYVECLLYTFHHLAHKVVTLPCLKQICDSSCIRCIIELGDPSDRLGEDFSEHYNDFTESKIWFGLEMLTPVHDCPFVIVVWIFLLILLNNVEEFTRATIKKLTQGMDENNKSMAGAKTDEEKEKIKTKKQNATTGLRTCNNILTMTKPLHAKVPSFIGDKRINLSWKEATKAASTAPAAGAKRPANAANGSNNIVSKKGRGAGGLQNQLVNRALEGLSGGGRGGMRGRGRGWGGRGRGRGGYHR

SEQ ID NO: 180546 - protein, 556 aa, Glycine max
  Coding DNA Sequence Number=SeqID_63768
  Gene Ontology: Mol. function=ionotropic glutamate receptor activity; Cellular component=membrane; Biological process=ion transport
  Homolog annotation: Hit_ID=Q5VMN1; Match level="QueryCoverage=85%, HitCoverage=55%, E-value=8e-71, Identity=33%"; Hit description =Putative Avr9/Cf-9 rapidly elicited protein
  Pfam annotation: Domain name=ANF_receptor; Domain location=52-387; Score=121.3; E_value=2.7e-33; Accession=PF01094.18; Description =Receptor family ligand binding region
MNLPSTIPLALPTYLFISFVLVNCYHAEATNGDDMVISIGAIIDVNSRVGKEQLVAMDLAAQSHNNTSKSHKMALHFQEPTKDPFGPTSLARNMIKTQKAQVIIGMHTWTEAASVAELGRETLVPVISFAAPTITPPLMPTRWPFSVRMANNGTAYAKCVADVVHAYGWQRVVVIYEDGDYEMLALLSETLQEVGSMIEYRLALPSPSYLPNPGEFIREELYNLIKNIQSRVFIVLQSSLEMVIHLFREASHMGLVERESAWIIPESITNLLDTVNKSAISYMEGALGIKTYYSNHSNEYQDFEAQFRKSFRAKYPEEDNCDPGFYALQAYDSIKIVAQAIDRTASGRKTLLTEILSSNFPGLSGEIRFEAAQLLQNPTFRMVNVDKKSYRELDFWTLKRGFITSLTTEQGSDSVSRNTESLRGVIWPGKLVRFPKGWNLPTKQNPMQIAVPGRTSFPAFVKVDPDEHHNSYKFNGFCIELFNKVIGILKYDLPHEFHPINGTYNDLVQLVYNKPYPCICEEAVSRFEPMTNKSPRHNFTAAPGLALKFPYNQQNK

SEQ ID NO: 180547 - protein, 498 aa, Glycine max
  Coding DNA Sequence Number=SeqID_63769
  Gene Ontology: Mol. function=ATP-dependent helicase activity
  Homolog annotation: Hit_ID=Q0ZFU8; Match level="QueryCoverage=99%, HitCoverage=100%, E-value=0.0, Identity=84%"; Hit description=SNI1
MENPSSGERWSRAGIDDNMLAMFDASETKDVHQDALDDRIAFIDAVRASCEHGKPPTSKIFGAVFHMLRTGKSLELIVGSYKLLVDLDKHFPRVYLSGMDDSRSSSNSPSKLVVVKEAWAPIIGFVDKATAVSEAGDKQSGGSLDHSSFQALIEELAEILSETKFEAASMEPLRNMLIFQYLVVVFEDDFLPRNATLNWSMQRESLLSLLLGSRKINYKSLMKYFMAILCQLSQLQSELSKHPVLQESSESKLSKNCHTALSLALHGVLKDTCVSMEKLLVMIMDLDMARKIADIEGHTTRGDSPRTPLMDIILDELSYNKDSVPVFLKVAPKYHLSSLPLSVPLTHFSFVADNCLYMGLDEIFSESKWKLEIVVQYLWKYITKPSVRTRKSNGHTEDATFDGALKCFSNKTGTKSLIKKIGVDVVQFLLAHGFQAHLSILSKGNAGDKQGGDSAIVDSCQTFISAFDSLRSTDAQMEILSIGKEALFTAATIIFMKS

SEQ ID NO: 180548 - protein, 130 aa, Glycine max
  Coding DNA Sequence Number=SeqID_63770
MTTTRVVASKRKKTNKNSDLRLIDIGEQCWGGRATEGDLVMEKGVIGKKEMGRKHKSHHIGRNIRIENRDKKGGRTFRHHYERNTTWQHGMRFAIGVGETCCNFFPAWHGSRTGADKISLMGFGQYHWRN

SEQ ID NO: 180549 - protein, 349 aa, Glycine max
  Coding DNA Sequence Number=SeqID_63771
  Gene Ontology: Mol. function=oxidoreductase activity; Cellular component=vacuole; Biological process=hydrogen peroxide catabolic process
  Homolog annotation: Hit_ID=O22959; Match level="QueryCoverage=88%, HitCoverage=89%, E-value=1e-117, Identity=64%"; Hit description =Peroxidase 19 precursor
  Pfam annotation: Domain name=peroxidase; Domain location=61-312; Score=387.2; E_value=2.5e-113; Accession=PF00141.13; Description =Peroxidase
  Subcellular localization annotation: CTP_CleavageSite=46; ConfidenceScore=5.82e-01
MSLPSFATTSFSFLFTSFFVFFILCGNSSSSLAIHANTTRPPRQLSVSYYAKSCPQVEQLVGSVTSQQFKESPVSGPATIRLLFHDCFVGGCDASILIASKPGSKELAEKDAEDNRDLKVEAFETVRKAKEQVERKCPGVVSCADILVIAARDYVHLAGGPYYQVKKGRWDGKISTASRVASNIPHANSTVDQLIKLFTSKGLTTQDLVALSGAHTIGFAHCKNFVARLYSYRGKAQPDPNMDPKLLHVLRMYCPNFGGNSDIVAPFDATTPFLFDHAYYGNLQKKLGLLASDQTLALDPRTKPIVEDLAKDKQKFFKAFVGAMDKLSLVKVVRGKRHGEKRRDCSMHM

SEQ ID NO: 180550 - protein, 177 aa, Glycine max
  Coding DNA Sequence Number=SeqID_63772
  Gene Ontology: Mol. function=hydrolase activity, acting on ester bonds; Biological process=lipid metabolic process
  Homolog annotation: Hit_ID=Q8LFP6; Match level="QueryCoverage=82%, HitCoverage=44%, E-value=1e-51, Identity=68%"; Hit description=GDSL -motif lipase/hydrolase-like protein
  Pfam annotation: Domain name=Lipase_GDSL; Domain location=39-175; Score=5.4; E_value=0.00064; Accession=PF00657.12; Description=GDSL -like LipaseAcylhydrolase
MEASNSHSFLSLVHLFVLFLLLCFVVTIEANSKKKVSAFYVFGDSTVDPGNNNFIDTAFRSDFPPYGRDFVNQAATGRFTNGKLGTDFLASYLGLKELVPPYLDPNLSDKELVTGVSFASAGSGFDPLTPMLGNVIPVAKQLEYFKEYKKRLEAQAQMTTSLTIFRCQYEERPTPPP

SEQ ID NO: 180551 - protein, 74 aa, Glycine max
  Coding DNA Sequence Number=SeqID_63773
MVFKSIGNGASKGAGLGYTGAGHGGIVGIGSGANGGNCSEEEDGKCWMVTGICNFSRMTLSLETMEARVTTEWS

SEQ ID NO: 180552 - protein, 91 aa, Glycine max
  Coding DNA Sequence Number=SeqID_63774
METYALMSHPIKALCLDVLQHKVPYSNSASHMLPRTQGDQSGSRCFARMLQPYGINIGLKEHSNRVTPKTYTPKSLSRPLPLDSGPTQKTF

SEQ ID NO: 180553 - protein, 37 aa, Glycine max
  Coding DNA Sequence Number=SeqID_63775
MAQAQGLSARCAQPQLWKDWGGNVFIGRVRIVFICIL

SEQ ID NO: 180554 - protein, 912 aa, Glycine max
  Coding DNA Sequence Number=SeqID_63776
  Gene Ontology: Mol. function=structural constituent of cytoskeleton; Cellular component=microtubule organizing center; Biological process= microtubule cytoskeleton organization and biogenesis
  Homolog annotation: Hit_ID=Q9FG37; Match level="QueryCoverage=87%, HitCoverage=97%, E-value=0.0, Identity=69%"; Hit description=Gamma -tubulin interacting protein-like
  Pfam annotation: Domain name=Spc97_Spc98; Domain location=186-659; Score=578.7; E_value=5.4e-171; Accession=PF04130.4; Description =Spc97  Spc98 family
GCSSMMEEEEDQQKLPDLVKELVHRLLSQNLPPNSPPLNPNSPEFRNSLRYALRILSSRLTPSVAPDAAAIADSIKRRLATHGHSSEALSFADLFSKFSSKAQSVNNKFAVIYLLKIVSEDRHTTTATTTPLLPNLSFSEPTSNKKPWNDNGALLISKDPENRRDVAFREFVDLVKEENEVSEEVLVQDVLYACQGVDGKFVKFDGESKRYVIPDSIRVPRATRSMVYNLCELGVLFRNVSGYISLSMDRFPNEDVGTVGQAFCSALQDELSEYYKLLAVLEAQASNPIPLVSESASSGNYLSLRRLAVWVAEPLVKMRLMADLVEKCRVLRGGAMAGAIHLHAQHGDPLVHEFMRRLLQRVCSSLFEMVRRWVLEGELEDIFAEFFIVGQPVKAESLWREGYRLHDSMLPLFISPSLAQRILRTGKSINFLRVCCEDHGWADAATEVVADHGATARRGGFGYGETDTLEFLVDEASKRIDKHLLDVIFKRYKFKEHCLAIKQYLLLGQGDFVQYLMDIVGPELSEPANTISSFKLSGLLETAIRASNAQYDDPEILDRLRVKMMPHESGDRGWDVFSLEYDARVPLDTVFTESVMARYLRIFNFLWKLRRVEHALTGAWKTMKPNCITSNSFTRLQHAVKMQLVSTLRRCQVSWSNFLAEMEVAKDLDDLLAAHEKYLHSIVEKSLLGELSQSLYKSLFVIFDLILRFRSRADRLYEGIHELQARFTESSLSSRDKNQSRSRKQLSDKSAEQGSWIADGRKALTQRAGEFLRNMEQDLDAIAKEYSSLQEGFISQLPVQQHVDLKKFVNKAEGQAEALFLQKDKALKALHPANFHCVFEWNNSIVANFLWTNRMDMKLLIFNWMPDMSSTDEIAGLAENVGAVQATLGFWKCCEKSELAQSIASAGGGDTG

SEQ ID NO: 180555 - protein, 96 aa, Glycine max
  Coding DNA Sequence Number=SeqID_63777
MGAYCNGNVSLSPSYDVASAQDPRLRELKQLGAVLLPSLTLRDIIGKCGSCGCKCGSCGCNCGCGESKDLEVEAKISDVDHFLKPLVEHFLNISLA

SEQ ID NO: 180556 - protein, 378 aa, Glycine max
  Coding DNA Sequence Number=SeqID_63778
  Gene Ontology: Cellular component=mitochondrion
  Homolog annotation: Hit_ID=Q5QTN8; Match level="QueryCoverage=76%, HitCoverage=81%, E-value=3e-74, Identity=51%"; Hit description =Calcium homeostasis regulator CHoR1
MTIYHDEVRRSKQQVDNIYKGEAKNHKLNHLHSQNMVVLKSTSPLSSLTSHFFNLSSSSSSSSKFTSPHSLRRRHFHHVHSTSRVAQFTIRAYMENPNTLGSFANRVIGALPVVGLIARILSDEGGVGDDLVDFAEFRRRVGKKCSETDSTAFYEFQDRRGKAGDPLYVLLCCWLAAIGAGLLKTEDILEGVARLRISNDIEFEEQSFMALMNESKEESSTSESINWVVRKRLRECLDRRTEGMFLLFINLQKYKVNRIGKTIPRYMNDILARRARQNADPPAVPMEIRAGKALDAIYVCCFGKDSIEEEDKRLLTAMLGAVFASVQREEIRRLVKDKAEKVAAGVDDEYVSELKPLSKEAVELQMKDLQFLQQNSET

SEQ ID NO: 180557 - protein, 300 aa, Glycine max
  Coding DNA Sequence Number=SeqID_63779
  Homolog annotation: Hit_ID=Q00V20; Match level="QueryCoverage=38%, HitCoverage=64%, E-value=4e-10, Identity=36%"; Hit description=[S] KOG4032 Uncharacterized conserved protein
MVEVAAAERVWGGEFGGGGGGGRKVKEWVCTDELHFNDLVADRIKGAQTKTLLLLSSLESGILNPKSLIPNQSHVRTPNFNPFFLNVRRQRLKAEIDKAMEGSRRLHGQSVGVFNEGICLVLSRWSALRSAVENEWGGRESRLKADQLASGILNWFTQSKEPLYIDDLEDILDQGMLSLNVEVEDGSVEEVAEKLMVMHEEFLEGNFSSFEDLRKANLEQATLPHVTQIANEDDTDEDGDDDEKMIVDDNSSKMNLDISTSDSNMNSVNRPVNEPLPKVSGEADDGWVVVSNRRNKGRKN

SEQ ID NO: 180558 - protein, 61 aa, Glycine max
  Coding DNA Sequence Number=SeqID_63780
MAHGGGNVAITILFAIMLAYSSEMLHADVPPKISSKISKASLEFQPEYPLKMMSAYVTIYI

SEQ ID NO: 180559 - protein, 322 aa, Glycine max
  Coding DNA Sequence Number=SeqID_63781
  Gene Ontology: Mol. function=catalytic activity; Cellular component =intracellular; Biological process=immune response
  Homolog annotation: Hit_ID=Q9FL05; Match level="QueryCoverage=98%, HitCoverage=68%, E-value=1e-112, Identity=59%"; Hit description =Similarity to intracellular protein
SHEQMSVDMVDYIVDEHHIDVYPQMIRRVKEMILASSEYAPSMSSSEKSFLYDIVANGRNGIDVDKFDYLLRDCRACGLGCNFEFQRLLETMRVLDDEICYRAKDLFLIVPCFRLCNLLDLTIHKMFATRADLYRTVYTHPKVKAIELMVVDALVHANSYLGISSNIHDPSEYWKFCNEYPVPKDMLDNYKKVTAQDIVCSQVFNLVKPSHLHKSGGVTLKEEDVAVCNVKIDLTRGKHNPLESIHFFKDYESDEKFTIPDDRVSHLLPTSYQDMIVKVYAKKPELVEAISEAFENFQLKTYGIKTQAHSTPQKKRRYNSFI

SEQ ID NO: 180560 - protein, 454 aa, Glycine max
  Coding DNA Sequence Number=SeqID_63782
  Gene Ontology: Mol. function=protein serine/threonine kinase activity; Cellular component=membrane; Biological process=protein amino acid phosphorylation
  Homolog annotation: Hit_ID=Q8LES3; Match level="QueryCoverage=89%, HitCoverage=94%, E-value=1e-135, Identity=79%"; Hit description =Protein kinase
  Pfam annotation: Domain name=Pkinase; Domain location=63-399; Score =169.5; E_value=8.7e-48; Accession=PF00069.15; Description=Protein kinase domain
  Pfam annotation: Domain name=Pkinase_Tyr; Domain location=63-399; Score=200.0; E_value=5.7e-57; Accession=PF07714.7; Description =Protein tyrosine kinase
  Pfam module annotation: Pfam domain module=Pkinase::Pkinase_Tyr; Domain location=63-399::63-399
MKKSESGGYVRADQIDLKSLDEQLQRHLSRAWTMEKNKEKEEEEVEGRSTRSRQEWEIDPSKLVIKTVIARGTFGTVHRGIYDGQDVAAKELDINDVLFGQQIHCLSFVLPVSACDFVVLVPLQSSNNFCLDMSPCFPEFFEKASKLMLFVKLLDWGEEGHRSDAEIASLRAAFTQEVAVWHKLEHPNVTKFIGATMGTSELQIQTENGHIGMPSNVCCVVVEYCPGGALKSYLIKNRRRKLAFKVVVQLALDLARGLSYLHTKKIVHRDVKTENMLLDKTRTLKIADFGVARIEASNPHDMTGETGTLGYMAPEVLNGNPYNRKCDVYSFGICLWEIYCCDMPYPDLSFSEVTSAVVRQNLRPEIPRCCPSALANVMKRCWDANPDKRPEMDEVVTMLEAIDTSKGGVIEDLERFFTVKEIDYGGMIYSSSMDCSDTNIKVLMGHLMSYEAYK

SEQ ID NO: 180561 - protein, 445 aa, Glycine max
  Coding DNA Sequence Number=SeqID_63783
  Gene Ontology: Mol. function=binding; Cellular component =intracellular; Biological process=protein kinase C activation
  Homolog annotation: Hit_ID=Q9FJY9; Match level="QueryCoverage=77%, HitCoverage=84%, E-value=1e-74, Identity=38%"; Hit description =Similarity to selenium-binding protein
  Pfam annotation: Domain name=PPR; Domain location=200-234; Score=8.7; E_value=0.7; Accession=PF01535.11; Description=PPR repeat
  Pfam annotation: Domain name=PPR; Domain location=258-292; Score =36.7; E_value=8.1e-08; Accession=PF01535.11; Description=PPR repeat
  Pfam annotation: Domain name=PPR; Domain location=295-329; Score =11.9; E_value=0.29; Accession=PF01535.11; Description=PPR repeat
  Pfam annotation: Domain name=PPR; Domain location=331-365; Score =14.6; E_value=0.14; Accession=PF01535.11; Description=PPR repeat
  Pfam module annotation: Pfam domain module=PPR::PPR::PPR::PPR; Domain location=200-234::258-292::295-329::331-365
MEFNWVVPSLKCSQGSLLGVSMKEEVPWKYCEIAIVSLIEEKLGQVALFNVEKALHAFTYASSTRTTLASSQAKLKQKTSKTPNLNHVPYIIDVLNHTFTTASSSPSHIHFPSTFPKRTLSSPRTVAKTALLDMFSKCGSLDEATKGVLREMGRENVELSEFTSCSALKSGASLKALELGRQVHGLVVRMGHDLGWKNDMMYNSMVFRCVRNRSYDEAVRVMGLVRPNVVALTSALVGCYENLDLWAGKQIHCVVDVISWTCMIDVYGRNGQGGEAVEMFQEIKEDGSKVLPNSVTFLSVLLACGHSGLMEEGKNCFKLLREKYGLQPDSEHYVFYIDILGRAGNIEEVRSTYHTMVEQGTGPTTGVWVALLNACSLNQDVERGELAAKHVLQLEPYKASNIVLVSNFYAATDRWDWVDELRSIMRTKGLVKEVGNSWINVLGFN

SEQ ID NO: 180562 - protein, 271 aa, Glycine max
  Coding DNA Sequence Number=SeqID_63784
  Gene Ontology: Mol. function=RNA-directed DNA polymerase activity; Cellular component=exocyst; Biological process=RNA-dependent DNA replication
  Subcellular localization annotation: CTP_CleavageSite=27; ConfidenceScore=5.00e-01
MGQSLPTLVPAYQPIKPRYYLSTVNFNAKAISGSQWMVKRKGFSRGSGELLEAKEILVKINDLDLKDEEGILSLRDLREKDYFKVRFKEDAWVRPKLDGVSFKELGEEDNALLVPKLKEKEIKEAIWNSDGDKCPGSDGLNFNFIKHLWKILKGDFINLMNEFHTNGVLLRGGHASFITHMPKKDIPLGLGGLQPMSLIGCILKVISKVLSNRVRKVLPKVIDVRQCAFLSERYMFDGVLISNEVVEEVRRCRKECAILKVGFKKAYDIVS

SEQ ID NO: 180563 - protein, 315 aa, Glycine max
  Coding DNA Sequence Number=SeqID_63785
  Gene Ontology: Mol. function=zinc ion binding; Cellular component =nucleus; Biological process=ubiquitin-dependent protein catabolic process
  Homolog annotation: Hit_ID=Q9XGC3; Match level="QueryCoverage=99%, HitCoverage=97%, E-value=1e-129, Identity=68%"; Hit description =SINA2p
  Pfam annotation: Domain name=Sina; Domain location=109-308; Score =434.6; E_value=1.3e-127; Accession=PF03145.7; Description=Seven in absentia protein family
MAPGSSVFKEVLESHLMSSDYEMGKAKSEAKSNSTSTKSSIGLSGKSGISSNNGVYPAHPAKGSSGMRLADSKPIFINTMCPNGHTLCSHCKVEVHNICPSCHHDLGNIRCLALEKVAESLELPCRYQSLGCHDIFPYYTKLKHEQNCGFRPYNCPYAGSECSVMGDIPTLVAHLKDDHKVDMHDGCTFNHRYVKANPHEVENATWMLTVFNSFGRHFCLHFEAFQLGSAPVYMAFLRFMGDDNEAKKFSYSLEVGANGRKLIWQGIPRSIRDSHRKVRDSQDGLIIQRNLALYFSGGERQELKLRITGRIWREE

SEQ ID NO: 180564 - protein, 260 aa, Glycine max
  Coding DNA Sequence Number=SeqID_63786
  Gene Ontology: Mol. function=protein-tyrosine kinase activity; Cellular component=membrane; Biological process=protein amino acid phosphorylation
  Homolog annotation: Hit_ID=Q709M0; Match level="QueryCoverage=97%, HitCoverage=69%, E-value=1e-98, Identity=70%"; Hit description =Protein kinase 2
  Pfam annotation: Domain name=Pkinase; Domain location=73-260; Score= -14.9; E_value=1.1e-07; Accession=PF00069.15; Description=Protein kinase domain
  Pfam annotation: Domain name=Pkinase_Tyr; Domain location=73-260; Score=-6.3; E_value=4.4e-12; Accession=PF07714.7; Description =Protein tyrosine kinase
  Pfam module annotation: Pfam domain module=Pkinase::Pkinase_Tyr; Domain location=73-260::73-260
MLCCGGAEEESTGSPANQYPTAPPRGGNTYGGGGNDRGEPRGNVAKSGAPQKVLPIEIPSMPLDELNRLTGNFGTKAFIGEGSYGRVFYAKLSDGTDAAIKKLDTSSSPEPDSDFAAQLSIVSRMKHDNFVELIGYCLEADNRLLVYQYASLGSLHDVLHGRKGVQGAEPGPVLSWNQRAKIAFGAAKGLEFLHEKVQPSIVHRDVRSSNVLLFNDYEAKIADFSLTNQSSDTAARLHSTRVLGTFGYHAPEYVLKKPSL

SEQ ID NO: 180565 - protein, 81 aa, Glycine max
  Coding DNA Sequence Number=SeqID_63787
  Gene Ontology: Mol. function=protein-tyrosine kinase activity; Cellular component=integral to membrane; Biological process=protein amino acid phosphorylation
  Homolog annotation: Hit_ID=Q709M0; Match level="QueryCoverage=98%, HitCoverage=21%, E-value=5e-31, Identity=79%"; Hit description =Protein kinase 2
MPKGQQSLVTWATPRLSEDKVKQCVDPKLNNDYPPKAIAKLAAVAALCVQYEADFRPNMTIVVKALQPLLNAKPSGPDPHA

SEQ ID NO: 180566 - protein, 276 aa, Glycine max
  Coding DNA Sequence Number=SeqID_63788
  Homolog annotation: Hit_ID=Q33BI2; Match level="QueryCoverage=94%, HitCoverage=17%, E-value=8e-56, Identity=46%"; Hit description =Expressed protein
MPGLAQRNEHQLTNGSSTPTCSLSANRFWSKNSDEVCYNQLQKGIVGKCSQCGCENLRNSNIAATTVFWIELSLQARQKLLRIDKQSLFEQARKNMYCSRCNGLLLEGFLQIAMYGKSLQQEGVDAHFPCNRSGGLKKLNNDESSIINGCQDEIQDPSIHPWGGLTTSRDGSLTLMSCYLYSKSLKGLQIVFDGARARERERELLYPDACGGGGRGWISQGIVSYGRGHGTRETCALHTARLSCDTLVDFWSALGEETRLSLLRMKEEDFIERLMY

SEQ ID NO: 180567 - protein, 73 aa, Glycine max
  Coding DNA Sequence Number=SeqID_63789
  Gene Ontology: Mol. function=transferase activity; Biological process= metabolic process
  Homolog annotation: Hit_ID=Q9SNU8; Match level="QueryCoverage=85%, HitCoverage=20%, E-value=1e-11, Identity=52%"; Hit description =Formiminotransferase-cyclodeaminase-like
  Pfam annotation: Domain name=FTCD_N; Domain location=1-73; Score= -125.8; E_value=0.079; Accession=PF07837.3; Description =Formiminotransferase domain, N-terminal subd
MVIVIWSCHLSNVVLAIVKAAFDSIDFEVHVGTDPWLGVMDHICFHPLLDASLDHAANAARCLATNMGSTLQG

SEQ ID NO: 180568 - protein, 57 aa, Glycine max
  Coding DNA Sequence Number=SeqID_63790
MGKYTLGTELIGASAMNKEQNPENYAETEQEEGKNESSGRPKRGSNRPRYLEDYVAK

SEQ ID NO: 180569 - protein, 65 aa, Glycine max
  Coding DNA Sequence Number=SeqID_63791
MCLLGKEMNGSSFLGDPTVLSSEGKVYGGLRFWLKRLCRMAGHDICQDVGLANDSGVKESLTLFP

SEQ ID NO: 180570 - protein, 100 aa, Glycine max
  Coding DNA Sequence Number=SeqID_63792
  Gene Ontology: Mol. function=ribonuclease H activity; Biological process=DNA integration
MGAWYQQRMKNAFDKKVRLRKFHEGDLVLRKMSHAVKDNRGKWAPNYEGPFIVKRAFSGGALVLTNMDGEELPLLANSDVVMRYHAWNLGQLKMSLHVLL

SEQ ID NO: 180571 - protein, 193 aa, Glycine max
  Coding DNA Sequence Number=SeqID_63793
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-35, Identity=34%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=78; ConfidenceScore=5.71e-01
MCSPMKARTCSPLKARTCSPLKARTCSPLKAKTCSPLKARACSPLKVRTCSPMKARTSSPVKARACSLLKARTCSPLEASTCKPLKARTCSPLKARTCSPLKVRICSPLKARVCSPLKARTCSPLKTRACSPLKARTCSPLKARTFSFLKASTCSPLKVRECSPQKARMCNYLKARACNPLKARTCIPLKGNA

SEQ ID NO: 180572 - protein, 144 aa, Glycine max
  Coding DNA Sequence Number=SeqID_63794
MGAKHLTRTKEWSHVIKQRSPDEIREILCSILRVSICYGSQSDIKVRTYGHLNFPEAFVFNLGILDIFWDSIGHSIQNLCDEDMAKSKGKDPLEGLAGPMTTARAGNGNEALQQVLSILFEYKPKFQGEKSKVVSCIMAQMEED

SEQ ID NO: 180573 - protein, 98 aa, Glycine max
  Coding DNA Sequence Number=SeqID_63795
MPQIKRKQAYAIREIPLCGGNQQEVFLRNPFFLQKAVASRGSNLARLGELGGKLLPYFAINRGRSEEERGSAFLALLILSKLLRKIVSVKKIQAEALL

SEQ ID NO: 180574 - protein, 60 aa, Glycine max
  Coding DNA Sequence Number=SeqID_63796
MAKGAEDDVSLYASMGSFAPSLMKGAEGAGGDVSLYASTGSFAPWLTKGAGNHKVTPHVT

SEQ ID NO: 180575 - protein, 91 aa, Glycine max
  Coding DNA Sequence Number=SeqID_63797
MNPSMRRWPRCPAERQGEGHKSRTIQPCVWSLAFVCMSARKPRGFGLAVSARWPAFGALRSAPSLSGRPLLRGVPPLHNVASDSREICLTR

SEQ ID NO: 180576 - protein, 114 aa, Glycine max
  Coding DNA Sequence Number=SeqID_63798
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=76%, HitCoverage=13%, E-value=3e-19, Identity=56%"; Hit description=E3 ubiquitin ligase PUB14
LRQGDPLAPLLFHLVAEGLTGLMRVIRTGSPRNQENVAAVLWSLCTGDPLQLKLAKEHGAEAALQELSENGTDRAKIKAGSILELLQRMEGGPAIKSAATTEPGSQNGKKLEGG

SEQ ID NO: 180577 - protein, 542 aa, Glycine max
  Coding DNA Sequence Number=SeqID_63799
  Homolog annotation: Hit_ID=O87109; Match level="QueryCoverage=94%, HitCoverage=48%, E-value=6e-32, Identity=27%"; Hit description =Surface layer protein
MAHATGELRFNFAKNINVQWQGNSINDGANSVSNTFKIKGYDQGSVLTANLITKNVYLTTGSDGTLSGTIATNVGNFTLFPQIDLAGYRGTGSIYLDGQLVGNEGRHVFDIGLLADPSIANIHNKDYKHITDLKAPELWDPAWGMPNGFTGSYGFALSGFADNVTVINVPVDSFMDAPFSQRALEITGNAGENSHITFEYAPDYRYKNFSPVMTISFDAKNIVHADAGTLSFKTNTVYIDSGIPEVREFLEISSKGDAENTLRLEGHDNHISEINITGDKALNLTIKNNFSEELKSITSHMANSTPLHLTMEQGGTGGGQFYQLLKQLDGLTGYDAIMSQLAGYQLSIANDAPTTSGIQANHIYNVMGNTSLATGKGADTVVFNHSTIDNMVTFNDYENSSTQNASWVEGDNIAVGDIDRQWLFSAGGSKTIDLVGSLSLNELTVLLSGMNVQTNTTPQQLFIELVYTVTQGHSQSALSEVSALSLNGFYFVMVDKNLNHSLDNDDIIFGLTNDNAFNMAHYDSPVLEINGIGSFTHDAVAA

SEQ ID NO: 180578 - protein, 167 aa, Glycine max
  Coding DNA Sequence Number=SeqID_63800
  Gene Ontology: Mol. function=catalytic activity
  Homolog annotation: Hit_ID=UPI00005FA05F; Match level="QueryCoverage =87%, HitCoverage=72%, E-value=9e-55, Identity=71%"; Hit description =COG1896: Predicted hydrolases of HD superfamily
  Pfam annotation: Domain name=HD; Domain location=1-94; Score=1.4; E _value=0.033; Accession=PF01966.12; Description=HD domain
MSLAPYAGDDVDIQRVIQMALLHDIVEIDAGDVLVYDLAARAAIHDQEVAAARRLFGMLPEAQREYFTALWQEYEDGESADARFALLLDRTMPMLMNLHNEGQSWVENGISLEQVLARNASIADVHPELWHHMEQHLRDAQRKGWLNGQFKQTQPRHGICVSYLLNP

SEQ ID NO: 180579 - protein, 167 aa, Glycine max
  Coding DNA Sequence Number=SeqID_63801
  Gene Ontology: Mol. function=nucleic acid binding
  Homolog annotation: Hit_ID=Q53KJ4; Match level="QueryCoverage=51%, HitCoverage=12%, E-value=1e-14, Identity=46%"; Hit description =Transposable element protein, putative
MHRSPTGNSVPLDLEIEATLQRNRAGGEGNFCKTEQLQPFLRRRLISPTYYHLIHHHQENLPLNYLKPLPWQKRMTRGLPLRIIQGNLFQGLPNEDPYAHLATFIEICNTVKIAGVPDEAIRLSLFSFSLAGEAKRWLHSFKGNNLKTWEEVVEKFLKKYFPESKTA

SEQ ID NO: 180580 - protein, 402 aa, Glycine max
  Coding DNA Sequence Number=SeqID_63802
  Gene Ontology: Mol. function=protein binding; Cellular component =membrane; Biological process=defense response
  Homolog annotation: Hit_ID=Q2YE87; Match level="QueryCoverage=97%, HitCoverage=32%, E-value=1e-159, Identity=71%"; Hit description=NBS -LRR type disease resistance protein Rps1-k-2
  Pfam annotation: Domain name=LRR_1; Domain location=259-280; Score =16.2; E_value=0.12; Accession=PF00560.23; Description=Leucine Rich Repeat
  Pfam annotation: Domain name=LRR_1; Domain location=282-304; Score =13.5; E_value=0.8; Accession=PF00560.23; Description=Leucine Rich Repeat
  Pfam annotation: Domain name=LRR_1; Domain location=306-327; Score =6.0; E_value=21; Accession=PF00560.23; Description=Leucine Rich Repeat
  Pfam module annotation: Pfam domain module=LRR_1::LRR_1::LRR_1; Domain location=259-280::282-304::306-327
FPPQNARGEDRRALEEIGREIVKKCNGLPLAARSLGGMLRRKHAIRDWNNILESDIWELPESQCKIIPALRISYQYLPPHLKRCFVYCSLYPKDHEFQKKNLILLWMAEDLLKLPNRGKALEVGYEYFDDLVSRSFFQRSSNRTWGNYFVMHDLVHDLALYLGGEFYFRSEELGKETKIGIKTRHLSVTKFSDPISDIEVFDKLQFLRTLLAIDFKDSSFNKEKAPGIVASKLKCLRVLSFCDFASLDVLPDSIGKLIHLRYLNLSFTRIRTLPESLCNLYNLQTLVLSRCRVLTRLPTDMQNLINLCHLHIDGTDIREMPRGMGMLRHLQHLDFFTVGKHKENGIKELGTLSNLHGSLSIRNLENVTRSNEALEARMLDKKHINHLSLEWSNGTDFQTELD

SEQ ID NO: 180581 - protein, 222 aa, Glycine max
  Coding DNA Sequence Number=SeqID_63803
  Gene Ontology: Mol. function=GTP binding; Cellular component =intracellular
  Homolog annotation: Hit_ID=Q9FH87; Match level="QueryCoverage=76%, HitCoverage=26%, E-value=1e-55, Identity=61%"; Hit description =Similarity to salt-inducible protein
  Subcellular localization annotation: CTP_CleavageSite=39; ConfidenceScore=5.11e-01
MHRFSALFFRKRAISSLLSLVIRHETTVCHFFCTTSEVSSSRTSSLLPPPPHCNSTFDNHGCLTNQFGLIRLQEISINHTDDHTHDEFASDVEKVYRILRKYHSRVPKLELALRESGVVVRPGLTERVLSRCGDAGNLAYRFYSWASKQSGHRLDHDAYKAMIKVLSRMRQFGAVWALIEEMRQENPHLITPQVFVILMRRFASARMVHKAVEVLDEMPKYG

SEQ ID NO: 180582 - protein, 402 aa, Glycine max
  Coding DNA Sequence Number=SeqID_63804
  Gene Ontology: Mol. function=GTP binding; Cellular component =intracellular; Biological process=metabolic process
  Homolog annotation: Hit_ID=Q9FH87; Match level="QueryCoverage=92%, HitCoverage=67%, E-value=1e-143, Identity=46%"; Hit description =Similarity to salt-inducible protein
  Pfam annotation: Domain name=PPR; Domain location=10-44; Score=35.1; E_value=2.4e-07; Accession=PF01535.11; Description=PPR repeat
  Pfam annotation: Domain name=PPR; Domain location=115-149; Score =46.2; E_value=1.1e-10; Accession=PF01535.11; Description=PPR repeat
  Pfam annotation: Domain name=PPR; Domain location=150-184; Score =26.1; E_value=0.00012; Accession=PF01535.11; Description=PPR repeat
  Pfam annotation: Domain name=PPR; Domain location=185-219; Score =34.8; E_value=3e-07; Accession=PF01535.11; Description=PPR repeat
  Pfam annotation: Domain name=PPR; Domain location=220-254; Score =23.1; E_value=0.001; Accession=PF01535.11; Description=PPR repeat
  Pfam annotation: Domain name=PPR; Domain location=293-327; Score =27.0; E_value=6.5e-05; Accession=PF01535.11; Description=PPR repeat
  Pfam annotation: Domain name=PPR; Domain location=45-79; Score=47.7; E_value=4e-11; Accession=PF01535.11; Description=PPR repeat
  Pfam annotation: Domain name=PPR; Domain location=80-114; Score=43.0; E_value=1e-09; Accession=PF01535.11; Description=PPR repeat
  Pfam module annotation: Pfam domain module=PPR::PPR::PPR::PPR::PPR::PP R::PPR::PPR; Domain location=10-44::115-149::150-184::185-219::220 -254::293-327::45-79::80-114
MRYRWKPSVKHFTSLLYGWCKEGKLMEAKHVLVQMKDMGIEPDIVVYNNLLGGYAQAGKMGDAYDLLKEMRRKRCEPNATSYTVLIQSLCKHERLEEATRLFVEMQTNGCQADVVTYSTLISGFCKWGKIKRGYELLDEMIQQGHFPNQVIYQHIMLAHEKKEELEECKELVNEMQKIGCAPDLSIYNTVIRLACKLGEVKEGIQLWNEMESSGLSPGMDTFVIMINGFLEQGCLVEACEYFKEMVGRGLFTAPQYGTLKELMNSLLRAEKLEMAKDAWNCITASKGCQLNVSAWTIWIHALFSKGHVKEACSFCIDMMDKDLMPNPDTFAKLMHGLKKLYNRQFAAEITEKVRKMAADRQITFKMYKRRGERDLKEKAKEKKDGRKRRARQRQWGGGRQKL

SEQ ID NO: 180583 - protein, 528 aa, Glycine max
  Coding DNA Sequence Number=SeqID_63805
  Gene Ontology: Mol. function=protein serine/threonine kinase activity; Cellular component=integral to membrane; Biological process=protein amino acid phosphorylation
  Homolog annotation: Hit_ID=Q5JNK2; Match level="QueryCoverage=52%, HitCoverage=71%, E-value=1e-97, Identity=61%"; Hit description =Putative Nod-factor receptor 1b
  Pfam annotation: Domain name=LysM; Domain location=125-168; Score =32.2; E_value=1.8e-06; Accession=PF01476.10; Description=LysM domain
  Pfam annotation: Domain name=Pkinase; Domain location=306-527; Score =88.3; E_value=2.4e-23; Accession=PF00069.15; Description=Protein kinase domain
  Pfam annotation: Domain name=Pkinase_Tyr; Domain location=306-525; Score=79.6; E_value=1e-20; Accession=PF07714.7; Description=Protein tyrosine kinase
  Pfam module annotation: Pfam domain module=LysM::Pkinase::Pkinase _Tyr; Domain location=125-168::306-527::306-525
MNCTDTTRVCTSFLAFKPQPNQTLAVIQSMFDVLPGEITVEGNGWDYIFIRKNCSCAAGMKKYVSNTTLTVKSNGGFEHDLVMDAYDGLALLPNTTTRWAREGGVISLSLFCSCSSGLWNYLMSYVIRDGDSVESLASRFGVSMDNIETVNAIDNPDSLTVGSLYYIPLNSVPGELYHLKNDTPSAPIPSPSVDNFSADHVTQKAHVPHEWIVGGLGIGLALIILTIIVWVALRSPNCLVEARNNAKDSAGKISKKFYVFGNPSLFCGCGKPVDQHQTYALMPDMLDMDKPVVFSYEETFSSTDGFSDSNLLGRRTYGSVYHGLLRDQEVAIKRLTTTKTKEFMSEIKVLCKVHHANLVELIGYAVSHDEFFLIYEFAQRGSLSSHLHDPQSKGYSPLSWITRVQIALDAARGLEYIHEHTKTRYVHQDIKTSNIFLDASFRAKISDFGLAKLVGETNEGEIAATKVVNAYGYLAPEYLSNGLATTKSDVYAFGVVLFEIISGKEAIIQTQGPEKRSLASIVSYAYET

SEQ ID NO: 180584 - protein, 199 aa, Glycine max
  Coding DNA Sequence Number=SeqID_63806
  Gene Ontology: Mol. function=protein binding; Biological process=two -component signal transduction system (phosphorelay)
  Homolog annotation: Hit_ID=Q9LU15; Match level="QueryCoverage=59%, HitCoverage=93%, E-value=4e-45, Identity=70%"; Hit description =Histidine-containing phosphotransfer protein 4
  Pfam annotation: Domain name=Hpt; Domain location=44-129; Score=49.7; E_value=9.5e-12; Accession=PF01627.13; Description=Hpt domain
MDKIPSRRQVAAMKQSLFDQGYLDEQFIQLEELQDDANPNFVEEIVTLYYRDSSRLISSLDHTLESNPLDFNKLDTIMHQFKGSSSSIGAKKVKAECTLFREYCRARNGEGCRRSFQQMKREYATLRKKLETYFQLARQVGPVETAFRPKEGLTPTQGKQHSQAKDTALPETQTCMHVRMLKPCLNQTKCILTTSLNSM

SEQ ID NO: 180585 - protein, 81 aa, Glycine max
  Coding DNA Sequence Number=SeqID_63807
MKGPNNDDWSTSKEMAKSRKVRPCEYQPFHKGYDIYRIMLPLLCCREVRFSTGTTYDDSLMNIEFNATFVTTKADLGKKYP

SEQ ID NO: 180586 - protein, 138 aa, Glycine max
  Coding DNA Sequence Number=SeqID_63808
  Gene Ontology: Mol. function=nucleic acid binding; Cellular component= nucleus
  Homolog annotation: Hit_ID=Q0PJL8; Match level="QueryCoverage=68%, HitCoverage=30%, E-value=2e-23, Identity=73%"; Hit description=MYB transcription factor MYB52
MKRMRTFFSITAAPWGGSEHGELGLGDEAAGRLEEEGDERNCRCAAAAEEEEEERLRFPMLALFFMIDPSVSLTPNSLTPPPPRDGHVRELWPLLVQWEQRRVMPIRRRLTRSREQMELKLWIEEEEKRKKSACSMCL

SEQ ID NO: 180587 - protein, 139 aa, Glycine max
  Coding DNA Sequence Number=SeqID_63809
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=9e-12, Identity=33%"; Hit description= UPI00006A17C9 related cluster
NLSPLEDYTSSPSEGCTPSPSEGCTPSPSKGCMPSSSEDYHSSPLKGYTPSSSKGYTLSPSEDNTLSPSKGYLATRTHLRRATCPHLPRTTCPHLQRTTRPRLQRTTCPHPHLPRTTCPHLQRTTRPRLRLRRATRPHL

SEQ ID NO: 180588 - protein, 123 aa, Glycine max
  Coding DNA Sequence Number=SeqID_63810
  Homolog annotation: Hit_ID=Q9FLE0; Match level="QueryCoverage=35%, HitCoverage=12%, E-value=3e-10, Identity=53%"; Hit description=GTP -binding protein-like
MVISRICKRLELWKEVESNTIDMMIENDFSREDKEGDRKNSHNKVEDSSDLDVDKSKLPLKLAIVGRPNVAGLTRDSIRTQSEFQGRTIYLVDTAGWLKRTKQEKGEHPSALCNQGRVYSRLI

SEQ ID NO: 180589 - protein, 93 aa, Glycine max
  Coding DNA Sequence Number=SeqID_63811
MAEIRMDGFIKPMKEHNLETLGLFVQIPNRSITMPYTGCLSGHLAVAMTNFARCFPIIIVARASWNNMEVRPETDTLAHKFVLSRISGTGSHD

SEQ ID NO: 180590 - protein, 61 aa, Glycine max
  Coding DNA Sequence Number=SeqID_63812
MQLPQEPLNKKPRGLARKSMAVTNFVELCGGSNSEFKLRKEERDQSPAHRVVLKEELVACS

SEQ ID NO: 180591 - protein, 97 aa, Glycine max
  Coding DNA Sequence Number=SeqID_63813
MFGKGTDWENNKKPYFPLTGGSVLDNGGCMNSARQSIHGASNKMVEDAQTALGNQFVGLRTRWWRMHEWQSIHGAPNLMVEDARTVLGNQFMGLQTR

SEQ ID NO: 180592 - protein, 108 aa, Glycine max
  Coding DNA Sequence Number=SeqID_63814
MGEVEEAQEQMKANMEAMKEQMATVMEAIMSMRKIMEANAVAVSATSAVAKTHEMPHHNLVDFEPCLGYATEGQAVGGIHAKHFEGPLVSPATTTLAFCGGKSPSCYG

SEQ ID NO: 180593 - protein, 75 aa, Glycine max
  Coding DNA Sequence Number=SeqID_63815
MADKIRKGAEKTKEVATSVGETLKNMGGEGETRRAKSQSYHDDSPRCFDDAKVQRVVSRLKNQAFKIPLKDSRIK

SEQ ID NO: 180594 - protein, 79 aa, Glycine max
  Coding DNA Sequence Number=SeqID_63816
  Subcellular localization annotation: CTP_CleavageSite=36; ConfidenceScore=5.38e-01
MASMDTSAKVNSKIFPCNLGMRGSGEFVPFLDTTSRGSKVPQRTFLRRRHGPSVGLFTEGIKTEPICDAYAKDTMRECT

SEQ ID NO: 180595 - protein, 356 aa, Glycine max
  Coding DNA Sequence Number=SeqID_63817
  Gene Ontology: Mol. function=transferase activity, transferring nitrogenous groups; Cellular component=intracellular; Biological process=regulation of transcription, DNA-dependent
  Homolog annotation: Hit_ID=Q3KAB3; Match level="QueryCoverage=98%, HitCoverage=74%, E-value=1e-109, Identity=57%"; Hit description =Aminotransferase, class I and II
  Pfam annotation: Domain name=Aminotran_1_2; Domain location=1-348; Score=55.8; E_value=1.5e-13; Accession=PF00155.11; Description =Aminotransferase class I and II
  Pfam annotation: Domain name=Aminotran_5; Domain location=4-341; Score=-167.0; E_value=0.00067; Accession=PF00266.9; Description =Aminotransferase class-V
  Pfam annotation: Domain name=DegT_DnrJ_EryC1; Domain location=39-346; Score=-186.5; E_value=0.0047; Accession=PF01041.8; Description =DegTDnrJEryC1StrS aminotransferase family
  Pfam module annotation: Pfam domain module=Aminotran_1_2::Aminotran _5::DegT_DnrJ_EryC1; Domain location=1-348::4-341::39-346
MIDLNFNSPALPEQTVLLREALKKLSGAGDLEALLRYQPHAGRMSEREIVAQHLNRQGMAASAGQVAIVNGAQHGLAVTLGGLLRPGDVVAADALTYPGFRALARLYQLELVAIPHTTQGPDLDMLRNLCEKRRVKAIYTMPTLHNPLGWVMNLAQRSQLVDIARQFDLFIIEDAAYAWLIENAPPPLMSLAPERTVYVCGFSKNIATGLRVGMVVCREALMPAIERTIRATSWNTPALTTALVCGWIQDGTLARLETIMRADARRRQAIARQALAGLPMIGNENAWFLWLPLGEDVRADRVVKQLLTMNIAISTAEPYSVGRDVPHALRLALASPSLDKLSAALKIMRPIIEYGV

SEQ ID NO: 180596 - protein, 126 aa, Glycine max
  Coding DNA Sequence Number=SeqID_63818
MLDEGLVRKSLNPCSFLVPKIGIMRHQIPMIGGMMNVLSGATLICKITHASNIFMIHIYRDSLAPLIELVRNHVPSWKMPRKWGDGMMQSYPSRALNRRLQEDWARDAREGAMVLMSLRVDFGPVG

SEQ ID NO: 180597 - protein, 197 aa, Glycine max
  Coding DNA Sequence Number=SeqID_63819
MTTLTQIWMTLLHSNVLPSDHNFDLPLPKCQLVYAILTQMSVHMAQVIADVIYLFAGIAPTRHPLDPEKSNRALGFPALITGLCQSYGVPITPSKVIRPLITRVFIEKYCTPRQAQGNAHQDAGAPPPPRQADSVGPLLVERYIYHLVRQQAAKHHGQVQIHECLYQFSLSQQDQGSAPFVCRTPEQFGAEVAWPGD

SEQ ID NO: 180598 - protein, 109 aa, Glycine max
  Coding DNA Sequence Number=SeqID_63820
  Homolog annotation: Hit_ID=Q18L78; Match level="QueryCoverage=60%, HitCoverage=9%, E-value=3e-08, Identity=52%"; Hit description=RNA -dependent RNA polymerase
VRPGILFDRYAILGDDVLITDPLVAEQYRLGLQRLGVKISTHKSLISSTGAVEFAKQFLVKDMRVNLSPVLDGVQSVWRESFLLNAMILSVLSSPALVSGLMVARAKNP

SEQ ID NO: 180599 - protein, 54 aa, Glycine max
  Coding DNA Sequence Number=SeqID_63821
MVCENKYANVLVPPTGFYMEILLVASRGAPISRLARISEQWLSANLALSLEDDG

SEQ ID NO: 180600 - protein, 433 aa, Glycine max
  Coding DNA Sequence Number=SeqID_63822
  Gene Ontology: Mol. function=sequence-specific DNA binding; Cellular component=nucleus; Biological process=regulation of transcription, DNA-dependent
  Homolog annotation: Hit_ID=Q940V6; Match level="QueryCoverage=89%, HitCoverage=97%, E-value=1e-156, Identity=68%"; Hit description=Heat shock transcription factor
  Pfam annotation: Domain name=HSF_DNA-bind; Domain location=54-229; Score=186.1; E_value=8.6e-53; Accession=PF00447.8; Description=HSF -type DNA-binding
MDRNMNFSYLEEKQSFFGFAVSIFSFALVFEHLNLDKVVKFVKKEAQGSSSSLPPFLTKIYEMVDDPSTNSIVSWSATNRSFIVWNPPEFSRDLLPKYFKHNNFSSFIRQLNTYGFRKIDPEQWEFANDDFVRGQPHLLKNIHRRKPVHSHSLQNIQGQGVSSLTESERQSFKDEIEKLKHEKEQLLRELEMHEQEWKMYEVQLQHSNDRLEKLEKKQENLVSSVSQVLQKPGIALNLLLLTENMDRKRRLPRSGLFSDDASIEDHMETSQVLPRENADGASIFSSSTERLDLLESSMTFWENITHDVGDVFVQSHLNLDFDESTSCADSPAISCVQLEVEDQPKSHGINVSSEPAVVAAPDLDASKEQPVETAPLTTGVNDIFWERFLTENPGSSEMQEAQSEREDSDGRSNAKFWWNIRNVNNPPEQMGHS

SEQ ID NO: 180601 - protein, 637 aa, Glycine max
  Coding DNA Sequence Number=SeqID_63823
  Gene Ontology: Mol. function=ubiquitin-protein ligase activity; Cellular component=ubiquitin ligase complex; Biological process =protein ubiquitination
  Homolog annotation: Hit_ID=Q84QD7; Match level="QueryCoverage=99%, HitCoverage=91%, E-value=0.0, Identity=65%"; Hit description=Avr9/Cf- 9 rapidly elicited protein 276
  Pfam annotation: Domain name=Arm; Domain location=410-450; Score =38.8; E_value=1.9e-08; Accession=PF00514.13; Description =Armadillobeta-catenin-like repeat
  Pfam annotation: Domain name=Arm; Domain location=451-493; Score =13.4; E_value=0.26; Accession=PF00514.13; Description=Armadillobeta -catenin-like repeat
  Pfam annotation: Domain name=Arm; Domain location=494-535; Score =19.1; E_value=0.016; Accession=PF00514.13; Description=Armadillobeta- catenin-like repeat
  Pfam annotation: Domain name=Arm; Domain location=553-593; Score =11.7; E_value=0.42; Accession=PF00514.13; Description=Armadillobeta -catenin-like repeat
  Pfam annotation: Domain name=U-box; Domain location=276-350; Score =76.2; E_value=1e-19; Accession=PF04564.6; Description=U-box domain
  Pfam module annotation: Pfam domain module=Arm::Arm::Arm::Arm::U-box; Domain location=410-450::451-493::494-535::553-593::276-350
  Subcellular localization annotation: CTP_CleavageSite=31; ConfidenceScore=5.12e-01
SPTLEAFLAPVDLSDVALVQTLISVANEIVSCFSKRSFFFQRKNSRSLIRKVEVFQLLLEYLRDSQSGSSCLPPTAVLCLKELYLLLYRSKILLDYCAQSSKLWLLLQNHSISGHFHDLNQEISTLMDVFPVKDVLLSKDVREQVELLQKQSRRAKLFIDMKDDALRLRFFSFLDEFENGGIPDSAELGSFYVEKLQIVDAASCRTEIEGLEEQIVNHEGDIEPTISVLNGLVAMTRYCRFLLFGFEEDELGFESGSQKKPKRRLITQEIAETFLTVPKDFCCPISLDLMRDPVIISTGQTYDRSSISRWMEEGHTTCPKTGQMLAHTRLVPNRALRNLIVKWCTAHGVPLEPPEVMDAMGEVFPSACPTKAALEANRATATLLIQQLAGGSQAGKTVAAREIRLLAKTGKENRAFIAEAGAIPYLRNLLSSRNAVAQENSVTALLNLSIFDKNKSRIMDEEGCLGSIVDVLRFGHTTEAKENAAATLFSLSAVHDYKKIIADEMRAVEALAGLLQEGTPRGKKDAVTALFNLSTHTENCVRMIEAGAVTALPIGAKAVVNEESAVAGLIGMMRCGTPRGKENAVAAMLELCRSGGAAATERVVKAPALAGLLQPFFLRGQNAQEEKQLHLQEFFRD

SEQ ID NO: 180602 - protein, 79 aa, Glycine max
  Coding DNA Sequence Number=SeqID_63824
GEGFAERWLGRWWWFTEGEGGAERWLGRWWWFTEGEGGAERWLVVASGGLAVGIPTVRIHLCPLSLTCTVINAAFKGHN

SEQ ID NO: 180603 - protein, 499 aa, Glycine max
  Coding DNA Sequence Number=SeqID_63825
  Homolog annotation: Hit_ID=Q1RVI7; Match level="QueryCoverage=36%, HitCoverage=72%, E-value=1e-40, Identity=50%"; Hit description =Fasciclin domain, putative
  Pfam annotation: Domain name=Fasciclin; Domain location=328-433; Score=46.5; E_value=9e-11; Accession=PF02469.12; Description =Fasciclin domain
MVALCKETIGHQDIVSSLFKGMQKEKKTINSVELSKAMFDAAQSGNVTILEFLFNNHPDLLFEVDSTKQRSLLHIAILYRQEYVYRLILSKGAFKNVMIQLIDSDGNNVLHLAAEFDSKERLGLPSLPVLMCSEEKWFQEVEKIVPPAMKRMKNNDGLTPKEVYYRSHKDLHTEAASIVKNLANTLLVVAILIVTLGITGAITVPIKDLDSTSSPFFPKKTWYTFFFLSIAFGTWLCASSMFCYASVILPQIMYTAAISGAIVVFDFLSNWSIYLICGFGAPKPPAKPAPATPTPAPAKSLVPSLPQSPFSDSSSNQYNFKILRKTKSFSTLIRLLKTTQIINQVNAQLVTTKSGGGLTILAPDDGAFSHLQAGYFNSLGDRQQKALIQFHVLPVSVSSSNFDSLSNPVMTLASIMYSDKTLAIHHVDTVLIPLYFSKPKPPAPAPTLAKAPKADKDNSSAQDDDQGESNKATSAANAINLISIHGTMLVSLGVALVAA

SEQ ID NO: 180604 - protein, 68 aa, Glycine max
  Coding DNA Sequence Number=SeqID_63826
MATSRWALKHPVYGIVILRLGIYTDRPNVMQSYPARALGRRLQVDWARDPREGPRVLMGLRVDFKPMG

SEQ ID NO: 180605 - protein, 231 aa, Glycine max
  Coding DNA Sequence Number=SeqID_63827
  Homolog annotation: Hit_ID=Q9FMD0; Match level="QueryCoverage=51%, HitCoverage=20%, E-value=4e-09, Identity=30%"; Hit description =Genomic DNA, chromosome 5, P1 clone:MUK11
MVALCKETTGHQEIASLLFNAMDNEKECLSYVQLSTAMFDAAKSGNIMILEFLLKDHPDLLFEVDCKEQRSLLHIAMLYRQESVYRLILNKGDSKKVMIQLIDFEGNNILHLAGMPARPEERFGLSTDHVLMHSEERWFQSHKELHKEAVSEVKDAANTLVVVATLVISLGITAGMTISVNDIDAILPSSWEPKDDSVHLRQTKLVFGNITLFGVSCNHVYCYCFRFHIDL

SEQ ID NO: 180606 - protein, 163 aa, Glycine max
  Coding DNA Sequence Number=SeqID_63828
HLTETCMRAGNTDIYGFLEPQSIQRSGQSQFESESYIKSWKQSSQCDVYLGAYLNGFHCSGHWQMVVILPKEHLVVCAFKGLDDAPQPKSKASARWIVVKCNRQKESTECDYYVMHWMSTIILGTFRNNWEAYFNDARPLEPERLKALQIQWAQYYLRVRDQT

SEQ ID NO: 180607 - protein, 329 aa, Glycine max
  Coding DNA Sequence Number=SeqID_63829
  Gene Ontology: Mol. function=transferase activity
  Homolog annotation: Hit_ID=Q1S9Q3; Match level="QueryCoverage=81%, HitCoverage=56%, E-value=2e-22, Identity=29%"; Hit description =Ankyrin
MEEEKEPLNSEQLSKVVFDAAKSGNIMILECLLKYHPDLLFEVDSREQRSLLHIAILYRQESVYQLILSKGDSKNVMIQLVDSKGNNVLHLAAGELAPEERFGLPNHVLMAREENWFQEVEKIVPPAMKTMKNERGFTPKEVFYQLHNELHKESVSAVKDAANTLIVVATLVITLGITGALSIPIKDVDSTLTPIFRKKTWYTLYFLAIEVGNYLCAASMMFYGSVIIPSSWEPKYEGVLLRQRKLMFGNMALSASLGLMFTAIVSGAILIYDFLSDWLFYFIAGLGCITLISPKLIRNIYEAYHPLQSVKNCNGSESSTFTGYGVFAV

SEQ ID NO: 180608 - protein, 213 aa, Glycine max
  Coding DNA Sequence Number=SeqID_63830
  Homolog annotation: Hit_ID=Q9FFL9; Match level="QueryCoverage=73%, HitCoverage=54%, E-value=3e-14, Identity=32%"; Hit description =Arabidopsis thaliana genomic DNA, chromosome 5, P1 clone:MIK22
  Pfam annotation: Domain name=Ank; Domain location=122-155; Score =19.1; E_value=0.016; Accession=PF00023.20; Description=Ankyrin repeat
  Pfam annotation: Domain name=Ank; Domain location=156-186; Score=0.5; E_value=27; Accession=PF00023.20; Description=Ankyrin repeat
  Pfam annotation: Domain name=Ank; Domain location=84-116; Score=15.9; E_value=0.15; Accession=PF00023.20; Description=Ankyrin repeat
  Pfam module annotation: Pfam domain module=Ank::Ank::Ank; Domain location=122-155::156-186::84-116
MSDSGAVTLPAVDDIPKHENCSELGIVVAEAEHLQSLEPESSFLELDRTHKRQIYIAASSGNWSEALSYFKIHPHWWRIPLTSRGVTALHVAVSMRKTSFVEKLVDRVDRMNMQDLEIRMADGNTAFCLAAITGNVKCAKILLGKNPGLLWIRDHKDMLPIQLSSSAGHIPMTELLFEAQDDLHNNIPFHDIVNLFFLTITNNIHSKLIHINF

SEQ ID NO: 180609 - protein, 174 aa, Glycine max
  Coding DNA Sequence Number=SeqID_63831
MGSSQKPSLKKRFYQVKNQELRGHQFTKVGAINGSTFNGKPSAKPMGVLFSNVDGLVDLAAIDAFLAYHNHKESPVVAMLADLYDTFDRGCEKSSARIVCCALALYVWLVSHLFLQEGRPVYPLQGHRSCIEKGKANWDQLLASMEGRLLICSLARRKEESGFYLHAKDVQMFP

SEQ ID NO: 180610 - protein, 38 aa, Glycine max
  Coding DNA Sequence Number=SeqID_63832
MWKGQLDIEAEEGVLSREPAKERGEGSSAGSGGKKVPK

SEQ ID NO: 180611 - protein, 162 aa, Glycine max
  Coding DNA Sequence Number=SeqID_63833
MAEETNKAIQWRMPMPVEEKKGTKFQSAEEEACHCIHRRRRKKTNLFGRKEKNETKEEEACREVAGCTGEEGKRRRKRYFRKFIQLLGAPAILLGAPSNSQSGNPSNICFIQTKHILLIGLLLPAPPLWLPEVILPAPKKLILEKAKCNFIFWIDTRSNSWG

SEQ ID NO: 180612 - protein, 191 aa, Glycine max
  Coding DNA Sequence Number=SeqID_63834
MTRTKKICQMTSKVAKEIVDKIASQGSFVTDGRQNVLTTAIGRPKHPGRVRAARVGVTIKQHFGLAPMTSCSQMQSQGLALSPEPEVDPSAACVSTKESYVNPIGNDPNTSDSEKCGLCIKENSLRLALNTFITSLTHLVKRFSEQGVVGPEKPTNRSDHDVMWEATVFEVFNDNFPLYIKHKDVSEIAHG

SEQ ID NO: 180613 - protein, 100 aa, Glycine max
  Coding DNA Sequence Number=SeqID_63835
  Pfam annotation: Domain name=Phage_AlpA; Domain location=41-90; Score= 41.8; E_value=2.4e-09; Accession=PF05930.2; Description=Prophage CP4 -57 regulatory protein (AlpA)
MAHGQVDRRVGRIQPQHVRPVSILKRCSTSGRGTLMREQGESLLPLKVVQSRVGMGKTKIYEQIKAGAFPACIKNGRTSVWVASEIENWIQKTVQQGRKG

SEQ ID NO: 180614 - protein, 173 aa, Glycine max
  Coding DNA Sequence Number=SeqID_63836
  Homolog annotation: Hit_ID=Q1JWY9; Match level="QueryCoverage=54%, HitCoverage=63%, E-value=8e-12, Identity=33%"; Hit description =Hypothetical protein precursor
MTRTHITRLVASVLSVALVVAGFWYGRNIPFATQWPLYEALGTTAAIIFARLRFSGRRDSEVAANPERGEGIGRFFTPIAHSTAILCLILLIGIVAPIAKQLPIVLEHVVVARSLAYGVLVSLTLWQLWTVVLTLVPADEIKRASDNEDRRRDLVAPLTKLGSVVRRGDGPAR

SEQ ID NO: 180615 - protein, 188 aa, Glycine max
  Coding DNA Sequence Number=SeqID_63837
  Homolog annotation: Hit_ID=UPI00005F9210; Match level="QueryCoverage =82%, HitCoverage=63%, E-value=1e-58, Identity=71%"; Hit description =COG1196: Chromosome segregation ATPases
MPPLIRLFTSAGDFMVRKALLAALLLAAAQAHADYQCSVNPKDDVIIKPQSVQVVGSNGNLEITPQGDVQFNGKSVSVDNATRQQAIDYQNALRRDLPWVDSGATTRLERGRVALDKVIVEKLGSDSNVRNRLTTLNGQLKQQMNRIIEHRPDGLTFHHQAIEQVRADGEKLVQSTLGGVLQDSLNEM

SEQ ID NO: 180616 - protein, 354 aa, Glycine max
  Coding DNA Sequence Number=SeqID_63838
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=99%, HitCoverage=53%, E-value=6e-49, Identity=34%"; Hit description=D -galactoside/L-rhamnose binding SUEL lectin; Integrase, catalytic region; ...
  Homolog annotation: Hit description=Galactose-binding like; Peptidase aspartic, catalytic
WSLNAQNKIRGRKRWGYISGTKVAPKNKKSNEYEAWEDENCLTYPVSQDVSRSYQPYREVISTQQNGSSVITYFVHGRILATTPLPNVQSVHAIVCVEANRQEPMLDSESTMGTAIDVKKYSKKGIHKCTRCNGDNHVVETCFKLHGYPNWHPKGKTTPNTKVDATSKSHISIVAGFVTKSGSEPIPKMDNSFLDNIVSSDHNQLAQSSPQVRLDSSEVSSDPISDNTNVDETDREIVSLDPTLDNTNLDGTNHEIDPCLCEITSNPNNESTIVQYNLPPCSNCGQPPAKYEPDLQAKVKKLWQILDGPKQWLMRWQLQTKNNTWNLVSLPREKKIVGCKWIFTIKRKTDETIE

SEQ ID NO: 180617 - protein, 163 aa, Glycine max
  Coding DNA Sequence Number=SeqID_63839
MKRWWATHPQSFADLVFANERIDVGPKRGKFDHPTRTTEKNGANKKGEKEGETHAVTAIPIRPSFPPTQQCHYSANNKPPPYPPPSYPQRPSLNQPQSMSTAFPMTKTTFSTNQKHQQKGILQQKACRVHPKFRCHMLNLIPYPLDNSMVAITPTKVPQPPFF

SEQ ID NO: 180618 - protein, 181 aa, Glycine max
  Coding DNA Sequence Number=SeqID_63840
MMHREIEVYVDDIIAKSKTEEEHLVNLRKLFKRLRKYQLRSRIVLGSGQNAEMGLKAEINQVNIGCLIYPEGVRVSSPGRSTPARDGLKEGEGNVFFTQNSPPPPPPHFQKTQSHETCCFCAPKPPLVSFCFHFCTFAHSLQGMAVGLFYILKCMGMLHCPRASFFHVQPCAHQVFGEMPQ

SEQ ID NO: 180619 - protein, 75 aa, Glycine max
  Coding DNA Sequence Number=SeqID_63841
  Gene Ontology: Mol. function=tRNA isopentenyltransferase activity; Biological process=tRNA processing
  Homolog annotation: Hit_ID=Q1W5W4; Match level="QueryCoverage=60%, HitCoverage=14%, E-value=3e-11, Identity=66%"; Hit description =Adenylate isopentenyltransferase
MWKRNMHRLDATEVFLKNATRQEEAWEDHVLSKSRRILHKFLYEDTHVVPACIAASVVIASSLPAMAAAAAAATH

SEQ ID NO: 180620 - protein, 116 aa, Glycine max
  Coding DNA Sequence Number=SeqID_63842
  Gene Ontology: Mol. function=peptidase activity
  Homolog annotation: Hit_ID=O81060; Match level="QueryCoverage=86%, HitCoverage=5%, E-value=2e-21, Identity=49%"; Hit description =Similar to late embryogenesis abundant proteins
LFEFLKGLVGGVIFIFSIHVVNALLGCASFSWPHIPTSLDAITWLKVYGHMGLVVVQGTVMASAIAVVEELLFRSWLPQEIEVDLGYHQGIIISGLAFSFLQRYGLIHSQPHSNSA

SEQ ID NO: 180621 - protein, 73 aa, Glycine max
  Coding DNA Sequence Number=SeqID_63843
MGMKRLPPFLCRAPDKDIDKSQSPVDVGLNHHPQDCTSSNPQATKKPQLSRAKGCLQLRQLFQHPYFRYLVQS

SEQ ID NO: 180622 - protein, 1455 aa, Glycine max
  Coding DNA Sequence Number=SeqID_63844
  Homolog annotation: Hit_ID=O81060; Match level="QueryCoverage=93%, HitCoverage=78%, E-value=1e-137, Identity=36%"; Hit description =Similar to late embryogenesis abundant proteins
  Subcellular localization annotation: CTP_CleavageSite=21; ConfidenceScore=5.60e-01
MLVLALTSFAPAANPFRFRPRAFCRRRLKINNSLPPPPSPAVPFENLFHSLITQFPSVNSLNFITPALGFASGVALFFSSRSNDSDSTLSDIGEWILFASPTPFNRFVLLRCPSISLEGERLVREERHYVRGGRIEVRSGRERELEELSYQRVCVSAADGGVVSLDWPDNLQLEEERGLDTTLLLVPGTPQGSMDPNVRLFVVEALSRGFFPVVMNPRGCAASPLTTPRGTATLHFHLPFSSSQPTKGLSTSLPSSSFSPFSNPGLLNYFIFCRLFTAADSDDICIAIMYINNARPWTTLMGVGWGYGANMLTKYLAEVGERTPLTAVTCIDNPFDLDEATRSSPYHIVTDQKLTDGLIDILQTNKALFQGKTKGFDVEKALLAKSVRDFEEAISMWLTAVELGLLKGRHPLLTDIDVSINPSKGLVVVEEVRSNKDAKVGTLLDLTRSDAFNGYSADPTKDLLEENENNTGLQFNSQQGLKRNFEQDDMNLQVKDGPLQQTRSSDADLIEEENVVSADSEHGQVLQTAQVVINMLDITMPGTLTEERKNKVLTAVGQGETLMKALEDAVPEDVRGKLTDAVTGILHARGSKLKVDRILNISQAPESVSGQKNQEKFRVSGAEVMVEDQPSVNQMKKTSSPIDGSDDAPGSIGKLAEGTETEVIPIEKSPNSTNLAQSQESNDEVSSSGSLRKETDESNDNNDTNEESKGKSVPDIDHIKNGLETGSKPYTPGLPDGAGGFESAAVGEQKSQNSGIAQADPKEENTILKDEQKSQDFSSDHSKNTSTDAKEEPSSPSMSSEHQTIEREGNDSEKKDNKNMQHVSHQTHSNNLASNAPAFSVSQALDALAGMDDSTQVAVNSVFGVIENMISQLEQSSENEEVEDGKDVEQKIEEKQKTNRQTKDSNTSADPSVDDHHNDMHLNNGSCHTEEQPSQSLSEINGNRIFNAQSCNSNDHLVQKENNTNTQLIDKRFLIGKWDGHRHMDRMPEFIAGGSYGGSPYNENFHKYLVSKIPIKPLDLGTTTALLLDYFPEEGQWKLFEQPQNMEIASSHTETSEEAGPKMKAPSSAKSSNAEKYIEPPYVILDAEKQQEPVKEFITTDTENRMTDTSDDRSDELMQFVKQSVLHSLKMEVSRKLNASEMIEMKSKLAEDMEHVANAISKAVVHSKVQQLYTEESKVQQLYTEESKVQQLYTEIQGRNVEGAIEKVGTLEGEHVINVISSSIQQTDCLRKVVPVGVLAGSILASLRKYFNVTTLQDDHRRSLIHDDEEKPSTKNYGNEGVTEIDQVPDEKTSLDHPIQTERIESASKDTSKNTVMVGAVTAALGASALFMQQKDPQQENETAESSSTSLKMNNCHKKEPERLQEEVSEKNQNNIVTSLAEKAMSVAGPVVPTKEDGEVDQERLVAMLADLGHRGGLLRLVGKIALLWGGIRGAMSLTDRLLSFLRIAERPLFQ

SEQ ID NO: 180623 - protein, 447 aa, Glycine max
  Coding DNA Sequence Number=SeqID_63845
  Gene Ontology: Mol. function=enzyme inhibitor activity; Cellular component=cell wall; Biological process=cell wall modification
  Homolog annotation: Hit_ID=Q69Y54; Match level="QueryCoverage=91%, HitCoverage=82%, E-value=6e-98, Identity=42%"; Hit description =Putative pectin methylesterase
  Pfam annotation: Domain name=PMEI; Domain location=17-146; Score =41.8; E_value=2.4e-09; Accession=PF04043.6; Description=Plant invertasepectin methylesterase inhibitor
  Pfam annotation: Domain name=Pectinesterase; Domain location=182-433; Score=489.0; E_value=5.7e-144; Accession=PF01095.10; Description =Pectinesterase
  Pfam module annotation: Pfam domain module=PMEI::Pectinesterase; Domain location=17-146::182-433
  Subcellular localization annotation: CTP_CleavageSite=44; ConfidenceScore=5.18e-01
MPMILSWSSSKNKNSFNSSKLSISISINPNIINTLLKSLQAAISGATKLSDLLNNAGNNIIDNKIGAVQDCRELQQSTLASLKRSLSGIRSQDSKKLVDARTYLSAALTNKDTCLESIDSASGTLKPVVVNSVISSYKDVSESLSMLPKPERKASKGHKNRRLLWLSMKNRRRLLQSNDGGELVVAADGTGNFSFITEAINFAPNDSAGRTVIYVKEGTYEENVEIPSYKTNIVLFGDGKDVTVITGNRSVVDGWTTFRSATLTVSGEGFLARDIAFENKAGPEKLQAVALRVNADFTAFYRCAMYGYQDTLYVHSFRQFYRECDIFGTIDYIFGNAAVVLHASKIITRMPMPGQFTVITAQSRDSPDEDTGISIQNCSILATTDLYSNSGSVKSYLGRPWRGTDNRVNWAGYHVMDYDSAYNFTVSEFIIGDAWLGSTSFPYDDGI

SEQ ID NO: 180624 - protein, 603 aa, Glycine max
  Coding DNA Sequence Number=SeqID_63846
  Gene Ontology: Mol. function=enzyme inhibitor activity; Cellular component=cell wall; Biological process=cell wall modification
  Homolog annotation: Hit_ID=Q9MBB6; Match level="QueryCoverage=99%, HitCoverage=100%, E-value=0.0, Identity=55%"; Hit description=Pectin methylesterase
  Pfam annotation: Domain name=PMEI; Domain location=79-231; Score =107.2; E_value=4.7e-29; Accession=PF04043.6; Description=Plant invertasepectin methylesterase inhibitor
  Pfam annotation: Domain name=Pectinesterase; Domain location=292-588; Score=686.6; E_value=1.9e-203; Accession=PF01095.10; Description =Pectinesterase
  Pfam module annotation: Pfam domain module=PMEI::Pectinesterase; Domain location=79-231::292-588
MAFQDFDLISERRRNEKRQKARKRIMIGVVSSVVLVAMIGAVLFVVVRNDNEAGNKKSNENKSHGHSQQSTTPGKDHVVAHSKMVKLVCSSADYKEKCEDPLNKAMEDDPKLTQPKDLLKAYVKFAEDEVSKAFNKTISMKFENEQEKGAFEDCKKLFEDAKDDIATSISELEKIEMKNLSQRTPDFNSWLSAVISFQQNCVDGFPEGNTKTELQTLFNDSKEFVSNSLAILSQVASALSTIQTLARGSRSLLSENSNSPVASLDKADGLPSWMNHEDRRVLKAMDNKPAPNVTVAKDGSGDFKTISECLNAVPQNFEGRYVIFVKEGVYDETVTITKKMQNITMYGDGSQKSIITGNKNFRDGVRTFLTASFVVEGDGFIGLAMGFRNTAGPDGHQAVAARVQADRAVFANCRFEGYQDTLYTQAHRQFYRSCIVTGTIDFIFGDAAVVFQNCIMVVRKPLENQQNMVTAQGRVDKQQVTGIVLQKCTIKADDSLVPEKDKIRSYLGRPWKEFSRTIVMESEIGDFIHPDGWTAWEGDFALKTLYYAEYGNTGPGASTNARIKWPGYQVINKDEASQFTVGSFLRGTWLQNTGVPATQGLYN

SEQ ID NO: 180625 - protein, 78 aa, Glycine max
  Coding DNA Sequence Number=SeqID_63847
MMIMKLNVLQETFASIYFLAVYFDVKSLYKMSDDLEIGSGNYMEIMSMSASNQCSIYLRVFTHKIAYYYQQEYGSLGK

SEQ ID NO: 180626 - protein, 248 aa, Glycine max
  Coding DNA Sequence Number=SeqID_63848
  Homolog annotation: Hit_ID=Q0PN09; Match level="QueryCoverage=83%, HitCoverage=90%, E-value=2e-57, Identity=59%"; Hit description =Lateral organ boundaries domain protein
  Pfam annotation: Domain name=DUF260; Domain location=11-125; Score =53.0; E_value=1e-12; Accession=PF03195.5; Description=Protein of unknown function DUF260
MDISAAEVEMCRIQRRRKHPCAETRSRSRQRHWNLTLMQTEKWIETAEAQGHATVFVAKFFGRAGLMSFISNVPENQRPALFQSLLFEACGRTVNPVNGAVGLLWTGNWHVCQAAVETVLRGGTLRPMPELMGLDAAAAAAAAADETSEAEVGCTDTWRIRNPNTNCRFTSSRSSSGGGGGKRKRSEELAKLQEQQPNLDLRLTPVFLQKEESRRPESPSMTSEESGTTTENRFGDQWSHWKVLNLFI

SEQ ID NO: 180627 - protein, 196 aa, Glycine max
  Coding DNA Sequence Number=SeqID_63849
  Gene Ontology: Mol. function=DNA binding; Cellular component =membrane; Biological process=DNA recombination
  Homolog annotation: Hit_ID=Q31IU7; Match level="QueryCoverage=99%, HitCoverage=28%, E-value=1e-22, Identity=36%"; Hit description =Putative integrase
MGDIVQFVPRVEKDADANLMEFIRLTREELTAFGGDGSWVDDRWQDGATTVVFATKTAPLDPYSFTPMAEPFKQFAKAYVRYSWSHRPVRNLSSMILALRCVEAGLLAACGRADVGLLGIAAMDVCANKCAEFCGTKQIQYAVGRHIQLIFDFLRDKKLVRFLPLWKSPFKKPAILTEGVGEAGAAYRASKLPSTQ

SEQ ID NO: 180628 - protein, 115 aa, Glycine max
  Coding DNA Sequence Number=SeqID_63850
VMGSQGETVSACEDREASPPASTRARRPGPRSWAGGPVPRDEYQAQGQTRNSSRGTGTRNGESVVVTGAMILKKSVDLKDPTKGESWCDMGEEFINLGGEMELLLGEAKKSLLKA

SEQ ID NO: 180629 - protein, 939 aa, Glycine max
  Coding DNA Sequence Number=SeqID_63851
  Gene Ontology: Mol. function=RNA-directed DNA polymerase activity; Cellular component=chromatin; Biological process=chromatin assembly or disassembly
  Pfam annotation: Domain name=zf-H2C2; Domain location=574-615; Score =20.9; E_value=0.0006; Accession=PF09337.1; Description=His(2)-Cys(2) zinc finger
  Pfam module annotation: Pfam domain module=RVT_1::zf-H2C2; Domain location=193-376::574-615
EHGLCFSCDEKLHRGHRCAPRVHLLIVEDDDPPDPDSSKIDGTDPAPVSPDGPDPYLAQISLILSRATSHLKHSGPRHSAWSSLSSHFSFESHGTDVVLGVQWLQSLGPATTPTTTTTHLSPELQALLIQFDALFQPPQGLPPVRDTDHYIHLISQATLVNIRPYRYPYYQKHKIEIQVDSMLQQGLIQPSTSPFLSSVLLAKKHDGSWHFFVDYRTLNAFTIKDRFPIPTIDELLDELGGARCFSKLDLLQGYHQIQMHAASIPKTTFRTHHGHYEFKGMPFGLCNAPSSFQATMNLIFRPYLRQFIIVEYLGHMVSHQGVELVASKIAAIHQWPQPRSIKALQSFLSLVGFYRRFIRGYATIATPLVKFTIVDPFHWTPQAQLAFDNLKHALSTAPVLALPEFNLPFTVETNALRVGMGALFSITSAVKKWRQYLLGHRFTIITDHRNLKELLTKIIQTLEQHMYLARLMGYDYTIQYRSGNYNRATYALSCLPEQESVTFLILSMPCLTFIEELRRQLLDHQKYQLLSQQIRACLDDHQGYSISQDLVMYKGRLWLPRGLPLISTLLTEFHATPTGGHAGVAKTIVRVSENFYWEGLHNDVAQFFAKCVDCQVTKYETKRLTGLLCPLPVPSRPWEDLSLDFIVDLPLFHGNSAPRGILCSSADFGKNFFGQVAHNYGWALPTIHRVMWSHNTSLNGGSGTTPFEITFGRKPFNFPKYVVGTLKIDAVEESISDRETTFQAIRKKLIKAQERMKLYADKKRREVTYECGEWVLLKLRPHRQTSAKGSQAIIGKLAKRFYEPFQITKRIGPVAYRLQLPENARIHPIFHCFMLKSFKGSPENIKPAELPPNFADEQPLLSPLAILGRRRTSSEPNSPWEDKVTLQGLRDDTRATKEMTQAINTKAEKEEKDKPASQQCNAILLDSLEFGFAIVDPRG

SEQ ID NO: 180630 - protein, 349 aa, Glycine max
  Coding DNA Sequence Number=SeqID_63852
  Gene Ontology: Mol. function=hydrolase activity, acting on carbon -nitrogen (but not peptide) bonds, in linear amides; Cellular component=cytosol; Biological process=metabolic process
  Homolog annotation: Hit_ID=Q9SZE9; Match level="QueryCoverage=99%, HitCoverage=82%, E-value=1e-179, Identity=83%"; Hit description =Formamidase-like protein
  Pfam annotation: Domain name=FmdA_AmdA; Domain location=1-310; Score =561.3; E_value=9.6e-166; Accession=PF03069.5; Description =AcetamidaseFormamidase family
VHYLSGPIRILDNDGVPAQPGDLLAVEICNLGPLPGDEWGFTATFDRENGGGFLTDHFPCATKAIWYFEGIYAHSPQIPGLTHPGIIGTAPSMELLNIWNERERDVEENGIKSFKLCEIRKGTSEWDKIAKEAARTIPGRENGGNCDIKNLSRGAKVYLPVFVEGANLSTGDMHFSQGDGEVSFCGAIEMSGFLELKGGMKEYLTPMGPTPLHVNPIFEIGPVEPRFSEWLVFEGISVDESGRQHYLDASVAYKRAVLNAIDYISKFGYSKEQVYLLLSCIPCEGRISGIVDAPNAVATLAIPTTIFDQDIRPKNNKVPVGPRLVRKPDVFKCTYDGNLPITRNPSATS

SEQ ID NO: 180631 - protein, 128 aa, Glycine max
  Coding DNA Sequence Number=SeqID_63853
  Gene Ontology: Mol. function=protein serine/threonine kinase activity; Biological process=protein amino acid phosphorylation
  Homolog annotation: Hit_ID=Q1EPE8; Match level="QueryCoverage=55%, HitCoverage=18%, E-value=4e-30, Identity=83%"; Hit description =Casein kinase II alpha subunit (Protein kinase), putative
MAQKIGKSTRRPGASSKARVYADVNVVRPKEYWDYESLNVQWGEQDDYEVVRKVGRGKYSEVFEGVHCTDGEKCVIKILKPVKKKKAVNVNVMQVALVLQSSSSCFHLVTQNKDALVAEGCLVVYFKV

SEQ ID NO: 180632 - protein, 222 aa, Glycine max
  Coding DNA Sequence Number=SeqID_63854
MDPPPPLRQLKHHIPEPSEHPRHQFHPPCHLQHYSPLTNNVTVFQNYGLIPFMSLKLPYYPELVRVFYSNLKIQDGNLISELPSQGAPFEGTIVDDWKFDYSNHDARHMYIIVRILHPRSSNLAQASEEDLIIMWAFLIGHQIDWAHLIRYRMHKALQSSAPLPYPQLVTLFLRHFQVPLDNEPFVQVKRSYAIGVGAVISFDYRKEMDGQWLKKGCTISAR

SEQ ID NO: 180633 - protein, 168 aa, Glycine max
  Coding DNA Sequence Number=SeqID_63855
  Gene Ontology: Mol. function=binding; Cellular component=outer membrane; Biological process=cellulose biosynthetic process
  Homolog annotation: Hit_ID=Q6CYY1; Match level="QueryCoverage=81%, HitCoverage=33%, E-value=5e-29, Identity=48%"; Hit description =Cellulose synthase protein C
  Pfam annotation: Domain name=TPR_4; Domain location=113-138; Score =12.1; E_value=1.4; Accession=PF07721.5; Description=Tetratricopeptide repeat
  Pfam annotation: Domain name=TPR_4; Domain location=63-88; Score =18.1; E_value=0.032; Accession=PF07721.5; Description=Tetratricopepti de repeat
  Pfam module annotation: Pfam domain module=TPR_4::TPR_4; Domain location=113-138::63-88
MNKLPLALLIASALAGSVAAAPGPQVAPVAWLLMQIRTGESTNKYDLVQQSLYRLEKIDPDNPQVLAARIRMALRQGDQAKAQQLFDALQKAAPDDAATRESAAGLRLMSPEGRQQLQQARLLATAGRLPEAKAAWDALFHGVFPDVNTELEYWRLVARLPGQQPLAW

SEQ ID NO: 180634 - protein, 82 aa, Glycine max
  Coding DNA Sequence Number=SeqID_63856
MAKFDPDIVLEFYANAWPIEEGVRDLRSWVKGPVDSFRCRRPKSIPGIPASIGGGPECEYGQRRTGQMDLMRRSSLSCYAYQ

SEQ ID NO: 180635 - protein, 66 aa, Glycine max
  Coding DNA Sequence Number=SeqID_63857
  Subcellular localization annotation: CTP_CleavageSite=14; ConfidenceScore=5.21e-01
MKLASTKSAMPSTRALSKSRESGRAYATQARVYRDINLLSRLNARLALSSYSLTPAKRENGTKRDL

SEQ ID NO: 180636 - protein, 123 aa, Glycine max
  Coding DNA Sequence Number=SeqID_63858
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=99%, HitCoverage=15%, E-value=4e-26, Identity=46%"; Hit description =Putative Na/H antiporter
MAYRSINQNVLANAPCSVGILVDKGLSGSNRLAGNQVSHHVVVLFFGGPDDREALCYGWRMVEHHGISLTIMRFVQSDQVQVEPLRQQHGGIDLDEPRHDEKLIHEFRIRCGDDDAVDYVEKV

SEQ ID NO: 180637 - protein, 254 aa, Glycine max
  Coding DNA Sequence Number=SeqID_63859
  Gene Ontology: Mol. function=DNA binding
  Homolog annotation: Hit_ID=Q1SDS1; Match level="QueryCoverage=77%, HitCoverage=36%, E-value=1e-19, Identity=31%"; Hit description=IMP dehydrogenase/GMP reductase
MGQLQRQAFHKTYGKIWDLAAIDAFLAYHNHKESPVVAMLADLYDTFNRRCEKSNTKIVCCTLALYVWLVSHLFRQEVRHACLLESHRSCTEKKGANWDQPLANKEGASINWFPRWKEGRVGVLISCGGFPNVPLMGTRGCISYNPVLVIRPLGYPMRRAPLEEELAPIITRGFNKTNMEALQKVRKAWEMVQKKDKELRGSNNGPIGDYRKWLKAHMQGLDWLPSLRTAKREEVEAPEEDKEVQALRVELKQG

SEQ ID NO: 180638 - protein, 139 aa, Glycine max
  Coding DNA Sequence Number=SeqID_63860
MGAKYLEVVKRGLHPNNGWSPDEIRAKDLTSALSKQLVWASYSSPGRVDTWASATNSLGRGLGSSSSMDSFASSKMNGSGMEREERERRRHFKEKMSLEEAHHHRRPWIRAWRKKEMNEGRGREEHEILCSKRALNFEV

SEQ ID NO: 180639 - protein, 494 aa, Glycine max
  Coding DNA Sequence Number=SeqID_63861
  Gene Ontology: Mol. function=phosphatidylinositol phosphate kinase activity; Cellular component=mitochondrion; Biological process =phosphatidylinositol metabolic process
  Homolog annotation: Hit_ID=Q1RTC2; Match level="QueryCoverage=100%, HitCoverage=27%, E-value=1e-146, Identity=56%"; Hit description =Chaperonin Cpn60/TCP-1; Phosphatidylinositol-4-phosphate 5-kinase; Zinc finger, FYVE/PHD-type
GANGDELKKVKHVIQYGIFAAYHLALETSFLADEGASPLEFPLKSPITVALPDKPSSTVRSISTIPGFSVLTARESQGAKPFKEVPKSNDIYKTERTPSSCSESTERLLVGDSIHMHEVSGGITQLALDMPSSNCNSFVSNTSSKENDKKCPKEFFQYRPDERRETMLNNGLISNSFGTFESSQQDGNSHLRAAALFANQGANPEPPNVKHDTNNFNNNNDHDDMIHSKEDFPPSTSDHQSILVFLSTRCVWKGTVCERSHLVRIKYYGSSDKPLGRFLRDQLLDPSYTCCSCELPSEAHVHCYTHRQGSLTICVKKLEFALPGEREGKIWMWHRCLKCPRIHGFPPATRRIVMSDAAWGLSFGKFLELSFSNHAAASRVASCGHSLHRDCLRFYGFGKMVACFRYASIHLHSVYLPPSKLEFNYDSQDWLQKEANELHNKAEILFSEVCNTLHQISEKVSGPVLQEGGNRVSDFRNLIAELKGMLQYEKEEFE

SEQ ID NO: 180640 - protein, 73 aa, Glycine max
  Coding DNA Sequence Number=SeqID_63862
  Gene Ontology: Mol. function=zinc ion binding
  Homolog annotation: Hit_ID=Q5GAQ5; Match level="QueryCoverage=68%, HitCoverage=11%, E-value=1e-14, Identity=70%"; Hit description =Putative senescence-associated-like protein
  Pfam annotation: Domain name=DUF500; Domain location=1-72; Score=2.1; E_value=4.9e-06; Accession=PF04366.3; Description=Family of unknown function (DUF500)
MMFENIANNTECCKTVGAFVGVSLEGNIVATRMDANLRFYGDPYLTTSDILLGMVDRPKAAQPIIASDVINSA

SEQ ID NO: 180641 - protein, 70 aa, Glycine max
  Coding DNA Sequence Number=SeqID_63863
MVIVDGAERMRKDQYLRLGGSECYREKVMASLENEPCHTPSASDQSPFSSPPPPPSNVCMQKFRLYETRS

SEQ ID NO: 180642 - protein, 569 aa, Glycine max
  Coding DNA Sequence Number=SeqID_63864
  Gene Ontology: Mol. function=mannosyl-oligosaccharide 1,2-alpha -mannosidase activity; Cellular component=membrane; Biological process=transport
  Homolog annotation: Hit_ID=Q7XZU2; Match level="QueryCoverage=99%, HitCoverage=69%, E-value=0.0, Identity=63%"; Hit description=SAC domain protein 3
  Pfam annotation: Domain name=Syja_N; Domain location=61-374; Score =320.0; E_value=4.1e-93; Accession=PF02383.9; Description=SacI homology domain
MIGRDKSRTYWKVLKIDRLDPSELNLREDSTTYTESECSDLLRRIHEGNKSTGGLKFVTTCYGIVGFIKFLGPYYMLLITKRRQIGAICGHTVYAVSKSEMIPLPNSSVRSNINFKNENRYKRLLCMVDLTKDFFFSYSYQIMRSLQRNMCDNETGHVLYETMFVWNEFLTRGIRNHLQNTIWTVALVYGFFKQEMLMISRREFTLTLIARRSRHYAGTSFAKLTMSWRRDFLTQYLRRGVNEKGRVANDVETEQIVFEDVAEGLPIQISSIIQNRGSIPLFWSQETSKLNIKPDIIFTYFSPVSKKDQSYQATRYHFENLVKRYGNPIIILNLIKTHEKKPRESILRQEFANAIDFINKDLSDENRLSKATNVLQLLGKVAAYALTLTGFFYCQTTPTLRPEECLKWPSTNNVDKGTFSPTRHVNDDNRVDNRDADENYSVKPPMLQRGVLRTNCIDCLDRTNVAQYAYGLAALGHQLHALGVIDHPKIDLDEPVADDLMGFYERMGDTLAHQYGGSAAHNKIFSERRGQWRAATQSQEFFRTLQRYYSNAYMDAMKQDAINVYVLQS

SEQ ID NO: 180643 - protein, 556 aa, Glycine max
  Coding DNA Sequence Number=SeqID_63865
  Gene Ontology: Mol. function=microtubule motor activity; Cellular component=microtubule associated complex; Biological process =microtubule-based movement
  Homolog annotation: Hit_ID=Q94HF1; Match level="QueryCoverage=39%, HitCoverage=98%, E-value=2e-92, Identity=75%"; Hit description =Eukaryotic translation initiation factor 3 subunit 12
  Pfam annotation: Domain name=SAC3_GANP; Domain location=354-493; Score=127.4; E_value=4e-35; Accession=PF03399.6; Description =SAC3GANP family
MSKVLSEIKDLVAAISTPEEIMAANKDDLIAKITQLKNQGITIASLERKLENVQKSIDKLVSAFSAEETPENKTPLRRKRILPFTLSNSPNMQHIIRAPCSPLSSSRKAMEHEIENRAPENNIGVSGSDSFAKLHKDTPRKDDESCDSVLSREASPATRQSKSVNVKKIPKMFKNVGASEFMLLRGDPSDQIYMEVELRRLTRLEQHLAEVGNATLLGGDEPAGSVSASIRALKQEREHLARKVNTKLTAEERELLYAKLEVPPVGKQRRLQFVNKLWTDPYNMQHVQESAEIVAKLIDFSVSDENSKDLIELNFSSPFNKKQWAGFALRKREMGREKETTKVAYTVEQLVAFNPYNPDILPDLENYVNDQVSSQTYSLDANLCLLRLYQFEPEKMSSQIVARILVKALMAMPAPDFSLCLFLIPERVQMEEQFKTLIVLSHYLEFWDEAAKSRHIVEAVPGFEQAIQGYAIHVLSLTYQRIPRTVLAEAINIEGLSLDKFIEHQVANSGWVVEKSQGRGQLVVLPRTEFNDPALKKNAADSVPLEHITRIFPILS

SEQ ID NO: 180644 - protein, 56 aa, Glycine max
  Coding DNA Sequence Number=SeqID_63866
MEYRSRLENGGHVNDNAIHSRGSGKGREWRIALSSRLENGGHVNDNAIHSRGSGKG

SEQ ID NO: 180645 - protein, 72 aa, Glycine max
  Coding DNA Sequence Number=SeqID_63867
MSHLVVSEQVEPFCHRLTLLWWYISQSFATCLTQKVMAARNEHKRLLTEVEAWERSKYVKFINGLRPNVEMM

SEQ ID NO: 180646 - protein, 127 aa, Glycine max
  Coding DNA Sequence Number=SeqID_63868
  Homolog annotation: Hit_ID=Q9ZU96; Match level="QueryCoverage=78%, HitCoverage=20%, E-value=6e-19, Identity=49%"; Hit description =Expressed protein
MEAKGVRFLAYQSIFSSVGSGDFDGVKKLVEKVKNEEWSSLSDVMSLQNDAGETALYIAAENNLQEIFSFLLSMCDFEVVKIRSKKADMNAFHVAAKRGNLESENPKRFNQNCIAIVFNTIPYMEKY

SEQ ID NO: 180647 - protein, 92 aa, Glycine max
  Coding DNA Sequence Number=SeqID_63869
MGFPLPAVTYLVENLSGLKHSILPPLKRFRYPLLRGKGWGFLLIGQGSKDSKVASQWGFLSWEPDLDIGGKTNLVSRCRSRAELPYYSTRHA

SEQ ID NO: 180648 - protein, 81 aa, Glycine max
  Coding DNA Sequence Number=SeqID_63870
FYGVPIAPSKVIRPPTNRASIKKYCASRQPQGKTPQQPGDGRQQAIDAPPPPLEPLSSSTKAGALPTTHGRPAGDQVQSQR

SEQ ID NO: 180649 - protein, 90 aa, Glycine max
  Coding DNA Sequence Number=SeqID_63871
MEENHKMILKSLGVINATKLVTSRPNVLQMMNGQRKVKRKDLMKEELRKHTLHGMTMIHPMVRKRRLIFKPKIMKVTITSLKNEKQGEKA

SEQ ID NO: 180650 - protein, 261 aa, Glycine max
  Coding DNA Sequence Number=SeqID_63872
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=4e-33, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
IRELHAPTLEELHVLYIRGLPTLSFRGLHVLTFRVLHALTFRGLHVLAFIELHTLTFRGLHVLAFRGLHVLAIRGRHDLAFRGLHVLHFRGLDVLAFKGLHVLAIRGLYTLTVRGLHVLAIRGLHTLIFRGPHALTIRGRHALTFRGLHVLAIRGLGTHTFKGLHALAFRGLHVLAFRGLHVLHFRGPDVLAFRGQYVLAIRELYAPTLKGLHVLAIRGLHALTFRGLHVLTIRGLHALTLRGLHVLAIRGLHTLTFRGLH

SEQ ID NO: 180651 - protein, 320 aa, Glycine max
  Coding DNA Sequence Number=SeqID_63873
  Gene Ontology: Mol. function=RNA-directed DNA polymerase activity; Biological process=RNA-dependent DNA replication
  Homolog annotation: Hit_ID=Q8H6Q8; Match level="QueryCoverage=99%, HitCoverage=51%, E-value=2e-42, Identity=37%"; Hit description=CTV.20
  Pfam annotation: Domain name=DUF755; Domain location=75-170; Score= -43.8; E_value=0.098; Accession=PF05501.2; Description=Domain of unknown function (DUF755)
QHFIGDPSLWKDRSAELLSNLKCRTLADFRWYRDTFLTRVYTREDSQQPFWKEKFLDGLPRSLGDKVRDKIHSQSANGDIPYENLSYGQLISYVQKVALKICQDDKIQRQLAKEKAQTKRDLGSFCEQFGLPACPKQKKKQASRKEAHDHKPANNRRFSKRRYSQKPSTSHISKYCRLKKKLRNLNLEPSIEEQINNLLIETSEEETETETSSSVLSDENLNLIQQDDQLSSTDDDGQINTLTREQELLFEAINSIPDPQEKKVFLEKLKKTLEVKPRQKDFITNNKFDVSNILKRLENSSTKPMTIQDLQTEINNLKRQ

SEQ ID NO: 180652 - protein, 125 aa, Glycine max
  Coding DNA Sequence Number=SeqID_63874
MFYAQQDETSQHLFFNCQFSRDVWSKCYQWAGIQITYHEERSSKKLHAIFYPRGESQDISMLEGVLVCSGIYGVFGFSETIDVEKTIELIKMTSWMWLTAKDKTFSSSWIAWATDPVLCKKGNLL

SEQ ID NO: 180653 - protein, 226 aa, Glycine max
  Coding DNA Sequence Number=SeqID_63875
  Gene Ontology: Mol. function=transcription regulator activity; Cellular component=nucleus; Biological process=regulation of transcription
  Homolog annotation: Hit_ID=Q1PF17; Match level="QueryCoverage=63%, HitCoverage=46%, E-value=1e-11, Identity=35%"; Hit description=Basic helix-loop-helix family protein
MGDDNSNGQSHINSLDQDKLLTGIVLEPEPPNFSFHQSVHHHHSSTMSQNNHHHSNNNVLVPTTSTMGSSTLSYDEDASFDERHGKMLKCNSSNSITISQDIVANSQIPSKSTFILSFENSTVEPALHDRPNYNNSPKHFEATCSSLLSSEITLNSDYIITKSEAKQGAKKHRTSSEIKDHIMAERKRRRELTERFIALSATIPGLKKHAGNNQTAVARTGSLFDD

SEQ ID NO: 180654 - protein, 115 aa, Glycine max
  Coding DNA Sequence Number=SeqID_63876
MSVPPKELPITKLKLEIASSITIKHRKGSSSTNMGKEMEKGICKRVNKEEGPKFLKEVMKLDAKGINPVEESSGKKIAGKGYLTTYNCGNKTSISTRNPLHKIEEAKKWVQIRHE

SEQ ID NO: 180655 - protein, 95 aa, Glycine max
  Coding DNA Sequence Number=SeqID_63877
  Gene Ontology: Mol. function=zinc ion binding
  Homolog annotation: Hit_ID=Q2HV40; Match level="QueryCoverage=89%, HitCoverage=23%, E-value=8e-18, Identity=58%"; Hit description=Zinc finger, RING-type
MQGLGQKFKQPAGTSIDFSTFEESELLKVGDMDVYPIAIKADGSSSDHGDSKSNETPSSGSSNSQITQVVFEKEKGELQVKVVKQILVAYVIMLE

SEQ ID NO: 180656 - protein, 340 aa, Glycine max
  Coding DNA Sequence Number=SeqID_63878
  Homolog annotation: Hit_ID=Q9LDU3; Match level="QueryCoverage=38%, HitCoverage=32%, E-value=1e-47, Identity=71%"; Hit description =Arabidopsis thaliana genomic DNA, chromosome 3, P1 clone: MJK13
MGQYTPLDQVLIFVLAMVTNMMSCSHVLYRNSEGKGYCGALGHGDEIDNTTPELLISLKNQLDVQVCTRKRKTFVLVNSGLVYGFGSMGFGSLRFLDRRVSDKVLKPRILDTMRAHHVSQISTGLYHTVLLSLMNKRYKEENKVPKGCDGNLIDPSSYRDIMRDEKSEDIAEASFRRKYTMKPERDRIEAKMIGRTQANPFGEQSNPKGFQRPQPSVGGCLSNCQEELKKVIKESLVRQNMFPKTSERLNSGSETFSTSTSQYFVVRTNSLFDPSFLAIAPKMEKAPSLIFKLMGLEEAPSKSFPVESFVKEPKLHVLHFNDTNSKQFGDLSHIALMKPR

SEQ ID NO: 180657 - protein, 155 aa, Glycine max
  Coding DNA Sequence Number=SeqID_63879
MDAPDLPEDDEDPLPDIDSPEDIMLASEKPLARTHRTPYRRKLKENPTLLLEPWLEENPTYTPLLGTRVLKHSSVLKAQSFLREVRRTRPHKPNAQASKTVDSVTLRCSTLTTTQEKVHSILLHPRSVFWKHRVKRSVKVPATSNKLADIPPHDQ

SEQ ID NO: 180658 - protein, 285 aa, Glycine max
  Coding DNA Sequence Number=SeqID_63880
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=9e-34, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPLEGYTPFTFRGLHVLTIRGLYALSFRGLRALAFRGLHVLALSGLHAFALGTSTLTFRGLHDLAFRGLHPLTFRGLHTLTFRGLHAFTFRGLHVLTFRGLHVLGFRGLHVLTFRGLDVLAFRGLDALTFRGLHALAFRGLHAFAFKGLHALTFRGLLVLAFRGLDVLAIRGLHILAFRGLDVLAFRGLHALVFKGLDILAFGGLDVLTLSGLHARALGTSTLTFRGLHTLTFRGLHVLAFKGLHALAFRGLHVFTIRGMYALAFRGLHALAFRGLHVLTIRG

SEQ ID NO: 180659 - protein, 186 aa, Glycine max
  Coding DNA Sequence Number=SeqID_63881
  Gene Ontology: Mol. function=catalytic activity; Biological process =metabolic process
  Homolog annotation: Hit_ID=Q10MK9; Match level="QueryCoverage=46%, HitCoverage=15%, E-value=1e-23, Identity=65%"; Hit description=AMP -binding enzyme family protein, expressed
MGIIAGAIKGHTRAIAALELLNVAACDEPLSVIVAVITPNILALYEAYFGIPMARVLLNPHNIRLNASTIAFLLGHCTAAVVIVDQEFFSLAKEALKIWFEKAKTFSPPFLIVIGDENCDLSDEDMTKSKGKDPLEGLGGPMTRARARKAKEALQQVLSILFEYKPKFQGEKSKVVSCIMAQMEED

SEQ ID NO: 180660 - protein, 1047 aa, Glycine max
  Coding DNA Sequence Number=SeqID_63882
  Gene Ontology: Mol. function=ATP-dependent helicase activity; Cellular component=nucleus
  Homolog annotation: Hit_ID=Q9M6R6; Match level="QueryCoverage=59%, HitCoverage=86%, E-value=0.0, Identity=81%"; Hit description=RNA helicase
  Pfam annotation: Domain name=DEAD; Domain location=137-315; Score =220.2; E_value=4.8e-63; Accession=PF00270.19; Description=DEADDEAH box helicase
  Pfam annotation: Domain name=GRP; Domain location=608-685; Score= -6.6; E_value=0.00033; Accession=PF07172.2; Description=Glycine rich protein family
  Pfam annotation: Domain name=GUCT; Domain location=547-643; Score =194.1; E_value=3.4e-55; Accession=PF08152.3; Description=GUCT (NUC152) domain
  Pfam annotation: Domain name=Helicase_C; Domain location=387-458; Score=99.6; E_value=9.2e-27; Accession=PF00271.21; Description =Helicase conserved C-terminal domain
  Pfam annotation: Domain name=p450; Domain location=704-1047; Score= -91.2; E_value=8e-07; Accession=PF00067.12; Description=Cytochrome P450
  Pfam module annotation: Pfam domain module=DEAD::GRP::GUCT::Helicase _C::p450; Domain location=137-315::608-685::547-643::387-458::704-1047
MPSLSLSDPDTPKPIAKKKTKTQSLTDPDLDGVSGKKTKKRKASDLEQEAMPPAAYNNDGDDETSSDLVQPEPASREDDNKNKKKKKKKVVKSEEKEQPLVTEANGEKKEDPNALSNFRISEPLRQKLKEKGIESLFPIQAMTFDTVLDGSDLVGRARTGQGKTLAFVLPILESLINGPTKASRKTGFGRTPSVLVLLPTRELACQVHADFDVYGGAMGLSSCCLYGGAPYQGQEIKLRRGVDIVIGTPGRVKDHIEKGNIDLSQLKFRVLDEADEMLRMGFVEDVEMILGKVENVNKVQTLLFSATLPDWVKQIAARFLKPDKKTADLVGNTKMKASINVRHIVLPCTSSARAQLIPDIIRCYSSGGRTIVFTETKESASQLAGILTGAKALHGDIQQSTREVTLSGFRSGKFMTLVATNVAARGLDINDVQLIIQCEPPRDVEAYIHRSGRTGRAGNTGVAVMLYDPKRSNISRIERESGVKFEHVSAPQPDDIAKAVSGEAAEMIIQVSDSVVPAFKSAAEDLLNNSGLPVIELLAKALAKAVGYTEVKQRSLLTSMENYVTLLLETGKPIYTQSFAYGVLRRFLPEEKVEAVKGLSITADGNGVVFDVAAKDLDIYLNGQENASNVSLEIVKTLPQLQQMEQHQRGGRFGDGGGRGYRFGGRGGGGRNGRFSNGGGRGGRGGNWGGKRCRYFDKKRRYHPVAGTVMHQMFNFHRLLDYMIDRTNQRKTYRLLSFIRTEVYTANPVNFEYILTTNFANYGKGWFHHSVLSDFLGDSIFTMDGEQWRHQRKAASYQFSTKMLREFSIQDLFMKATLDSVCKVVLGVELDTVCGTYKQGTEFSNAFDEVSAAIMYRYFKFLWRIIRFLNIGSEVVLNKSLRVIDEFVYELIRTKIEQAQKLQDNSPVRTSGERRHLVKVYNWKKLIQRKDTISVTLSWFLYELCKNPHVQEKIAQEIRQTTNVEAGSTIDELAARVTEENREKMQYLNAALNETLRLHPAVPVEGKFCFSDDTWPDRYSVRKGDLVSFQPYFMGRMKRVGQMKMEF

SEQ ID NO: 180661 - protein, 92 aa, Glycine max
  Coding DNA Sequence Number=SeqID_63883
  Subcellular localization annotation: CTP_CleavageSite=47; ConfidenceScore=5.10e-01
MKAMLSLSKTSNMEAFSRNVVKGTLQWLGGLRHEKSTSRSQFCTSKNASIKKVQGQRRIESFERTFDKRVNWSGGIAWKRGTWFWLEMASIM

SEQ ID NO: 180662 - protein, 98 aa, Glycine max
  Coding DNA Sequence Number=SeqID_63884
MRSRCRHTPTIEGGVAIWICVVHGQCAPDYMDWFYMISHPFMKLAQPGDPPRHPAVMQDETYMEPDMPKYPVATIAIEEAPAQAPSDVEQPRHVVEAC

SEQ ID NO: 180663 - protein, 165 aa, Glycine max
  Coding DNA Sequence Number=SeqID_63885
  Gene Ontology: Mol. function=protein binding; Cellular component =cytoplasm
  Homolog annotation: Hit_ID=P76270; Match level="QueryCoverage=99%, HitCoverage=90%, E-value=1e-72, Identity=80%"; Hit description =UPF0067 protein yebR
  Pfam annotation: Domain name=GAF; Domain location=13-151; Score=26.3; E_value=0.00011; Accession=PF01590.16; Description=GAF domain
MNKTEFYADLNRDFQALMAGETSFLAMISNTSALLFERLEEVNWAGFYLLEGDTLVLGPFQGKLACVRIPVGRGVCGSAVAQNRVQRVEDVHAFDGHIACDAASNSEIVFPLQVNNQIIGVLDIDSTAYSRFTAEDEQGLAELVSRLETLIAATDYQKIFAHVAG

SEQ ID NO: 180664 - protein, 778 aa, Glycine max
  Coding DNA Sequence Number=SeqID_63886
  Gene Ontology: Mol. function=identical protein binding; Cellular component=cytoplasm; Biological process=negative regulation of enzyme activity
  Homolog annotation: Hit_ID=Q1S0Z4; Match level="QueryCoverage=97%, HitCoverage=97%, E-value=0.0, Identity=78%"; Hit description =Orn/DAP/Arg decarboxylase 2; Protease-associated PA; Proteinase inhibitor I9, subtilisin propeptide
  Pfam annotation: Domain name=PA; Domain location=369-470; Score =105.4; E_value=1.7e-28; Accession=PF02225.12; Description=PA domain
  Pfam annotation: Domain name=Peptidase_S8; Domain location=120-609; Score=72.0; E_value=1.9e-18; Accession=PF00082.12; Description =Subtilase family
  Pfam annotation: Domain name=Subtilisin_N; Domain location=24-109; Score=94.0; E_value=4.5e-25; Accession=PF05922.7; Description =Subtilisin N-terminal Region
  Pfam module annotation: Pfam domain module=PA::Peptidase _S8::Subtilisin_N; Domain location=369-470::120-609::24-109
MALILASYLVLSTLFSANAEFVKKTYIIQMDKSAKPDTFTNHLNWYSSKVKSILSNSVEAEMDQEERIIYTYQTAFHGLAAMLSQEEAEKLEAEEGVVAIFPDTKYQLHTTRSPTFLGLEPTQSTNNMWSLKLANHDVIVGVLDTGVWPESESFNDTGMRPVPSHWKGACETGRGFRKHHCNKKIVGARMFYHGYEAATGKIDEQAEYKSPRDQDGHGTHTAATVAGSPVHGANFLGYAYGTARGMAPGARIAAYKVCWTGGCFSSDILSAVDRAVADGVDVLSISLGGGVSSYYRDSLSVAAFGAMEKGVFVSCSAGNAGPDPVSLTNVSPWITTVGASTMDRDFPADVRLGNGRKITGTSLYKGRSMLSVKKQYPLVYMGNTNSSIPDPKSLCLEGTLDRRMVSGKIVICDRGISPRVQKGQVVKNAGGAGMILTNTAANGEELVADCHLLPAVAIGEKEGKELKRYVLTSKKATATLGFQATRLGVRPSPVVAAFSSRGPNFLTLEILKPDVVAPGVNILAAWSEAIGPSSLPTDHRRVKFNILSGTSMSCPHVSGIAALLKARHPDWSPAAIKSALMTTAYVHDNTIKPLRDASNAEASTPYDHGAGHINPRRALDPGLVYDIQPQDYFEFLCTQKLTTSELGVFAKYSNRTCKHSLSSPGDLNYPAISVVFPLKNSTSVLTVHRTATNVGLPVSKYHVVVSPFKGASVKVEPDTLSFTRKYQKLSYKITLTTQSRQTEPEFGGLVWKDGVHKIIEHACLGHRMSYGFISTYSH

SEQ ID NO: 180665 - protein, 334 aa, Glycine max
  Coding DNA Sequence Number=SeqID_63887
  Gene Ontology: Mol. function=protein-tyrosine kinase activity; Cellular component=integral to membrane; Biological process=protein amino acid phosphorylation
  Homolog annotation: Hit_ID=Q1S0Z5; Match level="QueryCoverage=72%, HitCoverage=49%, E-value=5e-67, Identity=57%"; Hit description =Protein kinase
  Pfam annotation: Domain name=Pkinase; Domain location=65-285; Score =4.0; E_value=8.5e-09; Accession=PF00069.15; Description=Protein kinase domain
  Pfam annotation: Domain name=Pkinase_Tyr; Domain location=66-281; Score=-34.8; E_value=2.4e-10; Accession=PF07714.7; Description =Protein tyrosine kinase
  Pfam module annotation: Pfam domain module=Pkinase::Pkinase_Tyr; Domain location=65-285::66-281
  Subcellular localization annotation: CTP_CleavageSite=89; ConfidenceScore=5.81e-01
MPSRQLPTSAPPPNHRVSTPLFAFTASVCSLFFLLLLCLRKRKRTTPSSNPPHPFSYPVLRRATNSFSTRLGHGGFGPVFSGTLAGDPVAVKLMDSASLQGEREFHNELLFASRLRSPLVVPAIGFSSDPKRRRFLLVYHLMHNGNLHDALLRRKTPHLTLWKNRFSIILDVAKGIHYLHSLEPPIIHGDIKPSNILLDNSFSAKLADFGLARLKSEIEEFKLKREEKKKEESESDAGSELETQSVNTEQSFDDTGRENAASDYVMDWIGKEVRKERPNEVKKNGSSSAAATAASSSGTVEKKSRKKLEWWESMDDSGVLKKEKRRPAREWWKE

SEQ ID NO: 180666 - protein, 67 aa, Glycine max
  Coding DNA Sequence Number=SeqID_63888
  Subcellular localization annotation: CTP_CleavageSite=52; ConfidenceScore=5.66e-01
MSNTTYCRPPFRNPMRPPSPDSSTSSPAIAWCGTMRRRPSSAGNPTRKKRLRSEEHTSFFVGMRRCR

SEQ ID NO: 180667 - protein, 68 aa, Glycine max
  Coding DNA Sequence Number=SeqID_63889
  Subcellular localization annotation: CTP_CleavageSite=24; ConfidenceScore=5.03e-01
MASSTCFQQISSQITITKHKPKIRFTTPKMSFFRDLEQKWLPKVGALLELQWWRKKRMATLDREERAF

SEQ ID NO: 180668 - protein, 116 aa, Glycine max
  Coding DNA Sequence Number=SeqID_63890
MSDKRAETNYGHSAPFVIQEQQVDKSSDKCAETNYGHSAPCHSGAVSRVVGGDKLWSFRTPFRHPEAIVSDGTQRQIMVILHLSIEARSCPMAHRDKLWSFCALCQPRGMNSAVSG

SEQ ID NO: 180669 - protein, 85 aa, Glycine max
  Coding DNA Sequence Number=SeqID_63891
  Subcellular localization annotation: CTP_CleavageSite=36; ConfidenceScore=5.08e-01
MPSSTKKKMKKFHDSMIFKKDFRVGKKVLLYNSKLRLMSVEIKNDSTNKSSKVNGHRLKPFLTNPSLVDVVVEGTSLLHPTLPPP

SEQ ID NO: 180670 - protein, 90 aa, Glycine max
  Coding DNA Sequence Number=SeqID_63892
MDKVDIFVPHPLTNACLLIQLSPECGCKPLVCLLKQPALLSVDFQDRSIRDYSSCALVGESSTTRDPRSLNPFSEIRRREEEVSRKRGRL

SEQ ID NO: 180671 - protein, 39 aa, Glycine max
  Coding DNA Sequence Number=SeqID_63893
MDDLMAKKHAICSSKKPSEIDGINTLELANVTSGMSEDA

SEQ ID NO: 180672 - protein, 347 aa, Glycine max
  Coding DNA Sequence Number=SeqID_63894
  Gene Ontology: Mol. function=DNA binding; Cellular component =membrane; Biological process=DNA integration
  Homolog annotation: Hit_ID=Q1SS72; Match level="QueryCoverage=93%, HitCoverage=24%, E-value=4e-72, Identity=38%"; Hit description =Integrase, catalytic region
  Pfam annotation: Domain name=zf-CCHC; Domain location=224-241; Score =13.1; E_value=0.0068; Accession=PF00098.13; Description=Zinc knuckle
  Pfam annotation: Domain name=zf-CCHC; Domain location=262-279; Score =5.4; E_value=0.13; Accession=PF00098.13; Description=Zinc knuckle
  Pfam module annotation: Pfam domain module=zf-CCHC::zf-CCHC; Domain location=224-241::262-279
MESYLYLHPSENPAIALVSPVLDSTNYHSWSRSMITALSAKNKVEFVDGSAPEPLKTDRTYGAWRRCNNMVVSWIVHSVEEIWRDLKSRYSQGDLLRISDLQQEASTVKQGALSVIEYFTRLRIIWDEIENFRPDPICSCNIRCSCSALAIIVQCKLKDRAMQFLHGLNEQYANIRSHVLLMDPIPAISKIFSYVAQQERQLLGNISSNLNLESRDISINAVKVVCDFCGRVGHMENVCYKKHGMPPNYDGKSKSNNMRYGKMCTHCGKNGHTIDVCYRKHGFPPGYKTYNGRTTANNVVAVDSKATDDQTQHHESQDIVRFSPEQYKALLVTPSTPHIYINKGIKI

SEQ ID NO: 180673 - protein, 113 aa, Glycine max
  Coding DNA Sequence Number=SeqID_63895
  Gene Ontology: Mol. function=transferase activity, transferring hexosyl groups; Biological process=metabolic process
  Homolog annotation: Hit_ID=Q1RXI0; Match level="QueryCoverage=52%, HitCoverage=12%, E-value=1e-11, Identity=51%"; Hit description=UDP -glucuronosyl/UDP-glucosyltransferase
MNIVTNDASNQMISVSELMLQETRVQYIIAQLSLILYLPYANYFTNGHLDSAIDWIPSLKNITLRDLAGIYRTTDPNDILLDFVVEQIKGTSKASAIIMPTGVAPCSNFKEYI

SEQ ID NO: 180674 - protein, 74 aa, Glycine max
  Coding DNA Sequence Number=SeqID_63896
MTVKKRLSHEVLKVTIELSSLGTPGVQILHRIPKHTTVPIWGKELWRQQEEPAFVEMPRFCNLIIARGFSVMAG

SEQ ID NO: 180675 - protein, 267 aa, Glycine max
  Coding DNA Sequence Number=SeqID_63897
  Gene Ontology: Biological process=protein modification process
  Homolog annotation: Hit_ID=Q9ZQZ4; Match level="QueryCoverage=98%, HitCoverage=94%, E-value=2e-26, Identity=29%"; Hit description =Putative ubiquitin-like protein
  Pfam annotation: Domain name=ubiquitin; Domain location=191-263; Score=14.5; E_value=0.009; Accession=PF00240.13; Description =Ubiquitin family
  Pfam annotation: Domain name=ubiquitin; Domain location=6-74; Score =42.7; E_value=1.3e-09; Accession=PF00240.13; Description=Ubiquitin family
  Pfam annotation: Domain name=ubiquitin; Domain location=96-170; Score= 16.8; E_value=0.0052; Accession=PF00240.13; Description=Ubiquitin family
  Pfam module annotation: Pfam domain module=ubiquitin::ubiquitin::ubiqu itin; Domain location=191-263::6-74::96-170
MNIIFELQGGRSFSMEVGYFDTVLEIKEKVQKYQNIPVSKQILILNGQVLHDNDDPWKVEILHNTRIQLQVTPKKEENSKDLVVNSTHTKIQLNVKTASKTHVIPLEVDVNNDTVLRLKERIHEMETVAVPVNRLLFLHSSNGVEMLDHQLLRDCYVSENAEIDVGFRPSPPAAASASPGSKRLKLMVLPKSGTKKVPVEVNPSDNVGELRKELQKLHQRVQFHLPQDGYFFIYKQNVMDDDRSFRWHHVAQGDTIEIFNGSVTGGS

SEQ ID NO: 180676 - protein, 118 aa, Glycine max
  Coding DNA Sequence Number=SeqID_63898
  Gene Ontology: Mol. function=GPI anchor binding; Cellular component =anchored to membrane; Biological process=cell adhesion
  Homolog annotation: Hit_ID=Q2PES4; Match level="QueryCoverage=95%, HitCoverage=27%, E-value=5e-34, Identity=62%"; Hit description =Putative fasciclin-like arabinogalactan protein FLA2
MEVNDVDEANRFGVGAGGLVHCDGEGGAIGDLVELLSAEVVEEDVEGEDVLDNVDGGVFQEKVRHGGIVDGADNDGSFAVDFKGEVGEGEVVVEGEELMVLCKDAADVMRVGEGGEEE

SEQ ID NO: 180677 - protein, 303 aa, Glycine max
  Coding DNA Sequence Number=SeqID_63899
  Homolog annotation: Hit_ID=Q9FJJ1; Match level="QueryCoverage=98%, HitCoverage=60%, E-value=5e-38, Identity=38%"; Hit description =Arabidopsis thaliana genomic DNA, chromosome 5, TAC clone:K19B1
MEEPVMEQQPSAAASGNTARPRLQKYALRSANKLKEEKSETPNCSIPTSETMRGRSVGASSVSKSVSVLDFSGKDKSGSAKPPRRLSIPAKTPATSRPKLGGNSTPITETRTGRSAFGQGRSKTPISDISKTSSRTKLNLLTSASYWLNQIKLSESAAKHSISLGFFKLALEAGCEPLGPMQEGLKSYVGRHQLDGLEETVKALFESYNISETMEQWQVSETISHVPEEGTRSSDDDVRSSSSTMGTRKLKPKCLNTDSTQLTPSTESAKKETSQKSNPGSRLRGNLSTNTTTPRPALDNRNN

SEQ ID NO: 180678 - protein, 228 aa, Glycine max
  Coding DNA Sequence Number=SeqID_63900
TPGQDFARTAAGRRVRIMRTSMTTLTQMWMTLLLSNVLPSDHNSDLPLLKCQLVYAILTRMNVHVAQLITDAIYLFGGMPPTKLPLDPNKSNRALGCPALITGLCQSFRVPVTPSKVILPSITRAFIEKYCTPRQVQGDAPQAADAPPLPYQADPAGSLGMERYLQHLGFAPFACPTPDQFRAEVAWPRDWPKAQAGEAPAGAPDDAEEARMDEEMTDLLDFLRGSRA

SEQ ID NO: 180679 - protein, 200 aa, Glycine max
  Coding DNA Sequence Number=SeqID_63901
  Gene Ontology: Mol. function=helicase activity
  Homolog annotation: Hit_ID=Q9LTU4; Match level="QueryCoverage=54%, HitCoverage=9%, E-value=2e-10, Identity=32%"; Hit description =Helicase-like protein
  Pfam annotation: Domain name=DUF889; Domain location=25-197; Score= -113.8; E_value=0.0009; Accession=PF05970.5; Description=Eukaryotic protein of unknown function (DUF889)
MDGSKQDLPTRKRLGSGWQMIFVTITEYNIQTKDNSQMKRCNIDICVELRTFYKEMVMHQSMLVISLFMKSWTIIKKHYNTISILIILHSQHNVVEFSSSMDMEVLERLSCGKHWHRQSNQKILPVVPKGSRFDIVHAAINSSYLWNHCQNMTQKDGLCNGTRLIISRLGAHIIEAKIIFEKNIGHKTYIPRRVNRQFSP

SEQ ID NO: 180680 - protein, 94 aa, Glycine max
  Coding DNA Sequence Number=SeqID_63902
MYPEEILGTAGGRSGMTTSGRPSSGSVVNFWMWLYDNLNVLVYDAYVLKMDEDQWRYDFAMSQEVHMDYDYDNQEECGVNEPHVDCSNAFNTSQ

SEQ ID NO: 180681 - protein, 289 aa, Glycine max
  Coding DNA Sequence Number=SeqID_63903
  Gene Ontology: Mol. function=helicase activity; Biological process =viral genome replication
  Homolog annotation: Hit_ID=Q2R0W4; Match level="QueryCoverage=97%, HitCoverage=17%, E-value=6e-54, Identity=40%"; Hit description=AT hook motif-containing protein, putative
MDLATQVRRKRKLILQENRKNKKSIEDMLKDFYDQTTNLSHEDAEFHFGSPLMTDKESCNDDETRHINAGYHDIGDPIWTCQECGAQMWYGERINKDKKSLNPRFSLCCDDGKIQLPILEKPPDILKELLFGNSRQSKNFQTYIRSYNLMFAFTSPGAKIDRTLNTGKGPPSFRIQGQNHHLIGSLLPMPQNSPKFAQLYIYDTENEVQNRLAHNSNKDSMEEEIVVKIKQMFDHENMYAQTFRMTRDKFCDSSVCDLKLKLICDKQTDGRIYNLPKVAEVAALIVGNQ

SEQ ID NO: 180682 - protein, 89 aa, Glycine max
  Coding DNA Sequence Number=SeqID_63904
MYPSRRDVSPTDVRETIVLIRCLEWLGLALTQVMDMDGSGQFRMGVGWSYWSSSMALVELVLGLSMVGLDSQNSDHGLVSCEGSAEVAG

SEQ ID NO: 180683 - protein, 204 aa, Glycine max
  Coding DNA Sequence Number=SeqID_63905
MAFLGETSSQMIFNSRLAFIYPNGSIIHNDTGVYFQTSTPVPIRVPNRCDFASLKTRIHNTLQLSDKQFLDEIHYRKSFTDTSNQIRFECIKLINDDDVNTMLMCNDQFSCVGPIELLCTVGRTPDGIINLLERTMPRIHDAILYYNGKWNMSPQNKFVGCAFTGKNPKKFQIPSTCTIDELKNLIKQVAPKGIPPSWNSRITN

SEQ ID NO: 180684 - protein, 66 aa, Glycine max
  Coding DNA Sequence Number=SeqID_63906
MRSGGCIAARPGELLASSRSNLARPGELSSPRRAGYFSLKLSSGPDCAAIGVKQLNSVGKNPNVCK

SEQ ID NO: 180685 - protein, 406 aa, Glycine max
  Coding DNA Sequence Number=SeqID_63907
MVLLRCRLRVMWVGSAGLVNRFYFYALPLPLAPYTFYVTIITSAVDSSMEGEGSDLLEKVPKEALSTMDQNLDGPAIPLSDVELLRRSFNAVGHEVELFRSLISMKASIGTVDVCEPLPHYSKMEIILPNACRRDEEDSVGHKKEQCSEIMVKKVVAAESETLANDIMDTQNVNEEGPNNNADFNIASNNHGGVSVDHVKTNYREMSKREGGKNPQGGKGGELKIGGKSTFKKNVHPIVKHKVQVGMKVAISCTIPPMMEVHMTEYAIELVNRRKQKDQMEIEQSKKEKHGIVVELALVVLGPLSKIFVRSMKHPYCYCWRLMLLESLDNGLFQGWDWIVTLSRKVVVSLEDFGACGILICGRSKSFTMTTSPWAVIGDFNTMLMIEVVEVQTLLGRGTRFTGNDT

SEQ ID NO: 180686 - protein, 220 aa, Glycine max
  Coding DNA Sequence Number=SeqID_63908
  Homolog annotation: Hit_ID=Q6YZJ0; Match level="QueryCoverage=65%, HitCoverage=37%, E-value=8e-30, Identity=48%"; Hit description =Putative auxin-regulated protein
  Subcellular localization annotation: CTP_CleavageSite=31; ConfidenceScore=5.65e-01
MAMALSLSQFPVRGSVSLPKRRLPRRSFCIRGMSETSSTSSVSTQQEQPTSDNASSVTIAPPPNFKPPEPKRFAIRPDKTSEVFGALLPLIFRFATGVFVSGYSFSIVSKDEIPTDEYALELNGSTYILFCLVEYQTFGFLPATLQNSLIPSAVLFFDYMPSWIICSCPFCRKVREIVAILDLDVLFYPCPRNGPNFRQKVLEMGGKLQFPYMKDGIKVD

SEQ ID NO: 180687 - protein, 109 aa, Glycine max
  Coding DNA Sequence Number=SeqID_63909
  Subcellular localization annotation: CTP_CleavageSite=50; ConfidenceScore=5.28e-01
MISSSHLRIRRSKGNTLVDPKKLPSLVTGAWGANTFPYFMQTNFANASPQEMALKKLPAKRSRKNAAGEGSNAAPQVDVEFDGHNFWSGEHQCRFEAIKGWSFLKERRV

SEQ ID NO: 180688 - protein, 399 aa, Glycine max
  Coding DNA Sequence Number=SeqID_63910
  Gene Ontology: Mol. function=DNA binding; Cellular component=beta -galactosidase complex; Biological process=DNA integration
  Homolog annotation: Hit_ID=Q1SLU3; Match level="QueryCoverage=93%, HitCoverage=33%, E-value=1e-105, Identity=45%"; Hit description =Integrase, catalytic region
MQGELQALQLNNTWTLTTLPPHKTAIGCRWIYKIKHHADGSIERYKARLVAKGYTQMEGLDYLDTFSPLTKEVYMQVPPGLSVENPNLVCHLQPSLYELKQASNSIDEIQSITTLLDQTFKIKDLSNLKFFLGLEIARTSQGIHLCQCKYTLDILSDSGMLGSRPHSTPMDYSARLVGRLIYLTNTRPDIAYDVQQLSQCMSNPTNTHHQVAFRVLHYLKGTPGSSLFFAATGTPQLRAFSDSDWTGCCDSRRSITGFSVYFGSSLISWQSKKQSTVSRSSSEAEYQALASTTCELQWLTYVLQDFCVPFIQPATLYCDNQPAIQIATNLVFHEHTKHIEIDCHIVRHKVNSGLIKLLLVSSSKQLVDIFTKALSPAVFHDLCNKLGMMNIHSQLAGDS

SEQ ID NO: 180689 - protein, 106 aa, Glycine max
  Coding DNA Sequence Number=SeqID_63911
MPKVYRNDITSRVNDSRTYGFGDYLVWCELVKAMSHFNCTNLHTIVRILQAPESNIQEVDVRVIRDGDIPEFGVVSVEHEEMEATCLVCDWLEAVFPDDGCWIKAS

SEQ ID NO: 180690 - protein, 109 aa, Glycine max
  Coding DNA Sequence Number=SeqID_63912
MDHFLCNDNGIIALPIRDKVTLPRINKLLHDLSKSCCCNLSFDGRATRDSREMRGGGCTVAHPGELLASSRSNLARPSELSLRRQAGYFSPKLFGGPSKPKASLGEPGA

SEQ ID NO: 180691 - protein, 724 aa, Glycine max
  Coding DNA Sequence Number=SeqID_63913
  Gene Ontology: Mol. function=nucleoside-triphosphatase activity; Cellular component=integral to membrane; Biological process=transport
  Homolog annotation: Hit_ID=Q1SCH7; Match level="QueryCoverage=99%, HitCoverage=82%, E-value=0.0, Identity=73%"; Hit description=ABC transporter, putative
  Pfam annotation: Domain name=ABC_tran; Domain location=433-615; Score= 157.1; E_value=4.4e-44; Accession=PF00005.17; Description=ABC transporter
GSESEPGNTNFLEPAFFSDLPIYYLQNQCTQNSTFSVSVQMSGISKQQEVICAQGLRLWRNSSSEVNNELYKGYWRSNIERQINEIAAGYDFLNSNGSIFNVSIWYNSTYKKDTGFNPIALARIPRSVNLVSNAYLQFLLGPGTKMFFEFVKEMPKPETPIKLDLASLLGGVFFTWVILQLFPIPLTSLVYEKQQKLRIMMKMHGLDDGPYWMISYGYFLAISIVYMLCFVIFGSVIVLAYIGMFGTGLLADFPFHFFVQDTSFPRGWIIVMELYPGFALYRGLYEFSQYAFSGDALGTDGMRWSDLSDSTNGMKEVLIIMFVEWLLVLLFAYYIDQVLSSGCRKSPLFLKRFQKKPHSSFRKPSIQRQKSKVFVQIEKPDVTQEREKVEELLLESTINQAIVCDNMRKVYPGRDGNPEKLAVRGLSLALPQGECFGMLGPNGAGKTSFINMMIGLTKPTSGTAYVQGLDLRTHMDGIYTSMGVCPQHDLLWESLTGREHLLFYGRLKNLKGSALTQAVEESLKSVNLFHGGVADKQAGKYSGGMKRRLSVAISLIGDPKVVYMDEPSTGLDPASRKNLWNVVKRAKQDRAIILTTHSMEEAEVLCDRLGIFVDGGLQCIGNPKELKARYGGTYVFTMTTSIDHENDVENLVRQLFPNANKIYHISGTQKFELPKDEVKIANVFQAVETAKRSFTVSAWGLADTTLEDVFIKVARGAQAFNTLS

SEQ ID NO: 180692 - protein, 364 aa, Glycine max
  Coding DNA Sequence Number=SeqID_63914
  Gene Ontology: Mol. function=isomerase activity; Cellular component =periplasmic space; Biological process=carbohydrate metabolic process
  Homolog annotation: Hit_ID=Q8LFH1; Match level="QueryCoverage=92%, HitCoverage=91%, E-value=1e-117, Identity=58%"; Hit description =Aldose 1-epimerase-like protein
  Pfam annotation: Domain name=Aldose_epim; Domain location=28-360; Score=390.0; E_value=3.5e-114; Accession=PF01263.10; Description =Aldose 1-epimerase
MFKVYLVSSFLLGLLLLAQAHGNDKKIGFYQLKRGDLHLNLTNYGASLISVIVPDKHGVFYILSYVWNLDDITLGYDDIEQYKNDSWYFGATIGRVANRIGHAQFTLDGHTYKLPANDHGNTLHGGFKGFSDVVWTVKSHKEDDHITFTYDSHDNEQGFPGRLEVSVTYMLIGTNKYSLKMIARPIDKATPVNLAHHTYWNLKGQNSGDNILSHEVQIFGSKITPVDKELIPTGKFESVKGTPYDFLEPREVGSRINDLPGLYDMNYVLDASSPYHFRKVIIVREKVSGRKLELWSNQLGLQFYTGGMLNATKGKDGAIYHKHGGMALETQGFPDAVNRPNFPSQIVRPGETYKHYMVYRFTAS

SEQ ID NO: 180693 - protein, 93 aa, Glycine max
  Coding DNA Sequence Number=SeqID_63915
  Homolog annotation: Hit_ID=Q1S9I4; Match level="QueryCoverage=79%, HitCoverage=7%, E-value=9e-07, Identity=41%"; Hit description =Integrase, catalytic region; Zinc finger, CCHC-type
MEKSDKKTLKYKKGKKAYITWEDNDMDSSSDLENEIVNLSLMAKDYESEEDDSLKKSWYIDSGCSKHMTRDASKFTHISLKNSGHMTYDETTK

SEQ ID NO: 180694 - protein, 68 aa, Glycine max
  Coding DNA Sequence Number=SeqID_63916
  Homolog annotation: Hit_ID=Q8W234; Match level="QueryCoverage=89%, HitCoverage=6%, E-value=3e-23, Identity=91%"; Hit description =Transcriptional corepressor SEUSS
MSPSYFHLYNFFLMFVASARQLAKALEVPLVNDLGYTKRYVRCLQISEVVNSMKDLIDYSRETRTGPM

SEQ ID NO: 180695 - protein, 405 aa, Glycine max
  Coding DNA Sequence Number=SeqID_63917
  Homolog annotation: Hit_ID=Q1T4I1; Match level="QueryCoverage=91%, HitCoverage=63%, E-value=1e-126, Identity=64%"; Hit description=IQ calmodulin-binding region
MALQLQYVNGDPNSVLSWLERWSASYFWKPVPQPKKIRDSKSQRKQGNVSNGEAQITKSKRTTRKLPIANFETALEQTNPEFEKPKRNFRKTPYQVSDPEQENPQSELEKVKRSLRKIHNPVVENAGQPEVESETPKQHLEMTKVIPGHAVLEQATITSDDKIKMEETSTISNVPDVEITPIPSVNKEVSEILNNYQVSVESKPLSETPTKDRNTSHDEVKNKLGNLPETIFKDENSLLTNGDLSHSDLTGNENQKPTRKISNLTKQENGEDGIKNSPKLPSYMAATESAKAKLRAQGSPRFGQDGTEKNNTAGGSGRHSLPSSTNNQISSHSPKPQRSVPAGGKGGNKSDRTVPSSKAGNGKVTQAEWRSNTETDISVAAEVTKNEGNLKGDIAYCLLGGRFLP

SEQ ID NO: 180696 - protein, 96 aa, Glycine max
  Coding DNA Sequence Number=SeqID_63918
MGFFWFYFRHGVVLYVNSAPCRTQTAIANGEFGVTEQAANGTGETCLNRHYRWRFVQARNRQSNWRVPLSARLQGCRSCVFSECITSSRNSLDERL

SEQ ID NO: 180697 - protein, 937 aa, Glycine max
  Coding DNA Sequence Number=SeqID_63919
  Gene Ontology: Mol. function=nucleoside-triphosphatase activity; Cellular component=integral to membrane; Biological process=transport
  Homolog annotation: Hit_ID=Q84K47; Match level="QueryCoverage=96%, HitCoverage=94%, E-value=0.0, Identity=62%"; Hit description=ABC2 homolog 1
  Pfam annotation: Domain name=ABC_tran; Domain location=528-710; Score= 164.8; E_value=2.2e-46; Accession=PF00005.17; Description=ABC transporter
  Subcellular localization annotation: CTP_CleavageSite=61; ConfidenceScore=5.08e-01
MATTISGIPLVALQVKALLKKNLLLSWRNKRASLLQLLSPFMFIFLIFAIDKAMKAKTSTSSSYKSVTEPPMEPSLPITPCEDKLFINLPCYDFVWSGHQSPKFRIIVKSFKDKSEVDAWLFSNPMRCPAALHFIERNDTVIGYGLQTNSTSLQRRGKFENPTASFQLAAEREIARYLIGDAEFSWNVFLREFAHPSTTPFSVVASIGPAFFLVIAIFNFVLQIRSLVTEKELKLRQAMTMMGLYDFAYWFSWLIWEAVVAILSSLLIVLFGMMFQFRFFLDNSFVVLFFFFFLFELSMTGLAFMISAFIRKSSSATTVGFYIFIVGFVTQLVALVGFPYKDSFSKTTRNLWSLFPPNLFSQGINVLSDAVATSEDKGVSWSKRGECALNKTDCVITIDDIYKWLAATFFLWFVLAIYFDNIIPNASGVRKSIWYFLNPNYWMGKGGQKVKGSALCQEQSTPDDDVLEEENKVKQQLTEGLVDANIAVQIRGLAKTYPGTRSIGCCFKCKRTSPYNAVKGLWVNFAKDQLFCLLGPNGAGKTTAINCLAGITPVTDGDALIYGHSIRSSSGLSNIQKLIGVCPQFDILWDALSGQEHLQLFATIKGLSPSSIKSITQTSLAEVRLTDASKVRAGSYSGGMKRRLSFAIALIGDPKLVILDEPTTGMDPIIRRHVWDIIENAKRGRAIVLTTHSMEEADILSDRIGIMAKGSLRCIGTSIRLKSRFGAGFIANISFNGNNIECSPASGDAISTEHHEAVKKLFKNHLDVVPKEENNNFLTFVIPHDREALLKNFFSELQDREKEFGISDIQLGLTTLEEVFLNIARQAELESAAAEGRLVTLTLTSGESVQIPIGARFVGIPGTESAENPTWFMVEVYWEQDDTGALCIASHSQKVPIPHGVQLSSSPSRRHRRYLGQSGTVHGVVIDPSQVSSVDFQ

SEQ ID NO: 180698 - protein, 413 aa, Glycine max
  Coding DNA Sequence Number=SeqID_63920
  Gene Ontology: Mol. function=nucleic acid binding; Cellular component= membrane; Biological process=DNA integration
  Homolog annotation: Hit_ID=Q1ST43; Match level="QueryCoverage=98%, HitCoverage=27%, E-value=9e-64, Identity=35%"; Hit description =Integrase, catalytic region; Peptidase aspartic, catalytic
MELNMLTALSAKKKSEFVDGSIQRPASDHAAWKRCNNMVISWLVHSISLSITQSILWMDDAQDIWKDLKSRYSQGYLLRISELQQDMTSIKQVDKSIIEYFTRLHVIWDELESYRPDPICVCNPKCSCDALSNVLERKKQDHVMQFLRGLNDQFSTVRSSVLMMDPLPSIAKAFSYAMQQERQINSNDALGSTGLINTANTSSSNSPFSHVTEKMTFLIIHLLEEEKVVQLVLVEEIQVEETVRFVLTDFTNHIVDECYRKHGYPPDHKYHKPQGSSINNVNVAKEENANSDVEQNQEAQGSDVKLTAQQYKTLMTLLQPQGSSTHNSSHVNQIGTMIGSSHALTSNVSSISCSMSKVGESEWILDSGATDHVTSFSHLYSSCRQISLIIAKLPTGHTTIATYVGTVRFSHSS

SEQ ID NO: 180699 - protein, 129 aa, Glycine max
  Coding DNA Sequence Number=SeqID_63921
MSYHRQSKNSWIWSIDPSGSYIVKSAYSALHNWKFGTKICYCNKFTSTHGHGRQVYQRTLASHFNSGTPVLAIVSIMLYNWGFGSCGAFGRLGVRGFQLMLYFCAGVYLVGLDYDTNCMFKFDWGCQPW

SEQ ID NO: 180700 - protein, 74 aa, Glycine max
  Coding DNA Sequence Number=SeqID_63922
MTRMMELVLGMLRWLRDMMFYVPQWRWMNPCASWMIFPFGFVGGDLVEKRVRYENWKFWEKGGAITREVHDCSF

SEQ ID NO: 180701 - protein, 80 aa, Glycine max
  Coding DNA Sequence Number=SeqID_63923
MLVVMRKKPLSVEGQQHLHVDNERIDLKLASHGRKIEKFRRLAPKIEGIMIATGLSSLITCSLDTGDKGLLYAFVERWHK

SEQ ID NO: 180702 - protein, 251 aa, Glycine max
  Coding DNA Sequence Number=SeqID_63924
MNVAKVGSIISHVRLRISFVKRTRGGTCQTKDSDAQVINYLQSHTLSIRYDYLLIFIYKLQFIFSIIYKLLAIIYKSGIIYKGYNSPYQQGPAITLHSYKYQVPSPVLSTRATLKVDMRSPRAHFGHVHPDMPPSSKPACGQKRLSDVEGRSLDKWEGCKFIVPPSMDKCHPVSRVVTSTNATVAGLSSLSSPPAWTGVVWVAAVKLSKEDIDAILPPRALDRRLQKDWARDAREDPRVLMSLRVDFGPMG

SEQ ID NO: 180703 - protein, 105 aa, Glycine max
  Coding DNA Sequence Number=SeqID_63925
MPLVFENIGHIYKVNYVFGPANLFSFYGLDPLTFQRVFGLGRSLTVMGADHNGWVWWLWRHDGGGGLGGGGMLKRWCKCYCLVMFGYGFRSRSFFEQLLLQFSQI

SEQ ID NO: 180704 - protein, 263 aa, Glycine max
  Coding DNA Sequence Number=SeqID_63926
  Homolog annotation: Hit_ID=Q1T4E5; Match level="QueryCoverage=98%, HitCoverage=35%, E-value=3e-16, Identity=26%"; Hit description =Transposase
MHLGNTTTDRVEFAHWSLKRLLQNNIGDLCSIWEAMNNMITLQHTEIKHLLRQVLFEYEVNITEEMEAISKRFEELDVCGKVTIESKLWEIAYPDLNSMCAPPKMVKTKGAQKKQMTKHPRSTKCDYLTRKLAKWSDEYMHMLGGIDKYEELKRSLLADGLSMVSRDKWNNVTDMGYVIPSRHNVILVSLSLQQSMVFFPLRSQLPRDSYVHRVICIGYVYSNHFVQVFLRDVCPLSLTTMLWSTHCHYHAKQWPTPYISRMH

SEQ ID NO: 180705 - protein, 48 aa, Glycine max
  Coding DNA Sequence Number=SeqID_63927
MVCFTTLIEEEKAKATTIGIKPYSWHEFLHLFEHPFATYAVLAIRQRN

SEQ ID NO: 180706 - protein, 210 aa, Glycine max
  Coding DNA Sequence Number=SeqID_63928
MFILTPIVIESSLTSKRAHGFQALERRGRDYSLHFTIKVSKVVSKFHYDPTVNDSGIIVLLGQVWVYVGNEKGQCEEHFFHHRNCPKYPNGRPYSVSQRNSYVPQANVRANKWFQQGNEGSSSHFKKFEVSSLTLRRGGTTEGLRKGYYGYQNPPWVNRNMSKTQWKRHQRMKRDEILAMHHKNVVRPLVFSKINEGPPPRFEKKISIKD

SEQ ID NO: 180707 - protein, 103 aa, Glycine max
  Coding DNA Sequence Number=SeqID_63929
  Homolog annotation: Hit_ID=Q94I69; Match level="QueryCoverage=73%, HitCoverage=3%, E-value=2e-08, Identity=43%"; Hit description =Putative retroelement
MKQAPRIFAPNVLEAIKAEIESLLKAKFIQTTRLKNEVEFQWEKEHKEDFDDTKRYLANTLVLVPYAKGNDLTLYIVASYSTIASMLVQEDDNGIEHVVYYLS

SEQ ID NO: 180708 - protein, 122 aa, Glycine max
  Coding DNA Sequence Number=SeqID_63930
MALPRLSVAEVLSDSGADVLSTQKSFAIVSPNEQQKLRKTFSAEDDVGVSSSPEAGAVESISSEGFIRGRSYNIRLDDQVLLKFSPKNSDSTYYFSDMIGGTLTFFHEGARRCLEVTALVIC

SEQ ID NO: 180709 - protein, 107 aa, Glycine max
  Coding DNA Sequence Number=SeqID_63931
  Gene Ontology: Mol. function=ATP-dependent helicase activity
  Homolog annotation: Hit_ID=Q6Z8Y2; Match level="QueryCoverage=87%, HitCoverage=10%, E-value=6e-14, Identity=37%"; Hit description =Putative ATP-dependent RNA helicase
MSIYYDAYACRHITCNLSDLAPECPNPHDSRYYPERILIYDQHHGGCGISVQVQPYFTKFLAAALELLKCCCCSAEVGCPNCVQSFACHEYNEVLHKDAAIMIIKVT

SEQ ID NO: 180710 - protein, 1013 aa, Glycine max
  Coding DNA Sequence Number=SeqID_63932
  Gene Ontology: Mol. function=ATP-dependent helicase activity; Cellular component=nucleus; Biological process=protein modification process
  Homolog annotation: Hit_ID=Q6Z8Y2; Match level="QueryCoverage=66%, HitCoverage=75%, E-value=0.0, Identity=49%"; Hit description =Putative ATP-dependent RNA helicase
  Pfam annotation: Domain name=DEAD; Domain location=414-591; Score =118.7; E_value=1.7e-32; Accession=PF00270.19; Description=DEADDEAH box helicase
  Pfam annotation: Domain name=Helicase_C; Domain location=663-736; Score=51.6; E_value=2.7e-12; Accession=PF00271.21; Description =Helicase conserved C-terminal domain
  Pfam module annotation: Pfam domain module=DEAD::Helicase_C; Domain location=414-591::663-736
MTENNENAEIQIRALTGESIILPITPTTTGDKLRLQTQIGSFPIQHGEFLVLVPFAKKEKEPSRTHESDTVSNVPTSTTLADSTWSTIKEDLSLLHDDDTTENCDNASNSESKKEEMLQTQSIAGLGSEKQIELPYHLILDTLQDSSEGVLGEHNCEVFVKVLESVNCLSDLPLGHCKLLKQACEKRGGGGGLRKRRRELTLVLLEEALSELAKFGVKLGLDDIKLLSLLCPHLVCFGDEVEKTNFGDVIVVNNATGNDDQVEDNPKRVRKWLYVSKIVSTLKRRDSSFRKSLGWAFEQLPFEFGDEMTVGISLEELLAAVKDRDFVGKEDKLKRVKRSKTTSKPGLNNIGCHDTKTLLAVDMVDHLKKGIGSEGQIVHIEDICARKAIYSEIPIELSEKMRSVLKCIGVSKFYSHQAESIQASLHGKNVAVATMTSSGKSLCYNLPVLEVLSNNSSSSALYIFPTKALAQDQLRALLHMTKGLDIDLNIGIYDGDTSHNERMWLRDNSRLLITNPDMLHISILPHHQQFCRILSNLRFVVIDETHTYKGAFGCHTALILRRLKRLCSHVYGSVPSFVFSTATSANPRQHSMIIKKTQFSKSTDELADESANFVRSSPIVDVSRLFAEMVQHGLRCIAFCKSRKLCELVLSYAREILHETAPHLVDSICAYRGGYIAEERRKIESSFFGGKICGVAATNALELGIDVGEIDATLHLGFPGNIASLWQQAGRGGRRDRPSLAVYVAFGGPLDQYFMKNPKKLFERPIECCHVDSQNKQVLNFDLFLFKIIYFEFEQMEGVMLIMTDFVQVLEQHLVCAAHEHPLSVNYDEQYFGPCLESVIISLKARGYLSSVLSSDSSRIWNYIGPEVYEGAVYMYQGKTYLVEKLDLSNKTAFCKEADLKYYTKTRDYTDIHVIGGNIAYPVKVETNMFPKTNARVDVCKVTTTWFGFYRIWRGSNQIFDAVDLALPQYSYESQAVWVPVPQSIKEAVSKQNYDFRGGLHAASHAILHVVPL

SEQ ID NO: 180711 - protein, 81 aa, Glycine max
  Coding DNA Sequence Number=SeqID_63933
MENDGACSIVAEGTMQIKRLMVLVKFSTGVQRTRGTLDYIHSDMWACPSSIGTEAVNTSYLVNRSPSTGINCSTPEKIWST

SEQ ID NO: 180712 - protein, 705 aa, Glycine max
  Coding DNA Sequence Number=SeqID_63934
  Gene Ontology: Mol. function=RNA-directed DNA polymerase activity; Biological process=RNA-dependent DNA replication
MKKFLKKYFLESKTAQGKAEISSIHQFPDESLSEALDHFRRLLRWTPMHGFNKPIQLNIFIDGLRPHSKQFLDASARGKIKLKTLDETMELIENMVANDNAILLDRTYTPTKKNLLELTSQDTLLALNKLLAKQLETLTNTLSKLPQQLHSAHVLGTCTTQEEASKEAIQVIINKEEISLRTKVSLGGSTQGLNLYERTTKPEDTLAQFMQAFISNNKSIESAIKNLEVQEPVRNGLDKNESVGEVGEEEKKDEEEEERKDGGEVLNSKTKNQLAREGKKEAPVVVAKDIPYPLIPSRKDKDKYFACFLDIFRKLEITIPFEEALHAIIQRILPQKFKDLESVTIPCYIGTIVVGKTLINLRDVLVKVKQLTSLVNFVIMDIEEDVNIPIILGRPFMLTANCVVEWGTTTWRREQLIKTREGPLRQAGDVKEELERRHWDRKLTRLLEKKIDVALVKEFYSNIYDPEDDSPKQCKAIEVKLCLPGGHFILNIEGTPWKILRKDMTTLAQMWSVFSYSNLALTFHTFELNMDQAHFIYGIITKMDMDLGSMLSSQITQIAQSNSSRLDFPALIASLYDAKGVHSDILTFKTSVGPSCTTTSSYFCIHSSSTVATISGAFTAHVAEHSSRLVPNHADIVVDWDNTPPAHHDARGIPLAPTTAIVVPNEPIPAKDPAADVVDLGHNEDYIVDISMAQTPAWDPSSTHD

SEQ ID NO: 180713 - protein, 55 aa, Glycine max
  Coding DNA Sequence Number=SeqID_63935
MDSSSGQGMKNALLEPKCSSYEKNHDSLLVQPSYKPDKVRSDPYFQCSRDIKEDE

SEQ ID NO: 180714 - protein, 82 aa, Glycine max
  Coding DNA Sequence Number=SeqID_63936
MGWAIDLHGGAGEIPLSLPAECHRGLVNKMVGHTELSCSTQPPHSASQNRSVQASRLAQGVTLEDNCHEQKRILRLSHDHLL

SEQ ID NO: 180715 - protein, 169 aa, Glycine max
  Coding DNA Sequence Number=SeqID_63937
MTCGDKLWSFRTPFRHSETIVSDGTQRQIMVILRPFVIKRRDKSWSVCALLSSRGGEPDDMRRQIMVILHTFSSFGDNRVRWHVETNYGHSAPFFHPEAVSPMTCEDKLWSFCTICHPDTIVSDGTQRQIMAILHLSSSRGGEPDDVRRYLMVIRAFRQSKGTNSAVSG

SEQ ID NO: 180716 - protein, 122 aa, Glycine max
  Coding DNA Sequence Number=SeqID_63938
  Subcellular localization annotation: CTP_CleavageSite=35; ConfidenceScore=5.34e-01
MDMNIGALISGQMTSIAQSNSSRLGFPALITVLCRASGVVSDSLTFERLSLVINLSYIRKNCWNPDDLIVSIRGNRRARARPTDLPSTSAAPTPSSTSAAPSVPAQIDSQRFEAMLQGIHQG

SEQ ID NO: 180717 - protein, 287 aa, Glycine max
  Coding DNA Sequence Number=SeqID_63939
  Gene Ontology: Mol. function=ribonucleoside-diphosphate reductase activity; Biological process=deoxyribonucleoside diphosphate metabolic process
  Homolog annotation: Hit_ID=Q9PE31; Match level="QueryCoverage=99%, HitCoverage=82%, E-value=1e-148, Identity=90%"; Hit description =Ribonucleoside-diphosphate reductase beta chain
  Pfam annotation: Domain name=Ribonuc_red_sm; Domain location=1-251; Score=-12.5; E_value=4.3e-07; Accession=PF00268.12; Description =Ribonucleotide reductase, small chain
MKLDARQYGELNAREKNAYDSIIGLLATLDSPQTRFIYNVAEYITDPAAHANAAIIGQQEVIHNESYSYVLASITDLPNQNRIFEIARTHPTIIKRNAPIMGAYDDFMREKTAETLLKSLIQSSILEGINFYSGFAYFYNMVRQNRMNGTGKIISFINRDELAHTKFISELIRAIIGENPELQTNELTAYVHQSFEHAIELETQWSSEVLDGIDGIDVDEMVRYVKYRANKMAGMLGIERLYSDTTDNVMPWIKAYADNFTETKTDFFEMRNASYKKTNVDNGFDDL

SEQ ID NO: 180718 - protein, 210 aa, Glycine max
  Coding DNA Sequence Number=SeqID_63940
  Homolog annotation: Hit_ID=Q6EVY3; Match level="QueryCoverage=31%, HitCoverage=79%, E-value=2e-15, Identity=62%"; Hit description =Hypothetical protein api63
MNEKIDYHIEKYHFAPLDEAPRLARQWSEVLNECRETQAGAEERLRIALLNVDYVTSFELPFRLLLVRAPQLIAGLRDELSISQKNVVFNGKRFGCVYSLKSDLSGVPEAFQYSLSTRIHRTSASGVDALPYREIAKALKAPRERLKLALEQGLPVTALDGLFWFGIQRIAAEVRRLRKTGMAIVTAETEIFDTLTGTTRKVPVYRQAES

SEQ ID NO: 180719 - protein, 268 aa, Glycine max
  Coding DNA Sequence Number=SeqID_63941
  Gene Ontology: Mol. function=transcriptional activator activity; Cellular component=intracellular; Biological process=regulation of transcription, DNA-dependent
  Homolog annotation: Hit_ID=Q4KH39; Match level="QueryCoverage=92%, HitCoverage=83%, E-value=7e-62, Identity=52%"; Hit description=Pca regulon regulatory protein PcaR
  Pfam annotation: Domain name=HTH_11; Domain location=27-80; Score =11.5; E_value=0.005; Accession=PF08279.2; Description=HTH domain
  Pfam annotation: Domain name=HTH_IclR; Domain location=24-111; Score =110.7; E_value=4.3e-30; Accession=PF09339.1; Description=IclR helix -turn-helix domain
  Pfam annotation: Domain name=IclR; Domain location=137-265; Score =129.7; E_value=7.9e-36; Accession=PF01614.9; Description=Bacterial transcriptional regulator
  Pfam annotation: Domain name=Rrf2; Domain location=35-117; Score= -27.8; E_value=0.0092; Accession=PF02082.10; Description =Transcriptional regulator
  Pfam annotation: Domain name=TrmB; Domain location=25-87; Score= -10.4; E_value=0.044; Accession=PF01978.9; Description=Sugar-specific transcriptional regulat
  Pfam module annotation: Pfam domain module=HTH_11::HTH_IclR::IclR::Rrf 2::TrmB; Domain location=27-80::24-111::137-265::35-117::25-87
MEKGQEITRSSTDPWKGDPDFMASLARGLEVLQAFTPQRRLMSVSQISQRTGIPRAAVRRCLYTLSKLGFVYAEDGKNYELRPRVLSLGHNWLAASSLANAAQPVLRQLSQTLNESCSMAILDGDDILYIARASTSRIMTIDLHVGSRLPASTTSMGRVLLSGLANEPLNDYLARLTQLRYTSHTLVSVSALREELARVRQQGYAINDQELEIGLRSLAVPLTTPDGRIAAALNVGVHASQVSAERLYQHHLPLLRSAAEEISLLLHD

SEQ ID NO: 180720 - protein, 161 aa, Glycine max
  Coding DNA Sequence Number=SeqID_63942
MELAPEGRTLKYCRVRGQVIRFDVETINDFLDTPVILVDREGYPAYSQYLSIYPDHQAIAATLCTTGGKFVLNVDGAQEVVSNTLIFESLSHVINLAYIKKNCWNPTNPSITFHGTRRTRTRVVAPDAPPPSKPPSHVVPRLQASTSALLDAHNLMLQSLY

SEQ ID NO: 180721 - protein, 72 aa, Glycine max
  Coding DNA Sequence Number=SeqID_63943
MVLVLRGMHPDFDHIRDQVLTGQEGDEVVVKTKEDKLEEEVALNVLTERGTGRTIGVGHESHGLYYLKPNLC

SEQ ID NO: 180722 - protein, 54 aa, Glycine max
  Coding DNA Sequence Number=SeqID_63944
MIDNASSNDVAVTFFKKKLKIMGGLVMDECQACSIGGHEEVGYAFTFSLTLDHN

SEQ ID NO: 180723 - protein, 70 aa, Glycine max
  Coding DNA Sequence Number=SeqID_63945
  Gene Ontology: Mol. function=protein binding; Cellular component =protein complex; Biological process=protein catabolic process
  Homolog annotation: Hit_ID=Q9LT08; Match level="QueryCoverage=98%, HitCoverage=30%, E-value=4e-22, Identity=62%"; Hit description=26S proteasome non-ATPase regulatory subunit 14
MLLNLHKKKWTNVIKYNKFDQEEDELSPKKPAIANVGRQDAKKHLEEHVSNLMSSNIVQTLGMMLATIVF

SEQ ID NO: 180724 - protein, 80 aa, Glycine max
  Coding DNA Sequence Number=SeqID_63946
EVFVSLSFELNIVVRDNGIWEVIPANDMFPGPRGAQAIKIIGRSAWDVCKLLALFAPHGKVEDVCPECWLVVAGSHHFGG

SEQ ID NO: 180725 - protein, 159 aa, Glycine max
  Coding DNA Sequence Number=SeqID_63947
  Gene Ontology: Mol. function=UDP-arabinose 4-epimerase activity; Cellular component=integral to membrane; Biological process =carbohydrate metabolic process
  Homolog annotation: Hit_ID=Q9SA77; Match level="QueryCoverage=83%, HitCoverage=31%, E-value=8e-54, Identity=75%"; Hit description=UDP -arabinose 4-epimerase 1
MVWFSLQHITEILPGVGLDMIICIGETRSQPRSTRSMSLGGMDYVDPKRKGNFVGKVFLAAALTALCIIMIKRSPSLNPPSPFSIREPGVTHVLVTGGAGYIGSHATLRLLRENYRVTIVDNLSRGNLGAVRVLQELFPEPGRLQFIYADLGDKESVSL

SEQ ID NO: 180726 - protein, 242 aa, Glycine max
  Coding DNA Sequence Number=SeqID_63948
MEEKSKRGHKEHSCTESPTLNIDPPSPVARHLKWKIARTKRHGQMTSKVAQEIADKIDSLQEQATQGSFVPHGRQDILNTALGRPEHPGRVRVAGTGVTISQYFGQASRASSTSSPSINQQQLADIIGVIKDDIRKQLQDEIRKESAPIKAPEIQALLGRVSTKGSCAGPEGSGLLKELLSGGDDLMGLFVVVGENTVFAGLGKVFENSSTIHNVHYENDVVKVQVVRTYMPHAEVPIPTSE

SEQ ID NO: 180727 - protein, 129 aa, Glycine max
  Coding DNA Sequence Number=SeqID_63949
MTTIRKKWAAYFLEVGKWMSAFDMFLLGSFSPPQPSHTLVQEIIGKAPQDALGNQAEHALASLASMMLESPSFIVQFTHGLNLSLSSKEYTHGVVIRFRSVEAFEIFINSKEYKNISALGLLYAIQILV

SEQ ID NO: 180728 - protein, 83 aa, Glycine max
  Coding DNA Sequence Number=SeqID_63950
MKERVRGAQRVFEGYDAIKEQARVSLLCAPNSGTKLKGLSTTMHHQKRKTLDEDSLLSSESETQHDHRSTSTPYGSHRPRYRA

SEQ ID NO: 180729 - protein, 112 aa, Glycine max
  Coding DNA Sequence Number=SeqID_63951
LHELGLSEIVCVDNHLGISACHLTSQDDKGAEDDVSLRVSTEIVCADNHLGISACHRTSRVTIAKGGAVDKSEALSPTYPQFVMRNSDLRSSCKNGADNRKVSPHATGLLGH

SEQ ID NO: 180730 - protein, 307 aa, Glycine max
  Coding DNA Sequence Number=SeqID_63952
MEMMWDIPLSRNHWPNQCPDLHHVQPFYKPFEPKSQTLQPALTQDGKFCPGPRKKEQKDLSEKEDPFTVKLQIDTSWLSAPFINQRQASPLTRRDQCGHLHPSKRCQHLPIETTLVSPWSSRDNQGPIMVIRAFVNQRQASPLIETTLVSPSSSRDGKPDDMWRPIMVICRLCQPKASEPIDTQRPMSSLAHFRRRLNRQSSLIARGDTSWLSAPASSRDGKSDDMQRQHMVVRTLPIQRQSKTSESNDIQDDGHSFLIILEILQIYLCHPGMIKSDDAQRLFSAYQRQSSTEVFADAPDAFFGLSD

SEQ ID NO: 180731 - protein, 237 aa, Glycine max
  Coding DNA Sequence Number=SeqID_63953
MTEDRGGCMSIFTSTLLTSRAMCFDDNKDDDKKPMRMISRLSQEQFKNQEKDSRESFIKKIQDSRIIKIKIKDSKIQESREDLIKISIKKFFKTLSNTRSFHKIITKEFYSLGTSFVVQVEGTSTWVVVTENNRGYISYGSVLAEGTSTRLFKENKGGLLDPTGQGSTPYICPTPEQFEDEVAWQGDWPDTQTGAGPTGTPRDADGAQEDENMAEIARPVISPHLTLLLSVILSFSL

SEQ ID NO: 180732 - protein, 129 aa, Glycine max
  Coding DNA Sequence Number=SeqID_63954
  Homolog annotation: Hit_ID=Q10ES5; Match level="QueryCoverage=46%, HitCoverage=9%, E-value=2e-07, Identity=48%"; Hit description =Expressed protein
MGVYLSKCGGKWAELDGSNNFCIELSLEISEEKRKKGKIPSRGASITLPRRFRERFRESSSLFFVRSLILNRDHSGSLLGATEGLKASTLFLPVVEKAIADVPNLKDALGSIVDVMQAMASLIYSLSSK

SEQ ID NO: 180733 - protein, 156 aa, Glycine max
  Coding DNA Sequence Number=SeqID_63955
  Gene Ontology: Mol. function=protein tyrosine phosphatase activity; Biological process=protein amino acid dephosphorylation
  Homolog annotation: Hit_ID=Q7RS68; Match level="QueryCoverage=36%, HitCoverage=47%, E-value=1e-10, Identity=44%"; Hit description =Drosophila melanogaster CG14903 gene product
  Subcellular localization annotation: CTP_CleavageSite=38; ConfidenceScore=5.69e-01
MTLLGTALSISVIRVTLTHLRAPSFSNRASRLSSNSMSQSAATADPNAIATTNDAPSQPENADVVVQYVVLRRDLIDTWPLGSVVTQGCHASVSAVWSNKEDPFTVDYCSPDKIDSMHKLQHLDFWPFGVSVITIETAFVCNINDYKTATAATTAI

SEQ ID NO: 180734 - protein, 262 aa, Glycine max
  Coding DNA Sequence Number=SeqID_63956
  Gene Ontology: Mol. function=DNA binding
  Homolog annotation: Hit_ID=Q1S0F5; Match level="QueryCoverage=68%, HitCoverage=34%, E-value=3e-19, Identity=34%"; Hit description=IMP dehydrogenase/GMP reductase
MIEVSAEAIASLTQYYDQPLRCFTFGDFQLVPTVEEFEEILGCPLGGRKPYLFSQGVDLAAIDAFLAYHHSKESPVIVVLANACDTFDRRCDKSGARIVCCTPALYVWLVSHLFRHESRPVCPLQGHRLCTEKGKANWEQLLASVVGGSINWFPRWKERRVGVLSSCEGFPNVPLMGTRGCINYNPVLAIRQLGYPMRGAPSEEGVTPFIAWGFSDPNARILQGFRKAWGVVQRKDKELRGSSNGIIGGYHKWLKARVQELD

SEQ ID NO: 180735 - protein, 204 aa, Glycine max
  Coding DNA Sequence Number=SeqID_63957
  Pfam annotation: Domain name=DUF1852; Domain location=1-204; Score =285.9; E_value=7.7e-83; Accession=PF08908.1; Description=Domain of unknown function (DUF1852)
MNRDFAFTIKSSSFDEDYNPSESTRITTNFANLARGENRRENLRNTLVMINNRFNSLAHWDNPKADRYSVELEIISVEMRVEDQGASFPVIEILKTNIIDKKTQKRLEGIVGNNFSSYVRDYDFSVLLPAHNKNTAEFNIPDDFGDLHGNIFKHFVNSNAYHENFSKPPVICLSVSSKDTYHRTGNQHPVFGDEYRQDGASLTD

SEQ ID NO: 180736 - protein, 131 aa, Glycine max
  Coding DNA Sequence Number=SeqID_63958
  Homolog annotation: Hit_ID=Q3Z552; Match level="QueryCoverage=99%, HitCoverage=59%, E-value=5e-47, Identity=76%"; Hit description =Nucleoprotein/polynucleotide-associated enzyme
MAKVQRTAKKSRVQAREAREAVEENKKAQLERDKQLSEQQKQAALSKEYKAHVKQLIEMNRIVLAKGDIGFNFTDGNLIKRILVDKATQTQLINGRLAIARLVVENREECEYAIIPASVADKIAQRDAASI

SEQ ID NO: 180737 - protein, 37 aa, Glycine max
  Coding DNA Sequence Number=SeqID_63959
MAGEESMFHLEDECTWRWWIPNVIKGMDHYLGYPVVP

SEQ ID NO: 180738 - protein, 290 aa, Glycine max
  Coding DNA Sequence Number=SeqID_63960
  Gene Ontology: Mol. function=catalytic activity; Cellular component =nucleus; Biological process=metabolic process
  Homolog annotation: Hit_ID=Q10MK9; Match level="QueryCoverage=98%, HitCoverage=46%, E-value=1e-107, Identity=64%"; Hit description=AMP -binding enzyme family protein, expressed
MGVGRDIDDLPKNDANHTALTPLWFLERAALVHPTRTSVVHGSRHYTWHQTYQRCRRFASALSNRSIGLGHTAIIQLIGCIRFSLFTYHGYMWRLLHPTFQHFHEAHFGIPMAGAVLNTINVRLNASAIAFLLVHSSAVAVIVDQEFFPVAEESLEIWSEKSRSFNPPIVVVIGAENCHPKNLIHALAKGAVEYEKFLESGDPEFKWKPPQDEWQSIALGYTSGTTSSPKGVVLHHRGAYLMSLSGALHWGMSEGAVYLWTLSMFHCNGWCYPWTLAALCGTNICLRQAN

SEQ ID NO: 180739 - protein, 208 aa, Glycine max
  Coding DNA Sequence Number=SeqID_63961
  Gene Ontology: Mol. function=protein serine/threonine kinase activity; Cellular component=cytosol; Biological process=protein amino acid phosphorylation
  Homolog annotation: Hit_ID=Q38772; Match level="QueryCoverage=80%, HitCoverage=57%, E-value=4e-85, Identity=88%"; Hit description=Cell division control protein 2 homolog A
  Pfam annotation: Domain name=Pkinase; Domain location=2-173; Score =52.5; E_value=1.4e-12; Accession=PF00069.15; Description=Protein kinase domain
  Pfam annotation: Domain name=Pkinase_Tyr; Domain location=1-146; Score=-170.9; E_value=0.055; Accession=PF07714.7; Description =Protein tyrosine kinase
  Pfam module annotation: Pfam domain module=Pkinase::Pkinase_Tyr; Domain location=2-173::1-146
MQMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSVSARCDIVFFFIAIIKNCANKCLVQLPPFSVQGWGVVMLSRGSILH

SEQ ID NO: 180740 - protein, 62 aa, Glycine max
  Coding DNA Sequence Number=SeqID_63962
MTKEPKMGSVGGETEKPKMRRGGLIVGDCKAIEAETPFGLEGFRFEKERIVGLVENLKGEVE

SEQ ID NO: 180741 - protein, 304 aa, Glycine max
  Coding DNA Sequence Number=SeqID_63963
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SX33; Match level="QueryCoverage=90%, HitCoverage=23%, E-value=1e-117, Identity=72%"; Hit description =Putative phospholipid-transporting ATPase 9
MDRVIYFLFCILFLMAFVGSIFFGIATEDDLDNGLMKRWYLRPDDSTIFFDPKRAPAAAIFHFLTALMLYGFFIPISLYVSIEIVKVLQSIFINQDIHMYYEDADKPAHARTSNLNEELGQVDTILSDKTGTLTCNSMEFIKCSIAGVAYGRGVTEVERAMNRKNGYPLVDDTRGSTVRNSPVKGFNFSDERIMNGKWVDEPYANVIQNFFRLLSICHTAIPEVDEDTGNVSYETESPDEAAFVIAAREIGFEFYKRTQTSLSMYELDPVSGDKIESPIGLASFILVGPRGQLCLTISGLLRGE

SEQ ID NO: 180742 - protein, 615 aa, Glycine max
  Coding DNA Sequence Number=SeqID_63964
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9LI83; Match level="QueryCoverage=97%, HitCoverage=50%, E-value=0.0, Identity=77%"; Hit description =Putative phospholipid-transporting ATPase 10
  Pfam annotation: Domain name=Hydrolase; Domain location=24-305; Score= -1.7; E_value=0.066; Accession=PF00702.16; Description=haloacid dehalogenase-like hydrolase
MYKLLNVLEFNSSRKRMSVIVKDEKGRIFLLCKGADSVMFERLAKDGREFEEKTLEHVHEYADAGLRTLILAYRELDENQYKEFDNEISQAKNLISEDRETLIEEVSDKIERNLILLGATAVEDKLQNGVPDCIDKLAQAGIKIWVLTGDKMETAINIGFACSLLRQGMKQIIIHLETPDIKALEKAGDKGAIVKASRESIRHQISEAAQQLTASRGTSQQAFALIIDGKSLTYALEDNMKNMFLDLAIRCASVICCRSSPKQKALVTRLVKSGTGKTTLAIGDGANDVGMLQEADIGIGISGVEGMQAVMSSDIAIAQFCYLERLLLVHGHWCYRRISSMICYFFYKNITFGFTLFLYEVYASFSGQPAYNDWFLSLYNVFFSSLPVIALGVFDQDVSARYCLRFPMLYQEGVQNVLFSWRRIFSWMLNGFISAIIIFFFCTKAMEIQAFDEKGRTAGRDILGATMYTCVVWVVNLQMAVSISYFTLIQHIFIWGSIALWYLFLMVYGALSPSFSGNAYKVFIETLAPSPSFWIVTLFVSISTLIPYFSYSAIQMKFFPMYHEMVQWIRHEGKTNDPQFVAMVRQGSLRPTTVGSTARLAAKDNDFRDSGTNHR

SEQ ID NO: 180743 - protein, 246 aa, Glycine max
  Coding DNA Sequence Number=SeqID_63965
  Homolog annotation: Hit_ID=Q9LUV3; Match level="QueryCoverage=21%, HitCoverage=5%, E-value=8e-16, Identity=77%"; Hit description =Arabidopsis thaliana genomic DNA, chromosome 3, P1 clone: MGD8
MAFLLWRALSDRLPTKENLLKRGIIVEEVDHLWPLCNQHLETSYHIFLNYDFVQKTSYERICPTFKNGPVLVNSTPEEQYVNIEIPEQLIRGWQQQGCTHLHYGAIRNRISKLNMFFSGDSSTRKRVDLGGRSSKERDRNNLLEQTRLERNRRMWLRQQNSAALRIQETMFLGNSFGQVSHGGSWESKFPKLKNKFNYGNIDTKEETASRGNRVHQAKVQTQDKGVQIAAKAKKTITRPSYLSDYV

SEQ ID NO: 180744 - protein, 189 aa, Glycine max
  Coding DNA Sequence Number=SeqID_63966
  Homolog annotation: Hit_ID=Q6Z856; Match level="QueryCoverage=64%, HitCoverage=36%, E-value=3e-14, Identity=37%"; Hit description=Kelch repeat containing F-box protein family-like
  Pfam annotation: Domain name=Kelch_1; Domain location=6-58; Score =22.6; E_value=0.0014; Accession=PF01344.15; Description=Kelch motif
MLSPRGSFACAMVPARGSIYVAGGGSRHTMFGPAGSRIRSVEQYEVGRDRWVLMENLPGCVGFVGEEGRELWVIGGDGSGEWHLERVGDMSGNRERVGVGKIVVVEYNGCPMLFMLDRNEILRRLVDLLLAIGRSFFLLFCVMVLLVRIGAIKVLLHVVRFCDPMHRLWCHVTSAQQWSVIGNLRWLMM

SEQ ID NO: 180745 - protein, 109 aa, Glycine max
  Coding DNA Sequence Number=SeqID_63967
MQELDWLPKLRTSSEEEAETPEESEEVQALKAELEKAQAVKEKFKMIAIKVWKECDELRDINMATAEALDRETKRARKEEWGQNKFRGALWGSNIELKLQRVERDQSRV

SEQ ID NO: 180746 - protein, 433 aa, Glycine max
  Coding DNA Sequence Number=SeqID_63968
  Gene Ontology: Mol. function=transferase activity; Cellular component= intracellular; Biological process=DNA integration
  Homolog annotation: Hit_ID=Q1S330; Match level="QueryCoverage=48%, HitCoverage=21%, E-value=3e-60, Identity=56%"; Hit description =Integrase, catalytic region; Zinc finger, CCHC-type; Peptidase aspartic, catalytic
MNSEANKNTWKRKRRFCGFAIKKEPKATSARVHRLVVLTLGSSRQTRLHQVWGCLAKVALPDFKRTNVVPLHLHTSSSVTNEQVNEPRRSKRKRIESSFGPDFVTAFVVENNDVDKINDVFVSTFLIEEDPKTYNETVTSIDANFWKEAINSELDSIMSNHTWDLVDLPKGSKPIRCKWIFRKKLRTDGTIDKFKARLVVVGYTQKKEIDYFDTYSPVIKISTIRSLVALAAIHGLIVHQMDVKTTFLNGDLREEIYVEQPEGYVIQGQENKVWSVMFLMNCTRPDIAYAVSRLSRYTHNPGGGAISWKSSKQTCIARSTMVSEFIALDLAGQEAEWLRNLLADVPLWGKRSIPVSLHCDSEAAIGIAKNSVYNGKRRHIRIRHSSVRELLKNGVISLQFVRSENNLADPFTKGLTKKVILESSRGMGLKPLC

SEQ ID NO: 180747 - protein, 231 aa, Glycine max
  Coding DNA Sequence Number=SeqID_63969
  Gene Ontology: Mol. function=oxidoreductase activity; Cellular component=membrane; Biological process=metabolic process
  Homolog annotation: Hit_ID=Q2CQH8; Match level="QueryCoverage=59%, HitCoverage=54%, E-value=7e-19, Identity=40%"; Hit description =Probable short chain dehydrogenase
  Pfam annotation: Domain name=adh_short; Domain location=88-230; Score= -61.1; E_value=0.058; Accession=PF00106.15; Description=short chain dehydrogenase
MINQVLRRRLIIDRIDGYTVPTWKPRFKVLCPSTLLTSTQDKSLTLFFDVTMLLPPTQQHSLMMASHSPRILSLTRRAFSSCSFQGEGVSMVQGASRGIGLEFVKQLLENDDKEHVIATCRNPSASTGLIHLKDKFADRLRILPLDLTVENSIEASALSIRETYGRLNLLINASGILSIPEVIHPETTLNKVEKSSLMLAYEVNAVGPILVIKLSMRKDNGCPAIPTYLAH

SEQ ID NO: 180748 - protein, 502 aa, Glycine max
  Coding DNA Sequence Number=SeqID_63970
  Homolog annotation: Hit_ID=Q9ZPY4; Match level="QueryCoverage=34%, HitCoverage=37%, E-value=3e-20, Identity=37%"; Hit description =Expressed protein
MASAEGKAPYTANCFTQDFRIPLSSLDHPSSVSKKLVSDWVPNNSINDQILSNSVFVPHNLNSDKLPEMKWWLHVKSDLGDEANYTCQQLNSYESELGSFYAEFLNGSAKSGGDQLVKDFDFLSNIESANLYVEQPWHVVSPTCMKNNTRMPKIEASLNNTDLHFTPKKKDQEEFYFSDSHFMDCDISNFLVSEQGKMTSSDLESHLMGAEKTGPWWRTAGKDELASLVARKSLEHIGNCDLPHPQTKHVSPRPPYPKGVDHHDKTPPSLNRKTETGSSYADGYTTGISTSDCSFQDSSKHSSKDSSSSTEGCQINSENGSMSELLKALCHSQTRAREAEKAAQRAYSEKEHILSLFFRQASQLFAYKQWLHMLQLENLGMLLKKSNSKARKRRNSNKRCVIAKCVVAAVGLGLAGAGDVYSYWGIVLVLCHGLFLRIIALKMICAALKGTGGNINGDAVKETTEFIGFGVVGLLGFGVVGLLILGVVGLLDDRDPVRRRGN

SEQ ID NO: 180749 - protein, 194 aa, Glycine max
  Coding DNA Sequence Number=SeqID_63971
  Gene Ontology: Cellular component=cytoskeleton
  Homolog annotation: Hit_ID=Q9M3A3; Match level="QueryCoverage=99%, HitCoverage=54%, E-value=1e-18, Identity=34%"; Hit description =Protein ABIL2
MHGANRTKSKHVGYNLDDEDEWPNFRNGVNLKYKLIFLLLRLYPKAVRATIRETPPSTARRGRSPSPSLQPQRSGAFSFTSTMPKKDLERRSVSPYRFPLLRTGSRSSSRPTTPKISRPTTPNPSRPTTPNPSNARQRYPSEPRKSSSMRLSAERDHGKELEQYPSKSKRLLKALLSRRKSKKDDMLYTYLDEY

SEQ ID NO: 180750 - protein, 506 aa, Glycine max
  Coding DNA Sequence Number=SeqID_63972
  Gene Ontology: Mol. function=RNA-directed DNA polymerase activity; Biological process=RNA-dependent DNA replication
MHANNVKAINKFVANNKYVPYQKYGGKNPKGVKIRDYGVKGKSNFKKTVNSKIKYKEQVGAQILQQVMKKDTDEAKKDGRTYDESDIAFVLSKRLETGDSLVTDGDMDYTNETIIGTAMVLVENGGFNTLMKDTMKQNNSSFLILLETQTSGEKGRSIIRRIGLKGCCVEEASGHWGGIWCLWDTNNWSVTIGTTVVGEWAIVGDFNNTLSTRESAEGASKGGHRDMEAASEYKKTWIEYEQVLAEEELHWFQKSKAKWLYMGDHNTKYFHGITTIRRKRNKHDMLKDENGNWIFDTRAVESLVTNFYKDLYLDNGIVIPYVLNNAFPPLEENWINKLSRMPTNEEIHQTIKFMGSLKAPKLDGFHVLFFEHHWSVVGRDKCEVNFIKDFRPLSFCNVIYEAMTRLISQRLRPMMGKLVGHFQSSLTPIVKVGIILCLLKSFGGIFPMERHPIRRSPNFYLFDLCISIATDQGIWRPIRLSRNGPPITHLAFVDDVILSVKASLDQ

SEQ ID NO: 180751 - protein, 459 aa, Glycine max
  Coding DNA Sequence Number=SeqID_63973
  Gene Ontology: Mol. function=zinc ion binding; Cellular component =nucleus; Biological process=regulation of transcription
  Homolog annotation: Hit_ID=Q1SDI6; Match level="QueryCoverage=66%, HitCoverage=51%, E-value=3e-77, Identity=45%"; Hit description=FAR1; Zinc finger, SWIM-type
  Pfam annotation: Domain name=SWIM; Domain location=210-246; Score =33.7; E_value=6.3e-07; Accession=PF04434.8; Description=SWIM zinc finger
MARALWEVISETEHGLCTWHIMKNGIKHLGNLMKDGPNFLSNFKKCMYDNEEETNVEASWRTLLLKYNVEENTWLNSTYQIKEKWAACYMKYAFTLGMRSTQLSESINSDIKSCTRPNLNIKQFERIVKEKRYSELKQDYEMRQKLPRMIIQSSPMIRKLSQEYTPPMFNLFQREWDLIAATNIYKKKMEANGEYVITMVDENGEWRVSYESQIENGELTITCSCRKFEKWGILCCHLLRILFRKDVKLLPNKYILKWLESSNRYKQLCAMLMRLADEASDYPEACSLVYQGVLELSKKVAEIRLNQSPHGPHDSTCEATRYAIEPLASKGIGFKKRDVWYVNSKTMIYQESQVLLEASNSNSLIGFAHLNQLSLQEPTSILPKAYTHLVSFPPQPSQMSFTRMLVAQDEDNIPSPNWFLCCPTTEKPGPIPSLEALDFSQIISNDRICRSQIRICHGQ

SEQ ID NO: 180752 - protein, 310 aa, Glycine max
  Coding DNA Sequence Number=SeqID_63974
  Gene Ontology: Mol. function=protein kinase activity; Biological process=protein amino acid phosphorylation
  Homolog annotation: Hit_ID=Q6F3B8; Match level="QueryCoverage=80%, HitCoverage=89%, E-value=8e-37, Identity=30%"; Hit description =Expressed protein
  Pfam annotation: Domain name=DUF860; Domain location=42-273; Score =155.2; E_value=1.7e-43; Accession=PF05898.4; Description=Plant specific of unknown function (DUF860)
MFFNFEESAVKTIKLSFKYKVQQDLPFLQIQRYSYVNVYMKWKKDSYYDSVEHIHDSVQLKPIIALKNCIAWDLNGLTPEAAEIDRDEKRVYEECREDLRSRLRKMILMTREHVLPLKIIQGMQWYLGLLSDFLQHPEQNLDESFRFVDMEDGLKGLALDSGEKIYSLMEKNATKRDKRLVGVLHELLSLFVEHSAERKKLFCLKKYFGLPQKVHRAFERHPHMFYISFRNKTRTVILKEAYSNKSAIEKHPLLRVRKKYIKLMKKSEVILRNRRVNNRFSNCNAKLDIDSNDLGEKGHEMSSCSLEQVA

SEQ ID NO: 180753 - protein, 303 aa, Glycine max
  Coding DNA Sequence Number=SeqID_63975
  Gene Ontology: Mol. function=5-formyltetrahydrofolate transporter activity; Cellular component=membrane
  Homolog annotation: Hit_ID=Q10ZJ4; Match level="QueryCoverage=87%, HitCoverage=57%, E-value=2e-23, Identity=28%"; Hit description =Folate/biopterin transporter
  Pfam annotation: Domain name=BT1; Domain location=1-303; Score=120.1; E_value=6.1e-33; Accession=PF03092.7; Description=BT1 family
  Subcellular localization annotation: CTP_CleavageSite=27; ConfidenceScore=5.56e-01
MAKQTPSSTKHPHPSSSGNLQSFVWIASSAGGVLGNLLGGIFIGRFSPQSMFLYFGLLLALQFFITISVRESSLGLPKSPSGGIRKQLSQLLVALRKPEISYSISWFTASYAIIPALTGTMFFYQTQYLKIDSSVLGISKVFGQATMLLWGIIYNQYFKSVPPRKLISAIQAMMAFLMISDFLFVRGFYRQMGVPDSLYVVIFSGFLEVLFFFKILPFSVLIAQMCPPGCEGSIMAFLMSCVALALIVSGYLGVALASCIKVTASDFSGLPLGLLIQATCTLLPTFWSSCIPDKVETKAKRKD

SEQ ID NO: 180754 - protein, 99 aa, Glycine max
  Coding DNA Sequence Number=SeqID_63976
  Gene Ontology: Cellular component=membrane
MPPRRFPRTPPAEEAIQTNDWRLPEEDGWGCLVEEGVCLAISATMASFATSAIEAPRLLRRRYMEIVKIDMFDGEIAMTSHDSACKKAAKTDSRKYFRN

SEQ ID NO: 180755 - protein, 115 aa, Glycine max
  Coding DNA Sequence Number=SeqID_63977
MAIPKSRFATTKVSFKLSRDTFQETITSLLLSSLTHHHIMGEKCMKMVLWVLVVFKEDGDRWCGVVMETTVACGSQRALWFCRWSFIGCGCAGSSLKQNCWLPLCQIVVFLKELD

SEQ ID NO: 180756 - protein, 200 aa, Glycine max
  Coding DNA Sequence Number=SeqID_63978
  Gene Ontology: Mol. function=transferase activity, transferring hexosyl groups; Biological process=carbohydrate biosynthetic process
  Homolog annotation: Hit_ID=Q6CE34; Match level="QueryCoverage=29%, HitCoverage=38%, E-value=2e-09, Identity=46%"; Hit description =Similarities with wi|NCU03528.1 Neurospora crassa NCU03528.1 hypothetical protein
  Pfam annotation: Domain name=DNA_pol_delta_4; Domain location=2-90; Score=25.5; E_value=1.4e-07; Accession=PF04081.4; Description=DNA polymerase delta, subunit 4
MKRFYRQRKSTTNKSSSKSRKKSKVVEKCPEDYSSEEHVLRMFDMNMKYGPCLGLTRLQRWERAHKMSLNPPEQIKCLLEAEDVLSQTSRVKIRGLAGSNSATMKWKNTFSGHEEWQRTKCTATMEPRRLTKRATCPVSVLRRLDVVEECAVVCGSQERADSETEQWLEEEAENEGGNDDALAEERKFQSEKERELEFRE

SEQ ID NO: 180757 - protein, 140 aa, Glycine max
  Coding DNA Sequence Number=SeqID_63979
  Gene Ontology: Mol. function=5-formyltetrahydrofolate transporter activity; Cellular component=membrane
  Homolog annotation: Hit_ID=Q9SKZ5; Match level="QueryCoverage=56%, HitCoverage=14%, E-value=5e-10, Identity=41%"; Hit description =Expressed protein
MVASDGGGGGKLTKKVLGLGYWVQGFRCFPWLVVSFYLKDGLNVDPSILQILQSSANLPMVGKPLYGLVSDSVYISGQHRVPYIALGDSLNSLDYSWQSGLLALLRQLLTGVPLSVYSDSSVVPKNMWIRIVNLSLSSET

SEQ ID NO: 180758 - protein, 206 aa, Glycine max
  Coding DNA Sequence Number=SeqID_63980
  Gene Ontology: Mol. function=zinc ion binding; Cellular component =nucleus; Biological process=ubiquitin-dependent protein catabolic process
  Homolog annotation: Hit_ID=Q1S7F8; Match level="QueryCoverage=60%, HitCoverage=46%, E-value=3e-20, Identity=34%"; Hit description =Ubiquitin; Seven in absentia protein
  Pfam annotation: Domain name=Sina; Domain location=16-194; Score= -49.7; E_value=0.0015; Accession=PF03145.7; Description=Seven in absentia protein family
QVWHKCPFCSMFIGDKRCQAIETVMESLKTVCCNAKHGCNAIVRYSEKREHEKTCIFVPCLCPQPRCDWISNSNELGQHFNARHPTTRVLQAVSDGKLFVISNDEREKENPLILFHVGPDSWIPEFDYESTQELKFEFSLATVLHIPIEMWSSCNGQIKLQFLITTVSGAFKVVSEQKNELINDPTPNGRPKRIRNRPAGLDDFYP

SEQ ID NO: 180759 - protein, 275 aa, Glycine max
  Coding DNA Sequence Number=SeqID_63981
  Gene Ontology: Biological process=regulation of transcription
  Homolog annotation: Hit_ID=Q6Z2T5; Match level="QueryCoverage=55%, HitCoverage=68%, E-value=4e-23, Identity=38%"; Hit description=RWP -RK domain-containing protein-like
  Pfam annotation: Domain name=RWP-RK; Domain location=164-215; Score =62.4; E_value=1.5e-15; Accession=PF02042.6; Description=RWP-RK domain
MEVSPLEGFSELDWWTPQLPYSSNHLCFNEFPDLENLDLDFSLPSLGEHLEEVDQKPSNIVVPEGLRCNHEKVFGDALLATEHVSATCVKKEQVLNNIDQSPLPVLLASNSTTRKKPCALEFEEASFAIQNQNGSATASYLKKEEVQNIIHQRPLPVSSSSKKRTCVLEFDEIKKHFGVPITEAAKRLNVGLTMLKRRCRELSITRWPHRKLKSLQLLIDNVKEMGLEDEVPRLERQKRLLEKLPGLELSEEAKKLRQACFKANYKKRRCMALQS

SEQ ID NO: 180760 - protein, 77 aa, Glycine max
  Coding DNA Sequence Number=SeqID_63982
MEVDKSSGDADTSLPIKINCFLGKDLFLFLLMDDALESLKKKFMLLFLRCQKFQLIHSINDDFLQMGYYYTSLGTVC

SEQ ID NO: 180761 - protein, 291 aa, Glycine max
  Coding DNA Sequence Number=SeqID_63983
  Gene Ontology: Mol. function=sugar porter activity; Cellular component=membrane; Biological process=phosphoenolpyruvate-dependent sugar phosphotransferase system
  Homolog annotation: Hit_ID=UPI00006A08A1; Match level="QueryCoverage =83%, HitCoverage=15%, E-value=1e-09, Identity=23%"; Hit description =Serine/threonine-protein kinase MRCK gamma (EC 2.7.1.37) (CDC42- binding protein ...
  Homolog annotation: Hit description=kinase gamma) (Myotonic dystrophy kinase-related CDC42-binding kinase gamma) (Myotonic dystrophy protein kinase-like alpha) (MRCK gamma) (DMPK-like gamma).
  Pfam annotation: Domain name=TBPIP; Domain location=70-233; Score= -52.7; E_value=0.077; Accession=PF07106.3; Description=Tat binding protein 1(TBP-1)-interact
MANKVTFYCHLGKGPGCNMHTEDELADFKAWFEILSRKSSNGEDQGTSSKDTDLKKKGSTNRGNKPTRNNTAEKEKYSSEIKDEFSRLKGEYDKLALEKYSEVTALLAEKKFVWNQYNIMENDYADKLRTKEAEVEKANEKIKVLVSSMEQLQSEKYEKDSKISELQSKMAEMEAETKRLNKEISGLSVELESLRKFRNNQVTPPVLNHCTQGTKAPESGVVKSNRSRRNMTSKKEICTPNAPVPAKSSETGTKTKSMKRKEAPVIPTSDTPKLFSSSFKVPKLKSSVRVT

SEQ ID NO: 180762 - protein, 132 aa, Glycine max
  Coding DNA Sequence Number=SeqID_63984
  Gene Ontology: Biological process=regulation of transcription
  Homolog annotation: Hit_ID=Q6Z2T5; Match level="QueryCoverage=80%, HitCoverage=50%, E-value=2e-18, Identity=40%"; Hit description=RWP -RK domain-containing protein-like
  Pfam annotation: Domain name=RWP-RK; Domain location=21-72; Score =65.9; E_value=1.3e-16; Accession=PF02042.6; Description=RWP-RK domain
KEKVQIIDQSPLASSSSTKKRPCALEFEEISKYFGVPINEAAKQMNVGVTMLKKRCRELNIMRWPRRKIKSLQMVIDSVKEMGLEDEVARLEEHKKLLEKLPGLELSEEAKKLRHACFKANYKKKRCMALQA

SEQ ID NO: 180763 - protein, 447 aa, Glycine max
  Coding DNA Sequence Number=SeqID_63985
  Gene Ontology: Mol. function=DNA helicase activity; Biological process=DNA replication, synthesis of RNA primer
  Homolog annotation: Hit_ID=Q016M7; Match level="QueryCoverage=96%, HitCoverage=56%, E-value=1e-129, Identity=52%"; Hit description =Homology to unknown gene
MDKLAMEEAGFLNCVSVPDGAPPSISSKELPPQDKATRVILATDGDPPGQALAEELARRIGKEKCWRVRWPRKSRSDNCKDANEARLESWKLRTANSSNLITYSQVLMYLGPDALKEVIENAELYPIRGLFNFRDYFDEIDAYYHRTLGYDIGISTGWNNLNDLYNVVPGELTIVTGVPNSGKSEWIDALLCNLNEIVGWKFALCSMENKVREHARKLLEKHLKKPFFNERYGESVERMSVEEFEQGKLWLSDTFSLISGTVEAGCSNKIHCILLCLDYLAADTRCEDDSLPNISWVLDLAKAAVLRHGVRGLVIDPYNELDHQRPPNQTETEYVSQMLTLIKRFAQHHGCHVWFVAHPRQLHNWVGGPPNLYDISGSAHFINKCDNGIVIHRNRDPEAGPIDQVQVCVRKVRNKVAGTIGEAILLYNRVTGEYTPSDNNRPADRKR

SEQ ID NO: 180764 - protein, 498 aa, Glycine max
  Coding DNA Sequence Number=SeqID_63986
  Gene Ontology: Mol. function=transporter activity; Cellular component= integral to membrane; Biological process=cell division
  Homolog annotation: Hit_ID=Q94C59; Match level="QueryCoverage=67%, HitCoverage=61%, E-value=1e-134, Identity=69%"; Hit description =Patellin-4
  Pfam annotation: Domain name=CRAL_TRIO; Domain location=222-404; Score=66.1; E_value=1.2e-16; Accession=PF00650.10; Description =CRALTRIO domain
  Pfam annotation: Domain name=CRAL_TRIO_N; Domain location=136-207; Score=39.2; E_value=1.4e-08; Accession=PF03765.5; Description =CRALTRIO, N-terminus
  Pfam annotation: Domain name=EMP24_GP25L; Domain location=414-493; Score=31.4; E_value=3.2e-06; Accession=PF01105.14; Description =emp24gp25Lp24 family
  Pfam module annotation: Pfam domain module=CRAL_TRIO::CRAL_TRIO _N::EMP24_GP25L; Domain location=222-404::136-207::414-493
MASRAAKQNNISGKRIPNGSSVLDPLMLPLFVTMTAEVMAQEETQAAEVVVAVEPLKEEKVAEENVKPRESSVEASKPKMVEKSSSYKEESNYLSDLKEFERKALSELKSKLEEAILGNTLFEPKKEALLENEEKKNEGEEKEEEEEKKVDVEENDVSLWGVPLLPSKGAEGVDVVLLKFLRAREFKVNDAFEMLKKTLKWRKESKIDSAVDEDFGSDLASAAYMNGVDHEGHPVCYNIFGAFESEELYQKTFGTEEKRSEFLRWRCQLMEKGIQKLNLKPGGVSSLLQINDLKNSPGPSKLRVATKQTLAMLQDNYPEMVAKNIFINVPFWYYALNALLSPFLTQRTKSKFVVARPNKVTETLTKYIPIEEIPLHYGGFKRENDSEFSSQDGAVSELILKAGSTATIEVPALEVGNSLCWDLTVLGWEVSYKEEFVPTDEGSYTVIVQKGKKMGSQEWPLRNTFMNSEPGKVVLTIENTSNKKKRVLYRYKTIKSSF

SEQ ID NO: 180765 - protein, 95 aa, Glycine max
  Coding DNA Sequence Number=SeqID_63987
MLQWVSKEASQARSRCRNHHHVDRRTMMLVVGSPAGKVVGAPVADNRKRKEDSKQKGQLECGKRTPEEGRQAESSTEMQKRVISKVTAAGKITGE

SEQ ID NO: 180766 - protein, 119 aa, Glycine max
  Coding DNA Sequence Number=SeqID_63988
MENGCSEKKNEAYTLLESALIVTYLTALIVVACVLKRATYRGAERKGRVKRGSVQRLGCHLSAAFYDQGDILLAEFLATRDRLNICLDNGLQGVDMRVGFFGCRQTQIYDFGSTIDLHQ

SEQ ID NO: 180767 - protein, 84 aa, Glycine max
  Coding DNA Sequence Number=SeqID_63989
  Homolog annotation: Hit_ID=Q9LUV3; Match level="QueryCoverage=82%, HitCoverage=7%, E-value=1e-12, Identity=51%"; Hit description =Arabidopsis thaliana genomic DNA, chromosome 3, P1 clone: MGD8
MATWVPNLISSLPKDISDEFPTYACLLGNILETGGFALSRPDCSFDMAIDLAAVITFLLESHPSLTRSDGRESMLSIHTLKFSC

SEQ ID NO: 180768 - protein, 126 aa, Glycine max
  Coding DNA Sequence Number=SeqID_63990
MALHVATEKYMHLVDIVRGVTCPPASAWFVLESHRTERKVCSDTICNIPDCQCLSGSNTTILHTVTLHSTPRWSEPSTGQNPPRVAHCLGLCFYCRSRPSCASITSEFASNEASLRQKAEGAVKMD

SEQ ID NO: 180769 - protein, 448 aa, Glycine max
  Coding DNA Sequence Number=SeqID_63991
  Gene Ontology: Mol. function=protein serine/threonine kinase activity; Cellular component=mitochondrion; Biological process =protein amino acid phosphorylation
  Homolog annotation: Hit_ID=Q1RSC2; Match level="QueryCoverage=97%, HitCoverage=91%, E-value=1e-154, Identity=42%"; Hit description =Pentatricopeptide repeat
  Pfam annotation: Domain name=PPR; Domain location=129-163; Score =42.6; E_value=1.4e-09; Accession=PF01535.11; Description=PPR repeat
  Pfam annotation: Domain name=PPR; Domain location=164-198; Score =43.8; E_value=5.9e-10; Accession=PF01535.11; Description=PPR repeat
  Pfam annotation: Domain name=PPR; Domain location=199-233; Score =37.4; E_value=4.8e-08; Accession=PF01535.11; Description=PPR repeat
  Pfam annotation: Domain name=PPR; Domain location=234-268; Score =42.0; E_value=2e-09; Accession=PF01535.11; Description=PPR repeat
  Pfam annotation: Domain name=PPR; Domain location=24-58; Score=26.5; E_value=9.5e-05; Accession=PF01535.11; Description=PPR repeat
  Pfam annotation: Domain name=PPR; Domain location=269-303; Score =42.7; E_value=1.2e-09; Accession=PF01535.11; Description=PPR repeat
  Pfam annotation: Domain name=PPR; Domain location=304-338; Score =49.1; E_value=1.5e-11; Accession=PF01535.11; Description=PPR repeat
  Pfam annotation: Domain name=PPR; Domain location=339-373; Score =38.3; E_value=2.7e-08; Accession=PF01535.11; Description=PPR repeat
  Pfam annotation: Domain name=PPR; Domain location=374-408; Score =50.0; E_value=8e-12; Accession=PF01535.11; Description=PPR repeat
  Pfam annotation: Domain name=PPR; Domain location=409-443; Score =21.6; E_value=0.0027; Accession=PF01535.11; Description=PPR repeat
  Pfam annotation: Domain name=PPR; Domain location=59-93; Score=20.5; E_value=0.0061; Accession=PF01535.11; Description=PPR repeat
  Pfam annotation: Domain name=PPR; Domain location=94-128; Score=29.9; E_value=8.7e-06; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=129-163::164 -198::199-233::234-268::24-58::269-303::304-338::339-373::374 -408::409-443::59-93::94-128
MKHYPIAISLSKQMEAKGIEPNLVTLSILINCFCHMGQMALSFSVLGKILKLGYQPSTITLTTLMKGLCLKGEVKKSLHFHDKVVAQGFQMNQVSYATLLNGLCKIGETRCAIKLLRMIEDRSTRPDVVMYNTIIDGLCKDKLLMGALSLLNEMTLKNINPDVYTYSILIDALCNVGKVKEAKNLLAVMTKEGVKPDVVAYNTLMDGYCLVGGVQDAKQILHAMIQTGVNPDVCSYTIIINGLCKSKRVDEAMNLLRGMLHKNMVPDRVTYSSLIDGLCKSGRITSALGLMKEMHHRGQQADVVTYTSLLDGLCKNENFDKATALFMKMKEWGIQPNKYTYTALIDGLCKSGRLKNAQELFQHLLVKGYCINVWTYTVMISGLCKEGMFDEALAMKSKMEDNGCIPNAVTFEIIIRSLFEKDENDKAEKLLHEMIAKGLVRFRNFHGR

SEQ ID NO: 180770 - protein, 132 aa, Glycine max
  Coding DNA Sequence Number=SeqID_63992
  Homolog annotation: Hit_ID=Q7XDI4; Match level="QueryCoverage=99%, HitCoverage=14%, E-value=4e-19, Identity=43%"; Hit description =Expressed protein
MTSILTERAQAPAAKEVMKASFDAFLTVLLAGGTTRVFNESDHESIREDFDSLKQLFCSFGEELIAENEVEKAAEIVEGVMALMGMSTEQLMENLSTLSNETSGIGVIGNGQKLPMPPTLQESGIEQTPTQY

SEQ ID NO: 180771 - protein, 62 aa, Glycine max
  Coding DNA Sequence Number=SeqID_63993
LAANAILADSPRNIRIGLLNMYITINTTPASERKGRRSQKAAANGGSGGGGRLARRSWFRRR

SEQ ID NO: 180772 - protein, 87 aa, Glycine max
  Coding DNA Sequence Number=SeqID_63994
MPISPCRNISWSVSFRHRDRARKTLSGPEEVQQDPRVSSSDYRPLDRARKTPSGPEEAQQGPGFPALVTGLYHSYRVPVPPSKVIPS

SEQ ID NO: 180773 - protein, 100 aa, Glycine max
  Coding DNA Sequence Number=SeqID_63995
MLLSSNVIHICARVVMLVRMTHTHLFAAARGVARELIKGNYWPHNPERKSRPLKVRTYSPLRARACSPLKLRMCCPLKVRACNPLKVRTCSPLKAMACNA

SEQ ID NO: 180774 - protein, 96 aa, Glycine max
  Coding DNA Sequence Number=SeqID_63996
MALWQLIMRLGLSNQGNVNLLEKTTMDDLVKERSTGSVTFTLRVSSVNMFKSGSISTRTEEIVAICEGLKVVFQNNNATTGTMDNRGKPADCQLYI

SEQ ID NO: 180775 - protein, 98 aa, Glycine max
  Coding DNA Sequence Number=SeqID_63997
METKQHPPPQSPLVVANMHNERLQPPPQSSEFTPQQQHHQDYGNNSLFFSASREDFMSNLIDLDLQTPKSAYVYMQMKEKLVVTNEQLQSKEHGQVHQ

SEQ ID NO: 180776 - protein, 131 aa, Glycine max
  Coding DNA Sequence Number=SeqID_63998
MASSNQEKGNSQTESPPLTNQSSEQHTDPPPPTTTHPTHPPPHPMYYQNPHTYPQYPPGYPPGYPPGYHYPQNAPYYGPPPTYQTSSPGTRFIRSFILCFMMILTFFFLSSLVLALMLRPELPVYKVVSFN

SEQ ID NO: 180777 - protein, 38 aa, Glycine max
  Coding DNA Sequence Number=SeqID_63999
MASQKGILEPHCFEESRFRCSEQPRVPKKMEDIGLVNG

SEQ ID NO: 180778 - protein, 105 aa, Glycine max
  Coding DNA Sequence Number=SeqID_64000
MTRWMTLKNLMLEDAGTQCSGYSQPIKENKLVIIISLRSYNLPTAHYHSYKKRKRENSLLLTSNEAIPQQGKRRQSHDHSHDQIDTMALSTTIITTTLTMAKPRL

SEQ ID NO: 180779 - protein, 85 aa, Glycine max
  Coding DNA Sequence Number=SeqID_64001
  Homolog annotation: Hit_ID=Q1SMF0; Match level="QueryCoverage=87%, HitCoverage=14%, E-value=8e-08, Identity=38%"; Hit description =Tetratricopeptide-like helical
MAKSFVGHPYVGRLTKDEKIVVVDMTKSLVQQRNILLMFKEHNANSYTTIKQIYNARNAYRSSKKGSNIEMQQLMMLLDRDQYIH

SEQ ID NO: 180780 - protein, 45 aa, Glycine max
  Coding DNA Sequence Number=SeqID_64002
MEHLLGGDEQKRKTESKNAKKDDPRAANSSIPWGNINHVPSLLMD

SEQ ID NO: 180781 - protein, 223 aa, Glycine max
  Coding DNA Sequence Number=SeqID_64003
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=97%, HitCoverage=28%, E-value=9e-22, Identity=30%"; Hit description=DNA -directed DNA polymerase
TDSIVLGNPLPEEDVSSSVLGKFKLEDKILEGFFLAPKCYSYTTEESDGNKKVYKYKGPGRNVITPEWYKEQYADPSQSLIKKVTYQFRPDWKELSVKKKESTTTLRTLSNSKRIPFFNEKGKYVSTDPLDINDLSSLNYIGTKLLESFKRKTALLEKENSALSQKLQKLEQERGIIAQRRVEEGNNTEDNNTLEQNNAKRAEDNINGDLLDPDTMPRDKKPP

SEQ ID NO: 180782 - protein, 123 aa, Glycine max
  Coding DNA Sequence Number=SeqID_64004
MHCVIDYTYLAGNRLPEASTRFQSPFLSLVIDYTPGQSITRGFLSFLTSFSSLELAYLGTSQVLTDRLCPGWVGIGQAWFWAIAPNLTSPRSPDPRDISPGTTLWSTIKAGSFTLQHFLISSL

SEQ ID NO: 180783 - protein, 346 aa, Glycine max
  Coding DNA Sequence Number=SeqID_64005
  Gene Ontology: Cellular component=1-2nm peptidoglycan-based cell wall; Biological process=regulation of cell growth
  Homolog annotation: Hit_ID=P58722; Match level="QueryCoverage=100%, HitCoverage=50%, E-value=1e-101, Identity=52%"; Hit description =Putative membrane protein igaA homolog
  Pfam annotation: Domain name=IgaA; Domain location=1-346; Score=67.1; E_value=9.9e-20; Accession=PF07095.2; Description=Intracellular growth attenuator protein Iga
MSTLIVILAVMLACSLVAGIGYWYAMRHRPPLAKPLPFISPPCRKLTDEERAAVEKYIASLGKARQHSGGRSTRSSREPEALALTAQSNNVYPVTRSITRYGLSTDDPHKWRYYLDEVEVHLPPLWEQYIAEENYVELIRTQTLPLVISLNGHSLVNYAVEQPALPPLVRPMSTNASIRKEESENVELLQVRKESPEEYQLSRADGTREASAICCAFLLFFLSLVLPGSLMLWIALPAGAIVAVSLWFMYRFPGEKGLRDVHCLRGAPKRWGLFGESNQEQSNISLGIIDLIYPAHWQPYVAHDLGQVVRQGRFLSLQDEVRNFPVQRWRKNLVLACGSLLVLVML

SEQ ID NO: 180784 - protein, 168 aa, Glycine max
  Coding DNA Sequence Number=SeqID_64006
  Gene Ontology: Mol. function=transporter activity; Cellular component= integral to membrane; Biological process=transport
  Homolog annotation: Hit_ID=P72121; Match level="QueryCoverage=98%, HitCoverage=23%, E-value=6e-51, Identity=57%"; Hit description=Outer membrane protein C precursor
  Pfam annotation: Domain name=TonB_dep_Rec; Domain location=19-168; Score=29.6; E_value=1.1e-05; Accession=PF00593.14; Description=TonB dependent receptor
MGGMGATAQARNVDARIAGGELGVSYQVAPRWKLGGTLAYAWGQNRSDGRPMPQMPPLEARLSAAYDDGTWSAGALWREVAAQRRYALEQGNVVSKDFGPSAGFGVFSLNGGYAFSKQVQLSLGVDNLFDKTYAEHLNLAGDAGFGFAANTAFNEPGRTFWARLSFKY

SEQ ID NO: 180785 - protein, 204 aa, Glycine max
  Coding DNA Sequence Number=SeqID_64007
  Gene Ontology: Mol. function=ATP-dependent DNA helicase activity; Biological process=DNA repair
  Homolog annotation: Hit_ID=Q8YE55; Match level="QueryCoverage=100%, HitCoverage=17%, E-value=8e-82, Identity=77%"; Hit description=ATP -DEPENDENT NUCLEASE SUBUNIT A
MDDLMQAALVGEARRQLLETAHGGGDMELAAAFADVLQAAGEMGLQSLLDEAVSRRNGLQTYIAELGVPPHRSETLHRAFGFDPQTSEDDLLADLWPMPEFSEDALDLVMSIQKGASRAQDFALQLRRFDKVTGQRDREAVLRAAFLKSTGEPKSGSYVCSAAVKKLLPDFEEGFDTAAARVEQGLDRLKELRLVRLNLAAPTL

SEQ ID NO: 180786 - protein, 76 aa, Glycine max
  Coding DNA Sequence Number=SeqID_64008
MECVSPSRFLKFRKFRHHLNLFIDFLKRDKASNYNHIDHSRLVESMVMLSEACLCKVFKSLFLEHTRAKSSTFALM

SEQ ID NO: 180787 - protein, 588 aa, Glycine max
  Coding DNA Sequence Number=SeqID_64009
  Gene Ontology: Mol. function=transporter activity; Cellular component= membrane; Biological process=oligopeptide transport
  Homolog annotation: Hit_ID=Q2HUR9; Match level="QueryCoverage=96%, HitCoverage=98%, E-value=0.0, Identity=71%"; Hit description=TGF -beta receptor, type I/II extracellular region; Major facilitator superfamily MFS_1
  Pfam annotation: Domain name=MFS_1; Domain location=41-521; Score =24.4; E_value=2.4e-05; Accession=PF07690.6; Description=Major Facilitator Superfamily
  Pfam annotation: Domain name=PTR2; Domain location=103-505; Score =318.2; E_value=1.4e-92; Accession=PF00854.12; Description=POT family
  Pfam module annotation: Pfam domain module=MFS_1::PTR2; Domain location=41-521::103-505
DKIKGKVNRGNEVCTSDGAIDSHGHPAVRKRTGTWTTGILILVNQGLATLAFFGVGVNLVLFLTRVMGQDNAEAANNVSKWTGTVYLFSLLGAFLSDSYWGRYMTCAIFQVIFVIGLISLSLSSHISLLKPSGCGDKELQCGSHSSYQTAFFYLSIYLVALGNGGYQPNIATFGADQFDEGDPKERLSKVAFFSYFYLALNLGSLFSNTILDYFEDKGQWTLGFWASAGSAAIALILFLCGTRRYRYFKPVGNPLPRVGQVFVAAAKKWKVKVPSEENLYEDKKCSPSGRRKMLHTKGFRYLDKAAFITSKDLEQLEENKRNPWCLSTVTQVEEVKCILRLLPIWLCTIMYSVVFAQMASLFVVQGDAMATGISSFKIPPASMSSFDILGVAFFIFIYRHALDPFVAKVMKSKLTELQRMGIGLVLAIMAMVSAGLVEKFRLKFAIKDCSNCDGSSSLSIFWQVPQYVLTGASEVFMYVPQLEFFNAQTPDGLKSFGSALCMTSISLGNYVSSLLVAIVMKISTKGDIPGWIPGNLNLGHLDRFYFLLAALTTVDLVVYVALAKWYKYINFEGNNQEDIKKENHEVMV

SEQ ID NO: 180788 - protein, 228 aa, Glycine max
  Coding DNA Sequence Number=SeqID_64010
  Homolog annotation: Hit_ID=Q9MBG8; Match level="QueryCoverage=72%, HitCoverage=53%, E-value=2e-34, Identity=47%"; Hit description =Arabidopsis thaliana genomic DNA, chromosome 3, TAC clone:K5K13
  Pfam annotation: Domain name=DUF298; Domain location=3-95; Score= -4.8; E_value=0.00062; Accession=PF03556.6; Description=Domain of unknown function (DUF298)
MPLRHYSVQLTTLPEAYGFLGCHLITKMGRVVNLGNWALAHVPSPCFGKNQRYNISEDTWQQVLAFSWCTRDSLEAYDPEGAWPVLIDDFVEHMYRMQGSYYDNSNFHCNCGDPESQSCVFDDPLPGLRSFSGLKRKLPEDLSKSDDMDSNDMILSNCKRSRAHDAVDLEDNPPGNTADDCMETSRQNSPLCSSMSPCAVEGCLSKGFAGLLSTRSFVQFGRERRASF

SEQ ID NO: 180789 - protein, 523 aa, Glycine max
  Coding DNA Sequence Number=SeqID_64011
  Gene Ontology: Mol. function=transporter activity; Cellular component= membrane; Biological process=oligopeptide transport
  Homolog annotation: Hit_ID=Q2HUR9; Match level="QueryCoverage=98%, HitCoverage=89%, E-value=0.0, Identity=79%"; Hit description=TGF -beta receptor, type I/II extracellular region; Major facilitator superfamily MFS_1
  Pfam annotation: Domain name=MFS_1; Domain location=16-456; Score= -25.5; E_value=0.0047; Accession=PF07690.6; Description=Major Facilitator Superfamily
  Pfam annotation: Domain name=PTR2; Domain location=37-440; Score =326.6; E_value=4.4e-95; Accession=PF00854.12; Description=POT family
  Pfam module annotation: Pfam domain module=MFS_1::PTR2; Domain location=16-456::37-440
MGQDNAEAANSVSKWTGTVYLFSLLGAFLSDSYWGRYMTCAIFQVIFVIGLVSLSLSSYIFLLKPSGCGNKELPCGSHSSYQTILFYVSIYLIALGNGGYQPNIATFGADQFDEGDPREQHSKIVFFSYFYLALNIGSLFSNTILNYFEDDGLWTLGFWASAGSAALALILFLCGTRRYRYFKPNGNPLPRFCQVFVAATRKWKAKVLQDDKLYEVDEFSTNEGRKMLHTEGFRFLDKAAFITSKNFKQMEESKCSPWYLSTVTQVEEVKCILRLLPIWLCTILYSVVFAQMASLFVEQGDAMDTRISRFHIPPASMSTFDILSVAVVIFIYRRVLDPLVARTMKSKGLTELQRMGIGLVLAIMAMVSAGLVEHFRLKNAIEDCNECEGSSSLSIFWQVPQYVLVGASEVFMYVGQLEFFNAQTPDGLKSFGSALCMTSISLGNYVSSLLVAIVMKISATDEMPGWIPGNLNKGHLDMFYFLLAALTAADLVIYVLMARWYKYIKFQGNNDNGINKEDPEVGL

SEQ ID NO: 180790 - protein, 299 aa, Glycine max
  Coding DNA Sequence Number=SeqID_64012
  Gene Ontology: Mol. function=zinc ion binding; Cellular component =nucleus; Biological process=regulation of transcription
  Homolog annotation: Hit_ID=Q1SM76; Match level="QueryCoverage=96%, HitCoverage=56%, E-value=6e-95, Identity=61%"; Hit description=Zinc finger, Dof-type
  Pfam annotation: Domain name=zf-Dof; Domain location=137-199; Score =143.0; E_value=8.2e-40; Accession=PF02701.6; Description=Dof domain, zinc finger
MSEAKDPAIKLFGKTIPVPEILPGSNGAPASSSGDVVVDDSVDASSTNSSRESHTNTDAQEKDFDKDTLGEKPTDDKKEDGAPAQSSEEVANPDTASGTCEESIIQSTEREATTLKTTKTEEEQGETSNSQDKNLKKPDKILPCPRCNSMDTKFCYYNNYNVNQPRHFCKNCQRYWTAGGTMRNVPVGAGRRKNKSVASHYRQITVSEAALQNPRTDLPNGAYHPSLKCNGTVLTFGTDTPLCESMASVLNLADKTMHNYTRNGFHKPEELRIPVSHASGEKGDDQSNKSSVTSTTSVE

SEQ ID NO: 180791 - protein, 591 aa, Glycine max
  Coding DNA Sequence Number=SeqID_64013
  Gene Ontology: Mol. function=catalytic activity; Cellular component =intracellular; Biological process=metabolic process
  Homolog annotation: Hit_ID=Q9FK33; Match level="QueryCoverage=95%, HitCoverage=84%, E-value=0.0, Identity=64%"; Hit description =Selenium-binding protein-like
  Pfam annotation: Domain name=PPR; Domain location=120-154; Score=3.1; E_value=3.2; Accession=PF01535.11; Description=PPR repeat
  Pfam annotation: Domain name=PPR; Domain location=186-220; Score =34.2; E_value=4.6e-07; Accession=PF01535.11; Description=PPR repeat
  Pfam annotation: Domain name=PPR; Domain location=19-53; Score=24.9; E_value=0.00029; Accession=PF01535.11; Description=PPR repeat
  Pfam annotation: Domain name=PPR; Domain location=221-255; Score=0.3; E_value=6.9; Accession=PF01535.11; Description=PPR repeat
  Pfam annotation: Domain name=PPR; Domain location=287-321; Score =51.9; E_value=2.1e-12; Accession=PF01535.11; Description=PPR repeat
  Pfam annotation: Domain name=PPR; Domain location=322-356; Score=9.5; E_value=0.56; Accession=PF01535.11; Description=PPR repeat
  Pfam annotation: Domain name=PPR; Domain location=424-458; Score =10.5; E_value=0.43; Accession=PF01535.11; Description=PPR repeat
  Pfam annotation: Domain name=PPR; Domain location=85-119; Score=14.9; E_value=0.13; Accession=PF01535.11; Description=PPR repeat
  Pfam module annotation: Pfam domain module=PPR::PPR::PPR::PPR::PPR::PP R::PPR::PPR; Domain location=120-154::186-220::19-53::221-255::287 -321::322-356::424-458::85-119
MELFEILELEHDGFDVGGSTYDALVSACVGLRSIRGVKRVFNYMVNSGFEPDLYVMNRVLFVHVKCGLMLDARKLFDEMPEKDMASWMTMIGGFVDSGNFSEAFGLFLCMWEEFNDGRSRTFTTMIRASAGLGLVQVGRQIHSCALKRGVGDDTFVSCALIDMYSKCGSIEDAHCVFDQMPEKTTVGWNSIIASYALHGYSEEALSFYYEMRDSGAKIDHFTISIVIRICARLASLEYAKQAHAALVRRGYDTDIVANTALVDFYSKWGRMEDAWHVFNRMRRKNVISWNALIAGYGNHGQGEEAVEMFEQMLREGMIPNHVTFLAVLSACSYSGLSERGWEIFYSMSRDHKVKPRAMHYACMVELLGREGLLDEAYELIRSAPFKPTTNMWATLLTACRMHENLELGKLAAENLYGMEPEKLCNYIVLLNLYNSSGKLKEAAGVLQTLKRKGLRMLPACTWIEVKKQSYAFLCGDKSHSQTKEIYEKVNNMMVEISRHGYVEENKALLPDVDEEEQRILKYHSEKLAIAFGLINTPHWTPLQITQGHHFTILEMVVALVAIIGDDKIVSFKSQSFILSSLLLAHLSLTFD

SEQ ID NO: 180792 - protein, 294 aa, Glycine max
  Coding DNA Sequence Number=SeqID_64014
  Gene Ontology: Mol. function=structural constituent of ribosome; Cellular component=intracellular; Biological process=translation
  Homolog annotation: Hit_ID=Q5N757; Match level="QueryCoverage=48%, HitCoverage=64%, E-value=8e-25, Identity=44%"; Hit description =Pentatricopeptide (PPR) repeat-containing protein-like
MNKSRNQRCEKELLSRVVGTSRVEWFLKEEGVTIRRVEWFLKERSVAVRKEGAHPGSPILWITPKFSSFLFLAKWVVVEYVVSDPVSLCNSSVDQSMANSLDPKSRHRKTPNFLPSPPCQRSRSAVVDVVIFAAVIAAFGFLLFPYAQIVASESVKIGVVIVNLVEEEASVAPWIYMFIGVSVTFAALTTWVLVACTTRKCGNPNCKGLRKAAEFDIQLETEDCVKNSPSLTKGGGVKKGLFKVPCDHHRELEAELKKMAPPNGRAILVLRGRCGCSVGRLEVPRPKKNRKIKK

SEQ ID NO: 180793 - protein, 84 aa, Glycine max
  Coding DNA Sequence Number=SeqID_64015
  Homolog annotation: Hit_ID=Q9MBG8; Match level="QueryCoverage=81%, HitCoverage=21%, E-value=2e-20, Identity=68%"; Hit description =Arabidopsis thaliana genomic DNA, chromosome 3, TAC clone:K5K13
MFRFTRLKRIALKFKLTNIIDFETVGCTKADFPEFSRFYDFVFFMCRENGQKNITVSRAVTAWKLVLAGRFSLLHPWCDFVEVQ

SEQ ID NO: 180794 - protein, 134 aa, Glycine max
  Coding DNA Sequence Number=SeqID_64016
  Gene Ontology: Mol. function=zinc ion binding; Cellular component =nucleus; Biological process=regulation of transcription
  Homolog annotation: Hit_ID=Q1SM76; Match level="QueryCoverage=80%, HitCoverage=21%, E-value=6e-32, Identity=67%"; Hit description=Zinc finger, Dof-type
TPNSGPNSPTLGKHSREDYTFKPNESGGEDGHSKENNKEKSLWVPKTLRIDDSGEAAKSSIWATLGIKNDKADSVPGGTLFKAFPSKHDDKNHSMQSSRVLLANPAALSRCSKLIWQCSTGPEGNTSCKVTLVH

SEQ ID NO: 180795 - protein, 69 aa, Glycine max
  Coding DNA Sequence Number=SeqID_64017
MENQSPSLKTAEVDVPLHLIGFEIQDLSPQRVWEVKIWKLDPSNSAKKSLISSSRLTLRNNMPQIVHHA

SEQ ID NO: 180796 - protein, 677 aa, Glycine max
  Coding DNA Sequence Number=SeqID_64018
  Gene Ontology: Mol. function=binding; Cellular component =intracellular; Biological process=metabolic process
  Homolog annotation: Hit_ID=Q1SLN3; Match level="QueryCoverage=99%, HitCoverage=100%, E-value=0.0, Identity=73%"; Hit description =Tetratricopeptide-like helical
  Pfam annotation: Domain name=PPR; Domain location=118-152; Score =10.1; E_value=0.48; Accession=PF01535.11; Description=PPR repeat
  Pfam annotation: Domain name=PPR; Domain location=187-221; Score =32.7; E_value=1.3e-06; Accession=PF01535.11; Description=PPR repeat
  Pfam annotation: Domain name=PPR; Domain location=222-256; Score=9.0; E_value=0.64; Accession=PF01535.11; Description=PPR repeat
  Pfam annotation: Domain name=PPR; Domain location=288-322; Score =27.6; E_value=4.5e-05; Accession=PF01535.11; Description=PPR repeat
  Pfam annotation: Domain name=PPR; Domain location=372-406; Score =36.4; E_value=9.9e-08; Accession=PF01535.11; Description=PPR repeat
  Pfam annotation: Domain name=PPR; Domain location=443-477; Score=3.3; E_value=3.1; Accession=PF01535.11; Description=PPR repeat
  Pfam annotation: Domain name=PPR; Domain location=509-543; Score =16.4; E_value=0.085; Accession=PF01535.11; Description=PPR repeat
  Pfam annotation: Domain name=PPR; Domain location=82-116; Score=21.5; E_value=0.0031; Accession=PF01535.11; Description=PPR repeat
  Pfam module annotation: Pfam domain module=PPR::PPR::PPR::PPR::PPR::PP R::PPR::PPR; Domain location=118-152::187-221::222-256::288-322::372 -406::443-477::509-543::82-116
MVCVFSRYLPSLEELGKLLKLCADVKWLPFGKAMHAQFLIRNQTSNHSHISHLNSLVHLYVKCGQLGLARNLFDAMPLRNVVSWNVLMAGYLHGGNHLEVLVLFKNMVSLQNACPNEYVFTTALSACSHGGRVKEGMQCHGLLFKFGLVCHQYVKSALVHMYSRCSHVELALQVLDTVPGEHVNDIFSYNSVLNALVESGRGEEAVEVLRRMVDECVAWDHVTYVGVMGLCAQIRDLQLGLRVHARLLRGGLMFDEFVGSMLIDMYGKCGEVLNARNVFDGLQNRNVVVWTALMTAYLQNGYFEESLNLFTCMDREGIAALRHGDLLHARVEKLGFKNHVIVRNALINMYSKSGSIDSSYNVFTDMIYRDIITWNAMICGYSHHGLGKQALQVFQDMVSAEECPNYVTFIGVLSAYSHLGLVKEGFYYLNHLMRNFKIEPGLEHYTCMVALLSRAGLLDEAENFMKTTQVKWDVVAWRTLLNACHVHRNYDLGRRIAESVLQMDPHDVGTYTLLSNMYAKARRWDGVVTIRKLMRERNIKKEPGASWLDIRNDIHVFLSEGSNHPESIQIYKKVQQLLALIKPLGYVPNIASVLHDVEDEQKEGYLSYHSEKLALAYGLMKIPSPAPIRIIKNLRMCDDCHTAVKLISKVTNRLIIVRDANRFHHFRDGSCTCLDHW

SEQ ID NO: 180797 - protein, 119 aa, Glycine max
  Coding DNA Sequence Number=SeqID_64019
  Gene Ontology: Mol. function=catalytic activity
  Homolog annotation: Hit_ID=Q6AV57; Match level="QueryCoverage=90%, HitCoverage=72%, E-value=8e-24, Identity=51%"; Hit description =Putative thioesterase family protein
  Pfam annotation: Domain name=4HBT; Domain location=34-115; Score =24.8; E_value=0.00031; Accession=PF03061.12; Description =Thioesterase superfamily
MESSSSKTTAEVDVTLHFFGFELQHLSPQWTYPFKELHGGVSALIAESLTSMGAHIASGYQRVAGIQLSINHLKSVALGDFLYAEAIPLNVGRSIQNNLFIWRGVNWEINSVGDLAQRF

SEQ ID NO: 180798 - protein, 107 aa, Glycine max
  Coding DNA Sequence Number=SeqID_64020
MTLLEGKILQNTFFREGEGRKEERRKKETLTFTEEGGRRMRECKNEGVGGKRSRPKRNGCHCCEYVTEERMLSWEMPSQVERRKKGGVSIEKREMKISLKILLYFTE

SEQ ID NO: 180799 - protein, 130 aa, Glycine max
  Coding DNA Sequence Number=SeqID_64021
  Gene Ontology: Cellular component=extracellular region; Biological process=cellulose and pectin-containing cell wall organization and biogenesis
  Homolog annotation: Hit_ID=Q9FNT1; Match level="QueryCoverage=74%, HitCoverage=40%, E-value=2e-50, Identity=93%"; Hit description=Alpha- expansin
  Pfam annotation: Domain name=Pollen_allerg_1; Domain location=37-114; Score=173.2; E_value=6.4e-49; Accession=PF01357.11; Description =Pollen allergen
MFYYHDLDLIIKVFLLTLTVITAAAMTSNLKGRKGGIRFTINGHSYFNLVLVTNVGGAGDVHSVSIKGSRTRWQAMSRNWGQNWQSNSYLNGQSLSFVVTTSNGHSVVSYNVAPAGWSFGQTYTGRQFNY

SEQ ID NO: 180800 - protein, 282 aa, Glycine max
  Coding DNA Sequence Number=SeqID_64022
  Gene Ontology: Mol. function=nucleic acid binding; Cellular component= mitochondrial outer membrane translocase complex; Biological process =protein import into mitochondrial outer membrane
  Homolog annotation: Hit_ID=Q1S2B6; Match level="QueryCoverage=66%, HitCoverage=51%, E-value=9e-71, Identity=62%"; Hit description=RNA -binding region RNP-1
MLPVNYTAIEGAVQTAVGPDGKRKEPESNVLLASIENMQYAVTVDVLHTVFSAFGTVQKIAIFEKNGQTQALIQYPDIITASAAREALEGHCIYDGGYCKLHLSYSRHTDLNVKAFSDKSRDYTVPDPSLLAAQGPPTAWQNPQAASMYPGSAPAYHTQVPGGQVPSWDPSLQAVRPSYASAPGTFPVQTGAAPPMPSYAPASAMPVASSPHAQSSPMAHNANPMGIAQLGVPPNVNLQSSGASLSAPGSSPLMQTSQAAQGLLQPNARPGGASPSGQHYYG

SEQ ID NO: 180801 - protein, 401 aa, Glycine max
  Coding DNA Sequence Number=SeqID_64023
MAAGSGDGAEMMTLALYKRPLIILTLFLASALGVYFLAPEQRYAQWQWTQSDEALPTIARYDLIHSYPAQDGALLLISKRSERGAYNSFYGWAANYLSQVLFSGPQGLQMLGELDESIHDAVCGGQECVLFLSKGRRLVDVKQGTIGALIPWPEGDDNRPSFIGGKLVALPGKRALYLISTEGVFYSPDFGAHWRQTLDLPALLEARQLLGFERGEEDSPTAYASGKRKSIPEIFTAVDGDRVLFWMNPVLGSGALHIAVNGKTGEVAEPHWLTVRVTESAQAPDGGIYLIAQTLERGLYQLLRYQSDGQLKVLLETGDKSLYQLWAGNDKLVTQTDNGDARLSLIFDLRSSDVRYRQPLEYRYNGRDDARQTVIEPESHYGDDGEPPALPYFVRYRSTTP

SEQ ID NO: 180802 - protein, 424 aa, Glycine max
  Coding DNA Sequence Number=SeqID_64024
  Gene Ontology: Mol. function=transporter activity; Cellular component= integral to membrane; Biological process=transport
  Homolog annotation: Hit_ID=Q8X4N6; Match level="QueryCoverage=85%, HitCoverage=91%, E-value=1e-148, Identity=73%"; Hit description =Putative transcriptional regulator
  Pfam annotation: Domain name=BacA; Domain location=82-319; Score= -166.7; E_value=0.034; Accession=PF02673.9; Description=Bacitracin resistance protein BacA
  Pfam annotation: Domain name=MFS_1; Domain location=78-419; Score =147.6; E_value=3.2e-41; Accession=PF07690.6; Description=Major Facilitator Superfamily
  Pfam annotation: Domain name=Sugar_tr; Domain location=80-418; Score=- 159.8; E_value=0.072; Accession=PF00083.14; Description=Sugar (and other) transporter
  Pfam module annotation: Pfam domain module=BacA::MFS_1::Sugar_tr; Domain location=82-319::78-419::80-418
MPLSFMNMPLVSYASEITIPTLIVTGEKAHSRYFAEDAYKAVGSKEKELVIVPGANHVDLQTPSQNNQPAYWSGIFAMTLCVFVLIASEFMPVSMLTPIARDLDVTEGLAGQGIAISGALAVLTSLTLSTLAGNVNRKYLLLGMTILMAVSGLVIALASNYLMYMAGRAMIGIAIGGFWSMSAATAIRLVPQHQVTRALAIFNAGNALATVVAAPLGSYLGATIGWRGAFLCLVPVAAAAFIWQCVSLPGMNGNNNPASRGSVLRLFSRPVVSIGMLACGLFFMGQFALFTYVRPFLELVTRVDFSGLSLILLVIGVAGFIGTLVVPAFLNRKFYLTLMAIPGLMAVIAIALILAGHHVWAVSLLLGLWGMLATAAPTGWWTWITRTLPEDAEAGGGLMVAVIQLSIALGSTAGGMMFDSLGWR

SEQ ID NO: 180803 - protein, 249 aa, Glycine max
  Coding DNA Sequence Number=SeqID_64025
  Gene Ontology: Mol. function=diacylglycerol kinase activity; Cellular component=intracellular; Biological process=protein kinase C activation
  Homolog annotation: Hit_ID=Q1SLC5; Match level="QueryCoverage=99%, HitCoverage=69%, E-value=4e-97, Identity=46%"; Hit description =Tetratricopeptide-like helical
  Pfam annotation: Domain name=PPR; Domain location=17-51; Score=41.2; E_value=3.4e-09; Accession=PF01535.11; Description=PPR repeat
  Pfam annotation: Domain name=PPR; Domain location=207-241; Score=9.0; E_value=0.63; Accession=PF01535.11; Description=PPR repeat
  Pfam annotation: Domain name=PPR; Domain location=98-132; Score=40.7; E_value=4.9e-09; Accession=PF01535.11; Description=PPR repeat
  Pfam module annotation: Pfam domain module=PPR::PPR::PPR; Domain location=17-51::207-241::98-132
MECARRLFDEAPMKDVVSWNAMVGGYVLHNLNQEALELFDEMCEVGECPDEVHAKIMELNKGKLSTLLGNALVDMYAKCGNIGKGVCVFWLIRDKDMVSWNSVIGGLAFHGHAEESLGLFREMQRTKVCPDEITFVGVLAACSHTGNVDEARAGLLKEAFDFIASMKIEPNAIVWRSLLGACKVHGDVELAKRATEQLLRMRVDQSGDYVLLSNVYASHGEWDGAENVRKLMDDNGVTKTRGSSFVEAY

SEQ ID NO: 180804 - protein, 162 aa, Glycine max
  Coding DNA Sequence Number=SeqID_64026
  Gene Ontology: Mol. function=metal ion binding; Cellular component =intracellular; Biological process=mRNA editing
  Homolog annotation: Hit_ID=Q1SLC5; Match level="QueryCoverage=96%, HitCoverage=30%, E-value=8e-52, Identity=64%"; Hit description =Tetratricopeptide-like helical
  Pfam annotation: Domain name=PPR; Domain location=73-107; Score=22.2; E_value=0.0019; Accession=PF01535.11; Description=PPR repeat
  Subcellular localization annotation: CTP_CleavageSite=43; ConfidenceScore=5.17e-01
MIRKRRGRSTITNLGTLRQIHALMIVNGFTSNVGFLRKLVLTTAMSMVGPAATTAVTQYAVQMFAQIPQPDTFMWNTYIRGSSQSHDPVHAVALYAQMTHRSVKPDNFTFPLVLKACTKLFWVNTGSVVHGRVFRLGFGSNVVVRNTLLVFHAKCGDFEGCK

SEQ ID NO: 180805 - protein, 390 aa, Glycine max
  Coding DNA Sequence Number=SeqID_64027
  Gene Ontology: Mol. function=DNA binding; Cellular component=nucleus; Biological process=regulation of transcription, DNA-dependent
  Homolog annotation: Hit_ID=Q5PXZ4; Match level="QueryCoverage=99%, HitCoverage=100%, E-value=1e-91, Identity=48%"; Hit description=MYB transcription factor MIXTA-like 2
  Pfam annotation: Domain name=Myb_DNA-binding; Domain location=14-61; Score=53.5; E_value=7.2e-13; Accession=PF00249.21; Description=Myb -like DNA-binding domain
  Pfam annotation: Domain name=Myb_DNA-binding; Domain location=67-112; Score=46.2; E_value=1.1e-10; Accession=PF00249.21; Description=Myb -like DNA-binding domain
  Pfam module annotation: Pfam domain module=Myb_DNA-binding::Myb_DNA -binding; Domain location=14-61::67-112
MGRSPCCDKVGLKKGPWTPEEDQKLLAYIEEHGHGSWRALPAKAGLQRCGKSCRLRWTNYLRPDIKRGKFSMQEEQTIIQLHALLGNRWSSIATHLPKRTDNEIKNYWNTHLKKRLDKMGIDPVTHKPKNDALLSTEGPSKIAANISHMAQWESARLEAEARLARESKLRSSSHSSSSSLHHTLIGTSASSSSSLSLDHAWKNGGSTITITVNATRVSDLESPTSTLSENNVPPINNITSTVIEFVGSSERRTVKEEGDQEWNKLGYHESSTHLGEYKDGMENSMPFTSSLHELTMTMATTWGSSTSSAHEHAHVAEEGCFTNLLLNTNSGGHLSLSPEDGGESNYCHNNAGSSDAGSGNNGDLYQENKNYWNNILNLMNYSSPSDSPMF

SEQ ID NO: 180806 - protein, 376 aa, Glycine max
  Coding DNA Sequence Number=SeqID_64028
  Gene Ontology: Mol. function=DNA binding; Cellular component=nucleus; Biological process=regulation of transcription
  Homolog annotation: Hit_ID=Q1SLC7; Match level="QueryCoverage=99%, HitCoverage=98%, E-value=4e-98, Identity=52%"; Hit description=No apical meristem (NAM) protein
  Pfam annotation: Domain name=NAM; Domain location=16-142; Score =308.5; E_value=1.2e-89; Accession=PF02365.6; Description=No apical meristem (NAM) protein
MENVSKPRKENQKFELPAGFRFHPRDEELINHYLTKKVVDNCFCAVAIAEVDLNKCEPWDLPGLAKMGETEWYFFCVRDRKYPTGLRTNRATDAGYWKATGKDREIIMENALIGMKKTLVFYKGRAPKGEKTNWVMHEYRLEGKHNQPNPGKKNLAMYHMEIDRHHDQSEWVICRVFEKSPCGKKMHVLKCGRLNNSSGEEPSSCASLLPPLIDSSPYNSETRTTTAGELSQLTCFSDPNQTEDQNNTHDDIVDSMETPILNFSPSSRPDDASTLAKATLSSASNQSAQIAHQIGNSQFPDYYHVPQEQSMLRMLMEKQGPIANQIQKPEFSEGRDFDADISSMIYNNDMMHRMFGNQEHSSASAGPVDTDFLWNY

SEQ ID NO: 180807 - protein, 234 aa, Glycine max
  Coding DNA Sequence Number=SeqID_64029
  Gene Ontology: Mol. function=binding; Cellular component =intracellular; Biological process=protein kinase C activation
  Homolog annotation: Hit_ID=Q6ES36; Match level="QueryCoverage=97%, HitCoverage=55%, E-value=3e-59, Identity=43%"; Hit description =Pentatricopeptide (PPR) repeat-containing protein-like
MVLLLSACAELGYLSLGRWVHSQLVLRGMVLSVQLGTALVDMYGKSGALGYARAVFERMEKRNVWTWSAMILGLAPHGRVSHAGMVNEDYKYFHDMECVHGIKTLMMHYGAMVDVLGRAARLEEAYEFIQSMPIEPDPVVWRTLLSACTVHDVHDIQGGGNLVIVANMFAEVEMWEKAANVGHESGGMKKVAGESCADLGGSMHRFFAGYDPCPDLVPVYHLLDGFNLHLKMVN

SEQ ID NO: 180808 - protein, 151 aa, Glycine max
  Coding DNA Sequence Number=SeqID_64030
MPISPADVSVGLCRHDIGKDRTHKDTQWTRRSPTGPLGFQLWLRASVVLQGARSPRQGHGSRLQDTQWTRRSPTRSWSCQALITSLCQFYGVSVTSSKVIRPLTNRAFIKKYCVPRQAQGETPQRPGDSRQRATHAPPSPLEFTSAHPQKG

SEQ ID NO: 180809 - protein, 204 aa, Glycine max
  Coding DNA Sequence Number=SeqID_64031
  Gene Ontology: Mol. function=transcription factor activity; Biological process=regulation of transcription, DNA-dependent
  Homolog annotation: Hit_ID=Q9I4J0; Match level="QueryCoverage=67%, HitCoverage=50%, E-value=1e-22, Identity=44%"; Hit description =Probable transcriptional regulator
  Subcellular localization annotation: CTP_CleavageSite=27; ConfidenceScore=5.49e-01
MSGWWTATASAMSWVLSISIPIRRACRSANVRQAPRMRGFFFAGARQILQQRVQRLVGLDGAADQAERGAVRERRAAQLPQQPLFHPARRVVGGQIAETSAAQHQMGDAFHMVGHRRQVRRRDRAQLLRQQVAALDPARVFNLLALRRSPASPPATADNATPPTAGQSSRCPDRAAGAAALAQSRSANRCGTAIARPGGGAGSV

SEQ ID NO: 180810 - protein, 101 aa, Glycine max
  Coding DNA Sequence Number=SeqID_64032
  Subcellular localization annotation: CTP_CleavageSite=28; ConfidenceScore=5.38e-01
MTKFCFCVSSGPPPVDDKRVRMTVKFVSACHRARRLWMTQGCRMTVFCLRVSLGPPPLDDTRVQNDQILSLRVIGPAASGRQKGADNRKVSPRVIGPAASG

SEQ ID NO: 180811 - protein, 292 aa, Glycine max
  Coding DNA Sequence Number=SeqID_64033
  Gene Ontology: Mol. function=nucleic acid binding
  Homolog annotation: Hit_ID=Q1RVN3; Match level="QueryCoverage=97%, HitCoverage=51%, E-value=2e-13, Identity=22%"; Hit description =Nucleotide-binding, alpha-beta plait
  Pfam annotation: Domain name=RRM_1; Domain location=8-78; Score=23.4; E_value=0.0008; Accession=PF00076.12; Description=RNA recognition motif. (a.k.a. RRM, R
NNADITSFYFTHFPDEANEELLWRHFKNWGDVREVYIAKRLNKDGRRYGFMRFKGVSDAKGLEVRLDNIFINDCKLFVNLPRFDRPVRNTELQKKNPIGRKYTDEASKPCGDRRGTKPTILINPDEGGEYWCNETWVGMLKKVMEVETLEDRITWELGYNVRTKFLGDDMVLLPGMSDDKAKLLIQSETESDDSLFYSLEKWTPKCRPNNRVVWLQLWGFPIQVWEMKNLRRAVAAIGDVIESDDDTEDRRRLDRARVLVQTPLPPLIRSEVIVRVGELEYRVWIVEETGFE

SEQ ID NO: 180812 - protein, 173 aa, Glycine max
  Coding DNA Sequence Number=SeqID_64034
MTTVTQMWMTLLLNNVLPSDHNSDLPLPKCQLVIRPPITRAFIEKYCTPRQVQGDAPQDADAPLPPHQVDPAGSLGMEHYLQHLVRQQATNHRGQVQIHECLYRFSLSQQGQGFAPFACPTLEQFRAEVAWPGDWPEAQAGEAPAGSPGDAEEARMDEEMTDLLGFLGGSGAT

SEQ ID NO: 180813 - protein, 60 aa, Glycine max
  Coding DNA Sequence Number=SeqID_64035
MIPPPGIVPVAGEHKLQAVQLLQIVAQKGKGLCGGRQRSINHRVWRHVQIFDSWPVGLPG

SEQ ID NO: 180814 - protein, 134 aa, Glycine max
  Coding DNA Sequence Number=SeqID_64036
  Subcellular localization annotation: CTP_CleavageSite=33; ConfidenceScore=5.56e-01
MNAGALISGQITSMAQSNSSRLKFPALITALCRTRGVASNSLVFERLSPIINLAYITPPPARIAAAPSTPPPTDFQHFKAMLRSIHQGKIILLQSLQLIAPPDSIPTVEQFNEWVAWSGTQPPPHRDDEDPAAQ

SEQ ID NO: 180815 - protein, 118 aa, Glycine max
  Coding DNA Sequence Number=SeqID_64037
  Homolog annotation: Hit_ID=Q654D6; Match level="QueryCoverage=45%, HitCoverage=6%, E-value=5e-09, Identity=58%"; Hit description=Extra -large G-protein-like
MSDSANKLRLVRCPKCQNLLLELVDYSVYQCGGCGAVLRAKHKGYVSGSLSDEGKVELGGDSGKSESSLEKGLVDRSDASDVDAKVDNMARCFRTNQRILVLSAAKVAKKMKLKFTKE

SEQ ID NO: 180816 - protein, 80 aa, Glycine max
  Coding DNA Sequence Number=SeqID_64038
MGFIRLVTWLGVRGLWKNGLERLKECLRVILSKNLESLVEAMSSKVILMMPKNQESRKFQRFKNQVSRFKNQVSRIKIQE

SEQ ID NO: 180817 - protein, 76 aa, Glycine max
  Coding DNA Sequence Number=SeqID_64039
MQIEIFKILNLCLPEHFRCRVASGVSNPARLGELGENPSRGASVTLPRCFSEQIREGFPSFLTVLHRSSSFFGLQP

SEQ ID NO: 180818 - protein, 161 aa, Glycine max
  Coding DNA Sequence Number=SeqID_64040
  Homolog annotation: Hit_ID=Q1T2D5; Match level="QueryCoverage=70%, HitCoverage=7%, E-value=6e-26, Identity=49%"; Hit description=Chromo
MADNTRMKELTGDVKRILKMMENRNKEYAARFETLETTLEMTLKDKTRDPGSISLAMNNHPFKVVPWYQMMTRENSFKTWIAFTRALETEFGPSPCECPRSQLFKLTQIGSVQSYYVQFTALANRVQGITQEALLDCFVGRLKPNIRMDVIAQSPTSLLKT

SEQ ID NO: 180819 - protein, 301 aa, Glycine max
  Coding DNA Sequence Number=SeqID_64041
  Homolog annotation: Hit_ID=Q1SFS3; Match level="QueryCoverage=38%, HitCoverage=30%, E-value=1e-10, Identity=31%"; Hit description =Lambda repressor-like, DNA-binding
KVAAVIGDSAKELDRMKQIRNGVVGLPRKYLEDKARDMASQEKWGPFADVLALLIFGVVLFPNVDGLVDLVAIDAFLTYHHSKESPVVAILADLFDTFDRSTINWFPRWKEGKEGVLFSCGDYPNVPLIGTRGAQGLKVIQRIHKAWRSPLRKDKELRSIRNGVIGGYHGWLRIHTRGLDWLSKLKVIDEENYEAPEEDEEVRDLKLELGKARLAKEKFKSAATHIRMECTELQEENAATARALEQETKRARKEEYGREKFRGALWGSNNELKLRREERDRSRVQKEFGSTLGSNGAKHAR

SEQ ID NO: 180820 - protein, 248 aa, Glycine max
  Coding DNA Sequence Number=SeqID_64042
MFVRVSVVEVIFGDAEVPIPTSEIKFVKEALGSFVPWPTHLVKPILPEEAEKDVSSPLKTVEEEKAAEVIDPLGELVKNLFDIYQRPVEVSWDGAKFGINNVKDGFFITHADVSEIILGDKCLNISILQLWLMFIHDWSASIGYGPLYGFLEPQCIHNASSRRQECENYIGRWLKEAGKQIYIAPYLNQAHWQLVVLCPGDNVVVWFCSLKKKPDATIKGAVNSAMKSVTKTAEGKPPQHGPQWIEAK

SEQ ID NO: 180821 - protein, 100 aa, Glycine max
  Coding DNA Sequence Number=SeqID_64043
MEDAPVSLASLARKKGRLRQLATPLGIVLGVQIAVRPTWAFQFLPPEGGCFWKKQPCSPGRAGSKEERGSAFLALLILTKLLRKIVSVKKIQAKALPLQL

SEQ ID NO: 180822 - protein, 205 aa, Glycine max
  Coding DNA Sequence Number=SeqID_64044
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-31, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=78; ConfidenceScore=5.70e-01
MCSPLKAKTCSPLKARACSPLKARACSPLKVRACSPTKGRTCSPLKARTCSPLKVRMCSPLKGMACSSLKARACSPPKARMYSPLKARACSPLKARTHSPLKVMACSTLKPRACSPQKVRMCGPLKARACSPLNASTSIPLKVRTCSPLKARTCSPLKGRTYSPLKARTCSPQKARACSPLKARAYSPLMARTCSPLKVRACSPL

SEQ ID NO: 180823 - protein, 242 aa, Glycine max
  Coding DNA Sequence Number=SeqID_64045
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=34%, E-value=2e-83, Identity=80%"; Hit description=DNA -directed RNA polymerase beta chain
  Pfam annotation: Domain name=RNA_pol_Rpb2_6; Domain location=1-202; Score=65.1; E_value=2e-17; Accession=PF00562.18; Description=RNA polymerase Rpb2, domain 6
MHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKASNNIYSWIFEPEYPGKSKIFDGRTGNSFKQPAIMGKLIFEINSSMLMIKYMDCSQWTIMHLLHNNHLEEGPSREDNG

SEQ ID NO: 180824 - protein, 121 aa, Glycine max
  Coding DNA Sequence Number=SeqID_64046
MAIGELQARLQAQAGEHAGNLPELRIATDPAAEYEGMARMLAAAEATGMERIAFVRGRGVLEGPAAGRCRVAAAPGAGAADAAAASLLGASATADDSDYEDMARVPLAVSQHELRFEAPGH

SEQ ID NO: 180825 - protein, 64 aa, Glycine max
  Coding DNA Sequence Number=SeqID_64047
MTCGGYLMVTRTFRQQGAKEPIDAQTLISSSARFIVLTREVRGKRARWRAEINIVLDTFFRLDP

SEQ ID NO: 180826 - protein, 78 aa, Glycine max
  Coding DNA Sequence Number=SeqID_64048
MTIHLAGAFDLRCRASSTPFKALFQVVDEDTTKGKDHEALEGPMTRGILKKAQHSDEDTTKGKDHEALEGPMTRGRLK

SEQ ID NO: 180827 - protein, 83 aa, Glycine max
  Coding DNA Sequence Number=SeqID_64049
MQRRSTAGDLIPIDLEINATCRRRNSERIRKFLQDLEAVATPEEEPRSSEASSSFPIAGHSHIEPVEDPIMAKEPRRVTLEDY

SEQ ID NO: 180828 - protein, 307 aa, Glycine max
  Coding DNA Sequence Number=SeqID_64050
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=98%, HitCoverage=25%, E-value=1e-146, Identity=77%"; Hit description=DNA -directed RNA polymerase beta'' chain
  Pfam annotation: Domain name=RNA_pol_Rpb1_4; Domain location=95-172; Score=-1.9; E_value=0.015; Accession=PF05000.7; Description=RNA polymerase Rpb1, domain 4
MEVLMAERANLVFHNKVIGGTAIKRLISRLIDHFGMAYTSHILDQVKTLGFRQATDTSISLGIDDLLTIPSKGWLVQDAEQQSFILEQHHHYGNVHAVEKLRQSIEIWYATSEYFRQEMNPNFRMTDPFNPVHIMSFSGARGNASQILLYEHQMLDILHADLLKWFNTLVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQ

SEQ ID NO: 180829 - protein, 78 aa, Glycine max
  Coding DNA Sequence Number=SeqID_64051
MYIVVVKQGQDHLGLPSGVETKHERQKPIKVLKDERNRGWDHDRPIVALLCAKQAGNVAARQPRILCILQLSFTICLF

SEQ ID NO: 180830 - protein, 45 aa, Glycine max
  Coding DNA Sequence Number=SeqID_64052
ALYPGSWEHKEWSPYCCNMFFEEDNTSRNHLERYDYLGGVIAKCL

SEQ ID NO: 180831 - protein, 155 aa, Glycine max
  Coding DNA Sequence Number=SeqID_64053
MGSSQKPSLKKRFYQVKIKSLEVTSLGELGQLMGQLQRVEVSMEPIASLSQYYDQPLRCFTFEDFQLVLTVKELEEILGCQLGRKEAISFLWVLSLHDKSCQVVLFPNMEGLVDLAAIDAFLAFHHGKESPVVAILAMYDTFDRGCPSIRYKVTA

SEQ ID NO: 180832 - protein, 97 aa, Glycine max
  Coding DNA Sequence Number=SeqID_64054
MAPDSVGKIKSVDFGDPNESLENKHVWNPLTAPEFTSEGNSSSSMLASDVNPFAQGLKMDLQRFRKMKKENEEGGWKNHSSGIGVTDKVVFLDKPIS

SEQ ID NO: 180833 - protein, 223 aa, Glycine max
  Coding DNA Sequence Number=SeqID_64055
  Homolog annotation: Hit_ID=Q9AVH2; Match level="QueryCoverage=63%, HitCoverage=59%, E-value=1e-48, Identity=60%"; Hit description =Putative senescence-associated protein
VGGAGLWPRAKFRIGWPPPPPREGRIKATRAESQWIVAARPLCHLQYPVAYLSRLQRILPAARWELRFKASRRANPPHEVIIPTHGSFAPLAFQPSAMTNCAKAGAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDN

SEQ ID NO: 180834 - protein, 87 aa, Glycine max
  Coding DNA Sequence Number=SeqID_64056
  Homolog annotation: Hit_ID=Q6R4Q7; Match level="QueryCoverage=44%, HitCoverage=8%, E-value=1e-12, Identity=79%"; Hit description =Splicing factor-like protein
MESRPVGLICYTQTQVGVIGFRNRRARKRSVVACKGISKLRKKKMKPVFCGNLDFDARQSDVERLFRRYGKVDRVDMKSGISFFIIV

SEQ ID NO: 180835 - protein, 333 aa, Glycine max
  Coding DNA Sequence Number=SeqID_64057
  Homolog annotation: Hit_ID=Q1T6R1; Match level="QueryCoverage=23%, HitCoverage=18%, E-value=2e-12, Identity=49%"; Hit description =Pathogenesis-related transcriptional factor and ERF
  Pfam annotation: Domain name=AP2; Domain location=33-97; Score=119.4; E_value=1e-32; Accession=PF00847.10; Description=AP2 domain
  Subcellular localization annotation: CTP_CleavageSite=48; ConfidenceScore=5.60e-01
MAGAEATKYASSATSPTTTAANNMATKSNKPTIRRFIGVRQRPSGRWVAEIKDSSQHVRLWLGTYDTPEEAARAYDEAARALRGENARTNFAPVSQVILGQQQSGSNNNLSTGSDIGKHGLSFASLKAKLSKNLQNIMARASDHNNNNKSSKSRVSDHFTFASIFHRRSYQIPEGDTMKNIDKVVQPSIIVPPMEAGGVGDYNSSVANWESASSVSDCSSEWVGFGNSKLGLESDGYEIGEASVGDQGFLEQLMGWIETPDISDHQGEGSRSKRFKVSSSVLVPPTFTGSSYDCGSPFSGYASPYNNGYASPYNNGCASPCNGYASPYYNNKK

SEQ ID NO: 180836 - protein, 72 aa, Glycine max
  Coding DNA Sequence Number=SeqID_64058
  Subcellular localization annotation: CTP_CleavageSite=55; ConfidenceScore=5.16e-01
MAIESNNYPPTLQNVNAMLPNSSIKTQLDLFTSKPCPSSWKPVSALREKWELMFRVMRLKGLAGSMIERWRL

SEQ ID NO: 180837 - protein, 565 aa, Glycine max
  Coding DNA Sequence Number=SeqID_64059
  Gene Ontology: Mol. function=binding; Cellular component=vacuole, cell cycle-correlated morphology; Biological process=vacuole fusion, non-autophagic
  Homolog annotation: Hit_ID=Q1S1P5; Match level="QueryCoverage=98%, HitCoverage=99%, E-value=0.0, Identity=79%"; Hit description=IMP dehydrogenase/GMP reductase
  Pfam annotation: Domain name=Arm; Domain location=190-230; Score =13.8; E_value=0.23; Accession=PF00514.13; Description=Armadillobeta -catenin-like repeat
  Pfam annotation: Domain name=Arm; Domain location=231-271; Score =17.4; E_value=0.053; Accession=PF00514.13; Description=Armadillobeta- catenin-like repeat
  Pfam annotation: Domain name=Arm; Domain location=272-312; Score =37.1; E_value=6.3e-08; Accession=PF00514.13; Description =Armadillobeta-catenin-like repeat
  Pfam annotation: Domain name=Arm; Domain location=313-354; Score =18.1; E_value=0.032; Accession=PF00514.13; Description=Armadillobeta- catenin-like repeat
  Pfam annotation: Domain name=Arm; Domain location=356-394; Score =10.3; E_value=0.62; Accession=PF00514.13; Description=Armadillobeta -catenin-like repeat
  Pfam annotation: Domain name=Arm; Domain location=397-434; Score =14.0; E_value=0.22; Accession=PF00514.13; Description=Armadillobeta -catenin-like repeat
  Pfam annotation: Domain name=Arm; Domain location=435-475; Score =30.1; E_value=7.9e-06; Accession=PF00514.13; Description =Armadillobeta-catenin-like repeat
  Pfam annotation: Domain name=Arm; Domain location=476-518; Score=7.8; E_value=1.3; Accession=PF00514.13; Description=Armadillobeta-catenin -like repeat
  Pfam annotation: Domain name=HEAT; Domain location=201-232; Score =7.7; E_value=4.9; Accession=PF02985.12; Description=HEAT repeat
  Pfam annotation: Domain name=HEAT; Domain location=399-436; Score =5.3; E_value=9.5; Accession=PF02985.12; Description=HEAT repeat
  Pfam annotation: Domain name=HEAT; Domain location=445-477; Score =7.3; E_value=5.5; Accession=PF02985.12; Description=HEAT repeat
  Pfam annotation: Domain name=HEAT; Domain location=483-520; Score =2.0; E_value=24; Accession=PF02985.12; Description=HEAT repeat
  Pfam module annotation: Pfam domain module=Arm::Arm::Arm::Arm::Arm::Ar m::Arm::Arm::HEAT::HEAT::HEAT::HEAT; Domain location=190-230::231 -271::272-312::313-354::356-394::397-434::435-475::476-518::201 -232::399-436::445-477::483-520
MVEATQVSKDKDAAAFEARSTEDWLLHAQELVPVALANAREVKGFPGRWKMIISKLEQIPLRLSDLSSHPCFSRNALCKEQLQAVSKTLREAIELAELCVKEKYEGKLRMQSDLDALIGKLDLNLKDCGLLIKTGVLGEASLPLTVLGSMAESDIATHNNIRELLARLQIGHLEAKHKALDRLYDVMKEDEKNVLAIFGRSNVAALVQLLTATSPRIREKTVSVICSLVESGSCEKWLVSEGVLPPLIRLVESGSAVGKEKATVSLQRLSMSAETTRAIVGHGGVQPLIELCQNGDSVSQAAAACTLTNVSAVPEVRQALAEEGIVRVMINLLNYGILLGSKEYAAECLQNLTSSNEHLRKSVVSEGGVRSLLAYLDGPLPQESAVGALKNLVGSVSEETLVSLGLVPCLVHVLKSGSLGAQQASASIICRVCSSMEMKKIVGEAGCIPLLIKMLDAKSNTAREVAAQAISSLMVLSQNRREVKKDDKSVPNLVQLLDPSPQNTAKKYAVSCLGSLSPSKKCKKLMISYGAIGYLKKLTEMDIVGAKKLLQRLERGKLRSLFSRK

SEQ ID NO: 180838 - protein, 232 aa, Glycine max
  Coding DNA Sequence Number=SeqID_64060
  Gene Ontology: Mol. function=nucleic acid binding; Cellular component= nucleus
  Homolog annotation: Hit_ID=Q6R4Q7; Match level="QueryCoverage=85%, HitCoverage=41%, E-value=3e-51, Identity=58%"; Hit description =Splicing factor-like protein
  Pfam annotation: Domain name=RRM_1; Domain location=77-141; Score =59.4; E_value=1.1e-14; Accession=PF00076.12; Description=RNA recognition motif. (a.k.a. RRM, R
MFQHRNHDDFATVAGFAFVYMEDERDAEYAIRRLDRTEFGRKGRRIRVEWTKQERDSRRSGGDSRKSSSNSRPSKTLFVINFDPVHARTRDLERHFDSYGKILNIRIRRNFAFIQFESQEDATRALEATNLSKFMDRVITVEYAIRDDDDRDRRNGYSPDRRGHDSPDGRYGRGRSPSPYRRGRGSPDYGHGSNPSSRPDPRGSPKYERAESPINNGRYDSRSPPPRERSRS

SEQ ID NO: 180839 - protein, 1206 aa, Glycine max
  Coding DNA Sequence Number=SeqID_64061
  Gene Ontology: Mol. function=nucleoside-triphosphatase activity; Cellular component=membrane; Biological process=defense response
  Homolog annotation: Hit_ID=Q1STU5; Match level="QueryCoverage=99%, HitCoverage=99%, E-value=5e-83, Identity=26%"; Hit description =Leucine-rich repeat
  Pfam annotation: Domain name=LRR_1; Domain location=131-153; Score =2.6; E_value=94; Accession=PF00560.23; Description=Leucine Rich Repeat
  Pfam annotation: Domain name=LRR_1; Domain location=19-43; Score=4.3; E_value=45; Accession=PF00560.23; Description=Leucine Rich Repeat
  Pfam annotation: Domain name=LRR_1; Domain location=265-288; Score =2.9; E_value=80; Accession=PF00560.23; Description=Leucine Rich Repeat
  Pfam annotation: Domain name=LRR_1; Domain location=289-313; Score =3.5; E_value=62; Accession=PF00560.23; Description=Leucine Rich Repeat
  Pfam annotation: Domain name=LRR_1; Domain location=451-474; Score =1.7; E_value=1.4e+02; Accession=PF00560.23; Description=Leucine Rich Repeat
  Pfam annotation: Domain name=LRR_1; Domain location=476-496; Score =3.3; E_value=68; Accession=PF00560.23; Description=Leucine Rich Repeat
  Pfam annotation: Domain name=LRR_1; Domain location=532-552; Score =0.3; E_value=2.5e+02; Accession=PF00560.23; Description=Leucine Rich Repeat
  Pfam annotation: Domain name=LRR_1; Domain location=558-580; Score =3.4; E_value=66; Accession=PF00560.23; Description=Leucine Rich Repeat
  Pfam annotation: Domain name=LRR_1; Domain location=684-704; Score =5.9; E_value=23; Accession=PF00560.23; Description=Leucine Rich Repeat
  Pfam annotation: Domain name=LRR_1; Domain location=714-733; Score =4.2; E_value=46; Accession=PF00560.23; Description=Leucine Rich Repeat
  Pfam annotation: Domain name=LRR_1; Domain location=752-777; Score =8.3; E_value=8.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =131-153::19-43::265-288::289-313::451-474::476-496::532-552::558 -580::684-704::714-733::752-777
MKRLTQIWPPKIPLHSFGKLHELIIDRCNKLENVFPSYMVGSFLSLCDLKVTNCKSMEKIFDLKSVGKRRAWNMITSLQNVHVKALPKLEHVWNEDPGGILRFTYLKKIWVQECLKLKHIFPVSIAMNLKNLEYLEVWNCAQLKEIVFRGETIKESSVLFEFPKLTTARFSKLPNLESFFGGAHELRCSTLYNLSVEHCHKLWLFRTEIANPEEKSVFLPEELVTSRSLVNDNLGVVPMLKSLKLMNLASLKTIGFEEYTVLFRMLECLILKHCPCLNSIASSSVSFTYLTNLEVSNCNKLSYLLTPPTAKSLVQLTTMKVIQCESMKTIVFESEQEKTELNIIFRQLKEIELEALHELKCFCGSYCCAIEFPSLEKVVVSACSKMEGFTFSEQANKTPNLRQICVRRGKEEERLYWVRDLNATIRSLYKIRALDPDMAASNPYMALKIHQLKTLKLVNCIESNAIPTVVFSSLKNLEELEVSSTNVEVIFGIMEADMKGYTLRLKKMTLDNLPNLIQVWDKDREGILSFQNLQEVLVANCEKLKTVFPTELAKRIVKLEKLEIRHCEVLQEIVEEANAITEEPTEFSFPHLTSLNLHMLPQLSCFYPGRFTLECPALNHLEVLSCDNLEKFQNQQEAQCSTSVTKLPLFSEGKTIFILESLKLYWEIARMLCNKKFLKDMLHKLVELELDFNDVREVPNFVVEFAALLERTSNLEYLQISRCRVLEELFPSQPEQGDTKTLGHLTTSSLVRLQKLCVSSCGHLTTLVHLPMSFSNLKHLSVKDCHGLKCLFTSTTAKKLVHLEEMYIMRCKSVEEILAKELEDTTTSEAIQFERLNTIILDSLSSLSCFYSGNEILLLSSLIKVLIWECPNMKIFSQGDIEAESFMGIQVSLDPNEDLFFHQDLNNTVKRRFQQNELFEALDNESISDNLELKVDWHGKVGLENKWLDNLMTLKPDNCTLPNAIPSATLPHSETTEEFEVQNSIKVKEEGTAANVTQKFVFPRLENWNIHDLPQQLFPSAHLMNKDEGTSTSINSHPLILSLKVISNPKELRLDWKHNPALLFEKLHELDVFNFPHLTNLVYSTSRLSFSRLKKVSTFNCPHMQHLFTYSEAKKLMNIEEITNKECESVTEIIAKDGDENEHKGEGSSTLNSPSLKEVGFTKCYSTKLFHLGGKVRTILKVTIEGADWEGDINSAPMQQFEEEAA

SEQ ID NO: 180840 - protein, 903 aa, Glycine max
  Coding DNA Sequence Number=SeqID_64062
  Gene Ontology: Mol. function=nucleoside-triphosphatase activity; Cellular component=membrane; Biological process=defense response
  Homolog annotation: Hit_ID=Q1STU9; Match level="QueryCoverage=95%, HitCoverage=67%, E-value=1e-104, Identity=32%"; Hit description=H+ -transporting two-sector ATPase, alpha/beta subunit, central region; Disease resistance protein
  Pfam annotation: Domain name=AAA; Domain location=176-395; Score= -28.2; E_value=0.029; Accession=PF00004.19; Description=ATPase family associated with various cellular activities (AAA)
  Pfam annotation: Domain name=LRR_1; Domain location=600-623; Score =1.0; E_value=1.9e+02; Accession=PF00560.23; Description=Leucine Rich Repeat
  Pfam annotation: Domain name=LRR_1; Domain location=625-646; Score =1.8; E_value=1.3e+02; Accession=PF00560.23; Description=Leucine Rich Repeat
  Pfam annotation: Domain name=LRR_1; Domain location=671-692; Score =12.5; E_value=1.3; Accession=PF00560.23; Description=Leucine Rich Repeat
  Pfam annotation: Domain name=LRR_1; Domain location=694-717; Score =10.5; E_value=3.1; Accession=PF00560.23; Description=Leucine Rich Repeat
  Pfam annotation: Domain name=MobB; Domain location=175-270; Score= -38.6; E_value=0.063; Accession=PF03205.4; Description=Molybdopterin guanine dinucleotide synthesis protein B
  Pfam annotation: Domain name=NB-ARC; Domain location=140-507; Score= -1.7; E_value=3.5e-10; Accession=PF00931.13; Description=NB-ARC domain
  Pfam module annotation: Pfam domain module=AAA::LRR_1::LRR_1::LRR _1::LRR_1::MobB::NB-ARC; Domain location=176-395::600-623::625 -646::671-692::694-717::175-270::140-507
MQFVGIFVQVLPHLKSVCLHLKSGLGYLKLLPYELWRYESIVKELDRGFNNLQRERKRIGHKVKEEENRYGRAIDDDVIKWLQEADKIISEYDDFRLDEDSPYAVFCDGYLPKPSIRFRLSRIAVDLARRGNVLLQSANPDWLGRSSTDADFQSFASRNQTKKRIVDALADSNVGVIGVYGWSGVGKTSLIKEVAKEVKGKMFDVVIMVNVSFPEIRNIQGQIADRLGMILEEESESGRAARIRERLKNPKEKTLIILDDMEVKLDFGMLGIPFDDTVGSQMNNKKKNPLAHHKYAMKTEEFEASSLMKIEEPIARYTGCKILMISDSEQLLISQMGGKGIQTFSVEALTDKEAKKMFMTMAEIIPLMEKKAETMFKTMAEIIALREMEAETMSKIMTEMIGDENSKFEKLAAQIAKRCKGLPMTIVTTAKALKNKSLVVWEKAYLDLGKQNLTAMPEFSTKLSYDLLENEELKHTFLICARMGRDALITDLVRYCIGLGFLQGIYTVREARDRVYALVGKLKELSLLSDSFSIDHFTMHDIIRDVALSIASQEMHAFALTKGRLDEWPKKRERYTAISLQHCDVTDIMKKFPESIDCCRLRIFHLDNMNPRLEIPDNFFNGMKELRVLILIGIHLLSLPSSIKCLKELRMFCLERCKLAENLSIIGELEELRVLSLSGSDIECLPIELRKLAKLQIFDISNCFELKKIPADVLSSLTSLEELYVGKSPIQWKDEEGQGNQNGDVSLSELRQLNQLTALDIQIPKMTHFHKNLFFDQLNSYKIIIRDFNAYPAWDFKMLEMCEASRYLALQLENGFDIRNRMEIKLLFKRVESLLLGQLNDVKDIFNELNYEGFPYLKYLSILSNSKVKSIINSENPTYPEKAFPKLESLFLYDVSNMEHICH

SEQ ID NO: 180841 - protein, 895 aa, Glycine max
  Coding DNA Sequence Number=SeqID_64063
  Gene Ontology: Mol. function=RNA-directed DNA polymerase activity; Cellular component=chromatin; Biological process=chromatin assembly or disassembly
  Pfam annotation: Domain name=Chromo; Domain location=797-844; Score =28.6; E_value=2.2e-05; Accession=PF00385.14; Description='chromo' (CHRromatin Organisation MOdifier
  Pfam annotation: Domain name=RnaseH; Domain location=269-390; Score= -19.7; E_value=0.004; Accession=PF00075.14; Description=RNase H
  Pfam annotation: Domain name=rve; Domain location=525-647; Score =19.6; E_value=0.00014; Accession=PF00665.16; Description=Integrase core domain
  Pfam annotation: Domain name=zf-H2C2; Domain location=470-507; Score =21.3; E_value=0.00053; Accession=PF09337.1; Description=His(2) -Cys(2) zinc finger
  Pfam module annotation: Pfam domain module=Chromo::RVT_1::RnaseH::rve: :zf-H2C2; Domain location=797-844::12-181::269-390::525-647::470-507
MLQKGLIQPSTSPFSSPVLLVKKHDGSWRFCVDYRALNSLTVKDRFPIPTIDELLDELGGAQCFSKLDLLQGYHQIRMHSEDIPKTAFRTHHGHYEFRVMPFGLCNAPSSFQATMNLIFRPFLRRFVIVFFDDILIYNSSFDDQLHHLDLTFQVLLDNHFVLKKSKCSFGQSQVEYLGHLVSQRGVEPMPDKVVAIVNWPQPHSTRAVQSFLGLAGFYRRFIRGYAMIADPLVKATSDPFRWTPQAQQAFKALKSALSTAPVLSLPDFQESFTVETDASGNGMGAVLSQRGHPIAYFSKPFPKKLLRASTYVRELFAITSAVKKWRQYLLGHSFTIVTDHKSLKELLTQVIQTPEQHMYLAQLMGFDYQIQYRSGKHNQAADALSRSPEFTPSLLLLLSIPCLTFLDELHQQLTNNSQYCQRRQDILNSPATNPDFTLSQHFILYKGKIWLPRELPLIRTLMLEYHATPMGGHMGVTKTIARLSENFTWPGLRSDVATFVANCPECQFTKYETKCTAELLCPLPVPFWPWEDLSLDFITGLPSYQGKTVLLVVVDRFSKGIHLGVLPTAHTAHMVASLFIDIVVKLHAYHPHSDGQTEVMNRVIEQYLRAFVHRQPATWGRFLPWVELSHNTSWNAGTGSKPYEITFGRKPFSFLDYITGSSKLDAVDDILKHHEEVFLCIRQKLLKAQDAMKRTADAKRREVEYEVGNWVLLKLRPYRQRSAKDAQASSGKLAKRFYGPFKVLERIGKVAYRLKLPEGARIHPLFHCSLLKPFHGDPTLSHTPSLPDHLFNHQPIISPLAILDTRRAATTEGSWEVLVQWKGLLPDDTSWENWDQLQQTYHLEDKVILQGPREVDSNRAIPEEATEETTDMNAGLQTVKPKRKITRPAYLRDYA

SEQ ID NO: 180842 - protein, 77 aa, Glycine max
  Coding DNA Sequence Number=SeqID_64064
MAANSHCRELQQCWRRKVHGMRLTEQELVSDLLFADHIDPLYRVNGGQGIKHSEIENRNICITEFDSRCFLARDILI

SEQ ID NO: 180843 - protein, 728 aa, Glycine max
  Coding DNA Sequence Number=SeqID_64065
  Gene Ontology: Mol. function=nucleic acid binding; Cellular component= intracellular; Biological process=DNA integration
  Homolog annotation: Hit_ID=Q1RXN8; Match level="QueryCoverage=99%, HitCoverage=70%, E-value=0.0, Identity=46%"; Hit description =Peptidase S8 and S53, subtilisin, kexin, sedolisin; Integrase, catalytic region; Zinc finger, CCHC-type
  Pfam annotation: Domain name=rve; Domain location=143-306; Score =176.0; E_value=9.2e-50; Accession=PF00665.16; Description=Integrase core domain
  Pfam module annotation: Pfam domain module=RVT_2::rve; Domain location=448-630::143-306
MDSRCTYHMSPVKDYFEDLEQKEYGTVLLGNNKACKVHGIGTVRLRMFDNREMLLQDVRYVPKLKRNLISISMFDLMGCTTKVDNGMMKVSTGASIIAKGRRSNGLYILEGSTVIGQAFVASQTMEDKSKLWNLRLGHISMHTSTRPFEYAHADLWGPSRIQTHGGGSYFLSIIDDYSRRVWVYILRNKAETFQKFKEWHTQIENQQGTKLKVLRTDNGLEFVSDQFNIFCTHHGIKRHKTVAGTPQQNGLAERMNRTILERVRCMLLGASLPKVFWGEAANTTVYLINMSPSSALEYKTPMEDKLDARAIRCLFLGYAKGVKGYRLWRLDLKPSKLIISKDVTFDETRMRMYSENSECGKEKTHIEVEPFTDKVQENTQINPITDLDNIAEKLDTQERRIPKPNRKFAQADLICYALTTAEEIEGSTEPRNFKEAHESEERQLWLYAIEEELEALKKNNTWRLVELPKGQKVVSCKWIFKRKSEIPGVQKTRYKARILMSIANQFKLHLEQLDVKTAFLHGDLEETIYMRQPEGFALDDREDYLYLLLYVDDILVASCNKCMINDLKSRLNSEFETKDLGEARQIPSVDIKRDQLKGTLLLSQQAYMQKVVERFRMHQSKPVSIPLGQHIKLLKSQGPISDDDKKMMDAVPYTSGVGSIMYGMVCTRPDLAHARNSQGGTVIEGFMDADFTGCLDTRKSLAGYVFTLFGTAVSWKSNLQSIVALSTT

SEQ ID NO: 180844 - protein, 1026 aa, Glycine max
  Coding DNA Sequence Number=SeqID_64066
  Gene Ontology: Mol. function=nucleoside-triphosphatase activity; Cellular component=membrane; Biological process=defense response
  Homolog annotation: Hit_ID=Q1STU9; Match level="QueryCoverage=95%, HitCoverage=83%, E-value=1e-117, Identity=30%"; Hit description=H+ -transporting two-sector ATPase, alpha/beta subunit, central region; Disease resistance protein
  Pfam annotation: Domain name=AAA; Domain location=181-412; Score= -26.2; E_value=0.02; Accession=PF00004.19; Description=ATPase family associated with various cellular activities (AAA)
  Pfam annotation: Domain name=LRR_1; Domain location=532-555; Score =1.0; E_value=1.8e+02; Accession=PF00560.23; Description=Leucine Rich Repeat
  Pfam annotation: Domain name=LRR_1; Domain location=557-581; Score =0.8; E_value=2e+02; Accession=PF00560.23; Description=Leucine Rich Repeat
  Pfam annotation: Domain name=LRR_1; Domain location=603-624; Score =11.1; E_value=2.3; Accession=PF00560.23; Description=Leucine Rich Repeat
  Pfam annotation: Domain name=LRR_1; Domain location=626-649; Score =13.1; E_value=0.99; Accession=PF00560.23; Description=Leucine Rich Repeat
  Pfam annotation: Domain name=LRR_1; Domain location=788-825; Score =0.7; E_value=2.1e+02; Accession=PF00560.23; Description=Leucine Rich Repeat
  Pfam annotation: Domain name=LRR_1; Domain location=969-993; Score =5.5; E_value=27; Accession=PF00560.23; Description=Leucine Rich Repeat
  Pfam annotation: Domain name=LRR_1; Domain location=995-1017; Score =6.1; E_value=21; Accession=PF00560.23; Description=Leucine Rich Repeat
  Pfam annotation: Domain name=NB-ARC; Domain location=147-482; Score =41.9; E_value=5.9e-13; Accession=PF00931.13; Description=NB-ARC domain
  Pfam module annotation: Pfam domain module=AAA::LRR_1::LRR_1::LRR _1::LRR_1::LRR_1::LRR_1::LRR_1::NB-ARC; Domain location=181-412::532 -555::557-581::603-624::626-649::788-825::969-993::995-1017::147-482
MGSLIVVCHLFLTSPRLKAWLKDQWIHLKSYEARVRELECVVQKLKKKRDVIQHTIDEEEHRRGREIHVEVEEWKDRVDKLFFKYEDFKNDRYRELAEFNLLQSGYLPKPGIRYGRSREAYAIIREANGLLQTAKFDTLSYWPGPPSMAAFFSNVGYESYPSREETMRKIIEELEDPSVRMIGLHGLSGVGKTTLVKEVVKKALKDKMFDVVTMASLTKNPDIRKIQGQIADTLGVTLDEESDIARAARIQKILKNDKKNTLVILDDLWDKMDLNMLGIPYEIDNGSSQRNVTEGKSFGTDGFKNSKEGKALNDLSATRVKKEETFSQYKGCKILMISESKQALLRQMEGKANCILSLEVLKEKEAHMLFKKKAGIGDKNSEFENLAAQIANKCNGLPMSIVTTARALKNQSRSVWEDIHRKLEWQNLTGAPELSTKLSYDLLEDEELKYTFLLCARMGRDALFMDLVKYCIGLGFLQGIYTVRETRDRVYALVAKLKESDERPDKLERYAAISLHYCDFIEGFLKKRNYGRLRVFHVNNNNPNLEIPRNFFKGMKELKVLILTGIHLSLSKLSISSLTELRMLCLEQCVLDEDLSIIGKLKKLRILSFSGSDIENLPVELQQLEKLQIFDISNCSKLKEIPSGVISSLVSLEDLYMRNTLIQWEVEGQAHESKKASLSELKHLNQLITLDIQIPDVSYLPKNLFFDQLYSYKIVIGDLAAYLEADFKMPEKYETSRFLAIRLKGENDNIHSLKGIKMLFERVENLFLEELNAVQDIFYRLNLKGFPYLKHLSIVNNSTIESLIHPKDREQSQHPEKAFPKLESLCLNNLKKIVNICSCKLSEPSFGKLKVIKINLCGQLKSVFLISVVSLLSVLETIEVLECNSLKEIVQVETQSTGEVKLMFPELRSLKLQFLSQFVGFYPIPSRKQKELFNEKIDVSKLERMELSSIPIDIIWSVHQSSRISSFKNLTHLDVNSCWELKDVISFSMAKSLTNLQSLFVSECGKVRSIFPDCPQMEEIQEFEAS

SEQ ID NO: 180845 - protein, 281 aa, Glycine max
  Coding DNA Sequence Number=SeqID_64067
  Homolog annotation: Hit_ID=Q1S1P5; Match level="QueryCoverage=35%, HitCoverage=17%, E-value=4e-27, Identity=64%"; Hit description=IMP dehydrogenase/GMP reductase
MALGSDIANTVDSGTEEGVVVGMNEGGPRCKLAIVSHPLEPCQGTAIHVEGNNGAGENCGGFVCGEEDDGDEGRRSKKAWRSVSLRSAASSELGEGSGMVRRTNESTNVRGWNTLVSRTRPSYEEEGEDRDNYPADGPIGPHGVLTHNHAVCLLNSSCIPCCTPVSLSTSETRLKQILLEVAAQAISSLIVLSQNQIEVKMDDTSVPNLVQLLDSSTQNTAKKYAVSCLGSHSPSKKCKKLMISYGAIRYLKKLTEMDIPGAKKLLERLERGKLRSLFSRK

SEQ ID NO: 180846 - protein, 437 aa, Glycine max
  Coding DNA Sequence Number=SeqID_64068
  Gene Ontology: Mol. function=nucleoside-triphosphatase activity; Biological process=defense response
  Homolog annotation: Hit_ID=Q1STU5; Match level="QueryCoverage=98%, HitCoverage=92%, E-value=4e-51, Identity=34%"; Hit description =Leucine-rich repeat
  Pfam annotation: Domain name=LRR_1; Domain location=212-235; Score =10.3; E_value=3.4; Accession=PF00560.23; Description=Leucine Rich Repeat
  Pfam annotation: Domain name=LRR_1; Domain location=265-287; Score =3.1; E_value=75; Accession=PF00560.23; Description=Leucine Rich Repeat
  Pfam annotation: Domain name=LRR_1; Domain location=289-313; Score =3.2; E_value=71; Accession=PF00560.23; Description=Leucine Rich Repeat
  Pfam annotation: Domain name=LRR_1; Domain location=46-69; Score=2.8; E_value=86; Accession=PF00560.23; Description=Leucine Rich Repeat
  Pfam annotation: Domain name=LRR_1; Domain location=72-93; Score=1.6; E_value=1.4e+02; Accession=PF00560.23; Description=Leucine Rich Repeat
  Pfam module annotation: Pfam domain module=LRR_1::LRR_1::LRR_1::LRR _1::LRR_1; Domain location=212-235::265-287::289-313::46-69::72-93
MQAIFDIHVKVGDVANLQDVHLERLPKLEHVWKLNEDRVGILKWNNLQKICVVNCYSLKNIFPFSVANCLDNLEYLEVGQCFELREIVAISEAANTDKVSFHFPKLSTIKFSRLPKLEEPGAYDLSCPMLNDLSIEFCDKLKPFHKNAQRKPLFPEEVINKLKSMQIESQHANSPSSYMEKSNHRRHNLEELCLSRLTDTETLYSFLHRNPNLKSLSLSNCFFEEISPPTEIENLGVVPKLKSLKLINLPQLKEIGFEPDIILKRVEFLILKNCPRMTTLVPSSASLSSLTNLEVVNCAKLEYLMSPSTAKSLGQLNTMKVMKCESLVEIVGKEEDGENAGKVVFKKLKTLELVSLKKLRSFCGSDSCDFEFPSLEKTVVSACYNMEKFSEKVTSSSTPILQSIYVVHEKEKKRCCWKGDLNATIKTIFEEKFFLKN

SEQ ID NO: 180847 - protein, 917 aa, Glycine max
  Coding DNA Sequence Number=SeqID_64069
  Gene Ontology: Mol. function=nucleoside-triphosphatase activity; Biological process=defense response
  Homolog annotation: Hit_ID=Q1STU5; Match level="QueryCoverage=69%, HitCoverage=93%, E-value=8e-51, Identity=27%"; Hit description =Leucine-rich repeat
  Pfam annotation: Domain name=LRR_1; Domain location=21-42; Score=1.8; E_value=1.3e+02; Accession=PF00560.23; Description=Leucine Rich Repeat
  Pfam annotation: Domain name=LRR_1; Domain location=254-279; Score =1.5; E_value=1.5e+02; Accession=PF00560.23; Description=Leucine Rich Repeat
  Pfam annotation: Domain name=LRR_1; Domain location=310-333; Score =5.8; E_value=24; Accession=PF00560.23; Description=Leucine Rich Repeat
  Pfam annotation: Domain name=LRR_1; Domain location=336-360; Score =2.6; E_value=92; Accession=PF00560.23; Description=Leucine Rich Repeat
  Pfam annotation: Domain name=LRR_1; Domain location=468-504; Score =2.5; E_value=96; Accession=PF00560.23; Description=Leucine Rich Repeat
  Pfam annotation: Domain name=LRR_1; Domain location=520-543; Score =0.7; E_value=2.1e+02; Accession=PF00560.23; Description=Leucine Rich Repeat
  Pfam annotation: Domain name=LRR_1; Domain location=555-577; Score =5.4; E_value=28; Accession=PF00560.23; Description=Leucine Rich Repeat
  Pfam annotation: Domain name=LRR_1; Domain location=581-603; Score =5.2; E_value=31; Accession=PF00560.23; Description=Leucine Rich Repeat
  Pfam annotation: Domain name=LRR_1; Domain location=729-750; Score =3.2; E_value=73; Accession=PF00560.23; Description=Leucine Rich Repeat
  Pfam annotation: Domain name=LRR_1; Domain location=78-102; Score =1.2; E_value=1.7e+02; Accession=PF00560.23; Description=Leucine Rich Repeat
  Pfam annotation: Domain name=LRR_1; Domain location=858-880; Score =1.9; E_value=1.3e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =21-42::254-279::310-333::336-360::468-504::520-543::555-577::581 -603::729-750::78-102::858-880
MDNMSFSEHPELQQAWQDGQSLKELEVGDCKNVEVIFEMDVTEDAGTTFQLQNLSLERLPKLMQAWKGNGRGTHSFQNLQEVFVIGCQRLQNVFPAAVAKNLKKLHSLFIISCQRLEEIVKKEEDAEAEAAAEFVFPCLTTLHLSNLPELICFYPEPFTLGCPVLDKLHVLDCPKLELFESANRQPVFSDLKVISNLEGLALEWKHSSVLNSKLESGDYPNLLEYLIWIRLYFDVDDDGNPIFPIQTLQKASPNLKAMIISSCRSLEVFRTQIPEINKNLMLTQLCLIDVWKLKSIGSGEAQWLDEICKKLNELDVRGCPHFTALLHSPSSVTFSNLKELFIFNCQRLKYLFTSSAAKKLSQLEEIIVYYCKSIKEIVAKEEDETALGDVILPQLHRISLADLSSLECFYSGNQTLQLPSLIKVHIDKCPKMEIFSQGSIGPNSCREIVTRVDPNNRSVVFDDELNSSVKKVFLHQNHIVFGDSHMLQEMWNSETLPDWYFRNLTSMVVEGMGPQGSLSHLEQLQLENCDELAAIVANDEADNEEATKEIVIFSSITSLRLSDLPKLSCIYPGMQSLEWRMLKELHVKHCQKLKFFASEFQNSPDLNPDGEDRFSTDQQAIVSLEKVTPCLEVMSLGKEEAMMIEQGKLDIELPKLNSLKLQCFQDEQGDIFPFVFGLKVSVSLPTIEKLVLLHSAFKEIFPSEKTSNGIDYDKILSQLKRLELLSLFQLKSIGLEHSWISPFIQNLKTLLDCDGLKYLFTFSTAKTLVVLKEIYITKCKSLKTIVAKDGEEGGDDEDNDVEEEDQGEGNEDEDEDEDEEEDEDEEEANAKGDGDEDENEGNNDENGNQGEDDITFKKLESLTLSSLPKLRSFYTGSSSLNFPCLKEIVVWCKKLIVIAFAHVTLENRLSSSHATTE

SEQ ID NO: 180848 - protein, 277 aa, Glycine max
  Coding DNA Sequence Number=SeqID_64070
MTQELVARGDTLRLFAPRHSVTPSVIDEQRPMWSSAPFPEMSAFSDGDFSSLTSYPELRRGGGPDDTRRYLTVIRTLLSSRGGGPDDKAETKFGHSAPLYHPEAAGPMIRGDTLRLSAPFCHPEAAGPMTSRDQIWSFCTLVSSRGGGPDDTRRYLTVIRTLLSSRGGGPDDKQRPKFGHSAPLYHPEAAGPMIRGDTLRLSAPFYHPEAAGPMTSRDQVWSFCTLVSSRGGGPDDTRRYLTVIRILLSSRGGGPDDKQRPSLVILHPCIIQRRRAR

SEQ ID NO: 180849 - protein, 127 aa, Glycine max
  Coding DNA Sequence Number=SeqID_64071
  Gene Ontology: Mol. function=asparaginase activity; Biological process=glycoprotein catabolic process
  Homolog annotation: Hit_ID=P50288; Match level="QueryCoverage=79%, HitCoverage=31%, E-value=3e-40, Identity=78%"; Hit description=L -asparaginase precursor (EC 3.5.1.1) (L-asparagine amidohydrolase) [Contains: ...
  Homolog annotation: Hit description=L-asparaginase subunit alpha; L -asparaginase subunit beta]
  Pfam annotation: Domain name=Asparaginase_2; Domain location=1-126; Score=-132.3; E_value=0.0016; Accession=PF01112.9; Description =Asparaginase
MHNFCGIRKSILSFYTPWYTCQKNNNSPVIVAGTYANELCAMLATGKGETILCATVARDVAVLMEFKGVFLKEAANCVVHERTSKGLVGLVDVSAAGEVAMPYNTLGMFRACATEDGYSEIAIWPSS

SEQ ID NO: 180850 - protein, 531 aa, Glycine max
  Coding DNA Sequence Number=SeqID_64072
  Gene Ontology: Mol. function=transferase activity, transferring hexosyl groups; Cellular component=integral to membrane; Biological process=carbohydrate biosynthetic process
  Homolog annotation: Hit_ID=Q75IZ5; Match level="QueryCoverage=88%, HitCoverage=86%, E-value=0.0, Identity=67%"; Hit description =Putative glycosyltransferase protein
  Pfam annotation: Domain name=Glyco_transf_8; Domain location=151-506; Score=295.9; E_value=7.5e-86; Accession=PF01501.10; Description =Glycosyl transferase family 8
MKDKGHRKPIHLYKSFDAIDIAICYYNCFLPPPPLGSGYLQSKLLTLQERNAKVEHFAKRYNFTEEILSATSFSRQLAEQMVLAKAYVIIAKEHNNLHLAWELSSKIRSCQLLLSKAAMTGEPVTMEEAEPIIKSLSSLIFKAQDVHYDIATTIATMKSHIQALEERANTATIQSTVFAQISAEALPKSLHCLNVKLMADWLKMPSLQKLSHESRISPRLTDNNLNHFCIFSDNVLATSVVVNSTVMNADHPKQLVFHIVTDGINYGAMQAWFFSNDFKGATLEVQNIEKFHWLNESYSPIVKQLRIPESRAFYFGPYQGANVEPKLQNPKFLSLLNHLRFYIPEIYPLLEKVVFLDDDVVVQKDLTPLFSLDLHGNVNGAVETCLEAFHRYYKYLNFSNSIISSKFDPQACGWALGMNVFDLVAWRKANVTARYHYWQEQNADGTLWKLGTLPPALLSFYGLTEPLDRRWHVLGLGYDLNIDNRLIESAAVIHFNGNMKPWLKLAIGRYKPLWHKYINQSHPHLQDCAAG

SEQ ID NO: 180851 - protein, 110 aa, Glycine max
  Coding DNA Sequence Number=SeqID_64073
  Homolog annotation: Hit_ID=Q1SHR1; Match level="QueryCoverage=33%, HitCoverage=6%, E-value=2e-10, Identity=89%"; Hit description=Ankyrin
  Pfam annotation: Domain name=Ank; Domain location=56-86; Score=23.4; E_value=0.0008; Accession=PF00023.20; Description=Ankyrin repeat
MHLENETNTLVKERDRLVRETKWLEESINRERKLLGKVMKVLLGKELVVATRTDTKGQTTLHMAVKGQSLEVVEELIKADPSIINMGPIFRAPQRGQEPWPHHPQPLNPL

SEQ ID NO: 180852 - protein, 78 aa, Glycine max
  Coding DNA Sequence Number=SeqID_64074
  Gene Ontology: Mol. function=RNA binding
  Homolog annotation: Hit_ID=Q9ZVI3; Match level="QueryCoverage=53%, HitCoverage=14%, E-value=1e-09, Identity=69%"; Hit description =Putative RNA-binding protein
MWQAVLSLLEKPEVLYLIRYEHLNESLRVFIEVDLPVNVVDIRLRQAHEIIEELLKPMEASSLTMQTSCHCAFWRHAT

SEQ ID NO: 180853 - protein, 778 aa, Glycine max
  Coding DNA Sequence Number=SeqID_64075
  Gene Ontology: Mol. function=cellulose synthase (UDP-forming) activity; Cellular component=membrane; Biological process=cellulose biosynthetic process
  Homolog annotation: Hit_ID=Q8GUZ9; Match level="QueryCoverage=97%, HitCoverage=73%, E-value=0.0, Identity=75%"; Hit description =Cellulose synthase-like protein D4
  Pfam annotation: Domain name=Cellulose_synt; Domain location=1-778; Score=1790.9; E_value=0; Accession=PF03552.5; Description=Cellulose synthase
MSVVCEIWFAFSWLLDQLPKLFPVNRVADLDVLKDKFETPNPTNPTGKSDLPGIDMFVSTADPEKEPPLVTANTILSILAADYPVEKLSCYVSDDGGALLTFEAMAEAAAFANMWVPFCRKHHIEPRNPESYFNLKRDPYKNKVRSDFVRDRRRVKREYDEFKIPKATWMADTKHWPGTWTTAAPEHSRGDHASIIQVMLQPPSDEPLTGKESDSNALDFSEVDIRLPMLVYVSREKRPGYDHNKKAGAMNALVRASAIMSNGPFILNLDCDHYIYNSEALREGMCFMMDRGGDRLCYVQFPQRFEGIDTNDRYANHNTVFFDVNMRALDGIQGPVYVGTGCLFRRTALYGFDPPRIKEEGGWFGGKEKKKKSSTVASVSESLRNGSIEEEEMSSDLVPKKFGNSSLLVDSVRVAEFQGLPLADDDSSMKYGRPPGALTLPRDPLDVATVAEAINVISCWYEDKTEWGLRVGWIYGSVTEDVVTGYRMHNRGWNSIYCVTKRDAFRGTAPINLTDRLHQVLRWATGSVEIFFSRNNALFASSRLKLLQRIAYLNVGIYPFTSIFLIVYCFVPALSLFTGQFIVQTLQVTFLVYLLGITLTLVILAALEIKWSGIELEEWWRNEQFWLIGGTSAHLAAVLQGLLKVMAGIEISFTLTSKSGGDDENDEFADLYVIKWTSLMIPPITIMMVNLIAIAVAVSRTIYSEDREWSSLLGGVFFSFWVLSHLYPFAKGLMGRRGRTPTIVFVWSGLISITISLLWVAIDPPSGSSQIGGSFQFP

SEQ ID NO: 180854 - protein, 48 aa, Glycine max
  Coding DNA Sequence Number=SeqID_64076
MAAEVEAAFKTQSCLREKLTLDNVRHALNWLLSFELVSSSVWFHCHGY

SEQ ID NO: 180855 - protein, 408 aa, Glycine max
  Coding DNA Sequence Number=SeqID_64077
  Gene Ontology: Mol. function=peptidase activity; Cellular component =integral to membrane; Biological process=aromatic compound metabolic process
  Homolog annotation: Hit_ID=Q84SE0; Match level="QueryCoverage=87%, HitCoverage=91%, E-value=1e-109, Identity=57%"; Hit description =Putative TPA: Cgi67 serine protease
  Pfam annotation: Domain name=Abhydrolase_2; Domain location=58-267; Score=-70.9; E_value=0.016; Accession=PF02230.7; Description =PhospholipaseCarboxylesterase
  Pfam annotation: Domain name=BAAT_C; Domain location=135-284; Score= -78.0; E_value=0.019; Accession=PF08840.1; Description=BAAT  Acyl-CoA thioester hydrolase C t
  Pfam module annotation: Pfam domain module=Abhydrolase_2::BAAT_C; Domain location=58-267::135-284
MGCMVSQLAAKFAFFPPSPPTYQLKKNEDGKLTVVSAAAPIPHADDTSLDVLLVDTKHGNKIVAFYLRNPYARLTLLYSHGNAADLGQLYDLFVQLKVNLRVNLMGYDYSGYGASTGKPSESSTYADIEAIYECLETEYGVSQEDVILYGQSVGSGPTLHLAAKLPRLRGVVLHSGILSGLRVLCHVKFTFCLDIYKNINKIKKVKCPVLVIHGTEDDVVNWLHGNGLWKMSRESYDPLWIKGGGHCNLELYPDYIRHLCKFIQEMESMTTEKRLKKIRQSANQSKSNTGCTCSRCCRVKCCRVKCPECSNCCCCMNVSWSINCPECCWRPSCKCCRLPKFPSCFRSICRTKWSWPSCCATKCSLSLPSCCCCCYPKRARPSCCCMNCFCWQCCVGKHSDGTNGKQNG

SEQ ID NO: 180856 - protein, 67 aa, Glycine max
  Coding DNA Sequence Number=SeqID_64078
  Gene Ontology: Mol. function=RNA-directed DNA polymerase activity; Biological process=RNA-dependent DNA replication
MLKVDETYLNRYAKILNCKVMEVPFKYLGVPVGANSHKEAMWEPIVTKFRSKLAMRKQRTLSMGKRG

SEQ ID NO: 180857 - protein, 105 aa, Glycine max
  Coding DNA Sequence Number=SeqID_64079
  Subcellular localization annotation: CTP_CleavageSite=64; ConfidenceScore=5.51e-01
MNSKPIKPKQTRSSFNSNEQSRVGEQYKMNCSMAASRKTSSSNRNDQIAVSAYLTSMKAPKTTRNSEERKREKERSFDENGETKEKPTESFLRSNQFKALISLWK

SEQ ID NO: 180858 - protein, 61 aa, Glycine max
  Coding DNA Sequence Number=SeqID_64080
MTDKLARAQYLKNKNPKDCASLHIAQNRVHVLASLFKTSKDEKDKVVVGFLSLQFSGTTEN

SEQ ID NO: 180859 - protein, 345 aa, Glycine max
  Coding DNA Sequence Number=SeqID_64081
  Gene Ontology: Mol. function=glycerol-3-phosphate O-acyltransferase activity; Cellular component=chloroplast; Biological process =phospholipid biosynthetic process
  Homolog annotation: Hit_ID=Q43822; Match level="QueryCoverage=100%, HitCoverage=90%, E-value=1e-102, Identity=69%"; Hit description =Glycerol-3-phosphate acyltransferase, chloroplast precursor
  Pfam annotation: Domain name=Acyltransferase; Domain location=138 -297; Score=138.7; E_value=1.6e-38; Accession=PF01553.11; Description= Acyltransferase
  Subcellular localization annotation: CTP_CleavageSite=60; ConfidenceScore=5.78e-01
MSRTGSSAYYWVADATPPLRNSKTTMFMLSTPPTTTFFVTPTPRVPFLSSSKPSSVSLLRSSTASYSPCCSSSSSITPKVKSNDNNNCYLVSAKHSPANTSASVSSRTFLNAKNEQELLAGIRKEVEAGSLPANVAAGMEEVYNNYKNAGHNIILMSNHQTEADPAIIALLLETRIPYIAESMTYVAGDRVITDPLSKPFSIGRNLICVYSKKHMLDDPALIEMKRNANIRALKEMAMLLRSGSQIVWIAPSGGRDRPDPHTGEWAPAPFDTSSVDNMRRLVEHSGPPGHVYPLAILCHDIMPPPLKVEKEIGEKRIISFHGAGISVAPALSFSETTATSENPEK

SEQ ID NO: 180860 - protein, 377 aa, Glycine max
  Coding DNA Sequence Number=SeqID_64082
  Gene Ontology: Mol. function=catalytic activity; Cellular component =plastoglobule; Biological process=cellular metabolic process
  Homolog annotation: Hit_ID=Q6ZI86; Match level="QueryCoverage=67%, HitCoverage=62%, E-value=2e-13, Identity=39%"; Hit description =Dehydrogenase-like protein
  Pfam annotation: Domain name=Epimerase; Domain location=72-366; Score= -37.9; E_value=0.0011; Accession=PF01370.11; Description=NAD dependent epimerasedehydratase family
  Pfam annotation: Domain name=NAD_binding_4; Domain location=74-350; Score=-106.8; E_value=0.1; Accession=PF07993.2; Description=Male sterility protein
  Pfam module annotation: Pfam domain module=Epimerase::NAD_binding_4; Domain location=72-366::74-350
  Subcellular localization annotation: CTP_CleavageSite=44; ConfidenceScore=5.62e-01
MASFLSSLPAVSARPIPTSAFPLRKPLFQTPPTLHFKNHRFAVSCSYAEAGVNADSSSNTIDVVADVRSERIVVLGGNGFVGSAICKAAVSRGIEVISLSRATYLFGCLGRPRDVFYVNWDEVLVGATAVVSTLGGFGSEEQMKRINGEANVVAVNAAKEYGEPSAHLIEHEFSDKLTCVQPLFIILKHFFTFQLVGLDEKLETKLLERGEKTGRLCSEESRPDGEKTNNSRQRKTQKDYKRGIPKFILISVHDYNLPSFLLSSGYFTGKRKAESEVLSKYPNSGIVLRPAFIYGKRRVNGYELPLDLVGEPAEKILRAIENFTKPLSSLPASDLLLAPPVSVDDVALAVINGVTDDDFFGVFTIDQIKDAANKVRV

SEQ ID NO: 180861 - protein, 531 aa, Glycine max
  Coding DNA Sequence Number=SeqID_64083
MDRLGPNEALPLITWKGKHARCSMGNMQGVPFTSKQASKDVVEWGLELHMSSWRDNSWELTDNVRDKHLLVDKRARCSLSCGMVDVEGGHVSLSVIGCPMLKETVPCRGSLSDVWGSSFDKQRPPSLDKYCLGCFCQVVRDGHVFGVSRKACAAHAQYFCIRVAHRVGPYWSLWAALQLLPVIEEFASLLNAELPSFTMYLMLSNSAIGMGGSDSRGSIEQSIMDREVISIGGSSLEDTHRSASDNESSSLERVWASGCTSEGASHPHGRVAIVEMLGHLPACDVAKALGHRHPPQRSLALSGVIAIQCQVKLANPENSYKLVIQACESYDFPFLRATPNRFFKVLATGVVANGSVDPYREGRQTYFGVVIILIGRTGCSVSSLRPLVNYVELAWETVTPSIAPVIGEGGQPAGVVGPIAVMVKRHNGARPSSRKKLKTPMSLRALRQAIGLTLGAGRLSAMQDVPLTPPVVEAPATTSPSPPRVVVVQEVTPVAVKVTVPATQANSIVTLSSTITAHLLSIDVAMMPPHC

SEQ ID NO: 180862 - protein, 127 aa, Glycine max
  Coding DNA Sequence Number=SeqID_64084
MDTSGYLPRKNGFMSKEHSKSWKLHKLSNVGVTENGYGQQLHPLVAEVFPEALTLTTDLYEALLKVIDKGETKQLEKDMLLIGGNANCSPLESKAKADNGQPELSCVYQPHIELEIMVSKTLADLVG

SEQ ID NO: 180863 - protein, 136 aa, Glycine max
  Coding DNA Sequence Number=SeqID_64085
  Gene Ontology: Mol. function=protein binding; Biological process =ubiquitin cycle
  Homolog annotation: Hit_ID=Q1S0J2; Match level="QueryCoverage=83%, HitCoverage=39%, E-value=1e-42, Identity=66%"; Hit description =Cyclin-like F-box; Galactose-binding like
AYLQQIWWLEVEGDVDFQFPPGSYNVFFRLQLGRSSKRLGRRVCKTDDVHGWDIKPVKFQLTTSDGQHAVSQSHLDNPGNWILYHAGNFVSKNPNDLMKIKISLTQIDCTHTKGGNLYSGNESEAPELTFVIWVTG

SEQ ID NO: 180864 - protein, 67 aa, Glycine max
  Coding DNA Sequence Number=SeqID_64086
MENCTKQSLRIAPSSWVEDARTKTQFMGLRKRVEDGESHYAITMHGSKFVGKGRMNKNAIHGAPKKG

SEQ ID NO: 180865 - protein, 171 aa, Glycine max
  Coding DNA Sequence Number=SeqID_64087
MASSVLKVINEENFEAPEEDEEVQALKLELGKARLAKEKFKSAATNIRKECTELREENAATARALEQETKRARNEEHGRDKYRGALWGSNNELKLRREERDQSRVHGMILKEELTACSRSKRSLAQHLEANHASYHRAIKGRVKPVVDPRTKTSRGLRTSVRREGSKREGD

SEQ ID NO: 180866 - protein, 156 aa, Glycine max
  Coding DNA Sequence Number=SeqID_64088
MVYWRSYLQMRCFQVNLSTSLAVISRSGLASIHLIVRRNAWHVCKLLASSAPPGKVKGVCPECWPALKLSLRVCSRVILLWPSGMIPTPASFYVGRIVNIKFPTMDVELRKFYRPGRYPSCQFKLSQNLLDEVVCLDYHLMTLEVGPELWGRGGEC

SEQ ID NO: 180867 - protein, 380 aa, Glycine max
  Coding DNA Sequence Number=SeqID_64089
MASPSLSSRPRVSLDHLYTSSDADSLWGATYNLEKKTPVGFVLAFDENHIRLVRASSLEVEVAKWRATARTLVANGTVAFVKAIRRYKDLQVEKKGLGEKVEKLAVKRDWLAKESELRAANEREANKELKEELLLYKKEAWSSLKKDFRRPSRRLELDLGLFDPFKDVKDGVLIDEEYIIVEDEAADEGQGVAEQGNDAYVYGFLLSCGAFPLMVVRSYVDLPLVEGLANQSRGVRTKGGPWVFVPRANLGFFLSVYQEKTLGFLCTCIPVQTKVRNREDCQGLPSMELGFDESVAQELSDLGFGHRAPANMPLTVSGTHWRRSDMLQHISHSPWVAYTGVIAVLVCSCIRASYKVTHTRDMVAYSCAHATHRGWHVLEA

SEQ ID NO: 180868 - protein, 567 aa, Glycine max
  Coding DNA Sequence Number=SeqID_64090
  Gene Ontology: Mol. function=RNA-directed DNA polymerase activity; Cellular component=intracellular; Biological process=RNA-dependent DNA replication
MTSAALANLRQADNESLRKHMDRFGCTVVQIQNLNPEVALHSVLLALRPDKFTDSLYKKPTGSMDDDKHEGNTKTDLHKSDKRHKLDKCQPFPKGPRTIQPIPKMSPACHQSLPPITFTDKDFKGINPINQDDPVVISIIIANFMVSKVLIDQGSSADILVETRGYMDLMTTFGQGKLSRSFTIRYLLVDVDTSYFALIGRKTLNELGAIVFMPHLKMKFPTPTGEIVTIKANRKQAQKCYAESLKVAVYPPIREHAIPHPPTPSNMPTIHPGIIYHKLAICPEAKPISQKKRKMGEERRKAVKEEVKKIFKAKIIREVRFSTWLANIVMVKKANGKWRMSTDYNNLNRVCPKDAYPLASIDRLVGATSRVMPFGLKNIGTTYQRLMDRVFKQQIRLNIEVYMDDMVVKSQSIPQHVADLEEVFRELRKYDMHLNPKKCTFGVGGGKFLNFMITHRGIEAKPDKCTVILEMRNPANIQEVQNLNSRLATLSRFLLKLLEKEKPFYKLLKITEPFLWDETCEQAFLAFKTIATPLILSQPRPKAPLLLYLSVADESVSSALTQEEGKH

SEQ ID NO: 180869 - protein, 63 aa, Glycine max
  Coding DNA Sequence Number=SeqID_64091
MGYILPQPHGRRQMFLPKFRTVIRQVDMVKWGPELCTSAWRECVMGCVEGLMESIFIVVERDY

SEQ ID NO: 180870 - protein, 98 aa, Glycine max
  Coding DNA Sequence Number=SeqID_64092
MLTISKSDFRHSSSTRKGTIKIVETYSVSGVETEVFGIWKKMPSCKKLEQFGAELEGDWVKEDKIAPDSQFHISPDLGIFQDGCSFWINRTSLFSVLQ

SEQ ID NO: 180871 - protein, 131 aa, Glycine max
  Coding DNA Sequence Number=SeqID_64093
  Homolog annotation: Hit_ID=Q1RTL8; Match level="QueryCoverage=51%, HitCoverage=9%, E-value=2e-25, Identity=76%"; Hit description=IMP dehydrogenase/GMP reductase
MSVCKKLCRLKLSKRIYFGKDWAVSQPKHPPPMARSATAFLPSAPMVYAVISDPGIVDNPDIPSYQPHVYGRCDPPALIPLQMNARNVHNAVNQPEWRSPGTDTGLEESMWHLILVLLFCCLSYLSRITNC

SEQ ID NO: 180872 - protein, 189 aa, Glycine max
  Coding DNA Sequence Number=SeqID_64094
  Gene Ontology: Mol. function=sequence-specific DNA binding; Cellular component=nucleus; Biological process=regulation of transcription, DNA-dependent
  Homolog annotation: Hit_ID=Q56NI7; Match level="QueryCoverage=99%, HitCoverage=73%, E-value=1e-42, Identity=55%"; Hit description=MADS box protein M2
  Pfam annotation: Domain name=K-box; Domain location=27-119; Score =87.8; E_value=3.3e-23; Accession=PF01486.8; Description=K-box region
MERILERYERYSYAERQLVASDQPQTVGKLDSRTCKAQSKVGSPTEKSKVSNQFENFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 180873 - protein, 160 aa, Glycine max
  Coding DNA Sequence Number=SeqID_64095
  Gene Ontology: Mol. function=palmitoyl-(protein) hydrolase activity; Biological process=protein modification process
  Homolog annotation: Hit_ID=Q336S3; Match level="QueryCoverage=65%, HitCoverage=35%, E-value=9e-37, Identity=62%"; Hit description =Palmitoyl protein thioesterase containing protein, expressed
MIHVDELTVGENMDVKFSFGEGSLFGFDSWEGVTQGIGDACKHSGIRNFIKELSKWSGSPGYCLEIGNGSWDSWTKPLLKQLKKMSDLGQGYSIVGLSQGNLIGRGIIEFCDGAPRDKNFISLGGPHAGTASIPLCGVCAGSTTALRKSLQFLYILFVFC

SEQ ID NO: 180874 - protein, 95 aa, Glycine max
  Coding DNA Sequence Number=SeqID_64096
MAPPKEISVIIHHHGQIAADPDQELSHHNNDQSDDEGVVVPTSPLLQYHQPRLERPVSPDPSSPPYRATQLVTKVLDTVLAPGSWVHELVGRVMP

SEQ ID NO: 180875 - protein, 432 aa, Glycine max
  Coding DNA Sequence Number=SeqID_64097
SIFPERKVEIYHTEFDDFKTELERSNLHKCLTYLANGTIDLALVKEFYANLYSSEGPSPKQARVKGHLVKIDADNLNAFLETPVVLREGETLPTHSRYYRLPIDYREIEAALCIPGRGFILNVEGHPGRILRKDFTTLAQVWSVLSYSNLAFTSHTSDLTVDRARLIFGLVSRMDMNIDAFISSQMTSITQSNSSRLGFPALITTLFRARGVVSDSLTFECLSLIINLAYIRKICWNPGDLTVAFQGARRVRARPADIPSSSAAPAPIPASTSAASSVPAHSLQVVAPSGSILSVEQFLERVAWPGTQTSLYREGKGPIAWVPQQVQDASSETTIPEPFTLHPKAGEEQAIPETAATPVRSLEGTLEPPTPVANLSSPQPTTDPSTPVLDIPEDQTTPVLALNTSPLATLVLHLTDEKDAQTQVTQDLSQDF

SEQ ID NO: 180876 - protein, 71 aa, Glycine max
  Coding DNA Sequence Number=SeqID_64098
MFVFNSALKGLDDTQQSKSKAAARQKESTECGYYVMHNISTIILGSFKNNWETYFNDVRPLKQERLKTLHI

SEQ ID NO: 180877 - protein, 63 aa, Glycine max
  Coding DNA Sequence Number=SeqID_64099
  Subcellular localization annotation: CTP_CleavageSite=18; ConfidenceScore=5.05e-01
MTFTNGNCASIFTTSGVAARKFQTENEGRQSLFCYSKGKKLAETSYFVSLPVSFTILSQSQKE

SEQ ID NO: 180878 - protein, 93 aa, Glycine max
  Coding DNA Sequence Number=SeqID_64100
MGAYSRDEKLLMYFFQDSLAGAVVIWYTNLEASHIRTWKDFITAFITQVALPMVEREMIMMIVDTLPIFYYEKLVGYMPASFADLVFAGERIE

SEQ ID NO: 180879 - protein, 199 aa, Glycine max
  Coding DNA Sequence Number=SeqID_64101
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=1e-19, Identity=30%"; Hit description= UPI00006A17C9 related cluster
  Subcellular localization annotation: CTP_CleavageSite=51; ConfidenceScore=5.51e-01
MPTCPRIQSTTRPPLQWSTRSHLPRTTHPRLQRTTRAHHQGTTHPRLQRARCPHLQRSTRPHLKRATRPHLQRTTRPLLQRANVLAFRGLHVLTFRLQVLAFRGLHTLAFIGVHAHAFRGLHVLTFRALHVLTFRGQHALTLKGLHALAFRALHTLTFIGLLVPAFEGLHVLTFRGLHVLTFRKLHVLTFTGVDALIFR

SEQ ID NO: 180880 - protein, 57 aa, Glycine max
  Coding DNA Sequence Number=SeqID_64102
MGGVKERCKIGLWAFVVSLSMKPHAQHHLALNACRALSVLPSCMLGTSYALLDLSFF

SEQ ID NO: 180881 - protein, 69 aa, Glycine max
  Coding DNA Sequence Number=SeqID_64103
MTMDELKRLSIPSEMLKFFNHSSFPHKGHPTRSLHPPHEHTQHAHLNAYPTSSTFHFNIILNINIISSQ

SEQ ID NO: 180882 - protein, 362 aa, Glycine max
  Coding DNA Sequence Number=SeqID_64104
MDPKTIPGSQGLFRRIALGVSMGSESGGASGNLAIWKTGVGEEDPEWWRSHPAIPRSARDERTSRVMVLERSDKRRLTGCKILGAKSPDKEFELIWASSRSGVGFGSGSGVGFGSGSGVGFGLGPSDMSVASFGSGCSILGPNGSAAHRWPLWNFSSHVKHSPCSWREANSSGVRCLTVGAYGGEGSKGGKGMIRGGTKGAGGGATNGGVAAAVEADEALSTVIGWWTWTVRRISDVKPEMKQGNRKGVGKPIILLAKSSNSFRHRSKAVEKLVHVEGHRVHGIVKTDKGFVEVAGGHEDKRENQLLRTEHKCRKLRTGFEAPEPPEEEEEQRWEKSEIVILVSLASSTDHSTSFLRITRNA

SEQ ID NO: 180883 - protein, 237 aa, Glycine max
  Coding DNA Sequence Number=SeqID_64105
MRAGLTRGGAARLSIPTADPLGPNIEQPDPKLATLISEGPNPKPTPDPDPKPTPDPDPNPTPDLELAQISSNSLSGDLAPRILHPVSLLSGNCVVLLVDGGSNHNFLQPQLAISLGLPCRTAPTPLHVMFFHHGRFVELQGENATTPGLLPQHQFCHLCRHNEGVSHFHIASLKNQHLEDKVFLMGQGVIGKRDSIADKGMYSKEIDANQDIATIGVSTAKKGVNQAEKKVQAAVNT

SEQ ID NO: 180884 - protein, 61 aa, Glycine max
  Coding DNA Sequence Number=SeqID_64106
  Gene Ontology: Mol. function=structural molecule activity; Cellular component=coated vesicle membrane; Biological process=intracellular protein transport
  Homolog annotation: Hit_ID=Q9MAZ9; Match level="QueryCoverage=66%, HitCoverage=22%, E-value=3e-14, Identity=90%"; Hit description =Nonclathrin coat protein zeta1-COP
MVFNHLIQTEWKRVAVKYYSDDWPTNNAKLAFEKFVFTKTVKTNARRRFLLNDYARGGRST

SEQ ID NO: 180885 - protein, 232 aa, Glycine max
  Coding DNA Sequence Number=SeqID_64107
  Homolog annotation: Hit_ID=Q1RXS1; Match level="QueryCoverage=27%, HitCoverage=16%, E-value=3e-08, Identity=43%"; Hit description=Zinc finger, CCHC-type; Peptidase aspartic, catalytic
  Pfam annotation: Domain name=zf-CCHC; Domain location=69-86; Score =20.9; E_value=0.00035; Accession=PF00098.13; Description=Zinc knuckle
MERKPQEANINLSYFHGKENVKAYLDWEIRKDQGQGILGVTPSKPKDDKGKTIEKQPPKTSMQEKTSSTKCFKCLGRGHITSQCPTKKTIIMRGQDIYSSHDAATTSPSSSESEKAKGEESSEEIYSQEEGQPLMVKEECKEGMMQSDPPRALDRRLQEDWARDARECPRLAIWAQRASIAKRSISVLSTTKESSRASISWPHTKREISALNARVVFCQAQRMTGAKLKSTY

SEQ ID NO: 180886 - protein, 77 aa, Glycine max
  Coding DNA Sequence Number=SeqID_64108
MGKGGSRGRLLEDSLGVLPELPKEVVPETFRKKCSSGRNQRSSRRTLLPEISRNTSSGKFPEEVVLSEEFRKKGSFG

SEQ ID NO: 180887 - protein, 119 aa, Glycine max
  Coding DNA Sequence Number=SeqID_64109
MASEFTSDSPPRISASLHQSDFAPYVSRSYNAQWNAPELPYDKHMSRWGCILWEMEGWCLASDVEQAGVVADLGVAFVDDWVVLANRVLGMVVTSWVPPSFLFSQFSPGLISPEFIEAA

SEQ ID NO: 180888 - protein, 140 aa, Glycine max
  Coding DNA Sequence Number=SeqID_64110
MVSRGIIPFDKHIAAVKTTSNNMLSKRKTLDEGSLLSSKSETQHDHRFTSTPYVPMDPKRKRNKGEPTKEEVMILHEIRRPNSLKTIPTGVANCRNLPFGGRATRGLTGVSSKKGKCAELPPTFIRGKRRKNWKGVVYEL

SEQ ID NO: 180889 - protein, 200 aa, Glycine max
  Coding DNA Sequence Number=SeqID_64111
MQGVFGMIWGCTGSSALAIGIGGVLGIEGRVVAIDLSPLVDVGITAYNDKMTQEMSQSGNFTEISANDSVGKVLGKDHTGHVCCLRLGGLHSVAFQSTTSFNGLGSSFSNFNSVESSRLKEENTCLRDKLTTSEENVKTLKNVMLAYIQMKEGYIPFELGAMFGHNTSNVVIFISYNEGSGQDGPTPRGDSSLDSNFHAT

SEQ ID NO: 180890 - protein, 173 aa, Glycine max
  Coding DNA Sequence Number=SeqID_64112
  Gene Ontology: Mol. function=nucleic acid binding; Biological process= DNA integration
  Homolog annotation: Hit_ID=Q1SDG1; Match level="QueryCoverage=62%, HitCoverage=11%, E-value=2e-13, Identity=32%"; Hit description =Integrase, catalytic region; Zinc finger, CCHC-type
MEEGYSTDKPPMFRENGNYIPYDDELNEIPRSLWMEEQKLIFLLNSKALNVMMCTLLEEKYTKVHSFRSAKKMLDTLVITYEGMSQIKKNKISLLTQLIETLKVHEQELQHDRGLKKNKSLALNVQKTKKASLSKETSSKSAFKGSSQALRVEICFNEESKDKSDEDEFAFIS

SEQ ID NO: 180891 - protein, 142 aa, Glycine max
  Coding DNA Sequence Number=SeqID_64113
  Gene Ontology: Mol. function=DNA binding; Biological process=DNA integration
  Homolog annotation: Hit_ID=Q1S785; Match level="QueryCoverage=99%, HitCoverage=25%, E-value=1e-28, Identity=37%"; Hit description =Integrase, catalytic region
MARTMLNGNSTHKHLWAKIGRKSNISYFHPFGCKCFILNTKDNLGKFNSKSDYGTFIGYSKTSKAFRVYNFITLVVEEAIHVKFNDTEPNKDLSEMDESFANLRLEDELPKDKKVVGANWVFHNKMDENGKVVRSKAWLVAK

SEQ ID NO: 180892 - protein, 123 aa, Glycine max
  Coding DNA Sequence Number=SeqID_64114
MDFSLGVVTEDMEEVSVHITNVRPYVERWCMIESLDDKPFECYLVLYPKELSTQLASNEVITSTCALPFKLISSIVGVATYPSVGGQGEIKRASSHEENEWSRHQCLFEKNVRKTKKAKVYGF

SEQ ID NO: 180893 - protein, 169 aa, Glycine max
  Coding DNA Sequence Number=SeqID_64115
MDTPGSLQLSEDATTLVGPWNTVECSSINKGINRGITKSSLEKLNEVKGAKKYLELHSFGPICKTQDESFSREDVDRYAFNTRLKNLLIIFHETTYDLTEMDGGDFRGHEIAYAKAHVDIDAKAMEDNIVNEVIINLTNICVMDENPEASKAAQAYMKLHSGKRMCLMQ

SEQ ID NO: 180894 - protein, 233 aa, Glycine max
  Coding DNA Sequence Number=SeqID_64116
MEITTIHTNNKATIMSNTSSTSWKKLCAPEQQSDSFQSSWSEGPMIHVARALYNENAEKVGDQKTIVYNIMCKRANIWANILNKSILHKARVYHLFDKMDDDSKHTITVKGFLEAINRRKQKRLAKAITNEDKGLNNFGITKKIQKENKKAITKGRRGQRVDRKRKHTKRRHELASLSNANHQLKDLRETDYDNDDNVQLALRKSKVTQRQASPASKTARVTKAAHTAKKPIG

SEQ ID NO: 180895 - protein, 421 aa, Glycine max
  Coding DNA Sequence Number=SeqID_64117
  Homolog annotation: Hit_ID=Q94JW8; Match level="QueryCoverage=35%, HitCoverage=32%, E-value=1e-34, Identity=55%"; Hit description =Squamosa promoter-binding-like protein 6
  Pfam annotation: Domain name=SBP; Domain location=87-175; Score =156.0; E_value=1e-43; Accession=PF03110.5; Description=SBP domain
ECIGVVQSRKVDDVVDCRITSPSPLSNSLGDSNGGNSLIDLKLGRFDDHGDAMVPTFSKGAPILSLLESSTPPKRVRALGAHSQTAYCQVYGCNKDLSGCKDYHKGHKVCEVHSKTYKVIVNGIEQRFCQQCSSTAVMFSILSRFHLLAEFDDGKRSCRKCLAGHNERRRKPQVGIHSGKAGRLLQLYPVESCLMRNTKRVTGDLSKPEDNTSFTFRPLSSIPITNGHPQSRSLFPSYSEKQVPLLHKNGATSATGNVFSENNNQYHPPSLGGQSSGSQSLFQDTSLGSEDFNVFNTESAVQGLSQSSGIPMARPMVIPSSHSHYSMNQVSEKMMGISSQASNKVFDRFPPEFNPVDGRHLRPILISDNNEIFNFEMADGIFQGSDFVNVKDHLSCEDGLTFDSFQLSSPLQRVSNRGSSC

SEQ ID NO: 180896 - protein, 128 aa, Glycine max
  Coding DNA Sequence Number=SeqID_64118
  Subcellular localization annotation: CTP_CleavageSite=46; ConfidenceScore=5.27e-01
PSVADHPLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFHHVKVTLYR

SEQ ID NO: 180897 - protein, 132 aa, Glycine max
  Coding DNA Sequence Number=SeqID_64119
  Gene Ontology: Mol. function=alpha-1,4-glucan-protein synthase (UDP -forming) activity; Cellular component=cellulose and pectin -containing cell wall; Biological process=cellulose biosynthetic process
  Homolog annotation: Hit_ID=Q0PW29; Match level="QueryCoverage=86%, HitCoverage=32%, E-value=2e-55, Identity=86%"; Hit description=GRP -like protein 2
  Pfam annotation: Domain name=RGP; Domain location=1-121; Score=-93.0; E_value=1.9e-05; Accession=PF03214.4; Description=Reversibly glycosylated polypeptide
MGVEGLVEIDVKKSALITHVISDHLGLGVKTGLPYIWHSKASNPFVNLKKEYKGIYWQEELIPFFQSVSLPKECTTAQKCYIELSKQVKAKLGKVDEYFNKLADAMVTWIEAWDELNPSGPKSEALPNGSAK

SEQ ID NO: 180898 - protein, 86 aa, Glycine max
  Coding DNA Sequence Number=SeqID_64120
MVQPTNPRSSQRFSTKIASPMKDKGEDFESYRNIKARTLSPVKDKGEDFESYGNIKVKTLSPMKDKGEDFKSYENMKARTLSLMET

SEQ ID NO: 180899 - protein, 182 aa, Glycine max
  Coding DNA Sequence Number=SeqID_64121
  Gene Ontology: Mol. function=helicase activity
  Homolog annotation: Hit_ID=Q9LW42; Match level="QueryCoverage=85%, HitCoverage=9%, E-value=4e-43, Identity=46%"; Hit description =Helicase-like protein
MLSDLTKNHLLGKVVALEIPSQEDDPELYKLVQNHMVHGPCGILRPASPRMKEGKCSRFYPKKFQLTTLIDGDGYPVDRRRNTGQTITKNEIIIDNRCIVPYNPKLLKKYQAHINIEWCNQNTSIKYLFKYINKGYDKVTAVMVHDDTRTVPHANTLNDEIKEYLDCMYEPSLICKSSYNCI

SEQ ID NO: 180900 - protein, 124 aa, Glycine max
  Coding DNA Sequence Number=SeqID_64122
  Subcellular localization annotation: CTP_CleavageSite=52; ConfidenceScore=5.61e-01
MPNILQHLTTSPALPMTSSKVIQSYGATWRMNIRSTSQSTPSRVVLYIQMIVARMIRYMSVTDSWSYLTCRSDGSRCSRFRIRIHAVVKLSSITDQIKIVGRAGPTGIWWLIVQVWLGPPVSIV

SEQ ID NO: 180901 - protein, 59 aa, Glycine max
  Coding DNA Sequence Number=SeqID_64123
  Homolog annotation: Hit_ID=Q8L6Z9; Match level="QueryCoverage=73%, HitCoverage=8%, E-value=3e-11, Identity=77%"; Hit description=CTP synthase-like protein
MRPENPCSLCIQVVSHITAAIKDWIEGVVIPVDGKEGPADVCVIELGGTVEIVEHKSLV

SEQ ID NO: 180902 - protein, 326 aa, Glycine max
  Coding DNA Sequence Number=SeqID_64124
  Pfam annotation: Domain name=Phage_DNA_bind; Domain location=201-283; Score=-0.7; E_value=0.0036; Accession=PF02303.8; Description=Helix -destabilising protein
MKNGRLFFVSDVASGLECKCVCPECGQALVARNRDFPGRRRVRHFQHARASSCPGGYETAVHRMAKDVLGTADAVVLPRWASGDVVIEPEPMLIVNASLEVPLLDGATRPDVLVQGMASEIEFNLLCFEVRVRHAVDEPKRGLLATNGIDAVEIDLSNLDEEVVVDPAAFRREVLENSRNRRWIHLSNASYVSHRADKALIEIEDLTIAERTLITKAGRPFTIREQGAFLVKPGSRDPVRIQIPDETVGEHVQPYPRGMHTVSTRSLMIDEWGRLRLRYKMYLDQIQMNPSKLELPQGALFEASEDEVAGPGFRVRMRDWKGSPGH

SEQ ID NO: 180903 - protein, 93 aa, Glycine max
  Coding DNA Sequence Number=SeqID_64125
  Gene Ontology: Mol. function=transferase activity, transferring phosphorus-containing groups; Cellular component=membrane; Biological process=peptidyl-histidine phosphorylation
  Homolog annotation: Hit_ID=Q3BZ91; Match level="QueryCoverage=56%, HitCoverage=15%, E-value=1e-15, Identity=73%"; Hit description=Two -component system sensor protein
MGQCLALYFQCGQRPTQQAPDADAQPAGESRIAAGNAAIGPGPGQRRAEGIKGRRGCGVGHCTNLVQNVGSDPCRRSSRWTDWQSPCCLYRLW

SEQ ID NO: 180904 - protein, 209 aa, Glycine max
  Coding DNA Sequence Number=SeqID_64126
  Pfam annotation: Domain name=zf-CCHC; Domain location=178-195; Score =7.3; E_value=0.063; Accession=PF00098.13; Description=Zinc knuckle
MTSRNLDEALIRLDNTMHSMTLNMDKLLNRLALVPSSTTPNPTPVPHHSTFVPVQIRYAPSPYEDPVGVLFKLTQTELSACRPPFLLPCFISGFDAGDPLRSPGPSAYDCGPGRRPREDPGAEVVRPSSSSTAVATPPPAPLVPPRITPLPPLLPSPPQAPTIKRLTPEELASRHEHGLCFTCDEKFHRGHQCASRVHLLIAEDEEPAD

SEQ ID NO: 180905 - protein, 158 aa, Glycine max
  Coding DNA Sequence Number=SeqID_64127
  Homolog annotation: Hit_ID=Q10LQ3; Match level="QueryCoverage=76%, HitCoverage=21%, E-value=3e-07, Identity=31%"; Hit description =Expressed protein
  Pfam annotation: Domain name=DUF827; Domain location=3-128; Score= -84.1; E_value=0.00034; Accession=PF05701.2; Description=Plant protein of unknown function (DUF827)
MLGGLQEFMLLEPHHAEELDPEKLEEQAALDSTKRLVENLKSKVQKEESEANLNFQTSVCENISSVKEDEREDKKNRVREAEEQSKKRVVDAMHLVDEANVSKMDILRKVEEATEEVKTSKKALEEALERVEAANQGKLAVEEEANTELEVNNGLLLC

SEQ ID NO: 180906 - protein, 150 aa, Glycine max
  Coding DNA Sequence Number=SeqID_64128
  Homolog annotation: Hit_ID=Q1T1F7; Match level="QueryCoverage=56%, HitCoverage=17%, E-value=3e-12, Identity=44%"; Hit description=IMP dehydrogenase/GMP reductase
  Pfam annotation: Domain name=DUF1723; Domain location=64-113; Score =54.9; E_value=2.7e-13; Accession=PF08330.1; Description=Protein of unknown function (DUF1723)
MSPWQMLSHRTPVQRLTHRILERPELKLSSHGRKVHNLGKPVPAIEDMIVGIGLSPLISCSIDTDDQGLISSFIERWHRETSSFHLPVGEITITLDDVASLLHLSIVGALHDFQPLRSDEAVLLLVELLMVSPEVAMAETGQCGRPHVRL

SEQ ID NO: 180907 - protein, 66 aa, Glycine max
  Coding DNA Sequence Number=SeqID_64129
MTGTRRLCADAVGLQRWGAPMWFSVGTFTQHFDGGKAQTQLIRMKLADQLDPQEACGSTFSSCGST

SEQ ID NO: 180908 - protein, 136 aa, Glycine max
  Coding DNA Sequence Number=SeqID_64130
MEATMEAITNKKRGNRPYLDEEQKSNTSRKNGRRRRTRREKKNNHLALGKQTGSRKKEEGGRKVHRRKKEGEEARGTKKEKKKGSQNRIRKVVEKGRRKGRWLSHSAHSYTDSQPTWYPLTSSVHSATGNAAIVAL

SEQ ID NO: 180909 - protein, 118 aa, Glycine max
  Coding DNA Sequence Number=SeqID_64131
  Homolog annotation: Hit_ID=Q58T35; Match level="QueryCoverage=28%, HitCoverage=24%, E-value=9e-09, Identity=79%"; Hit description =Serine/threonine kinase
MVGFSNPLLNQELSMILAIDILVFGFGSKIFDSNLRTSGAQWLRFLRTSVARAKNRYGQWTKHPMSSRLNKDCSDGGTNSLASVKEFLTVKRIFQHSLILVMTLENNEEYGLLGKFEE

SEQ ID NO: 180910 - protein, 145 aa, Glycine max
  Coding DNA Sequence Number=SeqID_64132
GKTSAPVSLNGGLVQAVKITTLNARLPENLPVVTGHRDRYDLVFNAQGKAPYVLAWGNGAAKPASVEPDMLIPADLRKTYDLANLPQADIQDNVALGGEGRLTATSAAERESRMNTLLVWGVLIAGVVLLAGMAWRIWRETQRKA

SEQ ID NO: 180911 - protein, 665 aa, Glycine max
  Coding DNA Sequence Number=SeqID_64133
  Gene Ontology: Mol. function=ubiquitin-protein ligase activity; Cellular component=intracellular; Biological process=protein modification process
  Homolog annotation: Hit_ID=Q9LUV3; Match level="QueryCoverage=99%, HitCoverage=66%, E-value=0.0, Identity=73%"; Hit description =Arabidopsis thaliana genomic DNA, chromosome 3, P1 clone: MGD8
  Pfam annotation: Domain name=HECT; Domain location=343-665; Score =416.3; E_value=4.4e-122; Accession=PF00632.15; Description=HECT -domain (ubiquitin-transferase)
MTGEDEVMEVALDRKLNQQICNAIDTRFLLQLTNILFGDFSSANSSDHEPDDKEVAAVGAVCGFLYVIFNTLPLEKIMTVLAYRTELVPILWNFMKRCHENEKWSSLSERLSYLSGDAPGWLLPLAVFCPVYKHMLMIVDNEEYYEQEKPLSLKDIRSLIILLRQALWQLMWVNHTTSANSVKSVPVSPAIKKQSEAIQQRVSIVVSELLSQLQDWNNRRQFTSPTDFHADGVNDFFISQAVMENTQANEILKQAAFLIPFTSRVKILTSQLAAARQRHGSQAVYTRNRFRIRRNHILEDAYNQMSQLSEDDLRGLIRVAFVNELGVEEAGIDGGGIFKDFMENITRAAFDVQYGLFKETADYLLYPNPGSGMIHEQHLQFFHFLGTLLAKAMFEGILVDLPFATFFLSKLKQKHNYLNDLPSLDPELYRHLIFLKHYERDISELELYFVIVNNEYGEQTEEELLPGGKNLRVTNENVITFIHLVANHRLNFQIRQQSSHFLRGFQQLIQKDWIDMFNEHELQLLISGSLDSLDVDDLRQHTNYAGGYHSDHHVIEMFWEVLKGFSLENKKKFLKFVTGCSRGPLLGFQYLEPLFCIQRQKDHRMELSDVSSCRAGSNDPDEALDRLPTSATCMNLLKLPPYKSKEQLETKLLYAINADAGFDLS

SEQ ID NO: 180912 - protein, 122 aa, Glycine max
  Coding DNA Sequence Number=SeqID_64134
MDGSLVEFNDWIDEMEVEEMPWVKEFHMESENEICFKIKGRHRQGSLDGAPRDSIESIWWRDLKMVSQHPQQGQQLNRSTLWKVGCGNKFKFWEDKWTCRDNQLSEKYPRLYIISSQQHHLI

SEQ ID NO: 180913 - protein, 961 aa, Glycine max
  Coding DNA Sequence Number=SeqID_64135
  Gene Ontology: Mol. function=nucleic acid binding; Cellular component= nucleus; Biological process=translation
  Homolog annotation: Hit_ID=Q2QNI2; Match level="QueryCoverage=96%, HitCoverage=82%, E-value=0.0, Identity=61%"; Hit description=Zinc knuckle family protein, putative, expressed
  Pfam annotation: Domain name=DUF814; Domain location=545-646; Score =176.2; E_value=8.1e-50; Accession=PF05670.3; Description=Domain of unknown function (DUF814)
  Pfam annotation: Domain name=FbpA; Domain location=10-542; Score= -139.8; E_value=2.4e-05; Accession=PF05833.2; Description=Fibronectin- binding protein A N-terminus (FbpA)
  Pfam module annotation: Pfam domain module=DUF814::FbpA; Domain location=545-646::10-542
MVKVRMNTADVAAEVKCLRRLIGMRCSNVYDLSPKTYVFKLMNSSGVSESGESEKVLLLMESGVRLHTTLYMRDKSNTPSGFTLKLRKHIRTRRLEDVRQLGYDRIILFQFGLGENANYVILELYAQGNILLTDSTFTVMTLLRSHRDDDKGLAIMSRHRYPVESCRVFERTTIEKLRTSLVSSKEDDADEAVKANGNGSNASNVAKEKQETRKGGKSSATLKIVLGEALGYGPALSEHIILDAGLIPSTKVPKDRTWDDATVQALVQAVVKFEDWMQDVISGEIVPEGYILMQNKNLGKDSSISQPGSVSQMYDEFCPILLNQFKSRDYTKFETFDAALDEFYSKIESQRAEQQQKSKENSAAQKLNKIRQDQENRVHVLRKEADHCVKMAELIEYNLEDVDAAILAVRVALAKGMNWDDLARMVKEEKKAGNPVAGLIDKLHLERNCMNLLLSNNLDEMDDDEKTLPVDKVEVDLALSAHANARRWYEQKKKQESKQEKTVTAHEKAFKAAERKTRLQLNQVEKTVASISHMRKVHWFEKFNWFISSENYLVISGRDAQQNELIVKRYMSKGDLYVHADLHGASSTVIKNHKPAQPVPPLTLNQAGCFTVCHSQAWDSKIVTSAWWVYPHQVSKTAPTGEYLTVGSFMIRGKKNFLPPHPLIMGFGLLFRLDESSLGSHLNERRVRGEEEAADDYEETGPLEGKSDSEFEKDVTDIKSATDSERNDNLSADSHKPLPEDFPADASQTSLATINAETAISQDFPAKETSTLNVVDREILSDVSGNGLASVTPQLEELLDQVLELGPIAKSNKKYGIEKSQIDLDTEQYLEQSKTAVRDKPYISKAERRKLKKEQKHGEEDLNVEHGKYESKLKDISANLQAKEDQNLKKGGGQKISRGQKGKLKKIKEKYADQDEEERSIRMALLAVSSVAYMSLHFYPQTTEIIDVFALCTIDAIYFLN

SEQ ID NO: 180914 - protein, 58 aa, Glycine max
  Coding DNA Sequence Number=SeqID_64136
MIVVVVGLIVNRVVETVSKATMEATNGGGTTQNKEDKGRRQSAVAYGHMKQEGFLIFK

SEQ ID NO: 180915 - protein, 419 aa, Glycine max
  Coding DNA Sequence Number=SeqID_64137
  Gene Ontology: Mol. function=structural constituent of ribosome; Cellular component=ribonucleoprotein complex; Biological process =translation
  Homolog annotation: Hit_ID=P29344; Match level="QueryCoverage=96%, HitCoverage=93%, E-value=1e-171, Identity=76%"; Hit description=30S ribosomal protein S1, chloroplast precursor
  Pfam annotation: Domain name=S1; Domain location=107-174; Score=37.1; E_value=6.2e-08; Accession=PF00575.13; Description=S1 RNA binding domain
  Pfam annotation: Domain name=S1; Domain location=188-256; Score=66.2; E_value=1.1e-16; Accession=PF00575.13; Description=S1 RNA binding domain
  Pfam annotation: Domain name=S1; Domain location=265-337; Score =102.9; E_value=9.3e-28; Accession=PF00575.13; Description=S1 RNA binding domain
  Pfam module annotation: Pfam domain module=S1::S1::S1; Domain location=107-174::188-256::265-337
MAMTASQLRWGWRPTPKQQQRRRMVPVVCSIAIKNAQNKERAKLKKLFEEAYERCRTAPTEGVSFTIQQFTDALDKYDFDAEMGTKAPLCFGVLEWIGDGCWLCFQVKGTVFATDNSGAYVDITAKSTAYLPLHEACIHRIKNVEEAGIIPGMREEFMIIDENQADDTLILSLRSIQYDIAWERCRQLKAEDAVVKGKVINANKGGLVAQVEGLKGFVPFSQISSKSAGEELLEQVIPFKFVEVDEEQSRLVLSHRKAVAESQGQLGIGSVVTGSVQSIKPYGAFIDIGGISGLLHVSQISHDRITDIETVLQPGDVLKVMILSHDRERGRVSLSTKKLEPTPGDMIRNPKLVFEKAEEMAQTFRQRIAQAEAMARADMLRFQPESGLTLSGEGILGPLASDLPPEGVDLSEVPPAEDS

SEQ ID NO: 180916 - protein, 93 aa, Glycine max
  Coding DNA Sequence Number=SeqID_64138
  Gene Ontology: Mol. function=nucleoside-triphosphatase activity
  Homolog annotation: Hit_ID=Q1S4Z7; Match level="QueryCoverage=76%, HitCoverage=13%, E-value=6e-13, Identity=60%"; Hit description=AAA ATPase
MALVFQHMFEVRLGYEASIALLKGLDGIVSLTFHEAFTGEFVERDSDVRVHKAGEFVGVPSNTGLKRRGGNKRMNMSYMNMVEAMSDPACVHI

SEQ ID NO: 180917 - protein, 55 aa, Glycine max
  Coding DNA Sequence Number=SeqID_64139
MSSTNVKGETSNVISVDEKYKKSSFRNVILIKINGGENATSLLLTAIRAQVKTQD

SEQ ID NO: 180918 - protein, 833 aa, Glycine max
  Coding DNA Sequence Number=SeqID_64140
  Homolog annotation: Hit_ID=Q9LUT8; Match level="QueryCoverage=66%, HitCoverage=38%, E-value=1e-122, Identity=45%"; Hit description =Arabidopsis thaliana genomic DNA, chromosome 3, P1 clone: MGD8
  Pfam annotation: Domain name=YTH; Domain location=555-645; Score =202.9; E_value=7.7e-58; Accession=PF04146.6; Description=YT521-B -like family
  Subcellular localization annotation: CTP_CleavageSite=23; ConfidenceScore=5.18e-01
MLFSHAIFVPTTTAPTIISNSIVGGETQGPHWTVTTVRVTLSECVRIKQPKRRRWHLRSGVLVVSEAAEGRLGKFGKRKAMRNSETLRISSLLLLLLHLVSGSSVFCYAHTKTALSQPKSFAVSVRALGFREMSYESATSSSSLICGLIQSSWHVSVCGSFVLLGFTVSILSGGSSGMEVYDVSETRNHDADMIEGADLNSHFTSPNIERTEVMINEGAPEFFVDQNLYYPAATNYGYYCSGFGTPGEQEDQHRIFGVDGPNIQFTGAQNESFPYVYYSYGYAQSPYNPYNPYIPGAMIGADGSFGGGQHYYTLPNYQSPVSAPGYIPLVQPDNFSDSSADSFFGASASVSKPDGRGLKPKFNSASGNFSRNSSIFLSNQTSSLARASERPRANDGRKQGLTHASVSGSSFLNLASPAVHQSAVAKLRPKLHIGKAVPNGGNGSSDVLGEQNRGPRVGRSKHQLSVKAYTTMAGDGNEQGNIVIYPDQYNMEDFPLGYENAKFFVIKSYSEDDVHKSIKYNVWSSTPHGNKKLENAYEDAKKIAAEKSEVCPIFLLFSVNASGQFCGVAEMVGTVDFSKNMDFWQQDKWSGSFPVKWHIIKDVPNPNFRHIILENNENKPVTNSRDAQEIMYLKGLEMLKIFKNHTLKTSLLDDFMYYENRQKIMQDEKAKFLVKSFDSPIFVPVLEAPQKLNFFVDVPTDNYEKNLKPKDDSDGLKHISFSSPEQIVGNSDVTGIKHAHDEKDEKIAVDKEHISSILKIGSVTIAPKQVEAKQSVSNGNKEPVDVLTVGSMQVKVNGFPSSSGFLKVGSTPFDARALQPGKGDAAVKSGSQR

SEQ ID NO: 180919 - protein, 479 aa, Glycine max
  Coding DNA Sequence Number=SeqID_64141
  Gene Ontology: Mol. function=hydrolase activity, acting on glycosyl bonds; Cellular component=amyloplast; Biological process =carbohydrate metabolic process
  Homolog annotation: Hit_ID=Q1RUL3; Match level="QueryCoverage=80%, HitCoverage=81%, E-value=1e-158, Identity=63%"; Hit description =Ribosome-binding factor A; Glycoside hydrolase, family 28
  Pfam annotation: Domain name=Glyco_hydro_28; Domain location=110-455; Score=334.5; E_value=1.8e-97; Accession=PF00295.8; Description =Glycosyl hydrolases family 28
MSLIHWSLILWITMMLFIHNLDNVEGRYHYHKGQKKNSPAPNPPAESPTPPEDPPSPPSNSPSVPSDPYPNDPPGDSPSGCIFDVRSFGAVGDGSADDTDAFVAAWKEACAVESGVVLVPEDYCFKITSTIFTGPCKPGLVFQVDGTLMAPDGPECWPKEDSHSQWLVFYRLDQMTLTGKGTIEGNGEQWWDLPCKPHRGPDGKTVSGPCDSPTMIRFFMSSNLVLSGVKIQNSPMFHVKFDGCQGVLIDKLSISSPKLSPNTDGIHLGNTRGVGIYNSMISNGDDCISIGPGCSDVDIEGVTCAPTHGISIGSLGVHNSQACVSNLTVRNTIIKESDNGLRIKTWQGGTGSVTGLRFENIQMENVRNCIIIDQYYCMSKECLNQTSAVHVNDVTYRNIKGTYDVRTPPIHFACSDTVACTNITLSEIELLPYEGELLDDPFCWNAYGTQETMTIPPLDCLREGEPDTVVELSAYDCRS

SEQ ID NO: 180920 - protein, 111 aa, Glycine max
  Coding DNA Sequence Number=SeqID_64142
SRSPSYDRRNRSDQQLPDQKDLRAQEVGTSDPRMLPVSSGSGSQGNSFLGTEQVEQQPVVSSTDADWLYMAITLWQEVHSGGSGVVNFDHFVNCDGSSSLFAKGTCKCLVG

SEQ ID NO: 180921 - protein, 176 aa, Glycine max
  Coding DNA Sequence Number=SeqID_64143
  Homolog annotation: Hit_ID=Q9LUU1; Match level="QueryCoverage=46%, HitCoverage=92%, E-value=1e-29, Identity=64%"; Hit description =Arabidopsis thaliana genomic DNA, chromosome 3, P1 clone: MGD8
  Pfam annotation: Domain name=Complex1_LYR; Domain location=84-150; Score=16.4; E_value=0.016; Accession=PF05347.5; Description=Complex 1 protein (LYR family)
MWVVSVATPILYRKNAESFRTDRKRRRVSLLLCFARSRRDTAVDSELVDPHNQCQASAHHPNLFTKLYPVVLNMPSLQTALPPELANNAIRLYRECLRRAKYIGHRKHNTELLVDMVRQQFKKHMHETDPEKIQKLKDGAARGLINHILYESEQMTVSLSIQDLAAYESRTLPPLG

SEQ ID NO: 180922 - protein, 132 aa, Glycine max
  Coding DNA Sequence Number=SeqID_64144
  Gene Ontology: Mol. function=inorganic anion exchanger activity; Cellular component=integral to membrane; Biological process=anion transport
  Homolog annotation: Hit_ID=Q7X9F3; Match level="QueryCoverage=98%, HitCoverage=31%, E-value=2e-31, Identity=52%"; Hit description=Boron transporter
MEETFVPFCEIKNDLQGRLMCYKQDWIGGLTAGFRVCMWTAILLFLLAILGACSIINRFTRLAGELFGLLIAMLFMQEAIRGLIHEFHIPERANLTSPEFQSSWRFGNGMFSLVLYFGLLHTALRSRKARSR

SEQ ID NO: 180923 - protein, 358 aa, Glycine max
  Coding DNA Sequence Number=SeqID_64145
  Gene Ontology: Mol. function=inorganic anion exchanger activity; Cellular component=integral to membrane; Biological process=anion transport
  Homolog annotation: Hit_ID=Q7X9F3; Match level="QueryCoverage=99%, HitCoverage=59%, E-value=1e-116, Identity=56%"; Hit description =Boron transporter
MLNVPVLYIIGAFIPATMIAVLYYFDHSVASQLAQQKEFNLRKPPSFHYDLLLLGFMVIICGLIGIPPSNGVIPQSPVHTKSLATLKHQLLRNRLVATARSSMKKLESLGQVYGSMQDSYWQMQTPLVHQEPSAKGLKELKESTIHLASSMGSINAPVDESVFDIVKEIDDLLPVEVKEERECHATYVETVPFKTIAVFTAFQTAYLLVCFGITWVPIAGVLFPLMIMLLVPVRQYILPKFFKGAHLQDLDAAEYEVPALPFNLVAERDLSRTASFADYGEVLDGIVTRSWGEVKRVCSPKVMKSTPNISQELTSARFPDKIYSPRMSHLRGNQSPRGVGRGPFSPAEVRPSNLRKGG

SEQ ID NO: 180924 - protein, 153 aa, Glycine max
  Coding DNA Sequence Number=SeqID_64146
  Subcellular localization annotation: CTP_CleavageSite=57; ConfidenceScore=5.19e-01
MWVKTGESKVVSHSKRASIVMRKGKGNRNMPGKGKAKKTANCPNKAGFTNKLPGWVCSKSISRMKATRQQQWRVLHGWSTWQWTRQHQWRFRASWSRVGQARVSLAEQQRSRAAEQHSSSGSSGFSEQIATVKSFPPPCASSYLCVVPLVRNM

SEQ ID NO: 180925 - protein, 51 aa, Glycine max
  Coding DNA Sequence Number=SeqID_64147
MVLAESRFGLMAPMLALSHRHPSPLSSWSGLLDTCQRVWMTPLSERKDKSG

SEQ ID NO: 180926 - protein, 599 aa, Glycine max
  Coding DNA Sequence Number=SeqID_64148
  Gene Ontology: Mol. function=ATP-dependent helicase activity; Cellular component=nucleus; Biological process=mRNA catabolic process, nonsense-mediated decay
  Homolog annotation: Hit_ID=Q9SQV1; Match level="QueryCoverage=67%, HitCoverage=35%, E-value=1e-179, Identity=79%"; Hit description =Probable DEAD-box ATP-dependent RNA helicase 40
  Pfam annotation: Domain name=DEAD; Domain location=44-214; Score =243.3; E_value=5.3e-70; Accession=PF00270.19; Description=DEADDEAH box helicase
  Pfam annotation: Domain name=Helicase_C; Domain location=283-359; Score=127.3; E_value=4.4e-35; Accession=PF00271.21; Description =Helicase conserved C-terminal domain
  Pfam annotation: Domain name=ResIII; Domain location=40-209; Score= -20.2; E_value=0.0023; Accession=PF04851.6; Description=Type III restriction enzyme, res subunit
  Pfam module annotation: Pfam domain module=DEAD::Helicase_C::ResIII; Domain location=44-214::283-359::40-209
MTFDATGFPPEILREALDLCTIHWSDCCHILSFQIYSAGFSSPTPIQAQTWPVALQGRDIVAIAKTGSGKTLGYLMPAFILLRQRCNNSLNGPTVLVLAPTRELATQIQDEVVKFGRSSRVSCTCLYGGAPKALQLKELDRGADIVVATPGRLNDILEMKKIDFGQVSLLVLDEADRMLDMGFEPQIRKIVNEIPPRRQTLMYTATWPKEVRKIASDLLVNPVQVNIGSVDELAANKAITQYVEVVPQMEKQRRLEQILRSQERGSKVIIFCSTKRLCDQLARSIGRTFGAAAIHGDKSQGERDWVLSQFRTGKSPILVATDVAARGLDIKDIRVVINYDFPTGIEDYVHRIGRTGRAGATGVSYTFFSEQDWKHAGDLIKVLEGANQHVLPELRQMALRGPSNFGKDRGGVSRFDSGGGGGRWDTGGRGGMRDGGFGGRGGGMRDGGFGGRGGGFGGRGGGMRDGSFGGRGGGFGGRGGIRDGGSGQGGRGDFFPGRGNRGRGSGGPRGGHVGWGRGERGMDDRYNMDGRGQEAEVIVVALKESEHGIIAEVAAEVVAEVEAGVGAGAVVEAAAGLVVVVVAIAVVLVHVVTAVVAVV

SEQ ID NO: 180927 - protein, 1049 aa, Glycine max
  Coding DNA Sequence Number=SeqID_64149
  Gene Ontology: Mol. function=DNA binding; Cellular component=oxygen evolving complex; Biological process=DNA integration
  Homolog annotation: Hit_ID=Q1SS72; Match level="QueryCoverage=87%, HitCoverage=65%, E-value=0.0, Identity=48%"; Hit description =Integrase, catalytic region
  Pfam annotation: Domain name=rve; Domain location=224-384; Score =148.8; E_value=1.5e-41; Accession=PF00665.16; Description=Integrase core domain
  Pfam annotation: Domain name=zf-CCHC; Domain location=36-53; Score =12.8; E_value=0.0075; Accession=PF00098.13; Description=Zinc knuckle
  Pfam annotation: Domain name=zf-CCHC; Domain location=73-90; Score =14.2; E_value=0.0046; Accession=PF00098.13; Description=Zinc knuckle
  Pfam module annotation: Pfam domain module=RVT_2::rve::zf-CCHC::zf -CCHC; Domain location=578-804::224-384::36-53::73-90
MFSSYHHRATQIRRPSNAIPASLESKENVSINAVKVTCEFCGRVGHTESVCYKKHGVPTSYEGRSKTYSRSVKTCTHCGKIGHTIDVCYKKHGYPPGYKFGNSKVVNNIMEGKAVNDQMQRQESHDLDINTKAKIGTVEVSHGLYQLTLKPSHSRTICSTITHPKCNVIPIDLWHFHMGHPSIERLQVMKAYYPSLHNNNKNFVCNTCHYAKHKRSPFPSSISHAFSIFDLIHIDIWGPCSKISMHGHRYFLTIVDDHSRFTWVYLMKTKVETRELIINFVTYVQTQFNKTIKTIRSDNGVEFLMNDFYAQRGIIHQTTCIETPEQNGIVERKHQHLLHVTRSLLFQANLPLNFWCFALLHATYLINCIPTPLLHNKSPYEQLYTHPCDILNLRVFGCLCYISILQSHRQKLDHRAHPCIFIGFKPNTKGYLVYDLHSHSINTSRNVVFYEDHFPILPDTSESSSSSTSISPLPFSNNTDNFEHPTPPSAHLSSPHTSFTPKRRSTRLKKAPTYLQDYHHALTSQDDTNTHGVRYPLHSVLSYSRLSPSHKHFVMSISVNTEHKTYNEASKFDCWIKAMQAELQALQQNQTWTLTPLPPHKTTIGCRWVYKIKYKADGTVERYKARLVAKGYTQLKGLDFLDTFSPVAKLTTVRLLLALASLHNWHLRQLDVNNAFLHGDLDEEVYMTLPPGLHVQDRNLVPPSTFTIWSETSQPSVVHTTFFISHFPRLPSIRNNLDTIKHITNLLDTAFSIKDLGTLKFFLGLEVARNDKGIHLSQRKYVLDILSDSGMLASRPASTPMDYSTRLTASLGTPLSEASSSSYRRLIGRLIYLTNTRPDITYVVQQLSQYMAHPTSAHSQAAFRVLRYLKSSPGFGIFLAANGPLQLKAFSDSDWAGCRDTRRSITGFSIYLGSSLISWRSKKQPTVLKSSSEAEYRALASTTCELQWLTYLLRDFKVPFIEPATLYCDNKSAIQIACNPVFHERTKHIEIDCNIVREKVNQGCIKLLPISSQLQIADVFTKPLPTSLFQGLCSKLGMLNIHSQLEGGS

SEQ ID NO: 180928 - protein, 851 aa, Glycine max
  Coding DNA Sequence Number=SeqID_64150
  Gene Ontology: Mol. function=GPI anchor binding; Cellular component =integral to membrane; Biological process=root hair cell differentiation
  Homolog annotation: Hit_ID=Q9LFW3; Match level="QueryCoverage=48%, HitCoverage=95%, E-value=0.0, Identity=70%"; Hit description=COBRA -like protein 4 precursor
  Pfam annotation: Domain name=Phytochel_synth; Domain location=59-223; Score=306.6; E_value=4.6e-89; Accession=PF04833.5; Description =Phytochelatin synthetase-like conserv
  Pfam annotation: Domain name=RRM_1; Domain location=455-525; Score =38.5; E_value=2.3e-08; Accession=PF00076.12; Description=RNA recognition motif. (a.k.a. RRM, R
  Pfam module annotation: Pfam domain module=Phytochel_synth::RRM_1; Domain location=59-223::455-525
MEFESGTQKQKGTFACLKMVALIALCLILISPAESFDPLDPTGNVTIRWDIMSWTSDGYLATVTLFNFQLYRNIMNPGWTLGWTWAKKEIIWAVMGAQATEQGDCAKFKLKIPHSCKRNPQVVDLLPGAPFNMQFTNCCRGGVLTSWGQNPSGAVSAFQIGVGLSGTSNKTVKLPKNFKLLGPGPGYSCGPAKIVPSTAILTDDRRRKMQALMSWNVTCTYSQFLASKNPSCCVSLSSFYSDKVTGCPPCACGCQNNNTCVTKDSKILQENATSPHRKSDITLTPKPLLQCTHHLCHVRVHWHLKDNYKDYWRVKIAIINFNYRLNFTDWSLVVQHPNLNNVTQVYSFEYMPLLPYESINDTGMFYGLKYYNDLLMEAGPKGNVQSEVLMKKDKNTFTLKQGWAFPRRVYFNGDECMLPPPDSYPMLPNSGHKLPTTITLMATYVWRDAPDILSLYFTRFPENMGEKELWIAFKKWGDVREVFIARNKNRSGRRYGFVRFKGVDNAKKLEWQLDNLVLGGLKLHVNLTKHERERKTPQTIHKKHQPKEEVATMMVNGKDKDKGKEFAEQRTVIIGVQQHNHKQMKDSRSYENVVATCSKSVAKRWTLKLVQTANVPSCLSVQLMIPMEKTTWLTKTWVGRLRNLAMFDRLEEEFMWEGGEEIKLKYIGGDMVGMGDMLGDSALTKGCGKHHEDCESDWVSVGLLTMNEPTPNIESYLYLHPSENLAVALVSPALDSSNYHSWSKSMITALSAKNKVEFINGNAPEPLRIDRTYSAWSRCNNMVVSWIVHSVSIAIRQSILWMNKAEEIWDDLKSQYAQGDLLRVSDLQQEASSMKQGTLTVTEYFTKLRII

SEQ ID NO: 180929 - protein, 89 aa, Glycine max
  Coding DNA Sequence Number=SeqID_64151
  Gene Ontology: Mol. function=ribonuclease H activity; Biological process=RNA-dependent DNA replication
  Homolog annotation: Hit_ID=Q1T293; Match level="QueryCoverage=83%, HitCoverage=12%, E-value=4e-17, Identity=50%"; Hit description =Ribonuclease H
MAAILPIEIAHLKGWRKLWLECGSVLVVQAFKYALMAPWRIRNKWKSCIKLTKGISFLVGHIFREGNTCANILVTHTHSTSVNRQTLPN

SEQ ID NO: 180930 - protein, 53 aa, Glycine max
  Coding DNA Sequence Number=SeqID_64152
MVVVVVVVVVVLVEENEDVDGGVEFKLIGKSRLRDGCDRRMSLWVRLILFGRS

SEQ ID NO: 180931 - protein, 433 aa, Glycine max
  Coding DNA Sequence Number=SeqID_64153
  Gene Ontology: Mol. function=ATP-dependent helicase activity; Cellular component=nucleus; Biological process=mRNA catabolic process, nonsense-mediated decay
  Homolog annotation: Hit_ID=Q9SQV1; Match level="QueryCoverage=99%, HitCoverage=33%, E-value=5e-19, Identity=37%"; Hit description =Probable DEAD-box ATP-dependent RNA helicase 40
  Pfam annotation: Domain name=WW; Domain location=22-52; Score=42.0; E_ value=2.1e-09; Accession=PF00397.16; Description=WW domain
MATAEAASAGLGPRYAPDDPTLPQPWKGLIDGSTGLLYYWNPETNVTQYEKPTPPVPSGPAPSLAPIPGAHTVQPGGKVQQHGQQMQQVQSSQQQMGHLTQQHGQSMPPQQQSPHMAQVTQQQSSHGAQAAQQQNQHGQKMMQQPQGQQMMQQPQGQQMMQQPQGQQMMQQPQGQQMMQPQGHQARQQMMQPQGQQMHRQMPPQAIHSQHFVQGMPQDHGSHIVQPQTHQFTPQNMHYMSYQQNAITSRQPNSQHSQPNMVSPGQPNSQQVQHNMHGQPFENQQTTYPKVEEVDSKNGSQVGHSPSQYPQRSALPVQNNQNIPAEVGSGQVPNVGVNAGQPQQFRALSNSMQQSPSGSDLYYQHGPNFHSQMSPGMMHGHPSNVLPSGQKMGPEDSLRVRAGNEYYYNSNKDMATMGRQQPDITPIPIPRNQQ

SEQ ID NO: 180932 - protein, 148 aa, Glycine max
  Coding DNA Sequence Number=SeqID_64154
  Homolog annotation: Hit_ID=Q9MAX8; Match level="QueryCoverage=32%, HitCoverage=16%, E-value=5e-20, Identity=97%"; Hit description =Epsilon1-COP
MAFDGVICCLGKLCVVKMFLWFIQDARDPETLANLVVCCLHLGKPSNKSFSQLKLSHPEHVLVKRVSSAEEISQDESCVIELPNLQTIYFCSVRLLPEFGNGLRESYKLLLTVSQKTFTLRKNVTTDIVAVSRNTLMLWAQLRLQTDI

SEQ ID NO: 180933 - protein, 348 aa, Glycine max
  Coding DNA Sequence Number=SeqID_64155
  Gene Ontology: Mol. function=GPI anchor binding; Cellular component =anchored to membrane
  Homolog annotation: Hit_ID=Q69F98; Match level="QueryCoverage=90%, HitCoverage=82%, E-value=1e-163, Identity=73%"; Hit description =Phytochelatin synthetase-like protein
  Pfam annotation: Domain name=Phytochel_synth; Domain location=1-169; Score=321.6; E_value=1.4e-93; Accession=PF04833.5; Description =Phytochelatin synthetase-like conserv
AVVTMYNFQQYRHIQAPGWSLGWTWAKKEVIWNMMGAQTTEQGDCSKFKAGIPHCCKKDPTVVDLLPGTPYNQQIANCCKGGVLNSWGQDPSNAVSSFQISVGSAGTTNKTVKMPKNFTLKAPGPGYTCGPAKVVKPTVFITNDKRRTTQAMSNPNSPHLASVVSASGKTANTPLVQCTSHMCPIRVHWHVKLNYKEYWRVKITITNFNYRMNYSQWNLVVQHPNLDNITQLFSFNYKSLNPYEGLNDTSMLWGVKFYNDFLSSAGSLGNVQSEILLRKDKSTFTFDKGWAFPRRIYFNGDNCVMPPPDAYPWLPNASSKLVFSLLILYLSLLHQLVKAEVNPIVKNA

SEQ ID NO: 180934 - protein, 147 aa, Glycine max
  Coding DNA Sequence Number=SeqID_64156
  Gene Ontology: Mol. function=RNA-directed DNA polymerase activity; Biological process=RNA-dependent DNA replication
  Homolog annotation: Hit_ID=Q1T5K4; Match level="QueryCoverage=93%, HitCoverage=13%, E-value=2e-09, Identity=31%"; Hit description=RNA -directed DNA polymerase
MVDWLGSATGTSWEWQLEWRRHFSESKIDIVAKFMEGIEAVTVQPNQQDRWGWKLDPSEYTQREVLTICYPLTLQGEILMKCSRKFGRSKFQVSHFSWRLIRDRLPTKMNLKRRNVDSNDFSCLFFRSSDEDASHSFFNCDKILPLW

SEQ ID NO: 180935 - protein, 220 aa, Glycine max
  Coding DNA Sequence Number=SeqID_64157
  Gene Ontology: Mol. function=RNA-directed DNA polymerase activity; Biological process=RNA-dependent DNA replication
  Homolog annotation: Hit_ID=Q1RTD3; Match level="QueryCoverage=58%, HitCoverage=24%, E-value=8e-17, Identity=32%"; Hit description=IMP dehydrogenase/GMP reductase
MEKVKGNVYIYLEGDFNFIQRSSERVGRKIQETKAETKEWNINQFGDAHQKLKKVESKLNKLEKERDDRHLNEEEEKLRKQLQEDLWSAIQDPNKVKEETRLFFKRRFQESDWETKVGRGYFQIHCQQHNNLLVAPFKEDEVRTTIWDCGSIRFLNEFHANTVFPKGSNASFLALISKVHDPQGLNDYRPISLIGCTYKIVAKVLSSRLKKLPPYIIDKC

SEQ ID NO: 180936 - protein, 211 aa, Glycine max
  Coding DNA Sequence Number=SeqID_64158
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-27, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=30; ConfidenceScore=5.76e-01
PLKARTCSPLKARACSPLKAKTCSRLKVRSCSPLKARTCSPLKARACTPLKVRTYSPLKMRACSPLKVRMCSPLKARVYNLLKVRACSPLKGRTCSPLKGRMYSPLKGRMYSPLKVRTYSPLKVRVCSPLKVRTSSPLKARTCSPLKVRACSHLMARTCSPLKVRACSPLKVRACSPLKERMCSPLKVRACSPLKARTCSPLKARTCSPLK

SEQ ID NO: 180937 - protein, 107 aa, Glycine max
  Coding DNA Sequence Number=SeqID_64159
MKDKSQVWRSRLYGSASSMEVNSRGGGGAPIARYCDASPCACMGSQYFLMKAWLIIRAGNPRALLDSSGSTGCLVGAIPRNSGWHQKLVEPRAYLPMSQWHDLARGN

SEQ ID NO: 180938 - protein, 99 aa, Glycine max
  Coding DNA Sequence Number=SeqID_64160
MRCIKSDTGWADALVYSIFHHSNKGVPIGTCLIQGDTGRTQILERSQGRCAAIFLMLTLHMAVRVRHRNVKCHLGVNIKIGQRELIQGLTWSEIHKLET

SEQ ID NO: 180939 - protein, 82 aa, Glycine max
  Coding DNA Sequence Number=SeqID_64161
MGSSCCHTLTREGCAAVWISSVSGGGINYGGNTCKYTFSCRVASTCSSNIYIHLTPIFILFKHAMRITLFGCCQFHKRFAKK

SEQ ID NO: 180940 - protein, 87 aa, Glycine max
  Coding DNA Sequence Number=SeqID_64162
MSYPNFIRELLLDGMQPVIDRFKKAVASGGSNLARLGELGGKLLPYFAINRGRSEEGKGSAFLTLRIHLKLLRKIVSVKKIQAETLP

SEQ ID NO: 180941 - protein, 106 aa, Glycine max
  Coding DNA Sequence Number=SeqID_64163
MASNPSRAQKRFIDYFKVDASNEIMDFTKAFSEIIERHLKKLSIRYVDHKWIMVGEPTVGNIKEMEEDDEVEAQHEHAPQWNLFESHDSKDGWYASPPSRALSRSS

SEQ ID NO: 180942 - protein, 319 aa, Glycine max
  Coding DNA Sequence Number=SeqID_64164
  Gene Ontology: Mol. function=protein binding; Cellular component =nucleus; Biological process=mRNA polyadenylation
  Homolog annotation: Hit_ID=Q8LKU8; Match level="QueryCoverage=99%, HitCoverage=91%, E-value=3e-97, Identity=49%"; Hit description =Putative cleavage stimulation factor subunit 1
  Pfam annotation: Domain name=WD40; Domain location=107-145; Score =27.3; E_value=5.2e-05; Accession=PF00400.22; Description=WD domain, G-beta repeat
  Pfam annotation: Domain name=WD40; Domain location=146-184; Score =17.8; E_value=0.04; Accession=PF00400.22; Description=WD domain, G -beta repeat
  Pfam annotation: Domain name=WD40; Domain location=190-228; Score =14.8; E_value=0.3; Accession=PF00400.22; Description=WD domain, G -beta repeat
  Pfam annotation: Domain name=WD40; Domain location=278-316; Score =11.5; E_value=1.7; Accession=PF00400.22; Description=WD domain, G -beta repeat
  Pfam module annotation: Pfam domain module=WD40::WD40::WD40::WD40; Domain location=107-145::146-184::190-228::278-316
MTPLNVEAPPNRLLDLVAKGLAVEKGDITRGTGFTATLPLPHTTAIDFRQTSETTFLFIIKHNLFSVPDVKGSSKSFPKHETRHLSEHKVSKIKQMLLPEAKDGPVRPVIRTYYDHIQPINDLDFHPQGTILISGAKDQTIKTHTMFDLYLFIHLETFCWQIRYSCTGSMYVTASKDGAIRLWDGITANCVRSITAAHGTAEATSAIFTKDQRFVLSCGKDSTLKLWEVGSGRLVKQYLGAIHTQLRCQAIFNETEEFILSIDELSNEIVIWDAMTTEKVAKWPSNHVGAPRWLEHSPIESAFISCGTDRSVRFWKETV

SEQ ID NO: 180943 - protein, 261 aa, Glycine max
  Coding DNA Sequence Number=SeqID_64165
MQILQWISKGTNDHEIGRSSPNDWKAIRDKKAEGQDIITVRHHRAHQGTKTIEGRKLGSKNLKLFIFICGKDIPKACFYRTLDLNRIRNLNRRRHFIHSMNMKREELSGVGKKVLPISEASLSKTTERNSEQYCVTAETKDRTKGDRNKLISRMKELLRRVAATKTDERESFYDQKVLHFRRQGNIEAFPEDDQRISESPKISLTWDVETSSVHSLATWSENVQTKISHSHTYIPRRESSGITCRKENWITTDSEFVVLEL

SEQ ID NO: 180944 - protein, 112 aa, Glycine max
  Coding DNA Sequence Number=SeqID_64166
MKEFNIHLGSTFQPAIQSPKLKFTIDTIIRKPKSSRKGSYLAHGLKIYPKAHENPRAFPWISGPIYLESSIQCPCGKILLLHNRLSKRLPAKPNDYRNRCALSSAGLRLAAP

SEQ ID NO: 180945 - protein, 86 aa, Glycine max
  Coding DNA Sequence Number=SeqID_64167
MFDQQAAVSSAKPPERPDPEVDDPLYLMTLTIPQLFLKPLRVMWDATVFGVFNQNFLLHMTETSMQAGNSDVYGFLEPESIQRAGQ

SEQ ID NO: 180946 - protein, 114 aa, Glycine max
  Coding DNA Sequence Number=SeqID_64168
MVHHQAEFENDAKTELSIEGKEEVHWPIMPYAFGTEPSEPSRSDDRAKLIASSAMTKYRYNVSLRSSFVNIGEVDNNFEKDKALSADLAMNLANVVRDRVINMSNMVNNLKAKA

SEQ ID NO: 180947 - protein, 185 aa, Glycine max
  Coding DNA Sequence Number=SeqID_64169
  Gene Ontology: Mol. function=protein kinase activity; Cellular component=integral to membrane; Biological process=protein amino acid phosphorylation
  Homolog annotation: Hit_ID=Q84XU7; Match level="QueryCoverage=88%, HitCoverage=49%, E-value=7e-49, Identity=38%"; Hit description =Receptor-like protein kinase
  Pfam annotation: Domain name=LRR_1; Domain location=110-132; Score =12.8; E_value=1.2; Accession=PF00560.23; Description=Leucine Rich Repeat
  Pfam annotation: Domain name=LRR_1; Domain location=134-156; Score =10.6; E_value=3; Accession=PF00560.23; Description=Leucine Rich Repeat
  Pfam annotation: Domain name=LRR_1; Domain location=158-180; Score =16.2; E_value=0.12; Accession=PF00560.23; Description=Leucine Rich Repeat
  Pfam annotation: Domain name=LRR_1; Domain location=37-59; Score=1.1; E_value=1.8e+02; Accession=PF00560.23; Description=Leucine Rich Repeat
  Pfam annotation: Domain name=LRR_1; Domain location=61-83; Score =10.1; E_value=3.6; Accession=PF00560.23; Description=Leucine Rich Repeat
  Pfam annotation: Domain name=LRR_1; Domain location=85-108; Score =17.8; E_value=0.04; Accession=PF00560.23; Description=Leucine Rich Repeat
  Pfam module annotation: Pfam domain module=LRR_1::LRR_1::LRR_1::LRR _1::LRR_1::LRR_1; Domain location=110-132::134-156::158-180::37 -59::61-83::85-108
  Subcellular localization annotation: CTP_CleavageSite=30; ConfidenceScore=5.24e-01
ATFGYKHRRFQGPATLGNCPGSGPKWVGVKCNPRSNRVVEVNLDGFSLSGRIGRGLQSLQFLRKLSLANNNLTGGINPNIARIDNLRVIDLSGNSLSGEVSDDVFRQCGSLRTVSLARNRFSGSIPSTLGACSALASIDFSNNQFSGSVPSGVWSLNALRSLDLSDNLLEGEIPKGVEAMKNLRS

SEQ ID NO: 180948 - protein, 158 aa, Glycine max
  Coding DNA Sequence Number=SeqID_64170
  Gene Ontology: Mol. function=chromatin binding; Cellular component =chromatin; Biological process=chromatin assembly or disassembly
  Homolog annotation: Hit_ID=Q1SAV4; Match level="QueryCoverage=76%, HitCoverage=30%, E-value=7e-29, Identity=50%"; Hit description =Integrase, catalytic region
  Pfam annotation: Domain name=Chromo; Domain location=73-126; Score =23.8; E_value=0.0006; Accession=PF00385.14; Description='chromo' (CHRromatin Organisation MOdifier
VSVVPSYHKLAKRFYGPFEVVERIGAVAYRLLLPASSRIHPVFHISLLKPHKGPLPAIPATLPAASLDHHPLPAPLHILDWKLDHSVDPPVTLVLVQWDGMAPEESTWERWDELRQAHNLEDKVAFGDGCIDSNIDSSNNRPRRISRRPNYLKEYVQA

SEQ ID NO: 180949 - protein, 149 aa, Glycine max
  Coding DNA Sequence Number=SeqID_64171
  Homolog annotation: Hit_ID=Q2QQL6; Match level="QueryCoverage=56%, HitCoverage=21%, E-value=5e-12, Identity=45%"; Hit description =Expressed protein
MRNDALKVLWKELRVFCYENGDIERKVEFLVQRMRCGVECVVDMPKLLGVSFEKQIVPRYSVVECFRGKGAIGFEVGLKDLVMPSRPFSSLLPQTVFFFFFLTSAIFVFFFLTTPAFLFVTIVAVKRRLSGRGSSSSSATIVVVKRSLS

SEQ ID NO: 180950 - protein, 84 aa, Glycine max
  Coding DNA Sequence Number=SeqID_64172
GRGGGGGEERDEGVLREAEGEEESREGVAEVREGGGEAVFLEEGDKGDLFSVVEVGVNVEERTRVCRSGAQRHWNFKLFHKKYQ

SEQ ID NO: 180951 - protein, 76 aa, Glycine max
  Coding DNA Sequence Number=SeqID_64173
MVRWMTLKNLVLEDIGTQHFDRKCHKGGIVGDSGDNDSGGDTNGGGGGGSNADDDGDGGGGGQKLTSVSLKYRLMN

SEQ ID NO: 180952 - protein, 144 aa, Glycine max
  Coding DNA Sequence Number=SeqID_64174
  Homolog annotation: Hit_ID=Q1T344; Match level="QueryCoverage=52%, HitCoverage=27%, E-value=8e-11, Identity=39%"; Hit description=RNA polymerase, RBP11-like
MDEDQWTYDNIMSEEVDMDYENEQECGVNEPHVDCSDAFNTSQSLVPKIMFCSELDQLSMKMNLWSGQYKYRKKEFVRRDIGSRKCGCPFKLLGKPIIRRQGWMVKLICGIHNHELAKSLVEHLYAGRLTKDEKTIIADMTKLM

SEQ ID NO: 180953 - protein, 240 aa, Glycine max
  Coding DNA Sequence Number=SeqID_64175
  Gene Ontology: Mol. function=aminoacyl-tRNA ligase activity; Biological process=tRNA aminoacylation for protein translation
  Homolog annotation: Hit_ID=Q45NM7; Match level="QueryCoverage=39%, HitCoverage=55%, E-value=3e-29, Identity=72%"; Hit description =Histidyl-tRNA synthetase
MANSILKLEKIKNNRKGLVEGIILNVYLSKLVEEKGLTAETADKTETFVKEKGPPLALLFKFREGSTFLKDDGFVAALNDLEILFKLMDKSKGPDKVVFDLSLARGLDYYTGVIFEVVSKGDTQLPLLESPKLLQSASAITPINNPMEAYVLDHLNHSTSLLPPLLIQQENVGQQNFQATYGNINNSNEQAVDPVTNWRVLDKFVASQLSQDASKDNIFQGTANSSGQFRHLDKQRASGA

SEQ ID NO: 180954 - protein, 45 aa, Glycine max
  Coding DNA Sequence Number=SeqID_64176
MVKVGVEEVRDADAYVPIPTKEDKQVSKGPKKLVDRAKPDDYPIY

SEQ ID NO: 180955 - protein, 120 aa, Glycine max
  Coding DNA Sequence Number=SeqID_64177
MTNISIALKIGLVTDPVMELGEGDLDGIVQGQPDVDVAEVEGEAVKATSTVLCKNDLTLVWQDDTAATTGVEIECEVVRADDTDSLDSERLRHREIARGKRLKRGQHSRGFLKWLETMSF

SEQ ID NO: 180956 - protein, 190 aa, Glycine max
  Coding DNA Sequence Number=SeqID_64178
  Gene Ontology: Mol. function=RNA-directed DNA polymerase activity; Biological process=RNA-dependent DNA replication
  Pfam annotation: Domain name=AT_hook; Domain location=119-131; Score =14.9; E_value=0.061; Accession=PF02178.9; Description=AT hook motif
MKWRKASGVLCDAKVPIKLKGKFYRTAVRPAILYGTECWAVKSQHENKVGVAEMRMLRWMCGKTRQDKIRNEAIRERVGVALIVEKMVENRLRWFGHVERRPVDSVVRRVDQMEKRQTIRGRGRPKKTIREVIKKDLEINGLDRSMTPKRHTYLLVLHRNKKHQSGNNVKKKTRVPKPLKSETEELNMVS

SEQ ID NO: 180957 - protein, 59 aa, Glycine max
  Coding DNA Sequence Number=SeqID_64179
MDAEFKEKCLPRSLFEWDNVVAWFYSLHNKPDNYIKGIVNIEFYSSNNIGTIENKDNSH

SEQ ID NO: 180958 - protein, 703 aa, Glycine max
  Coding DNA Sequence Number=SeqID_64180
  Gene Ontology: Mol. function=1-phosphatidylinositol-4-phosphate 5 -kinase activity; Biological process=phosphatidylinositol metabolic process
  Homolog annotation: Hit_ID=Q9SUI2; Match level="QueryCoverage=98%, HitCoverage=90%, E-value=0.0, Identity=61%"; Hit description =Phosphatidylinositol-4-phosphate 5-kinase 7 (EC 2.7.1.68) (AtPIP5K7) ...
  Homolog annotation: Hit description=(1-phosphatidylinositol-4 -phosphate kinase 7) (PtdIns(4)P-5-kinase 7)
  Pfam annotation: Domain name=MORN; Domain location=110-132; Score =31.9; E_value=2.2e-06; Accession=PF02493.10; Description=MORN repeat
  Pfam annotation: Domain name=MORN; Domain location=133-155; Score =31.5; E_value=2.9e-06; Accession=PF02493.10; Description=MORN repeat
  Pfam annotation: Domain name=MORN; Domain location=156-178; Score =30.4; E_value=6.2e-06; Accession=PF02493.10; Description=MORN repeat
  Pfam annotation: Domain name=MORN; Domain location=179-201; Score =18.9; E_value=0.018; Accession=PF02493.10; Description=MORN repeat
  Pfam annotation: Domain name=MORN; Domain location=18-40; Score=24.3; E_value=0.00042; Accession=PF02493.10; Description=MORN repeat
  Pfam annotation: Domain name=MORN; Domain location=41-63; Score=34.2; E_value=4.6e-07; Accession=PF02493.10; Description=MORN repeat
  Pfam annotation: Domain name=MORN; Domain location=64-86; Score=31.5; E_value=3e-06; Accession=PF02493.10; Description=MORN repeat
  Pfam annotation: Domain name=MORN; Domain location=87-109; Score =20.1; E_value=0.0079; Accession=PF02493.10; Description=MORN repeat
  Pfam annotation: Domain name=PIP5K; Domain location=424-702; Score =278.8; E_value=1.1e-80; Accession=PF01504.9; Description =Phosphatidylinositol-4-phosphate 5-Kinase
  Pfam module annotation: Pfam domain module=MORN::MORN::MORN::MORN::MOR N::MORN::MORN::MORN::PIP5K; Domain location=110-132::133-155::156 -178::179-201::18-40::41-63::64-86::87-109::424-702
MEDSERFEERSFSNGDVYIGKIKGMLPHGKGKYTWSDGTVYEGDWVNGKMTGKGLITWPTGAKYEGEFSGGYLHGHGTFTHSTGCIYSGGWRMDAHHGIGRKEYSNSDIYEGLWKEGIREGCGRYSWENGNTYIGNWKSGKIDGRGVMKWANDDIFDGCWINGLKQGSGVYRFADGGLYIGTWSKGLKDGRGTFYPAEKHTATKQKFTRSFSEKISVSGRSKSSRQISHRTSSLDANCIIQDPAGDCICRDSSPTLSQTFNESQSEASGVNSLLYEREYMQGVLIMERIRNYSEIPHKNKRQNTFSVKQAKKSSWIDIFGGSRSYYLKLNLQLGISNTDRYIWAWVENVKTFKYTVGKITPVPAREVRSSDFGDRARIRMYFPKEGSQLTPPHCSIDFYWKDYCPMVFRNLREMFKLDAAEYMMSICGDSGLRDISSPGKSGSIFFLSQDDRFVIKTLKKYELKVMLNMLPKYYHHVGSYENTLITKFFGLHRITLRGGKKVRFVVMGNMFCTELHIHRRYDLKGSTQGRYTDKDKINSNTTLKDLDLKYEFHMDKKLRESLFKQISLDCMFLESQHIIDYSLLLGLHFRAPENLKALVEPPRLPQPQHGLPSEDDAQKQGEQLIIPKGLLLVAHEPSFVNTAPGPHIRGNTLRAYSIGDKQVDLLLPGTARLRVQLGVNMPAQATRKLQEDKVEESEVELFE

SEQ ID NO: 180959 - protein, 129 aa, Glycine max
  Coding DNA Sequence Number=SeqID_64181
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=P22180; Match level="QueryCoverage=97%, HitCoverage=13%, E-value=7e-60, Identity=88%"; Hit description =Plasma membrane ATPase 1
  Pfam annotation: Domain name=E1-E2_ATPase; Domain location=4-129; Score=15.3; E_value=3.4e-10; Accession=PF00122.10; Description=E1-E2 ATPase
MYNVEDASILVPGDIINIKLGDIIPTDARLLEGDPLKIDQSVLTGESLPVKKGPDDGVYSSSTCKQGEIEVVVIATGVHTFFGKAAHLVDTTNQVGHFQKVLTAIGNFCICSIALGMVVEIIVMYPIQD

SEQ ID NO: 180960 - protein, 72 aa, Glycine max
  Coding DNA Sequence Number=SeqID_64182
  Gene Ontology: Mol. function=nucleotide binding; Cellular component =endoplasmic reticulum; Biological process=response to unfolded protein
  Homolog annotation: Hit_ID=P29357; Match level="QueryCoverage=73%, HitCoverage=8%, E-value=8e-18, Identity=79%"; Hit description =Chloroplast envelope membrane 70 kDa heat shock-related protein
MRAGRITEYGVDGVHGDLVLSGIFDESFGIDEGDIKGCGTVALIVGDDFNAVVLPDSNRCKVNESYNGVEGE

SEQ ID NO: 180961 - protein, 54 aa, Glycine max
  Coding DNA Sequence Number=SeqID_64183
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=P20649; Match level="QueryCoverage=98%, HitCoverage=5%, E-value=6e-21, Identity=92%"; Hit description=ATPase 1, plasma membrane-type
MAIGSHRLSQQGAITKRMTSIEEMAGMDVLCNDKTGTLTLNKLTVDKNLVEVGC

SEQ ID NO: 180962 - protein, 143 aa, Glycine max
  Coding DNA Sequence Number=SeqID_64184
MLHTADGEEPKKEEEELNKLVTTVEEKLKKGEKPKKVATATAVEEESNKVVVATLKEKLKKIAFAEGEKLKNDTLPSEGGEELKKLVTQKTIDEVIFEVEPCTVKEMEVVQSFIDAHGGDEFDQPFVAALSNEAHLQSFMMLK

SEQ ID NO: 180963 - protein, 215 aa, Glycine max
  Coding DNA Sequence Number=SeqID_64185
MSGVLVFVGGCNRNLEALDDMYYLYTGIARENEQRPEKLSLKKQLKRKCLEQNPNLVRNPVMCGYGVGAASNQPMEILNCSQPSRLNIPVNQSLLPGKKMFQAQVKEKNSAGYTIETVIDGKPLHGVLFKNQPNTLIPVPNTSSRKRPVSEILSPASNGIHSQNVTAYKVLGQDRMQDKRELRGESSESHECHKDADTIVVSSNPTTVAESFKVN

SEQ ID NO: 180964 - protein, 94 aa, Glycine max
  Coding DNA Sequence Number=SeqID_64186
  Gene Ontology: Cellular component=integral to membrane; Biological process=transport
  Homolog annotation: Hit_ID=Q9FVU0; Match level="QueryCoverage=41%, HitCoverage=18%, E-value=2e-07, Identity=64%"; Hit description =Integral membrane protein, putative
MTEIAKGCRNGREKEYLDGDGGVVGVITGDNDVIGQNDNVVLDFFRDALGASGGFKSIIALPVVVVVVLRHPSLFIDAISAFVCFTSIIITLQC

SEQ ID NO: 180965 - protein, 197 aa, Glycine max
  Coding DNA Sequence Number=SeqID_64187
  Gene Ontology: Mol. function=protein binding; Cellular component =integral to membrane; Biological process=transport
  Homolog annotation: Hit_ID=Q69TX8; Match level="QueryCoverage=74%, HitCoverage=70%, E-value=7e-59, Identity=74%"; Hit description =Putative transmembrane protein Tmp21
  Pfam annotation: Domain name=EMP24_GP25L; Domain location=37-107; Score=42.4; E_value=1.5e-09; Accession=PF01105.14; Description =emp24gp25Lp24 family
MTELETLILMGTNYSSHEKLCIIRYTSNNNCHVGRCNSGWLLNDNLLIQLVIKVTSPYGNNLHHKENTTHGNIAFTTQEAGNYLACFWVDSHSQGVVEVNVNLDWKIGIAAKDWDSVARKEKIEGVELELRKLEGAVEAIHENLLYLKGREADMRTVSEKTNGRVAWFSIMSLAMCIAVSGLQLWYLKRYFQKKKLI

SEQ ID NO: 180966 - protein, 89 aa, Glycine max
  Coding DNA Sequence Number=SeqID_64188
  Gene Ontology: Mol. function=zinc ion binding
  Homolog annotation: Hit_ID=Q08ET6; Match level="QueryCoverage=83%, HitCoverage=15%, E-value=3e-30, Identity=85%"; Hit description=RING -finger protein
VTEALACAGLESSNLIVGVDFTKSNEWTGKNSFNRQSLHHIGSGLNPYEQAISIIGKSLAAFDKDNLIPYFGFGDGISLNKFNLWSALF

SEQ ID NO: 180967 - protein, 89 aa, Glycine max
  Coding DNA Sequence Number=SeqID_64189
MDRAKANKAFHGNLTLTKSWNGGREEAERGSGGDSARRNGRRGVVHRLAFRFQRKRNPSHTLPQHGSAPACGSCPVVASLLYLFRLMST

SEQ ID NO: 180968 - protein, 503 aa, Glycine max
  Coding DNA Sequence Number=SeqID_64190
  Gene Ontology: Mol. function=nucleic acid binding; Cellular component= intracellular; Biological process=DNA integration
  Homolog annotation: Hit_ID=Q1S1X7; Match level="QueryCoverage=83%, HitCoverage=39%, E-value=4e-54, Identity=29%"; Hit description =Integrase, catalytic region; Zinc finger, CCHC-type; Peptidase aspartic, catalytic
  Pfam annotation: Domain name=zf-CCHC; Domain location=239-256; Score =22.5; E_value=0.00019; Accession=PF00098.13; Description=Zinc knuckle
  Subcellular localization annotation: CTP_CleavageSite=44; ConfidenceScore=5.03e-01
MGFFKQRKIYSRFSSFQQYTSSYNITKTSVGRKRWLDDTLCTVQSSPLKYLFKKLVNTIKIDKFTGKNFNLWHIKMHSLLKEQGIWAPLSGLPSKIDKSVLSSFDNSLVSIDEVLYEVSEEQTTYELTQASETLHYEINMLQVAVETMSICPLNERSVSKRALGQVKLLMELYDIDAKIEDKDLAMIFKFSLYSRELRLKASGNSDEAAASRLSMNNTAKGEKKKKDKGNKKGMIYPKDICNYCKEPSHWKKDCPKKTKKEYVATIVQNDSSSENDLVLFVVDQQQQHSEQWIMDLGWSYYMCPHRNWFVTYEKKFAGNVLMGNSAPCKTVEIGSIQIRKHDEIVRTLTNVHHASELKKNLVFVGVIDSKGSTSTVSQVGSHASNDNSLWHMLLRHMSEKRMKILSKQDLIGNHKMKPLQFCEHCVYGKRHRTKFSKAMHTIKAAMDCIHSYYQGPSRVSSLRGAKYFLFVIDDYSRMTWIFTMKQKSEAFKFFKHWTILMQN

SEQ ID NO: 180969 - protein, 286 aa, Glycine max
  Coding DNA Sequence Number=SeqID_64191
  Homolog annotation: Hit_ID=Q67UA7; Match level="QueryCoverage=99%, HitCoverage=65%, E-value=2e-64, Identity=45%"; Hit description=F-box protein-like
MDSMPDAILQCILSRITNARDVSSCNCVSKRWKDSTPYIRTLYFPRSSFETPSSSSEGADNIIKRMVSRVVKLEELIVYSPFSPDGLASWLSLAGQTLLQLELRMDNLADNRGFHESPSKLDYIGAAKNLESLKLWGVLMVRSPKWDVFPNLKNLEIIGVRLEDPVLSVVLRSCPVLTRLLLLGCEGVRSVSIELPCLEECKLDFYGMGNSSLTLTSPQIESLEVQGCSWIRVPETKHLRNLSISNSAGRVYMVDFGNLSALEYLCMRGIQWCWDAICKMLRLASK

SEQ ID NO: 180970 - protein, 69 aa, Glycine max
  Coding DNA Sequence Number=SeqID_64192
MKKKTERRRRQREGDETYLGMVAKEKKQRLVTMLECDEDDARVRRTRCSNVDRDLEVRRRLEEEESAKA

SEQ ID NO: 180971 - protein, 77 aa, Glycine max
  Coding DNA Sequence Number=SeqID_64193
LRWLQIRSNPVSASLLQAVLTKFFLSAEEDFHQELARHLGLSFDEHKPSSDNTKFVKDISENAATSPTMMGKDNIAS

SEQ ID NO: 180972 - protein, 90 aa, Glycine max
  Coding DNA Sequence Number=SeqID_64194
MDATVVFHGELVIARSQNLLGHGMSIGMRPEGALRTYRERESGRASGSRPRAKREISVLSAADLCTLFQSAYFGKRALEVARRAACALKP

SEQ ID NO: 180973 - protein, 84 aa, Glycine max
  Coding DNA Sequence Number=SeqID_64195
REFAKRNLQWLSARKNPKEDELSSLLSAPLQVNKHIASAHPLSEISALSDPDLRHEHEQGHLFKPEIRFAKGVWTFLEKLCMHE

SEQ ID NO: 180974 - protein, 42 aa, Glycine max
  Coding DNA Sequence Number=SeqID_64196
MDLVPELIPFEFSLIHHLEKELGRTKNKKLFMAMAGVCNITR

SEQ ID NO: 180975 - protein, 262 aa, Glycine max
  Coding DNA Sequence Number=SeqID_64197
MYHTELDEFKGELERCNFHKRLTNLADSSIDLALGESLPTYSRYCRMPTDIREIELDMNVEALISGKITSMAQSNSSRLGFPALITTLCRTIGVASDSLVFECLSLIIILAYIRKNCWNPDDPTIIIRAARRPRARLVEAPSTLAAPHLGSTSVAPPLARIALVAPPNFIPTVEQFNEWVAWPGTQPPLHRDDEDPAAQVPHQPADESSESSTPEPLIRKRRVVVTQEAAATPEKSHEATPEPPAPVADTTSPQQSCLQTPL

SEQ ID NO: 180976 - protein, 111 aa, Glycine max
  Coding DNA Sequence Number=SeqID_64198
MVTTIPRIIIVCQYSLGSVRSVFVETTTLLHLGLTMVLFDYGKFKVIPKTFSLFIVCHWSKFCCTQLGLNLSTGCGSNVFQGYFDDAKESRVKQSFKKIFKNQVSRFKIQE

SEQ ID NO: 180977 - protein, 159 aa, Glycine max
  Coding DNA Sequence Number=SeqID_64199
MPLPQGDVDSYPLFTTEGSAPNALPQPNIAEVSQPRPMQPLLFSMGGLPSAVEGREKLDFIEERLKAVEGFCDYPFTRIYAWYPMLSSLQNSRDEKLLMHFFQDSLVGAAIIWYTNLEASRIRTRKDLIIAFIRQYQYNTDMAPNRTQLQNIHYKKLSM

SEQ ID NO: 180978 - protein, 102 aa, Glycine max
  Coding DNA Sequence Number=SeqID_64200
MVKTRGLDRALGRVGARGLGRGGDGDDIDGAPQLQRPTASACRRRVPVILDDDVPVVPADSPAIPEAEAAVAGDEPMVDVATQDTGAETDAQDTGAEIDGDE

SEQ ID NO: 180979 - protein, 346 aa, Glycine max
  Coding DNA Sequence Number=SeqID_64201
  Homolog annotation: Hit_ID=Q5XM22; Match level="QueryCoverage=23%, HitCoverage=46%, E-value=7e-23, Identity=60%"; Hit description =Resistance-like protein HAAS-2
  Pfam annotation: Domain name=DUF1723; Domain location=43-90; Score =21.0; E_value=0.0017; Accession=PF08330.1; Description=Protein of unknown function (DUF1723)
MVQKGDPSVLTECADHVAGSVWSGHERPELKLCSHGRKVHNLGRHVPAIEDMRWQRETSSFHLPVGEVSITLDNVASLLHLPIVGAFHDFQPLCTDEAVVLLVELLMVSTEVAMAETGQCGGHVRLQWLRDVYQRRCQMQHWTAAARTYLLHLLGCTLFANKSATHVHVSHLQAFRDLTIAGWYAWGAAGLVHMYDQLNDAIAECNADPDYDEVSPHACRWIVTKKTVKKTHYSDHLTAVGDLCAVSSQCASDYMDWFFVISHPFMTAPQMDPPRDAYAMQPSHIPHEAAPASTHTNPDADEPRHAVEACHVIAEVLEQHLNAPGTSTHEEVIQKCLRIAMGVTED

SEQ ID NO: 180980 - protein, 140 aa, Glycine max
  Coding DNA Sequence Number=SeqID_64202
  Gene Ontology: Mol. function=catalytic activity; Biological process =trehalose biosynthetic process
  Homolog annotation: Hit_ID=Q9FJQ1; Match level="QueryCoverage=66%, HitCoverage=24%, E-value=3e-35, Identity=76%"; Hit description =Trehalose-6-phosphate phosphatase
MKLCFYRTLGFSKRTREGTSLVDLWLVKDFTRLKEISRTLYHPSALNTFEQIVYSAKGKQIVVFLDYGGTLSPIVADPDKAFMTRKMRATLKGIARHFPTAIVTGRCRDKVYNFVKLAELYNAGSHGMDITGPTKSPKAR

SEQ ID NO: 180981 - protein, 62 aa, Glycine max
  Coding DNA Sequence Number=SeqID_64203
MMGVKHFEVVKRKSHANKQWSPDEIRVDLCIWTSCVQSYHKNNRQWCIHLEHRSLKKDDGTQ

SEQ ID NO: 180982 - protein, 161 aa, Glycine max
  Coding DNA Sequence Number=SeqID_64204
MTINSWGFRLDGGGCTNNTRQSIRGAPDSMVEGCMNENQFMGAPGLDGGGMHGMTINSWGSGLRFNWWRMHETALGQIKFVGLPDSMGKRRVKLKLGIKSLIVYKKTHTGEAGSFGLFLIFMWGGISPVESDFEWQSQRKNYFKKMGFPLPAVIYPAENLS

SEQ ID NO: 180983 - protein, 41 aa, Glycine max
  Coding DNA Sequence Number=SeqID_64205
VQEQMLDVRRKSLSWGIKYFSTQLNDRKPEFNHHIDYHRQS

SEQ ID NO: 180984 - protein, 65 aa, Glycine max
  Coding DNA Sequence Number=SeqID_64206
MPSFRDLEQKWAPKVGALFGASMENEGEENGNQCHMSPFEWSQKGPLSLLIVTHTQPQKVRKFDL

SEQ ID NO: 180985 - protein, 235 aa, Glycine max
  Coding DNA Sequence Number=SeqID_64207
MCYALRESKPVINAETAPRSNRLSLIAIKRIVFEHLPSCLPKKVTTKEFLDALGERKPTSGKGHWKNTKSTSNASHKYQGSWKPDKGVQISKGAQSEGKQTKDYDNVSASVVVESFVAKRSKIEEKCFVLWHKRLGHISRERVERLTKTNILPSLNFDDLGTCADCIKRRFTKTKKKEKSEALEKFKIFKTEVEKQLGKIIKVVRFDHGGEYYGKYGVTGKHMGDHSLYIWKTVE

SEQ ID NO: 180986 - protein, 89 aa, Glycine max
  Coding DNA Sequence Number=SeqID_64208
MEAPSKPPVELASLVFSKELSLPLAISASRGTASQTGEERKVATVIGELRASCNSHWRVRAVGIAIPDGDLGSLYTRKLFQCCCVYTIK

SEQ ID NO: 180987 - protein, 130 aa, Glycine max
  Coding DNA Sequence Number=SeqID_64209
  Gene Ontology: Mol. function=acid phosphatase activity; Cellular component=cellulose and pectin-containing cell wall
  Homolog annotation: Hit_ID=Q9LU48; Match level="QueryCoverage=53%, HitCoverage=27%, E-value=2e-21, Identity=68%"; Hit description=Acid phosphatase
  Pfam annotation: Domain name=Acid_phosphat_B; Domain location=6-130; Score=-61.5; E_value=0.0018; Accession=PF03767.5; Description=HAD superfamily, subfamily IIIB (Acid
MNPTDFRFLLAPSSIEAPSPVLPLKLLPLLPLKLLQLFDFIAPTSPLEASLIGSCTVEERLEVFDREKFNNWVEKGVTPAIEPSLKLYEDVLNLGFKVILLTGRSERRRSVTVDNLINAGFKEWDQLILR

SEQ ID NO: 180988 - protein, 157 aa, Glycine max
  Coding DNA Sequence Number=SeqID_64210
  Gene Ontology: Mol. function=protein binding
  Homolog annotation: Hit_ID=Q8LKR1; Match level="QueryCoverage=68%, HitCoverage=72%, E-value=2e-23, Identity=53%"; Hit description=Actin- related protein 5
MAVVNVLLIMSMYALLFLIIFLSVVILFNLGDEVSIIVINLGSHTCKVGYAGKDAPKRYLEHTLSHTYVVGAIDHMDIDGIAGINDENSDKTKGKCKLYVGSQSLGYRRDHMEVMSPLKNGVVVDYNVVYNIWDHALRFLPLRKLMTVLLICSTPKN

SEQ ID NO: 180989 - protein, 93 aa, Glycine max
  Coding DNA Sequence Number=SeqID_64211
MLSPIVNVTGHALNKDSSTFDSNIIIKDEEKELHGTFKCFGSLKLILELHEMRSDNPEKIEVEKALLDSPDSKVSAKIVATLAPLQLYIENII

SEQ ID NO: 180990 - protein, 210 aa, Glycine max
  Coding DNA Sequence Number=SeqID_64212
MDVVNDLHMGPPATTNLGGSTSTDDVNSSQKQKIVRKKTQGKSVECEGPDFSLDKSSPKTDATIKHPLHESPALPNFLSCQIIVEYSTENEKSKRQKTTHNAIEGNVNGCGTPEGIFSPKASTPALDMPSEHPIQCFSNDLITSQSCVEVGICQGHNEEKKQNMINTTAENSNSQQGIPEESCNHISFAASHEPFAKECVSEVVKLNTEH

SEQ ID NO: 180991 - protein, 75 aa, Glycine max
  Coding DNA Sequence Number=SeqID_64213
MWDQHRLKRALKPGFPSIREKEKGLKPSLHCLHAMSISPSTDFNLKIPTMNMCENEFLTWGPNFTMIQRLTSPGS

SEQ ID NO: 180992 - protein, 162 aa, Glycine max
  Coding DNA Sequence Number=SeqID_64214
  Subcellular localization annotation: CTP_CleavageSite=51; ConfidenceScore=5.14e-01
MQNEKERTYLKHGTKHTRFQVSNKNFVITFGVATLTSSVLLPRICSLDSTSCSHNVIKITRRTRRKRNHFDHQNSDFSLFATISVVVTIGSRNFRKRRWNLWSLKSDLLYDTVGARDNCPFIQGPKPDPIRFGSSMRGASVSLRGRRLANLTTEECGQELHF

SEQ ID NO: 180993 - protein, 52 aa, Glycine max
  Coding DNA Sequence Number=SeqID_64215
  Homolog annotation: Hit_ID=Q6ZKI0; Match level="QueryCoverage=77%, HitCoverage=20%, E-value=7e-07, Identity=63%"; Hit description =Putative quinone-oxidoreductase QR2
MVAQVKAFIDATGDLGKVEQLADKPTGIFITTRCQGGGKETIKKEVEQDFRG

SEQ ID NO: 180994 - protein, 66 aa, Glycine max
  Coding DNA Sequence Number=SeqID_64216
MGCDEGIPVDAARAADDDDEGVTEMESKGLVVAWAEMMGLKGFMEVVVVCMDGDDGVPNDDVSMPR

SEQ ID NO: 180995 - protein, 486 aa, Glycine max
  Coding DNA Sequence Number=SeqID_64217
  Homolog annotation: Hit_ID=Q10CM8; Match level="QueryCoverage=26%, HitCoverage=26%, E-value=6e-38, Identity=56%"; Hit description =Expressed protein
MVNSSCWRNSGSPSPENCNKEPTIQDHQKDDSHKFSDGPLRVCLMDGETKLSIDQVTSQSGAAAEEIKLSTDNINEQRFMTTSSAVDIPSEHLKTDGRPLDHTEITRNDLCCADEEIELSTDNIKEQRFMATSSAVDIPVEQLKTSCRKLDNTEITRNDLCCAGDVSDLSLDTVRDGHLKISQFSLDRNFAGNQKNKLLILDLNGLLADFVSISDTDTPFRRYRREPEPDFVLRGKKGDMVKCLVSSFQISYLALAQIWLICYSFLLQSTRGPFVTIFYSFALTHFMWEYGRLDPRAMLMHQSNFLWGNLQPNCSFVGYKVGLVVGKGGLKGEGREGRGRSRNQSHCTKTKFSTVENIDKPLVLKEIRKLWEKAEPDLPWEKGEFNESNTLLLDDSPYKALMNPRHSAIFPYSYRYYHTRDSELGREGDLRVYLKGLAKAENVQNYVSENPFGQRPIREANPSWGYYRRVIESLQRSQNDGPSLPR

SEQ ID NO: 180996 - protein, 124 aa, Glycine max
  Coding DNA Sequence Number=SeqID_64218
  Gene Ontology: Mol. function=nucleic acid binding; Cellular component= mitochondrion; Biological process=DNA integration
MVINRNTIFGDQFMMPQTVETHVLVLDGASPSSVEVQIDFEPLSVILDKENPCVMVEVMESLQKNQTWELVKLLLGKRVIGCKWVYKREPLVSKQELEKFKDCLVGKGYSQQKGIDFSPRYALG

SEQ ID NO: 180997 - protein, 82 aa, Glycine max
  Coding DNA Sequence Number=SeqID_64219
MRQGPVLLGHRQETVRLVQRQGSGHLGQRQGQCIRTEIGQWKPLVAGRRATNGGQTKKSTGDNMSPMEHDFSLSLNHTLIST

SEQ ID NO: 180998 - protein, 47 aa, Glycine max
  Coding DNA Sequence Number=SeqID_64220
  Gene Ontology: Mol. function=calcium ion binding
  Homolog annotation: Hit_ID=P93484; Match level="QueryCoverage=87%, HitCoverage=6%, E-value=2e-17, Identity=90%"; Hit description =Vacuolar sorting receptor 1 precursor
MVVAGRIKQLTSLLARIHSMGEYVNALWLMVYNSKEMAIRLVKVKRL

SEQ ID NO: 180999 - protein, 139 aa, Glycine max
  Coding DNA Sequence Number=SeqID_64221
MASRKRKATTSRPQEPYDTTRFVSEVAWERYEQNVHSRNILLETNVNLYVIEYDEFCRELERRRWHKALTRQPDGRIDVALVKEFYANLFDLEDKSPRQEPGERYTTYTKFCSTHPDPQELASKLCIPSGFALNAEGAP

SEQ ID NO: 181000 - protein, 144 aa, Glycine max
  Coding DNA Sequence Number=SeqID_64222
MDRRILPERNVRIYHTEFDEFKADLERCNLHKHLANLQEGSIDVAMVKEFYAILYSSEDQVPKCSKVRGRMIKIDADNLNEFLHTPMLLEEGELLPTYSRFCRLRSDPREMEVILYIPGKGFVLNVEGQPWKLLRKDLTTLAQK

SEQ ID NO: 181001 - protein, 213 aa, Glycine max
  Coding DNA Sequence Number=SeqID_64223
MGRARLVYGLVTGMDMNIGGLISGQITIMAQSNSSRLGFPALITALCRSRGVGSDALTSYRSLRPNLQELAHQRPIMIVEKFIEQQKPELEDDQSSEAIVPGAFDVAKVPVPADPPSPVVDPSSPTPKAALPSTPIIIFDDPTPKLLNPRSLVRLNIQALSVDPSFKTTPDLDSPLSDAILPRKGPVTRAMSKRLKEDWARAAEEGSRVLMSL

SEQ ID NO: 181002 - protein, 315 aa, Glycine max
  Coding DNA Sequence Number=SeqID_64224
MELTSLGLTVLYITCGLGNLAPLDLEIEATCRRNNAERRRKFLQERTAQPSLEEAQSSESSSAFPELRESKVGAFEVHIMAEDKPQRVTLEDYSSSTVSQFFTSIAWPEVQAHNITYPHSLIQLIQGNLFHGVPEDAVRLSLFSFSLAREAKRRLHSFKGNSLKTWEELVAKDTNSWILQADSAEHFYKWFETTVQAKPARAFFTRCTVGTNKLLAKQLESLTETLSKLPTQLQATQPSHSAVMQVEGCSICGGAHESGYCIPLDDAAKEVNYMGNQHRPGFNACGFVGYQQGVNFNQNQGQWRSLPGNQFNKDQ

SEQ ID NO: 181003 - protein, 138 aa, Glycine max
  Coding DNA Sequence Number=SeqID_64225
MKFNTKHLQHTSNHMRMVQILHPTKIYTFNDWQMCFLRQEGDDEFYKRLINDIPPIFTRFIFNLHQYPEAMMQRANHPSSPDQNPWVPSEGMIAKVKRKQDKLNCQLTEMQKEAEAKQQQEKLKFEELFNNLHAHLGP

SEQ ID NO: 181004 - protein, 166 aa, Glycine max
  Coding DNA Sequence Number=SeqID_64226
MAHRDKLWSSTPFLSSRDKKVRWHVETNHGHPHPLPSRDKRARWHAETNYGHPYPFRHPKTSKSDGRRRQIMVIRTCSIQRQASLMARRDKSWSSAPLPSRDKRVRCYAETNHGHPHLCHPKTIKSDGTKRQIMVIHTLFAIQRQASPMAREDKSWSSAPFPSRDK

SEQ ID NO: 181005 - protein, 170 aa, Glycine max
  Coding DNA Sequence Number=SeqID_64227
MPHGDKLWSSAPFRRPQGPSIETIEVSPINQRQASSLACGDHHGHSLYCFPRLLQSPSVIQRQSSPMAGRDHHGHPFSLLCSLRRYLETIKFDGMWRPSWSSFTFEDDNVFSHCMPSKGNNVLIIHFKDDNVFSHCMPSKGDNILIYISKTTMSSVIACLQKAIMTIICF

SEQ ID NO: 181006 - protein, 100 aa, Glycine max
  Coding DNA Sequence Number=SeqID_64228
MLHLQQASLEKTMEKRFLVEHMEPNLLIKNTLEASLKSFNDFVLFNMNMLMQQRLPPYVEPPPPPSTIVLASISIENSIPGPLPSPLKSPPSNPPPFTAS

SEQ ID NO: 181007 - protein, 56 aa, Glycine max
  Coding DNA Sequence Number=SeqID_64229
MKTHPLAELAVAKRGRITKPSCTLSRAFLGQARFVAASAELTFEELSAYPCGRCLA

SEQ ID NO: 181008 - protein, 205 aa, Glycine max
  Coding DNA Sequence Number=SeqID_64230
  Gene Ontology: Mol. function=hydrolase activity; Biological process =pathogenesis
  Homolog annotation: Hit_ID=Q9C6Z2; Match level="QueryCoverage=99%, HitCoverage=100%, E-value=7e-75, Identity=65%"; Hit description =Diadenosine 5,5-P1,P4-tetraphosphate hydrolase, putative
  Pfam annotation: Domain name=NUDIX; Domain location=8-186; Score =75.9; E_value=1.2e-19; Accession=PF00293.18; Description=NUDIX domain
MEGLPQGYRPNVGVCLINSDDQIFVASRLNVPGAWQMPQGGIEDGEEPKSAAIRELREETGIVSAEIIAEVQKWLTYDFPPAVKAKVNRLWGGEWHGQAQKWISVQRSPLTTYMVAKILAWQYRKQDGWLLKQMFLMRLTKDDSEVNLTNGEAEPEFAEWKWADPEEVIEQAVDYKRPTYEEVIRTFKPYFQGSGISAKCKSTKW

SEQ ID NO: 181009 - protein, 60 aa, Glycine max
  Coding DNA Sequence Number=SeqID_64231
MKPHREEGRKGWLLASDSAKGEIMRDRERDCERPRVRLRARGRNETASGDVEGRSGRSES

SEQ ID NO: 181010 - protein, 85 aa, Glycine max
  Coding DNA Sequence Number=SeqID_64232
MKNERRTSKNVRGIDHGNVAPGAKRNVPEWTIFPLPLVPCPFLFETSRNPTDSIVIAVKQLNSAGKNPYVDKNCPHSEYLAHFFS

SEQ ID NO: 181011 - protein, 37 aa, Glycine max
  Coding DNA Sequence Number=SeqID_64233
MASLLRNGCVARKPPAWLATLSNEDLATLYYETAQTA

SEQ ID NO: 181012 - protein, 228 aa, Glycine max
  Coding DNA Sequence Number=SeqID_64234
  Gene Ontology: Mol. function=protein serine/threonine kinase activity; Cellular component=nucleus; Biological process=protein amino acid phosphorylation
  Homolog annotation: Hit_ID=Q9XF95; Match level="QueryCoverage=65%, HitCoverage=41%, E-value=2e-70, Identity=84%"; Hit description =Putative mitogen-activated protein kinase MAPK
  Pfam annotation: Domain name=Pkinase; Domain location=63-224; Score= -46.7; E_value=8.9e-06; Accession=PF00069.15; Description=Protein kinase domain
  Pfam annotation: Domain name=Pkinase_Tyr; Domain location=63-223; Score=-137.0; E_value=0.00046; Accession=PF07714.7; Description =Protein tyrosine kinase
  Pfam module annotation: Pfam domain module=Pkinase::Pkinase_Tyr; Domain location=63-224::63-223
MSKKMGLLRIGSKKRQGDIKRSKPRCRNSKKMATLVEPPNRIKPKGKHYYTIWQTLFEIDTKYVPIKPIGRGAYGVVCSSINRETNEKVAIKKIGNIFENSIDALRTLRELKLLRHIRHENVIALKDVMMPIHKTSFKDVYLVYELMDTDLHQIIKSSQPLSNDHCKYFLFQRLNDIGMLRSEFPFSIINIQLKSELTIKYPLSCILIHNHQAAFEELGQFELWLYIF

SEQ ID NO: 181013 - protein, 385 aa, Glycine max
  Coding DNA Sequence Number=SeqID_64235
  Gene Ontology: Mol. function=cysteine-type endopeptidase activity; Cellular component=vacuole; Biological process=proteolysis
  Homolog annotation: Hit_ID=O64458; Match level="QueryCoverage=92%, HitCoverage=92%, E-value=1e-158, Identity=75%"; Hit description=Bd 30K
  Pfam annotation: Domain name=Inhibitor_I29; Domain location=44-103; Score=89.8; E_value=8.4e-24; Accession=PF08246.2; Description =Cathepsin propeptide inhibitor domain (
  Pfam annotation: Domain name=Peptidase_C1; Domain location=135-362; Score=252.1; E_value=1.2e-72; Accession=PF00112.13; Description =Papain family cysteine protease
  Pfam module annotation: Pfam domain module=Inhibitor_I29::Peptidase _C1; Domain location=44-103::135-362
MGFLVLLLISLLGLSSSSSISTHRSILDLDLSKFTTQKQVSSLFQLWKSEHGRVYHNHEEEAKRLEIFKNNLNYIRDMNANRKSPHSHRLGLNKFADITPQEFSKKYLQAPKDVSQQIKMANKKMKKEQHSCDHPPASWDWRYHLKCVKDVQKIKRYYREKRNGWAFSATGAIEAKNAIVTGNLVSLSEQEITDCVYKANSCNGGYHFHAFEWVIENRGIATEVDYPYTAEDHGTCKANKTQNSVTIDNFGGLIISEHSTQPETDKALLSATLEQPISVAMDARDFHFYTGGIYDGGNCSSPYGINHFVLIVGYGSLDGVDYWIVKNSFGKDWGMDGYIWIQRNIANPIGVCAINFFASWPIKEKSETLVSARVKADQRVDYSPL

SEQ ID NO: 181014 - protein, 1100 aa, Glycine max
  Coding DNA Sequence Number=SeqID_64236
  Gene Ontology: Cellular component=cytosol
  Homolog annotation: Hit_ID=Q10JI7; Match level="QueryCoverage=98%, HitCoverage=98%, E-value=1e-79, Identity=26%"; Hit description =Expressed protein
MAAKLLHSLADDNPDLQKQIGCMTGIFQLFDRHQVLTARRISQKRLPSGNSPFSDGSLERDSDNILHRQTATDTDKGVNERQRISTESSRASFSSCSSSVSSLDCKAEAEATYDRILFPETPSRDAAMNQSTTSPHFGYNSLDLRDVVKDSMYREARGLSVKTTAKEESAINAAKHRDSPRPIQLSKSVDGSYRVGIDGKQSVPIDLKESIRVLAKLREAPWYYVETKELPRSSHESKDGHWNSISKDAPWFPYEGKETSRLSFESRETIKSTPKLKELPRHSLDSKEGSLHSYSTDSKATHHSRNIYSGTSTSNDKFPTLQQPSATPSRPPSIVAKLMGLEGLPDSSLAGDAQSSSTETYSAQDNGQFRRPSKNGLMRPLRLSNSPKISLKDPTSPRRKNPDLVMKPISSSRVPIEPAPWKQQDGNQSSQKPNLRGIKAPARAPDSFPSVYSEIEKRLKDLEFKQSGRDLRALKQILEAMQEKGLLESRKVEQAPNVVGSQSDYEPKATNQNQNTRSVRQQNTQRNNFLSSTVKGSDSARAFESPIVIMKPAKLVEKTVIPASSVIPIGGLSGSQKYQIGGVYVDNNKTGTSTTRVANDQSPRNIHRDASASSIDKKASSSKTTRPVQSQSRPQQLPKENSQSSVKHSRSVSPRLQQKKLELEKRSRPPAPPSDSNKPRRQSGKKATELGSPGGRQRPKSLNLPHGDEQLSEISNESRSLSCQGDGVSLQSDSLTVNSKMDMEVTSSLRTVEIDDSRSPSLKAAKRLISETVQKKSTPRLDEEETVAELATDAPEHPSPISVLDGSVYRDDVPSPVKQISEDSKGEDAQESKENEIKDQWNPEDSLSFNSTGPLEINRKKLQNINHLVQKLRRLNSSHDEARIDYIASLCENTNPDHRYISEILLASGLLLRDLSSELLTFQLHSSVHPINPELFLVLEQTKASSLLSKEESIPGKDANSKLNKEKFHRKLIFDSVNEILGAKFSSSPEPWIQPNSNRLTKKTLSAQKLLKELCFEIEKIQAKKTECSLEEEDDGLKNILCEDVLHGSESWTDFHGYLPGVVLDVERLIFKDLVDEVVIGESTGLRVKSLVRRRKLFGK

SEQ ID NO: 181015 - protein, 66 aa, Glycine max
  Coding DNA Sequence Number=SeqID_64237
MVLLAEAALGLLGFENNGLHAGIGKIQKSRERERESRYNKHDFDVGNTSSSVFPIVQTQLLTLYGK

SEQ ID NO: 181016 - protein, 141 aa, Glycine max
  Coding DNA Sequence Number=SeqID_64238
MVRTICFGRALGRVLGKALGREVTCDADDAPNGEGPQHLHDVHHVDDAADEVHEQHQETASNDVVPDVEGFPGEPHDTSVLTDYAHYVAVTVWNEYERPELKLYSHGRKVEKFGRPTLEIEILVDAIGLSPLIACSLDTGD

SEQ ID NO: 181017 - protein, 61 aa, Glycine max
  Coding DNA Sequence Number=SeqID_64239
MKIISKRFKELDVCGKVTLKNKLQKIVYPNLNSMCPPLEKVTMDKWMNITDMRYVITSRYF

SEQ ID NO: 181018 - protein, 127 aa, Glycine max
  Coding DNA Sequence Number=SeqID_64240
MPLKGKQLVVYPCKTLWRALSIIHNHNPHVPQQVKTLVLWQKWKSLDHLKERLRAIEGGEDYAFANLEELFLVPNIITSPKFKGLDFDKYKGTTCPKNHLKMYYRKMEAYAKDEELLIHSFQESLTG

SEQ ID NO: 181019 - protein, 107 aa, Glycine max
  Coding DNA Sequence Number=SeqID_64241
MPERVFYVLLIEESNVIDRQAHPTQQHSKVHSRVANYHNLPFSGRATRGSWVRLPREGNTWSHHQCLFEGNVGKTGMCGLQTLSVKGLRVVFTHGEGISTLRVHHMG

SEQ ID NO: 181020 - protein, 353 aa, Glycine max
  Coding DNA Sequence Number=SeqID_64242
  Homolog annotation: Hit_ID=Q8S9H7; Match level="QueryCoverage=24%, HitCoverage=31%, E-value=1e-17, Identity=55%"; Hit description=MYB -like transcription factor DIVARICATA
MVERNEERIRVPLKRKDFVSIELKERMGENNNNEFHGCGGNTTSQGGDDGFDEPLYWKYPTLQDLEWEGTVICLPPKLTSLSNIFAPKVLPLLMFLPSETTTTLVPPMLSTPPTFNRTSKINCHRYRTSIAGTTLMITRIHSLLTAQRTRLLQCGQIPKAITHCHGRPVLGSPMSAGDGVKKTTGCLCLGFRNMERKIGKTFQESSKQETQLKLLLMPKSISFVRPQVIKAKEEAFMTWSYQIMVLSLIAFTRRMKFLFQILMALSLTILIIRMGFLFKIIQCRSYMKFIWQSLTTLISKIGFLDQCDKYIKSTARHHIDDCSVTTLEAHLRNFFVFEGCIACLVYSRKLSNC

SEQ ID NO: 181021 - protein, 143 aa, Glycine max
  Coding DNA Sequence Number=SeqID_64243
  Gene Ontology: Mol. function=RNA-directed DNA polymerase activity; Cellular component=chromatin; Biological process=RNA-dependent DNA replication
MCIDYTDLNRACPKDAYPLPKIDRLVDGIPGYRMLSFLDAYLGYNQIKMDLADDNKITFITESTNYCYKVMPFGLKNVRVTFQRLMDKIRSPRNMKEAQRLVTRIASLSRFLPRNVEKAKSIMNLHKKEKNFQWNDECEENFR

SEQ ID NO: 181022 - protein, 126 aa, Glycine max
  Coding DNA Sequence Number=SeqID_64244
MGLASQHMDNLWQWKARSMSGMLVMDHANRELHGQVGGWTLWHLEYLETGDREREFAKHNLQWLSARKNPEEDELSSSLSAPLQVIKRTASAHLLSETRALSQNPLMHAKRSRSALSERARTRPPI

SEQ ID NO: 181023 - protein, 119 aa, Glycine max
  Coding DNA Sequence Number=SeqID_64245
  Homolog annotation: Hit_ID=Q7XY17; Match level="QueryCoverage=69%, HitCoverage=26%, E-value=3e-07, Identity=32%"; Hit description=Emr1
MVAWPFYTKQKMNAFMLSEELGVVVRVVEKEGGVDQIKIIHDSRDAKDEDFKRMQQEEHEKVKQSSTTGQVNAEEYRLKVEEYMKFVEVQDKEMENFVAEKEKLLHAHGTGYAAMKRMH

SEQ ID NO: 181024 - protein, 135 aa, Glycine max
  Coding DNA Sequence Number=SeqID_64246
MSDDDDINDDNIDNNDGSNANGGSVVRANCDDNASDGDNDDNSGDSLGDDDVDGTGTSGSIGDDSMLVPMVVMMVPMVVVIMFFSFGPTSLTFPFLQAAFLESFKLSWKISIFTNPSNPVASFSFNIAENRCCTD

SEQ ID NO: 181025 - protein, 143 aa, Glycine max
  Coding DNA Sequence Number=SeqID_64247
MRLLIFCLRLKEPYSLSHYASDCYEQNVHSRNILPERNVALYVTEYDEFHRELKRRRWHRALTRQPDEHIDVALFDAETLNAFLEIPVVLEPGESYTTYTRFYRTRLDPQELASKLCIARRGFVLNAEGAPWKLLRKDLTTLA

SEQ ID NO: 181026 - protein, 210 aa, Glycine max
  Coding DNA Sequence Number=SeqID_64248
MAQSNSSRLGFPALITALCIARGVVPDSLTFESLSHAINLAYIRKNCWNPDNPTITFPRTHKAKAWGPSNASTSAPSSYAPPSSSSSTTIYTSLRTLRPFRSEHRDFSANAAEPSPWLMPGEALIAQESQPEPEATPEVTPEETPEIAPAATPSEAPEEGDGAADIDYVADMAAAQSSWDPWPTPALDTPVLAQDTPSVPQDDHTLAQDD

SEQ ID NO: 181027 - protein, 66 aa, Glycine max
  Coding DNA Sequence Number=SeqID_64249
MAKSQLAWVSCRGLSKGFQGSALKDIERIEREEEERRENEAEALLNHDRDRPLHCSLFSVLRVAVD

SEQ ID NO: 181028 - protein, 391 aa, Glycine max
  Coding DNA Sequence Number=SeqID_64250
  Gene Ontology: Mol. function=hydroxymethyl-, formyl- and related transferase activity; Cellular component=nucleus; Biological process= biosynthetic process
  Homolog annotation: Hit_ID=Q7N3P5; Match level="QueryCoverage=99%, HitCoverage=91%, E-value=1e-114, Identity=45%"; Hit description =Similar to proteins involved in antibiotic biosynthesis
  Pfam annotation: Domain name=Condensation; Domain location=1-163; Score=-101.9; E_value=0.0039; Accession=PF00668.10; Description =Condensation domain
MWHHLIGDHSTLAVMQEEINLILAGRGDELAKAPPFRNAVAQARLGVSKAEHERFFRTMLADIDEPSLPFGLSDVHGEGRDISTAHLALPPALNQQLRRQARRLGVSLASLCHLAWAQVLARATGRDEVVFGTVLLGRMQAGDGAERALGLFINTLPLRLDVNEVGAESAVLQAHIRLSGLLAHEHAPLALAQRCSGVAAGTPLFSALLNYRHNSGEDTALPTGVTLLDSQERTNYPFVLSVEDGGDSLGLTAQVRQPIEAQRVCGYMAQALSALAQALEQAPQTPVCELEVMPDEEYALQLCRWNHTAEAYPADTCVHELFEQQARLTPQAIALIQDAQRLSYAQLNARANRLAHRLIERGVQPGDRVAVRLARSIELVCAQLAVIKAGA

SEQ ID NO: 181029 - protein, 97 aa, Glycine max
  Coding DNA Sequence Number=SeqID_64251
  Gene Ontology: Mol. function=RNA-directed DNA polymerase activity; Cellular component=mitochondrion; Biological process=RNA-dependent DNA replication
MSASYSTCLFEALKLSLRACSRVILLGLSRMIPAPLPFTLDAPSTVACFILNVELWQFDKLVYHPSYKFRLSQNLLDRVVHLDYHLMTLEVGPKSSR

SEQ ID NO: 181030 - protein, 137 aa, Glycine max
  Coding DNA Sequence Number=SeqID_64252
MGARDMTFMHKAGHEVKKEYPGLVEVSPMCCRPGIPGGSGGAEVEGAGAGEGASAKEAGAGRAAEDGPSDPQARALRVPGNLIVGSSRFQQFFFMYAKLMARLRDSKVRESDTTPWATQSAEMRAGKLSLEELDWAI

SEQ ID NO: 181031 - protein, 32 aa, Glycine max
  Coding DNA Sequence Number=SeqID_64253
MAWVTRDPLGFISEFTAQTNKFILITICFKRK

SEQ ID NO: 181032 - protein, 84 aa, Glycine max
  Coding DNA Sequence Number=SeqID_64254
MIVESIKRELERCEAEKKALEKRRLLARNYWLEHRMSLPRYLKLSQMLNLNSNRCTSSMVASTNDSTRKCRRTVTCRHGEIKAH

SEQ ID NO: 181033 - protein, 89 aa, Glycine max
  Coding DNA Sequence Number=SeqID_64255
  Subcellular localization annotation: CTP_CleavageSite=71; ConfidenceScore=5.64e-01
MSPPPLGPHNHSHSSQALGTASSSSSGLCISSHTNSLKHSGTWTFLSLENHHMQKLLGKNSQTSFSKSDFRLKYVALFVLVRLAQFLTA

SEQ ID NO: 181034 - protein, 111 aa, Glycine max
  Coding DNA Sequence Number=SeqID_64256
MGGKRKKSNDDDDVEAKALEQGEAIRATSKTKAPEEAREVCQGQGLRHCSQESSQVWGASPHLPSSLLMLALNDVVVATVFLGIPCIRGVPLVVRRRLGERESNATFLALF

SEQ ID NO: 181035 - protein, 55 aa, Glycine max
  Coding DNA Sequence Number=SeqID_64257
MAIPVVEHDSDEKITRWGNGIRVKVKRKEKMVIFQDFIQSFAQASNQLTWANQVF

SEQ ID NO: 181036 - protein, 219 aa, Glycine max
  Coding DNA Sequence Number=SeqID_64258
  Gene Ontology: Mol. function=RNA-directed DNA polymerase activity; Biological process=RNA-dependent DNA replication
MGFNLTWRKWIKACLQSATISILVNASPTKEFVPTRGLRQGDPLAPLLFNIVAEGLTGMMWVATAKNLYRSFMVGKHKTYLRWKRRHELHKRELDNVVAVTEAQPGLRQTRTQTEGETIITPWEYPFRDSFVSYFSSTCESEQMLKLRTPNVKTKGCTSMDKWQRRSPQCGCSHGSAGQFDTKTISGRRRKKKNDRVQARGLCNFRSLLSHDNNIGFLK

SEQ ID NO: 181037 - protein, 222 aa, Glycine max
  Coding DNA Sequence Number=SeqID_64259
  Homolog annotation: Hit_ID=Q2KK36; Match level="QueryCoverage=56%, HitCoverage=73%, E-value=4e-08, Identity=29%"; Hit description =Prenylated rab acceptor family protein
MILYCTQSTKSSNEAYNDCKIHILNANDPRTHHVHPHANEHQSHECRCHKNHHHHSIIHPGAEHHHRLVVEEVEEEPCHQVHDDRDWVLEKAREQNHDEVVHAKVVEVASHMHHRFFHRVRVREGVEREHLFQWSARGERRTRGCRGACDQIGVFYQSHRWTCFRYSASEKEQVMKCLEAAIECQGVRLELCADNRVGLLSDINPSSPREQPRHRSSRHRNT

SEQ ID NO: 181038 - protein, 245 aa, Glycine max
  Coding DNA Sequence Number=SeqID_64260
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=5e-27, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLSPSEGYTPSPSEDYWSSPSEGYTSSPLEDYTSFPSEGYTPSPSEDYTSSPSKGYTSSSLEDYTSSPSEGYTPSPSEDYTSSPSEGCTFSPWVLVPSPSEGYTSSPSEGCKPSPLEGYTPSPLEGYTPSPFGGLDVLTLGTSTLTLRGLHALAFRGLHVLAFRGLHALAFKELHALAFRGLHILTFRGLQALVFRGLHSSPSENYTPSPSEDYTSSPSKGCTSSLSEGSTSAPLENSRSSALNA

SEQ ID NO: 181039 - protein, 44 aa, Glycine max
  Coding DNA Sequence Number=SeqID_64261
MGFAGGSGSKPTTFLTQITCYKCYRRGIFREIAHIPRRSKMVGV

SEQ ID NO: 181040 - protein, 198 aa, Glycine max
  Coding DNA Sequence Number=SeqID_64262
  Pfam annotation: Domain name=Dabb; Domain location=10-97; Score=40.6; E_value=5.4e-09; Accession=PF07876.3; Description=Stress responsive AB Barrel Domain
  Pfam annotation: Domain name=Dabb; Domain location=110-198; Score =2.6; E_value=0.032; Accession=PF07876.3; Description=Stress responsive AB Barrel Domain
  Pfam module annotation: Pfam domain module=Dabb::Dabb; Domain location=10-97::110-198
MSSTSQGTVVEHVVLVKVKDDTEPTKVNAMVNAMNSLATIDGVKHLTVGPLLRNGPTTTTSGLRFTHMLHNRYNSKEALEGFLFPVCDDLMVVDWVAGGVNLPPLAKGSALRVSFLKLKESIYEEVKDEALSVVRGMEHGVAGVLWQFSYDENFSPERAKGFTLASLAVFPEREELQSVELDEGLGVVVEDVVVVDYV

SEQ ID NO: 181041 - protein, 336 aa, Glycine max
  Coding DNA Sequence Number=SeqID_64263
  Gene Ontology: Mol. function=transferase activity; Cellular component= membrane; Biological process=metabolic process
  Homolog annotation: Hit_ID=Q1S2I4; Match level="QueryCoverage=99%, HitCoverage=86%, E-value=1e-175, Identity=86%"; Hit description =Exostosin-like
  Pfam annotation: Domain name=Exostosin; Domain location=7-300; Score =241.6; E_value=1.7e-69; Accession=PF03016.6; Description=Exostosin family
MEKIFKVYVYPDGDLPIAHDGPCKDIYSIEGRFLHEMEHGAGRFRTNDPNAAHVFFLPFSVTWMVKYLYTPLSFNVTPLKKFVSDYVRVVSTRHPFWNITHGADHFMLACHDWGPHASQGNPFLYNTSIRVLCNANTSEGFNPRKDVSLPEIHLYGGEVSPKLLSPPPDTAPRRYLAFFSGGLHGPIRPALLGHWKNHDENDVIRVYEYLPKDLDYYSFMLTSKFCLCPSGHEVASPRIVEAIYAECVPVILSEYYVLPFSDVLQWEAFSVQVDVSDIPRLKEILSAISEDKYRKLKEGVKAVRRHFTLNRPAKRFDVFHMILHSIWLRRLNIELR

SEQ ID NO: 181042 - protein, 142 aa, Glycine max
  Coding DNA Sequence Number=SeqID_64264
MEIPRKYLLSPILSLILLSFIIVVVLRPCQLLEFAPIIAGSKPAYSVPLDSLRTKLSSENQLHAVGNSGELRRNKFRNRTATRKVGKLEQRLAAARAAMRKVASESEGERSNLSVATTARDDSYHRYVPAGAIYRNARLFYR

SEQ ID NO: 181043 - protein, 85 aa, Glycine max
  Coding DNA Sequence Number=SeqID_64265
  Gene Ontology: Mol. function=DNA binding; Cellular component=nucleus; Biological process=regulation of transcription
  Homolog annotation: Hit_ID=Q0PJE9; Match level="QueryCoverage=91%, HitCoverage=33%, E-value=1e-20, Identity=69%"; Hit description=MYB transcription factor MYB121
  Pfam annotation: Domain name=Myb_DNA-binding; Domain location=10-57; Score=17.9; E_value=0.037; Accession=PF00249.21; Description=Myb -like DNA-binding domain
MESKASCEKERPWSYEEDKIPMKYVQVHGERNWRNLFERASLKRCGESCKHPWLNYLKPTTTHNPQRKHFFRRRAHNQTSPALGE

SEQ ID NO: 181044 - protein, 120 aa, Glycine max
  Coding DNA Sequence Number=SeqID_64266
  Gene Ontology: Mol. function=oxidoreductase activity, acting on NADH or NADPH; Cellular component=mitochondrial inner membrane; Biological process=electron transport
  Homolog annotation: Hit_ID=Q10MD5; Match level="QueryCoverage=49%, HitCoverage=34%, E-value=1e-15, Identity=66%"; Hit description=ETC complex I subunit conserved region family protein, expressed
  Pfam annotation: Domain name=ETC_C1_NDUFA5; Domain location=74-120; Score=37.0; E_value=6.4e-08; Accession=PF04716.4; Description=ETC complex I subunit conserved region
  Subcellular localization annotation: CTP_CleavageSite=80; ConfidenceScore=5.15e-01
MFQCFVLVVIVTQPNPLGLQGTSRGKPYVTSILHNSAFESLHDLKSSMAALMNSSTMVLQVKALTKIVGLDMVLNAREVLVGLYSKTLKEFRKVLKDEGYHNAMESFTKHRLSVCKEEED

SEQ ID NO: 181045 - protein, 101 aa, Glycine max
  Coding DNA Sequence Number=SeqID_64267
  Homolog annotation: Hit_ID=Q2HRF3; Match level="QueryCoverage=64%, HitCoverage=14%, E-value=4e-07, Identity=44%"; Hit description=SDL-1 protein
MEEEGVVILNKNCEEVTLGEIERDATDKDISEILALEDPWQRLLHPAEVLIVRGEVKGPVREVREGRVVGLEERVDAAIRVVTKGGSDGGDGHARELVVIW

SEQ ID NO: 181046 - protein, 347 aa, Glycine max
  Coding DNA Sequence Number=SeqID_64268
  Homolog annotation: Hit_ID=Q2QVB3; Match level="QueryCoverage=43%, HitCoverage=35%, E-value=2e-27, Identity=41%"; Hit description =Expressed protein
MKNAMDLEDHEHDLTLALRCGSPERTTHSSSPSLPQINISLMELQMPYPNYLVPFSNHNIDPLLVSCSKLNINPSLVSSSNNNTDHPLLAMSPSNPAGAAAPTPVLRRRPRRASSQRRRRSQGKSETIPAPFPWATDRRATVHNREYLLQNNVIAITGRVQCGRCGYEFEMTLDLEEKVNELSKFIRKKRRSMHDRAPAAWVNPVMLKCVYCGRENCTKPTLLYTKKREINWLFLLLGQMLGFCTIEQLRYFCKHTNNHRTGAKDRLLYAAYMTLSKQLVPECFEGLSTSILIRGGNIAGVVENSRSHNIGSLTVLEGHGYKDGHRSRSDLESGGFYIGYDSITDVE

SEQ ID NO: 181047 - protein, 201 aa, Glycine max
  Coding DNA Sequence Number=SeqID_64269
  Gene Ontology: Mol. function=DNA binding; Cellular component=nucleus; Biological process=DNA integration
MLNLEFEVKDLGRAKKILGIEITKNRNKKEQEPKSDEEVTYMLKVSYISAIGSIMYSMVCCKPNLSYSMSVVRKFMANLGKRHWKATKWVLKYISRTTDVRLKYVNHGEVPMIERYVDSDFARSINSRKSIVGYVFKVFQNIGSWHANLQSVVAFSTTEAKYMSASKVVKEPLWLKGLVLECNDPPRRYDITTLNRKNFNF

SEQ ID NO: 181048 - protein, 102 aa, Glycine max
  Coding DNA Sequence Number=SeqID_64270
  Homolog annotation: Hit_ID=Q1SKA6; Match level="QueryCoverage=57%, HitCoverage=7%, E-value=4e-09, Identity=50%"; Hit description =Rad21/Rec8 like protein, C-terminal; Rad21/Rec8 like protein, N- terminal
MVYPSGTRHESLKHVVKGLNPDECIYGENLVEREIPLMSANRIFYKKVEYVLEDCNEVLVKINKFVVNKEGLVCVETLCMPVTKPERFELDAFELDEPEDAG

SEQ ID NO: 181049 - protein, 101 aa, Glycine max
  Coding DNA Sequence Number=SeqID_64271
MEKIRIQRVCVKREIVKQNLEKDEVSKNKAKQTDINEVQEALKTSSKKTTSVKKKETVAGESSTSTTKKRKTLLIRASNDINVIMELRKKRRTTNKSSRTN

SEQ ID NO: 181050 - protein, 58 aa, Glycine max
  Coding DNA Sequence Number=SeqID_64272
MEGRGCCEMYVASMRKSFKDSLKVLEADIQHANTLVITVAKGWWPVNGSYPSSLFIFL

SEQ ID NO: 181051 - protein, 125 aa, Glycine max
  Coding DNA Sequence Number=SeqID_64273
  Gene Ontology: Mol. function=nucleic acid binding; Biological process= DNA integration
MARGGHRWSVVVEEELGVLEEDLGEEEEEEDGWCYIKLLQVKELETTTVHCNSQSVVSLSKNQVHQDRTKHVGVKYHFIKDVIKGGVVAIKKIATWENIADMLTKALLSKKFNYCLQLLSVISLK

SEQ ID NO: 181052 - protein, 128 aa, Glycine max
  Coding DNA Sequence Number=SeqID_64274
  Gene Ontology: Mol. function=RNA-directed DNA polymerase activity; Biological process=RNA-dependent DNA replication
  Pfam annotation: Domain name=AT_hook; Domain location=60-72; Score =14.9; E_value=0.061; Accession=PF02178.9; Description=AT hook motif
MCGKTRQDRIRNEAIRERVGVAPIVEKMMENRLRWFGHVERRPVDSVVRRVDQMERRQTIRGRGRPKKTIREVIKKDLELNDLDRSMCHQEEQAYFTFYFIGLLLSSLHRLYPILLSQTNSAHLVSLR

SEQ ID NO: 181053 - protein, 107 aa, Glycine max
  Coding DNA Sequence Number=SeqID_64275
MGCTHGPEIYPKAHKNPRAFSCISGPIYLEFSIQCPCGVGLHHQHTSVKAQLKKLEVDMPELFLELERLVMEMGKSALLTTACGNNKATKSQANQKGNDRIPPQADI

SEQ ID NO: 181054 - protein, 70 aa, Glycine max
  Coding DNA Sequence Number=SeqID_64276
MRFLRRSYLAGTVARGEIEVFEIGNRMQHTARALNIGEVVAILKETIDGIEGGRDDEVVVVDKGDEGDEE

SEQ ID NO: 181055 - protein, 346 aa, Glycine max
  Coding DNA Sequence Number=SeqID_64277
  Gene Ontology: Cellular component=membrane
  Homolog annotation: Hit_ID=Q6CWV6; Match level="QueryCoverage=99%, HitCoverage=83%, E-value=2e-24, Identity=26%"; Hit description =Similar to sp|Q03730 Saccharomyces cerevisiae YML018c
DIFVDYKQPFAVTYLGASLMVVYLPVAFIKDWLCKLFEHRSSRSGKSAKVGDEFSVRCTSPLKGNGVQKNIEVELGGMTRKDSDANLSAHEEVKPLMAKYNDATAIKVEKEHTTREIATYGFYIAPIWFITEYLSNAALARTSVASTTVLSSTSGLFTLFIGVLMGQDTLNVSKVVAVLVSIAGVVMTTLGKTWAADDAISSASNGQRSLVGDLFGLLSAMSYGLFTVLLKKISGEEGERVDVQKLFGYVGLFTLVALWWLIWPLSALGIEPKFTIPHSARVDEVVLANGFVGSVLSDYFWALCVVWTTPLVATLGMSLTIPLAMMADMVIHGRHYSALYILGSIQ

SEQ ID NO: 181056 - protein, 113 aa, Glycine max
  Coding DNA Sequence Number=SeqID_64278
MVEPSKKRKGSSSRSQRHSEAQETQIPSSISSSLLFSSEEQQIRYTNLFSSRSITNPKFIDMDFFSNENFECIQAFENSNLIPFMSLKLPVYSELVKFFYSNLEIQESTLISE

SEQ ID NO: 181057 - protein, 86 aa, Glycine max
  Coding DNA Sequence Number=SeqID_64279
MGLLLAKCGTWIISNTPPHDKHFLGLGREQQMVGVCHHKARTSESVVPGSELALIPYPTYYLANQNLQAYHSPYQARCVFSTSIRT

SEQ ID NO: 181058 - protein, 106 aa, Glycine max
  Coding DNA Sequence Number=SeqID_64280
  Homolog annotation: Hit_ID=Q40287; Match level="QueryCoverage=56%, HitCoverage=12%, E-value=2e-07, Identity=41%"; Hit description =Anthocyanidin 3-O-glucosyltransferase
  Subcellular localization annotation: CTP_CleavageSite=47; ConfidenceScore=5.16e-01
MLSAQAANMTINTKAQASKMMDTTAKAAMMMNKYYSSAWWHLDTALRIMMQRRVTMQSFSSTMPLRSGEGMLMMRQREGVRTELRICISVREVWEVTARMVTLKLW

SEQ ID NO: 181059 - protein, 69 aa, Glycine max
  Coding DNA Sequence Number=SeqID_64281
  Homolog annotation: Hit_ID=O04379; Match level="QueryCoverage=59%, HitCoverage=4%, E-value=2e-11, Identity=69%"; Hit description =Protein argonaute
CSLPGWPGVTKYVGLVCAQPHREELNQDLFKCWKDPHHGIIYGGMIRNENSSMSEDQTSDHVMETLVVV

SEQ ID NO: 181060 - protein, 897 aa, Glycine max
  Coding DNA Sequence Number=SeqID_64282
MEREANKELEKELIMYKKEAMEQHEKGFQKAVRQAGFFAKDLIWVFSIVPRTMNRPLWQEWNFLWRRKKNLGDVGSKALVMSCHSCNDASSSLCGASPLIVCMTFTLIEGLTDHSDGSLSYGTLTFDYGVVVLEGVNLGFNEPWTRDVFALSFDKPVKLHRGLPRTDLGFCEPVKVLDLTSLWRINQLHVHPGFWRHSPRVDLRFDELGVSSARDMLLQTCHFLEWHILETWCLSPGTYWRLDQGIVCLGFWRDSLRTWVPTLAYMSRVEWYVLETWGCALTYMSPMEWHILEKSGRVLAYVSPVEWHVLEPRGCALAYMVDLGFDKPTAHVSCSYIQGRALTYVSPVEWHTLEMWGRALAYVLLVEWHILETWAHPLALGSLMEWHVLKTRPGNFPSYVLARLTKSEPLDDCVGCLCLTISLGMFDRGEKEGIPTYEVFLGELLHLVGCDFLEWSFLNPLGEVVDRPQEDQTIEIVRRGAWNVYKLLASSASLCEIKGAIPECRLVVADAHHIGCERVSPGGHLATFLLFSSHKFFGVYGRSLEHLMDYSVEDYFLGLVSGCNLPLDKLQDDSCPTPLHVGRAVNVEASPVWVVWSFLENFSRKSTMTCVFIGSWGSYWISNSGKFYGGYSWPGSTQNWRCGNGLLEGRQGLFASLIPKEWVSFLEKFVERLRFFNELGDKPRQGCYSSIQLLEFQDVSRTAHLQNNCAFVKASKKLNTWNLDTPSTCLSMMGKGYSLTALRCSSPIFLFFCDISYAFMLMAIEVPTKLHELSGPFVYAYDMSGTIHYGTKAPCVRIGCHFQAFLLTLLCLLLICLDSHNFSCQDINGATLVDKYLRHYEVGNYDGDNHGVVLVDEVNTLKSLSVKVIASRLHGDGESTRDGVDYFSDLLGRLLFL

SEQ ID NO: 181061 - protein, 188 aa, Glycine max
  Coding DNA Sequence Number=SeqID_64283
MSRSRRWIDINPELEHLLANAPINHDTAAPPDAIFVTVSVRDQDMLEGLWHLVDRDGTYHTVVYNRDLDQLAIVAGWTALRHFYHLTANHLVSLNHFGKSVFFIKILRVPCLPKSFPKWHSLYHQVSGSVTFKVFLTEQKISCSNLHNDAILPRKGPITRAMRWRLQEDWARAVEEGLRILMNLRVDC

SEQ ID NO: 181062 - protein, 104 aa, Glycine max
  Coding DNA Sequence Number=SeqID_64284
  Subcellular localization annotation: CTP_CleavageSite=27; ConfidenceScore=5.09e-01
MKKSTNGTLVKTKTKHANEAKAEASIRCSSRLTNCEVNSKEEKTNAGNSNQRTSLTSITSPTLLASGVALLSKLELIHDSFGFWLTCMYIGLWDGLFTLSVKLK

SEQ ID NO: 181063 - protein, 37 aa, Glycine max
  Coding DNA Sequence Number=SeqID_64285
MVASGGIGVVHGGSMVIHGEEAFLHNNLGQGWSKAAL

SEQ ID NO: 181064 - protein, 91 aa, Glycine max
  Coding DNA Sequence Number=SeqID_64286
MTTSLTGTTPPTVTSLSIFVGLSHHEETLWGGSVGERGTKEGFLIHGHTLMNLTTWFQIRALCCLKGGDSATMTVGLSEREGLLGSAPMTG

SEQ ID NO: 181065 - protein, 133 aa, Glycine max
  Coding DNA Sequence Number=SeqID_64287
MTRTKSEKKIISVIVDILRVYSQGPRKEFANLMLEEEKEVEALINAKDFRFLGFIVGKEKDLMIFGKIAFGRSSHTYGSKFSRSIFTYFSSAILRLSLEKLKLSLKASKSSFVAVSLRLCVENSRLSDKPLFE

SEQ ID NO: 181066 - protein, 110 aa, Glycine max
  Coding DNA Sequence Number=SeqID_64288
MKKIPGLQAPMELTPHKFLIYHFFICQDVPSTMYYFLKDKGWYNLHLGNVAECQLVFNHHRKSLKTGAGWKQFCQILSLDAGMEIVFEFINPCVNRILYWLCSIDEMCYD

SEQ ID NO: 181067 - protein, 119 aa, Glycine max
  Coding DNA Sequence Number=SeqID_64289
MQGSTFRDRGNWSVLPHYNLLPYPQQIPTRLSGNSTLDNFGCHKIYRQSKIDLEERVNGSCRSAPVAPPTRAFFHPLLQLLNHDLYWGKVKRKGRATKTMGPKLTPEGSARVCEGKLQS

SEQ ID NO: 181068 - protein, 89 aa, Glycine max
  Coding DNA Sequence Number=SeqID_64290
MEDKIMWVGGEDITPKYLGGDIVLLMRLTDTRAKEICRESAVNGMTLFYSLEKRHPKNIKKIVSEVGEIVEVDEEVIDLRRLDKARVLI

SEQ ID NO: 181069 - protein, 105 aa, Glycine max
  Coding DNA Sequence Number=SeqID_64291
  Gene Ontology: Cellular component=integral to membrane
  Homolog annotation: Hit_ID=Q9SEW5; Match level="QueryCoverage=91%, HitCoverage=50%, E-value=3e-36, Identity=69%"; Hit description=Amino acid transporter c
MALFGLVQIVMSFIPDLHNMAWVSVVAVLMSFTYSFIGLGLGIATVIIFQALGDIAFAYPYSILLLEIQDTLQSPPPENQTMQSSTCAVDALDMQLLKMIHQETS

SEQ ID NO: 181070 - protein, 108 aa, Glycine max
  Coding DNA Sequence Number=SeqID_64292
MGQNRYKISYITDVENCFCSSDCILRIEALDKSVKAIDRPWRKSTISGTQAMCEWSIGRPKVVSHEPLADCVFDMAAGSGLKLSKEVLHLSLNRVLTMGEREISRDRE

SEQ ID NO: 181071 - protein, 108 aa, Glycine max
  Coding DNA Sequence Number=SeqID_64293
  Gene Ontology: Mol. function=DNA binding; Cellular component=nucleus
  Homolog annotation: Hit_ID=O04696; Match level="QueryCoverage=96%, HitCoverage=30%, E-value=6e-26, Identity=60%"; Hit description=DNA -binding protein PD1
  Pfam annotation: Domain name=DUF296; Domain location=1-89; Score =56.8; E_value=7.3e-14; Accession=PF03479.5; Description=Domain of unknown function (DUF296)
  Subcellular localization annotation: CTP_CleavageSite=34; ConfidenceScore=5.14e-01
MSGTGTVSLVTLRQPTSTNASVTFKGQFQILCLSASYLVAEDGGPLNRTGGISVLLSSPDGHVIGGGVVVLIAGSPVQVMLCNFDYCDSKTKSKQATTLKDESSEQPP

SEQ ID NO: 181072 - protein, 210 aa, Glycine max
  Coding DNA Sequence Number=SeqID_64294
  Homolog annotation: Hit_ID=Q6Z4M4; Match level="QueryCoverage=76%, HitCoverage=27%, E-value=3e-09, Identity=28%"; Hit description =Fibroin heavy chain-like protein
  Subcellular localization annotation: CTP_CleavageSite=55; ConfidenceScore=5.00e-01
MKGFMKTPPSKILFADLTANKDQSRRNQANAMKSCEPETARRRRDSLDQTVLDASAEVVTRPNEPSNGSSELKLGPSRNFGATIEQPSNSTSSDLNIVLVSQVAQPSDAPLQFSTSFLSFASVSNGKNEGLDVGISREDEMEEEAPETSNNTTELSLGSFGGFAINSSPNPSMPKTNPFGGSFNNLATSLSSSTVTFSVPSGEMFKPASF

SEQ ID NO: 181073 - protein, 54 aa, Glycine max
  Coding DNA Sequence Number=SeqID_64295
MIRKATSEKAHPGIMGRHKTEKGSSKSGCRAFTNLIAKDWPKSFTLLPYCAPLN

SEQ ID NO: 181074 - protein, 74 aa, Glycine max
  Coding DNA Sequence Number=SeqID_64296
  Subcellular localization annotation: CTP_CleavageSite=36; ConfidenceScore=5.30e-01
MWYWGVEGVIGAAAPGGGVVPGGGFGTVSSTGGFAGAGSRGGFGAFSSKGSGGFGAFGSGGGSKPPELFTKMRK

SEQ ID NO: 181075 - protein, 73 aa, Glycine max
  Coding DNA Sequence Number=SeqID_64297
MMIIVRKKVPSIEKARWWSLENRCHPSLERMGFESPSSERVHFEGARRRKGKEEKMHSERLRRKGNEKNESNK

SEQ ID NO: 181076 - protein, 79 aa, Glycine max
  Coding DNA Sequence Number=SeqID_64298
MENKESKKAWMEKKTERRRRQREGDETYLGMVAKEKKQRLVTMLECDEDDARVQRTRCSDADKDGFARRRLEEEESAKA

SEQ ID NO: 181077 - protein, 144 aa, Glycine max
  Coding DNA Sequence Number=SeqID_64299
MTNNDEIYWGQHTTQAQKRKQIPITRERKETKQSGFHWIVTGGHLSKLEISRVIRGSKRWWFPQFVFVVRGLWRNIKAGNECGDMVHGQEHSCWFVPFLEQGYWKLIQALSNLEEFYTRRIWILCNVALFSISTTRIWKEGYNR

SEQ ID NO: 181078 - protein, 616 aa, Glycine max
  Coding DNA Sequence Number=SeqID_64300
MGVQKLNGDNFTQEEDPRVSSVLLRMLLYKEYPNEAQYCYDFGPVWNKMIKEKQKEKKHKKDKKDKEKRESKEKREKEGRDGKHKEKKDKKEKHREKKKDKDKDKDKSKDRDKSKSSSADDKGFPRQAEGLNAGKPHQKEIKQDDKKGILFENRLTKQYAGNNGEKAREKNHLAEENKDSKFLLELDRRIRDDDGGADNQLVHKFTNTNHRKDEGTVRLVAKGPGGTRSDGNEKLKDMGLHVKKMDGRGIQDEVRPIGNTPPVQNHVGNFHPGVGGIPKLLGKYFERNLEATVEGKEKVKEKKDEKKKAKEKTEERKVKENKDEGKEKVKEKKDDKRRDKRKDREKEKKGHGKDKDRDKEKKKEDKAKEHSELKTTEQNKLKESNKVGIINSNSFTQPFRNSHGNAVSGENLKKRKDIESNGVPHVNDSLPNKFPKLSSSHPFTENGRVLEPCQVSIPNASDRPREATSVKVEKKESKMNGIIESQPFAASSNKTQTANVSADLVTEASAKPLHPDTKYLGQVYSVPKVEQWSDFDDQEWLFGSNVSQERKSVVKSSEVWETPQGNICWYCQIGGAALTLCVVVIHLDNREFVQVVERGRGEVQACATCFSFFAES

SEQ ID NO: 181079 - protein, 73 aa, Glycine max
  Coding DNA Sequence Number=SeqID_64301
MATSQSLQIVKYQWVGGSPVQQGKERHCGGTGDKAWIKETESLPMKRPRVALHETCNTIVEKKYLESTIAGSL

SEQ ID NO: 181080 - protein, 93 aa, Glycine max
  Coding DNA Sequence Number=SeqID_64302
MARREPNQREKMSLCVFDVQVKKWWKGRLRRLRFPIMGRGGGPGGSFLVLNNDDSPPLKPASSSSASPLTSSSTSSTTRWCATSTSLPPCAPL

SEQ ID NO: 181081 - protein, 166 aa, Glycine max
  Coding DNA Sequence Number=SeqID_64303
MGSKSTLRLTRTLGPFLGSLAQSTWSLLANALAGIPQRITPTPEAKYMHVGYANSTGEKYPCMHHSPMHPTPCLPRHSMGYANMGGGIPMLVITLVPLAGHQYDWRKQWKKYKVHPATSNGGTNGRDLASLTGGTKHGWMALMDDGMNGMGYLTSGIGETLWVDLR

SEQ ID NO: 181082 - protein, 115 aa, Glycine max
  Coding DNA Sequence Number=SeqID_64304
  Gene Ontology: Mol. function=geranylgeranyl reductase activity; Biological process=chlorophyll biosynthetic process
  Homolog annotation: Hit_ID=Q8GZB1; Match level="QueryCoverage=95%, HitCoverage=60%, E-value=3e-27, Identity=50%"; Hit description =Geranyl-geranyl reductase
MWLHGIYFAAKSGRVCGNGVVKASEGGDKMIGECDLRREYLKPWDAEVFYGSNACREALVELCGDEYVQRMTFESYLYKKLARGRVLDHAKLLMNTVGSLVRSKVVQTSMENFIL

SEQ ID NO: 181083 - protein, 300 aa, Glycine max
  Coding DNA Sequence Number=SeqID_64305
MPVLVRVPSSGYFWKDVCGGGCGLAMTISDDNDESIATGSEISDVASWETVNDDEMEVLEDSREVCYNTCKKPIKDSQFAAHAELCRSLQLTKQTMLELDDNIGNRKPPRKEKKKLGASSANQASARREQRRSESLDNIDFALSQSYLNSQVRVVPFPNEVTGKLFSSNTSFEYKTVFYMSSEGKNLLHEGVCPYEDPASSTSEKGVPPLAVARELRGCRQADWRDSLRERCLAAPTGEKASTVGLQCLGLGFAVLKRLVFAVLFLFLLECELVVPVFVVLPWFKFRSNLVLVVLPSFKF

SEQ ID NO: 181084 - protein, 58 aa, Glycine max
  Coding DNA Sequence Number=SeqID_64306
MDEEYDVIVLGTAKLLLHAEERRNDALLKSESCKGDKVTLLARIGELDDIIEIEDTRD

SEQ ID NO: 181085 - protein, 185 aa, Glycine max
  Coding DNA Sequence Number=SeqID_64307
MHSKTLNMKGDSRGSITTLRYFIYSNLTRNTLKRQSPKSLQELAQGTSILCRHDQVHIEATKGTKVVIGASSNFSHIKVVTKHILKEHSDLVNEVEELKGHEGSSASFARVVIGGETAAKAVELHFLGDRSGVGVHNLLEAGDPGSEVVNGKGSRRRGGMWGGNVCGYVQRWERAGCGKGERTML

SEQ ID NO: 181086 - protein, 118 aa, Glycine max
  Coding DNA Sequence Number=SeqID_64308
MRCYNSTPLKRSFVPKTLPKDRKGYYASGSQYQDVCPIEAPFSDFNQKTPLHLVTKSDNSRFISETYTSMSEHGVLSEHGVPTSFSIRFLKAIHLVFCSPEHKVQDHHRIQTQTTHRE

SEQ ID NO: 181087 - protein, 205 aa, Glycine max
  Coding DNA Sequence Number=SeqID_64309
MSSFLSNSTIGMGGSDFRGSIQQPLMDWKVIFISGLSSEDTHRGASDSESSSSDRLKVSCRTGGGTSGLHGRVWPSTASPAKELILVTVISPLLLLGDQGEVRDDVMKYKSPLTSMVSVAALQCQVKLANPKDSSKIVVQACESDNFPFLRVASANSPFFFMYRCQIEVLGLVLPLIAFKCALLEHLNLAPFPNPPKQLGHGESL

SEQ ID NO: 181088 - protein, 273 aa, Glycine max
  Coding DNA Sequence Number=SeqID_64310
MAGKIGWVSLNNMSKNLFEFNSSLFCCFKVLATDVVADGIIGDFAWRPLVKGQPAGEVGLVVSVIESRAPLSLRAPRHVARLTPSLSHPSSLEDGPLALTTVEVPGSTIVIVATPAPPPPPTIHAAAVGVLATSAGFIMASSSTVATPLLSVGVATMNALVMLPPPSSAPPIPPSVVLVVASLSLSFHPHVSLDHLYTSSNADSLCGANYKLEQKTLGAKHYGLCQSLPPQKFGDSGGEWTTTPKGSTQGVVLVDRPKGGLLLAQFGNRSALR

SEQ ID NO: 181089 - protein, 175 aa, Glycine max
  Coding DNA Sequence Number=SeqID_64311
MPPITFIINDFKAIDSMQDDPMVISVEIANYIVKKNLIDQGSSADILFWKTFKQLYIPEFEILPHDDPLFGWGIGRDKGLHLALHQVRTWGATIEKNHYNRACRPKDEQEMLHGQPYVRPSHEGGNPEVVHCIEARIEAEKVEELELYPITNDNNRVTLVEEMTVQLLASAPDRT

SEQ ID NO: 181090 - protein, 61 aa, Glycine max
  Coding DNA Sequence Number=SeqID_64312
MSRKQMKERKNRAKKIRGVKKILVGNLDPDVTNDHMKQVFGPYGELVVVAIPIGNFFIFDV

SEQ ID NO: 181091 - protein, 333 aa, Glycine max
  Coding DNA Sequence Number=SeqID_64313
  Gene Ontology: Mol. function=protein binding; Biological process =primary shoot apical meristem specification
  Homolog annotation: Hit_ID=Q1S365; Match level="QueryCoverage=98%, HitCoverage=29%, E-value=7e-89, Identity=50%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=WD40; Domain location=141-179; Score =31.1; E_value=3.9e-06; Accession=PF00400.22; Description=WD domain, G-beta repeat
  Pfam annotation: Domain name=WD40; Domain location=231-269; Score =0.6; E_value=31; Accession=PF00400.22; Description=WD domain, G-beta repeat
  Pfam annotation: Domain name=WD40; Domain location=282-321; Score =1.6; E_value=24; Accession=PF00400.22; Description=WD domain, G-beta repeat
  Pfam annotation: Domain name=WD40; Domain location=98-137; Score=7.0; E_value=5.6; Accession=PF00400.22; Description=WD domain, G-beta repeat
  Pfam module annotation: Pfam domain module=WD40::WD40::WD40::WD40; Domain location=141-179::231-269::282-321::98-137
MKQILRLAYCNMGDSIVALASNGIHLVWRWPRNGFNLDGKASAQFCSQLWHPKDGPQFMINELLSIKCVNPASCFAYSNGYIISTSGGMVSLFNTVTFKTLTTIMSPPPMVTSLAYYPKDNNIFGIGFDDSTILIYHVRQAEVLFKLEGHSTRVTAIAFSYSSNILVSGDANAQIILWNTDGWKKLKDKQLQIQGNQVSVCETQIQFHPDQINFLVVHRSHLAIYEATELKCVNQWLPEVPILISQATFSSDGHTVYSIFGDGAVAIFDASNFEIRCRVYRSCYLPTISRWGVYPISVAAHPQKPAQFAVGLSDGSVYVFEPQMPGGDWIKNH

SEQ ID NO: 181092 - protein, 68 aa, Glycine max
  Coding DNA Sequence Number=SeqID_64314
MEFSLHLSLSHLSFLCFLRNFLLHCIQQRIFLKKLQGLLHRFPGILSTERGQSALESFDSYQRSVIER

SEQ ID NO: 181093 - protein, 128 aa, Glycine max
  Coding DNA Sequence Number=SeqID_64315
  Gene Ontology: Mol. function=hydrolase activity; Cellular component =membrane fraction; Biological process=regulation of translational termination
  Homolog annotation: Hit_ID=Q8PH67; Match level="QueryCoverage=96%, HitCoverage=98%, E-value=2e-55, Identity=87%"; Hit description =Translation initiation inhibitor
  Pfam annotation: Domain name=Ribonuc_L-PSP; Domain location=8-127; Score=205.3; E_value=1.4e-58; Accession=PF01042.11; Description =Endoribonuclease L-PSP
MSRQIINTEKAPAAIGPYSQAVRAGNTVYFSGQIPLDPATGDIVGAGDVEAQARRAFDNLKAVAEAAGGSLDKVVRLGLYLTDLGEFAKVNAVMQDYFQAPYPARSTIEVSGLPKGANFEVDAVMVID

SEQ ID NO: 181094 - protein, 126 aa, Glycine max
  Coding DNA Sequence Number=SeqID_64316
MAVGSTLAGYGEWKILSPALWRLGSIVFGIAGYALIWLGLKALSDGRFVSPKTLLGTCLVVVLGIVLAYEVAENNALRAALFNGCAALAYLGAAVVLFSGWRKEPLLSRIAMGAITTVSGLISLLV

SEQ ID NO: 181095 - protein, 224 aa, Glycine max
  Coding DNA Sequence Number=SeqID_64317
  Gene Ontology: Mol. function=helicase activity; Cellular component =intracellular; Biological process=Mo-molybdopterin cofactor biosynthetic process
  Homolog annotation: Hit_ID=Q1MDR9; Match level="QueryCoverage=98%, HitCoverage=45%, E-value=3e-80, Identity=63%"; Hit description =Putative helicase/glycosylase
  Pfam annotation: Domain name=UDG; Domain location=58-215; Score=97.0; E_value=5.5e-26; Accession=PF03167.9; Description=Uracil DNA glycosylase superfamily
MAAKEASQPKPFHHRLQAAASAREEQPPLPDGTLASLAHEARHCTRCALHCKATQTVFGDGPENAKIMVVGEQPGDHEDLAGKPFVGPAGQLFDRTLREIGVDRGGLYVTNAVKHFKYETRGKRRIHQRPNAGEVEQCRWWLNQEIALVQPKLIVAMGATALYALTGGKEKVSEIRGRPLPMQEGRTLFVTVHPSYLLRLPDEQAKEMEIKKFKQDMLYVRNFE

SEQ ID NO: 181096 - protein, 99 aa, Glycine max
  Coding DNA Sequence Number=SeqID_64318
MTKLGLCLSSGPPPLDDKRVRITVRMTKLGLCLPSGPPPLDDKRVRITIRMTKLGLCLSSGPPPLDDKRVRITIRYLRVSWVQNDQTWSLLVIGPAASG

SEQ ID NO: 181097 - protein, 158 aa, Glycine max
  Coding DNA Sequence Number=SeqID_64319
MTLLLSNILPSDRNANLPLRKYQLVCVVPTWGSHPQRHPVNLKKSNRALGFPALVTGLYQSYRVLVPPRQGHIIIGIAPARHPVDPKKSNRVLELSSSNHGSLSVLRRRNTTVAWGWSVAGNRHTATTSRVNLSSSAKRLERCLRHMADQQATKSKAK

SEQ ID NO: 181098 - protein, 95 aa, Glycine max
  Coding DNA Sequence Number=SeqID_64320
MVPSGVANCRNVPFCGRAKARLTGALSKGGKMRGVATNVYLWETSEKPKETGRNENSKFGSCDHFKALDLKNDPFYLRGYGTTERSEFILTEINE

SEQ ID NO: 181099 - protein, 80 aa, Glycine max
  Coding DNA Sequence Number=SeqID_64321
QANGSSEGDGALPCKGLLCSIFFALVLILLWTGKRCDLCLILMRFHAKKANSSAEGDGALPCKGFLCSIFFALVLILLWT

SEQ ID NO: 181100 - protein, 96 aa, Glycine max
  Coding DNA Sequence Number=SeqID_64322
MSLSHTKSLRLYHGTRHMMTHVKQNDNQSKYKNKSGVSYHILRSLSLSEIIRRPIRVTLFCENAPIMWDQHRLKGALKLDDPQGLHSEEFVRASPS

SEQ ID NO: 181101 - protein, 124 aa, Glycine max
  Coding DNA Sequence Number=SeqID_64323
MEEQASQDSMEEQASQDSFVAHGQHPGRVRAAGANVTIKQYFGPTPRTSHTSSSIAPKDMEQLTQKIRDQLEESITEKVTRQVLALPPEPVDGRSATHVSPKENVVIWFCSLHNRLDFLKGIII

SEQ ID NO: 181102 - protein, 40 aa, Glycine max
  Coding DNA Sequence Number=SeqID_64324
AQAGEAPVGAPAEAPDEVDEAREYEETTDLLDFLRGNGAT

SEQ ID NO: 181103 - protein, 315 aa, Glycine max
  Coding DNA Sequence Number=SeqID_64325
  Gene Ontology: Mol. function=UTP:glucose-1-phosphate uridylyltransfera se activity; Biological process=UDP-glucose metabolic process
  Homolog annotation: Hit_ID=P0AEP3; Match level="QueryCoverage=52%, HitCoverage=54%, E-value=5e-81, Identity=90%"; Hit description=UTP- -glucose-1-phosphate uridylyltransferase
  Subcellular localization annotation: CTP_CleavageSite=64; ConfidenceScore=5.29e-01
PANHRQLPHKLSSTHHGGTAGAGAGYCRAVGQRSGVLLPGRNACRRQRRAGCIIAQSTVQRFIAGATVRAKAASAGTQWSAAPGEYAVASGQPERSVPAAAGLNATLHINTQQIQLSNGVPLGTMGSTHLNQISQRADAWQCHGQSLALHLGLGTRMLPATKAIPKEMLPLVDKPLIQYVVNECIAAGINEIVLVTHSSKNSIENHFDTSFELEAMLEKRVKRQLLDEIQSICPPHVTIMQVRQGIAKGLGHAVMCAHPLVGDEPVAVILPDVIIDEYESNPTKDNLAEMLTRFEESGRSQIMVEPVADVTAYGV

SEQ ID NO: 181104 - protein, 194 aa, Glycine max
  Coding DNA Sequence Number=SeqID_64326
AELEQAQTVKERFKSATLKIRKENAELRDVNIATTKALEQETKRARREEHDRNKFQGALWGSNRELKLRREERDQSRVDSLILKDELKVYLRSKGSLSQRLCETETNMLAIVSKYQEELNLATAHEHKVADEYARVYTEKEARGRVIDSLHQEATMWMDRFALTLIDFPTTPSPKQWRTPTPPTRRSMDFSAII

SEQ ID NO: 181105 - protein, 271 aa, Glycine max
  Coding DNA Sequence Number=SeqID_64327
  Gene Ontology: Mol. function=catalytic activity; Cellular component =cytoplasm; Biological process=nucleoside metabolic process
  Homolog annotation: Hit_ID=UPI000068549F; Match level="QueryCoverage =85%, HitCoverage=85%, E-value=1e-102, Identity=77%"; Hit description= AMP nucleosidase
MVFHELGADLGIGGFGLDPIGDHRLVRDQQQRATGDVVGEAGGEHRGRFHVDGHAAHRPQPFLEGLVVFPDPAVGGVDRAGPVVVAEVADHGRNRTLQREGRQGRDFRRQVIARGTLATDRSDRQHQVTQLVLALEATALAQEQHRLGHHRRQQVHDDRGIGAAHAEVDHGDAINGGTGHRPVQADDRRAGQLGERMQVAPEVGQQDVLAELVQGHAGIPGQPVVDDFLLALHGRSGTAGDRVFSATRPVPSSYRRQACEEGHLASPPPPG

SEQ ID NO: 181106 - protein, 135 aa, Glycine max
  Coding DNA Sequence Number=SeqID_64328
MELAWDGAKFGLPNASNGFFITHADVTEIILGDKCLNISVLQLWMMFMNDWSTSIGFSPVYGFLEPQSIRCTKDTCEECQKKYAVIFQGKDNAPPPPPQWIEAKYFSDGTTLDTDTMTTIRKKWAAYFLEVGKWM

SEQ ID NO: 181107 - protein, 101 aa, Glycine max
  Coding DNA Sequence Number=SeqID_64329
MDVKERLKTFAKIGEELATQLAQASKVASSRSNSLLQEESGRPNFRRSYKNSRIAKNTSFRFPSHYGIFTDRWSRLGLERVELGMGKPLHVGGSTIESALV

SEQ ID NO: 181108 - protein, 873 aa, Glycine max
  Coding DNA Sequence Number=SeqID_64330
  Gene Ontology: Mol. function=protein binding; Cellular component =membrane; Biological process=defense response
  Homolog annotation: Hit_ID=Q1SWU6; Match level="QueryCoverage=99%, HitCoverage=94%, E-value=0.0, Identity=55%"; Hit description=Disease resistance protein
  Pfam annotation: Domain name=LRR_1; Domain location=503-524; Score =10.4; E_value=3.2; Accession=PF00560.23; Description=Leucine Rich Repeat
  Pfam annotation: Domain name=LRR_1; Domain location=526-548; Score =11.0; E_value=2.5; Accession=PF00560.23; Description=Leucine Rich Repeat
  Pfam annotation: Domain name=LRR_1; Domain location=550-572; Score =9.4; E_value=5; Accession=PF00560.23; Description=Leucine Rich Repeat
  Pfam annotation: Domain name=LRR_1; Domain location=802-823; Score =6.2; E_value=20; Accession=PF00560.23; Description=Leucine Rich Repeat
  Pfam annotation: Domain name=LRR_1; Domain location=825-847; Score =10.5; E_value=3.1; Accession=PF00560.23; Description=Leucine Rich Repeat
  Pfam annotation: Domain name=NB-ARC; Domain location=66-362; Score =229.6; E_value=7.1e-66; Accession=PF00931.13; Description=NB-ARC domain
  Pfam module annotation: Pfam domain module=LRR_1::LRR_1::LRR_1::LRR _1::LRR_1::NB-ARC; Domain location=503-524::526-548::550-572::802 -823::825-847::66-362
MVEFVLETLLGNLNSLVQKELLLFLGFDQNLEKLSSLLTTIKATLEDAEEKQFSNRAIKDWLEKLKHAAHILDEIIDKCSYEGLGLEYQGVKCGPSDKDLSVYPIVGLGGLGKTTLVQFIFNQEKVVNHFELRIWVCVSGDFSLERMTKAIIEAASGRACKNLDLGSKRKRLQDILQRKRYLLVLDDIWDDNQENWKMLKSVLACGAKGACILVTTRQSKVATTMGTIPTHQLPVLPDKYCWELFKHQAFGLNEQEQVELEDIGKEIVQKCRGVPLAAKALGGTLRFKRNKNEWLNVKESNLLELSHNENSIIPVLRLSYLNLPIEHRQCFAYCAIFPKDENIGKQYLIELWMANGFISSDERLDAEDVGDGVWNELYWRSFFQDVETDEFGNVTRFKMHDLVHDLAQSITEDVCCITENKFITTLPERILHLSDHRSMWNVHKESTDSMQLRLFKSLRTYILPDHYGDQLSPHPDVLKCHSLRVLDFVKSETLSSSIGLLKHLKYLNLSGGGFETLPEFLCKLWNLQILKLDRCSRLKMLPKSLICLKALRQLSFSDCQELSSLPPQIGMLTSLRILTKFFVGKERGFCLEELGPMKLKGNLDIKHLGNVKSLMDAKEANMSSKQLNKLRLSWDRNEDSELQENVEEILEVLQPDIQHLWRLDVEEFKGAHFPQWMSTPSLKYLTLLNLLNCENCLQLPLLGKLPSLKILGTINNNYVEYLYEESCDGEIVFRALEDLTIRHHPNFKRLSREYGENMFPCLSNLEITECAQFLGEEVLLKGLDSLTVFSCDKFNVSPGFQRLWKLWISNCREVEDLQALQDMTSLKVLRLRDLPKLESLPDCFGNLPLLCELIFYCSKLTCLPMSLRLTSLQ

SEQ ID NO: 181109 - protein, 429 aa, Glycine max
  Coding DNA Sequence Number=SeqID_64331
  Homolog annotation: Hit_ID=Q1SAV4; Match level="QueryCoverage=23%, HitCoverage=25%, E-value=2e-25, Identity=51%"; Hit description =Integrase, catalytic region
  Pfam annotation: Domain name=Auxin_inducible; Domain location=325 -418; Score=10.2; E_value=3.2e-06; Accession=PF02519.5; Description =Auxin responsive protein
  Pfam annotation: Domain name=Chromo; Domain location=262-312; Score =29.4; E_value=1.3e-05; Accession=PF00385.14; Description='chromo' (CHRromatin Organisation MOdifier
  Pfam module annotation: Pfam domain module=Auxin_inducible::Chromo::Re trotrans_gag; Domain location=325-418::262-312::74-184
MKAPRQSDHEEKSHALNTLKTTCELVVAAIVSHSNLVRLATMAEHGTRCTTTDRLEEAISTLAEKHSELASKVDAMCEHFSNMAPPPSPSFRPHQCPPVKLDVPRFNDYDPLGNDFITSWPALLQAIETRFAPSFYDEPRDTLFKLIQRTSVTEYLTEFEMLANRIVGLSPPMLLSCFISGLNPKIRCEVQAFQPVSLPQAMALAHLQEDKCIGKIAYRLQLPQESRIHPMFHCLMLRPHHGPFELPTSSLPPEALHNQPVLELLTILDSRVDSSTSLPTRLVLVQWVGLPPEDSTWEKWEDVCSAHHLEDKAPPQSDHEEKSRALNTLKTTCELNCIIYNKSSIFKSGESIKGYLAVYVNEKMKQFFILVSHLNQPSFQELLSRAECPLIAGRDILIPSSSSRSRVGFFICIAISINTLIRVIGVLGP

SEQ ID NO: 181110 - protein, 97 aa, Glycine max
  Coding DNA Sequence Number=SeqID_64332
MKIHKTIKRTPKGPYIMFKSLKTNTNRMKNEERVKNDVEVDHGHNSAEPLTSAPSRLFIGNKGTWLINSLPRRASYFTPKLFEGPGEPKASLGDRGV

SEQ ID NO: 181111 - protein, 674 aa, Glycine max
  Coding DNA Sequence Number=SeqID_64333
  Gene Ontology: Mol. function=protein binding; Cellular component =membrane; Biological process=defense response
  Homolog annotation: Hit_ID=Q1SW19; Match level="QueryCoverage=99%, HitCoverage=71%, E-value=1e-146, Identity=42%"; Hit description =Disease resistance protein
  Pfam annotation: Domain name=LRR_1; Domain location=444-465; Score =6.0; E_value=22; Accession=PF00560.23; Description=Leucine Rich Repeat
  Pfam annotation: Domain name=LRR_1; Domain location=467-488; Score =9.4; E_value=5.1; Accession=PF00560.23; Description=Leucine Rich Repeat
  Pfam annotation: Domain name=LRR_1; Domain location=569-590; Score =0.3; E_value=2.5e+02; Accession=PF00560.23; Description=Leucine Rich Repeat
  Pfam annotation: Domain name=LRR_1; Domain location=615-637; Score =10.1; E_value=3.6; Accession=PF00560.23; Description=Leucine Rich Repeat
  Pfam annotation: Domain name=NB-ARC; Domain location=1-303; Score =268.3; E_value=1.6e-77; Accession=PF00931.13; Description=NB-ARC domain
  Pfam module annotation: Pfam domain module=LRR_1::LRR_1::LRR_1::LRR _1::NB-ARC; Domain location=444-465::467-488::569-590::615-637::1-303
MAPLYLKEAEVVGFDGPRDTLEKWLKEGRKKRTVISVVGMGGLGKTTLAKKVFDKVRNHFTLHAWITVSQSYTIEGLLRDMLLNFVEEEKRVDHASMDKKSLIDQVRKHLHHKRYVVVFDDVWNTLFWQEMEFALIDDENGSRILMTTRNQDVVNSCKRSAVIKVHELQPLTLEKSLELFYTKAFGSDFDGHCPSNLKDISTEIVKKCQGLPLAIVVIGGLLFNEKREILKWQRFYQNLSSELGKNLSLSPVKKILDFSYHDLPYNLKPCFLYFGIYPEDYKVERGRLIPQLIAEGFVKSEATKTLEEVAEKYLNELIQRSLVQVSSFTKGGKIKSCGVHDLVHEIIREKNQDLSFCHSASERENLPRSGMIRRLTIASGSNNLMGSVVNSNIRSLHVFSDEELSESSVERMPTNYRLLRVLHFEGDSLHNYVRLTENFGDLSLLTYLSFRNSKIVNLPKSVGVLHNLETLDLRESGVRRMPREIYKLKKLRHLLVYDKLFGFLGGLQMEGGIGDLTSLQTLRDMDADHVTEEVMKGLERLTQLRVLGLTCVRGQFKSSLCSLINKMQRLDKLYITVSTFRSINLQFDVCAPVLQKVRIVGGLKEFPNWVAKLQNLVTLSLTRTRLTDDPLPLLKDLPYLSSLFINHSAYKGEVLQFPNRGFQNLKQILLRRLY

SEQ ID NO: 181112 - protein, 38 aa, Glycine max
  Coding DNA Sequence Number=SeqID_64334
MAVTLSNSSFKILESRCQLGVDGKCNANEEVNPATTIT

SEQ ID NO: 181113 - protein, 73 aa, Glycine max
  Coding DNA Sequence Number=SeqID_64335
MQNSKRNVYLGAYLNGTLKGFDDTPQSKSTTVVRWIVVKYFNAARPLEPEILKAFHIQWASYYLKVKNETISV

SEQ ID NO: 181114 - protein, 136 aa, Glycine max
  Coding DNA Sequence Number=SeqID_64336
MDRSKRLCPREKTSGFVFEENIKKTKKDEGLCILKMRVRELFAHGEEKRLPMIREGDKDTQNIKETPKCPYIKFKSLRTYTNRMKNEERTKNDVEVDHGNEGTWLISRSPRQAGYFTPKLFEGPGEPEASLGEPGV

SEQ ID NO: 181115 - protein, 55 aa, Glycine max
  Coding DNA Sequence Number=SeqID_64337
MALGIGQKHQRNGEITEAREKTQKHGGDGADEIMRKLRKERRTYLQRWKQRRRRG

SEQ ID NO: 181116 - protein, 84 aa, Glycine max
  Coding DNA Sequence Number=SeqID_64338
MSSSSRPMPRRESPWGVTREYHPKLKAHRCNDHVEDVKGVALAPTYLQMIYGTNDRLKFTLQEEKRLPMIEEGDTDAQNNKEGP

SEQ ID NO: 181117 - protein, 107 aa, Glycine max
  Coding DNA Sequence Number=SeqID_64339
MREHKKNCSKGKEFVIKKEGERKYKITLHIENCKESKVEGENNAKVEDSKYEKFRIRRMAENQTKIKALILSKLAIIFKDRIQKVKTKDKKKVNDDDEEDYVPEYEG

SEQ ID NO: 181118 - protein, 424 aa, Glycine max
  Coding DNA Sequence Number=SeqID_64340
  Gene Ontology: Mol. function=ATP binding; Biological process=apoptosis
  Homolog annotation: Hit_ID=Q8LJ95; Match level="QueryCoverage=58%, HitCoverage=42%, E-value=3e-44, Identity=41%"; Hit description=NBS -LRR resistance protein RGH1-like
MSHHSLLSTPQLHQEEDLQRIKDCYNSLGPEFKRIFSSLLQFPENAVFKRREIALWFSQYGDYRWNSVWVDSILKSKVIVPHGNGKSPIASKFKINPLLRHKSLSPLFQNEEVPICGYYSQIKTSSSSRASDIGYQRLVLDQRKIKISDGFGFKSFRAVYNFGASYLNFGPGWMAKMKDLWVLQLGRFMQDSPKHHIEVDSEEFLKELSGHEDLLCLSLRGISRIFELPPSIVKIESLGILDLKACHNLQTLPSDISSLRWLWYLNLSECYLLDGMPKGIENLTWLGGFVLSSPSKTPCRISDIAAKLERLVRLSIRIGSGAVIQDGEFESLKMLSILKHLKISWGVFDTSLKKLHLEGFPGQNIPEWLKPSKLPQELELRQLHITGGKLKSLDHGENNDWGVEIVYLKYLKDLDVDLGHLRKL

SEQ ID NO: 181119 - protein, 116 aa, Glycine max
  Coding DNA Sequence Number=SeqID_64341
  Gene Ontology: Mol. function=RNA-directed DNA polymerase activity; Cellular component=intracellular; Biological process=RNA-dependent DNA replication
MASQHSDGKEVNEKWRMCINYIYLNKACPMDSYPLPSIDRLIDRSTRFPILCFLDAYSGYNQIVMFKQDEEKIAFMTNTTNYCYSVMLFRLKNSKATYQRLMDKKYQLVKEKLGGL

SEQ ID NO: 181120 - protein, 144 aa, Glycine max
  Coding DNA Sequence Number=SeqID_64342
VTLRAESQHFASVHDDNPRVAFIPYFGFIKEIWELNYVKFIVCVFKCKWVDNNTDPCDEKWSVVLHGKTIGVNVEDDNSYIDTYVSPLSTQMSPNIVGEEEVDDANGYTTQLSSSSSFSYWCSIIVAIYLEADKKIHMANIIGD

SEQ ID NO: 181121 - protein, 64 aa, Glycine max
  Coding DNA Sequence Number=SeqID_64343
MDAKCSYQVLKNLLTAMILCELLHEQRWGYLQRHFEAQGRSVEINKLCDLHVKDSFITVTSLIE

SEQ ID NO: 181122 - protein, 168 aa, Glycine max
  Coding DNA Sequence Number=SeqID_64344
MEEMIAFREQMHKESSRKQVERKEKTESGQDRGRSRRHNTKECNTLKDKIERLIQKGIFRSSSKTKTVHKTMNKQEKEVENIGGFVGGYPSLNELGAIILTPYLTMKFPSKDGRIIVFWADQMIARECYTTSLRVSKGKKGAEPKAQLMACTSLNNLRDIDPDPREVE

SEQ ID NO: 181123 - protein, 116 aa, Glycine max
  Coding DNA Sequence Number=SeqID_64345
MEAMKEQMTTMMEAMMSMRKMMEVNTATIVAASTATKVDPTHPFGLNKVNHPVSDMVGQGGEALGSMGGPYFVQSGHAHVAQPMGETYEVPQDHTLADFEPHLGYAIEGQAFGGVP

SEQ ID NO: 181124 - protein, 90 aa, Glycine max
  Coding DNA Sequence Number=SeqID_64346
  Subcellular localization annotation: CTP_CleavageSite=41; ConfidenceScore=5.63e-01
MSWKTRHITIPRSSLPPPKLAPSSKKSRKATRLKSLATRLVMMEKPVVYVDPATRKSNGPHKKKLRTYLGIIARDKVDVTFVYEKEVLTA

SEQ ID NO: 181125 - protein, 75 aa, Glycine max
  Coding DNA Sequence Number=SeqID_64347
MVFSITTNLDWHHFYGGVKGLLSRKPAEGGSKIVTEGTWCEWGSRTNWKGVRLSTVGAFDLQQSGQSVASNQKID

SEQ ID NO: 181126 - protein, 55 aa, Glycine max
  Coding DNA Sequence Number=SeqID_64348
MGEDEKIVTSGVFGGKAREWRIMEIGVWVHSGEVAIEARWWWFRFMVEGRWWGRV

SEQ ID NO: 181127 - protein, 151 aa, Glycine max
  Coding DNA Sequence Number=SeqID_64349
  Gene Ontology: Mol. function=transferase activity; Biological process= DNA integration
  Homolog annotation: Hit_ID=Q1SPQ1; Match level="QueryCoverage=52%, HitCoverage=18%, E-value=1e-09, Identity=54%"; Hit description =Polynucleotidyl transferase, Ribonuclease H fold
MANVDGGNKWLMTTHDSLREVLEFKTVGASGFGRVRVGLVSCGRLRESQELWESFGVYGHWRWSEGGGHWRWPASVRIDNGMKIDNRVEGGSIPNPLQQRFPFNESEMSLRWCKLRSNARIGTEAKPGTYSGRARGGRPERDLKGVIPMTE

SEQ ID NO: 181128 - protein, 77 aa, Glycine max
  Coding DNA Sequence Number=SeqID_64350
  Homolog annotation: Hit_ID=Q1S6K0; Match level="QueryCoverage=48%, HitCoverage=12%, E-value=2e-08, Identity=81%"; Hit description=SOUL heme-binding protein; Bacterial regulatory factor, effector
MSFVMPSKYGANLLLPKDSSMRIKEVPRIIVVVVSFSGLKRSLGQIMAYVGIDLSSPTLATLNLIPTFTFILALIFR

SEQ ID NO: 181129 - protein, 61 aa, Glycine max
  Coding DNA Sequence Number=SeqID_64351
MSSLVTTITCHQLSLSSPLSVAVIAITCHHCYHRHSHCSPTLLSVCVLTYSKTTAKAELGT

SEQ ID NO: 181130 - protein, 115 aa, Glycine max
  Coding DNA Sequence Number=SeqID_64352
  Gene Ontology: Mol. function=binding; Cellular component=thylakoid; Biological process=photosynthesis
  Homolog annotation: Hit_ID=Q6K378; Match level="QueryCoverage=93%, HitCoverage=12%, E-value=9e-33, Identity=62%"; Hit description =Tetratricopeptide repeat protein-like
MEDAVTSENAQELFDIAADRFQEMAALALFNWGSVHMSRARKMVSIPDDGSRESSFEFVKVGYEWALKDYMNAEKRFEEAVKIKSDFYEGLLALGHQQFEQARLCWSHLIAKNKG

SEQ ID NO: 181131 - protein, 72 aa, Glycine max
  Coding DNA Sequence Number=SeqID_64353
MALACDFCKETTHGVFWVRIGSEIPLAIYTLGMMAKYLDVLEIPRCAHVQFLVPQNAWSMHVCEFSQGDVWD

SEQ ID NO: 181132 - protein, 122 aa, Glycine max
  Coding DNA Sequence Number=SeqID_64354
MEKKKESRTIPRIKGVTQERCKQMKENSKKLRDMNKDGVNSKANAVKRVEDEDDLFLATNDEVAKTKWVIDSATSKHICRDQEMFDTLKTDGEFAYFKLGNGGKMKVEGIRSVRIKLHDGAI

SEQ ID NO: 181133 - protein, 134 aa, Glycine max
  Coding DNA Sequence Number=SeqID_64355
  Homolog annotation: Hit_ID=Q1S7U6; Match level="QueryCoverage=62%, HitCoverage=5%, E-value=2e-22, Identity=67%"; Hit description =Prefoldin
MENEILLAQENFEKLNREIEKGAEKLKTGEEHCDMLEKSNQSLWLVAENLLQRMAMKDQALLEKHAEIERLQTLMPEEHSDFWEILGHEIGLLKSEDGQLVKLAQLLVLERQTKKVVQLYWYQRNHTTRVQENR

SEQ ID NO: 181134 - protein, 451 aa, Glycine max
  Coding DNA Sequence Number=SeqID_64356
  Gene Ontology: Mol. function=sequence-specific DNA binding; Cellular component=nucleus; Biological process=regulation of transcription, DNA-dependent
  Homolog annotation: Hit_ID=Q93WT0; Match level="QueryCoverage=83%, HitCoverage=76%, E-value=1e-48, Identity=34%"; Hit description =Probable WRKY transcription factor 31
  Pfam annotation: Domain name=WRKY; Domain location=199-259; Score =131.4; E_value=2.5e-36; Accession=PF03106.6; Description=WRKY DNA -binding domain
MEDKAAIKELLEDEENPYDNTMGSTLLSLSLNNSGQPLNQMGMLRIKLEEAKKENEILKAMLNQVNQHCTALQNRILFEMQQHQLFSSSPRNDNNNHDLQGNKQDAEKLPMLHTRQFLNMGESSSILDGNTKACAIAENAEKKMLGKNLACDDNKYNVEGEINSQITSHEAKSTEDQVSEVTCRRARVSIRARSDFSSMFDGCQWRKYGQKTAKGNPCPRAYYRCSMGTACPVRKQVQRCFKDETVLITTYEGNHNHPLPPAARPLASSTSAALNMFLSGSITSSHSSTILPNSPLSTISPSTAVATFSQNATCPTVTLDLTQPNNNNYLQFQSATTSSQDHTQSFFPLPLHGNPQNYSEGLMHLWSKVPIPTMLAPEKNLALVDVVSEAINKDPSLKAALFSAISSLTGDPDQKDNINNISQLHSKSSGGYDPCSKMPAIPPIQPYTKLI

SEQ ID NO: 181135 - protein, 377 aa, Glycine max
  Coding DNA Sequence Number=SeqID_64357
  Gene Ontology: Mol. function=aspartic-type endopeptidase activity; Cellular component=lysosome; Biological process=lipid metabolic process
  Homolog annotation: Hit_ID=Q1SD40; Match level="QueryCoverage=66%, HitCoverage=58%, E-value=2e-55, Identity=43%"; Hit description =Peptidase A1, pepsin
  Pfam annotation: Domain name=Asp; Domain location=80-304; Score=30.2; E_value=2.1e-15; Accession=PF00026.14; Description=Eukaryotic aspartyl protease
MDFKYLLVGMCVWAWFGSITFATSNDGRLMRIGLKRRTLDLQCLKAARIKEAGHHRDLGGVNRNCCDEDIVYLKNYLDAQYFGEISIGSPPQYFNVVFDTGSSNLWVPSSKCIFSKQKYVRFNVHKLHLGKYAGIPCKIPYGQGSIFGFFSQDNVQVGDIIIKDQEFAEITREGSLALPALPFDGILGLGFQDTSGGCAAVVDSGTSLIAGPTTVVTQINHAIGAEGYTSFECKSILHNYGDSIWESLIAGYVLRVEEGCSTVCYGGFVAIDVPPPQEMRQMHASPSLFNLYLVYDNTGALGHVEDDVQKEKQKVNRELLGLLEFCGVELEIGEEVESIKECGWFKIVEQGLKELKVALWIGDEDDREPLVYGLLSN

SEQ ID NO: 181136 - protein, 80 aa, Glycine max
  Coding DNA Sequence Number=SeqID_64358
MELQQKIKEKRLKPYTTRMAKIQGQKEGKHILIFTKKSGPNLGPWAQKSTMRFMRTLRPSLVALVQSSWSLVSNTLGHRI

SEQ ID NO: 181137 - protein, 88 aa, Glycine max
  Coding DNA Sequence Number=SeqID_64359
MNYLTKTTVWNAEVGLQRTLVIMNPNNDDGVEETIVTGLRGYFDDAKESRVKKNPKIQESSFKNQDSRIIKIKIQDSRFKKQGKTQSR

SEQ ID NO: 181138 - protein, 230 aa, Glycine max
  Coding DNA Sequence Number=SeqID_64360
MYHSQTSMLIFLFTFGCVALCILSLKIRTVIIVIKRKELALRCPYQTRAKARVMGEMMEAMKEQMTIMMEAMMIMRRMMKVNAAIVVAACTATEVDPTHPSSFNQVNHPTSDMVGQGGKALGSTGGPHFVQVENKHSFPPYGLSPNYTPLNVTHTPNKNVDNSAPIPIESQQPQSDHAHVSQPMGETHEAPRDHNLADFEPHLRYATEGQAAGSVPLPNTLGGPQYHPEP

SEQ ID NO: 181139 - protein, 74 aa, Glycine max
  Coding DNA Sequence Number=SeqID_64361
SDDESLEGTNTWDPPINFEQETNQTEDEGNEDVGLPPELERMVAHEHQEMGPHQEETELVDGSLLVELLWRLDL

SEQ ID NO: 181140 - protein, 56 aa, Glycine max
  Coding DNA Sequence Number=SeqID_64362
MEEDKFIHECLIYAVQSHVVLHPTANKLLTQESLTSGIGWMAWALSKDSILVYFWF

SEQ ID NO: 181141 - protein, 223 aa, Glycine max
  Coding DNA Sequence Number=SeqID_64363
MQKTEKGAKIINLKSEKKEPNPFPPPQYIIYSLLKTDTNAKKGKGEKAMRNCIRCCISCIFPCGALDVIRIVHSNGRVEEISGTVKASDVMKAHPKHVLKKPCSSPADAAGISGGVHKIVVVPPDAELQRGKIYFLMPLPPTPPTQEKKNRQRKKKRKEHRERTMNNTNNASMITSMTSLLVSDRYLNDILSEKVSSQRDRRRGRVAVWRPHLESIYESPSDP

SEQ ID NO: 181142 - protein, 167 aa, Glycine max
  Coding DNA Sequence Number=SeqID_64364
  Homolog annotation: Hit_ID=Q1S3X6; Match level="QueryCoverage=86%, HitCoverage=80%, E-value=3e-60, Identity=75%"; Hit description =Ribulose bisphosphate carboxylase, large chain
  Pfam annotation: Domain name=DUF640; Domain location=1-133; Score =299.8; E_value=4.9e-87; Accession=PF04852.3; Description=Protein of unknown function (DUF640)
  Subcellular localization annotation: CTP_CleavageSite=17; ConfidenceScore=5.22e-01
MSTQIQNGSSSSSQQPLSRYESQKRRDWNTFGQYLRNQSPPVPLSQCNFNHVLDFLRYLDQFGKTKVHLHGCIFFGQPTPPAPCACPLRQAWGSLDALIGRLRAAYEEHGGSPETNPFGGGAIRVYLREVKECQAKARGIPYKKKKKKRNPILKGTQRAKDIEQQAS

SEQ ID NO: 181143 - protein, 77 aa, Glycine max
  Coding DNA Sequence Number=SeqID_64365
MDVYGVLGRNKRVSERRNEAKECVGAVEKDENHVLWSFERTECGAFEDGKRDAAWWEPTRNTLLISRRPGAYSPNAA

SEQ ID NO: 181144 - protein, 102 aa, Glycine max
  Coding DNA Sequence Number=SeqID_64366
  Gene Ontology: Mol. function=zinc ion binding; Cellular component =nucleus; Biological process=regulation of transcription
  Homolog annotation: Hit_ID=Q0GLE9; Match level="QueryCoverage=76%, HitCoverage=78%, E-value=1e-18, Identity=60%"; Hit description=Dof3
  Pfam annotation: Domain name=zf-Dof; Domain location=45-100; Score =55.6; E_value=1.6e-13; Accession=PF02701.6; Description=Dof domain, zinc finger
MAQVQSGQASEGIIKLFGTTIRLYGRERKEDKNHREDGTDEDIKRADKIIPCPRCKSMETKFCYFNNYNVNQPRHFCKKLQYAWNSEISQLPEYSRVMTQAK

SEQ ID NO: 181145 - protein, 1180 aa, Glycine max
  Coding DNA Sequence Number=SeqID_64367
  Gene Ontology: Mol. function=actin binding; Cellular component =cytoskeleton; Biological process=chitin metabolic process
  Homolog annotation: Hit_ID=Q5QNA6; Match level="QueryCoverage=95%, HitCoverage=81%, E-value=8e-48, Identity=23%"; Hit description=SCAR -like protein 2
MCPSDLILVAQDLVSGDIQIQPSFKEYLQIQTNLTLGKLKKQGNLIKARMKSISSAINGRTSSSQTTSTIDMTMKSDLEHYSNSFDSKSGAGYIECVFHPSNSKQSDEPDYKAPSSTKLKRKNDTLSSVSHHIDDSISHDTLEKQVASSSSGVTWDEKEEIVESKSQACDIDKTPERLVENHDLDMHVNEAVTITSIDYNHILFNEESNLKPVSNRVQTDDIDSEPDNYVDALNTIESESENDIDYITKREVQQLSSRVTRGTIENGVTEAPPNLLDNNLSDVVSQTDYTVPLNEEKGNLADSLQENRVLDLVSKPNASNLGYVSPSDDLDRENMTRDTASLNKEPFRDLSDSLQDIPPLTSEPHASNLGPENPSDVPYSEEMTRDTVCFNKEMFGNLPDLLQEISPLTSEPHASNLGPGHPSDVPYGEEMTRDTVCFNKETFRYLPDSMQEIPPLTIEPRTSNLGPVNPSNAPYSQETTTDTISLNKEMFGNLPNSLQETPALTLEPHASNLASVSPSDISVSKGIAKNIADSHHPKTPACEQVPCTIENSVLDNSVCTDTYIGSSTVNDTVSAPIETDISFSGSNNSNLPDEEAGKINNNICKSEETRRESLADHSVRFWTNGGLLGLEPSKPPDFNKSTSLSQGSLSTKSETDGGSHHNSMQKSNGYKEERESSEDVAEQILKEPSSRFLTSGHNDDQACISEKATGNSQQSNGFCQIERNSLGEIRVAAPESVLPSILDTKDITEPNQGNGENSSRVFGLSRRLLINSFQRKVSFDEKLERYNSLKSVILDQSGQNGIVGQSLPETTTSKEKVGSGYPIKSLPPSPPLEHMKISFHPVSGLEISKLKLKFPDGSNRHESLKDVFPSFQLVPEASLPLDGLVSHSDDDDTFCRSSPYISDDGRSPRSDYNSEQWESDETPENSDQGVHDSPRRRSSAESVSIDDTNVRSGQGTCTTNGVEHSLSRPLLDFPSYDNVNPALEKESKRHSKCNNVMSHSHAEPTQPPPPPPPLPPTQWRVSKPQLDMTNGTHHLSEDAEHIDDHGIPHSTIFQQPRLTQVEQLQINHDDHESYNNIIYRLKDKCINLIEHFLQLDPQKLKGQKEANQLKMGKETDEREDFLYQIRTKAFNLRPTVTGKSNDTTGPTANVKVTAILEKANAIRQVVASDDGEDDDNWSDT

SEQ ID NO: 181146 - protein, 105 aa, Glycine max
  Coding DNA Sequence Number=SeqID_64368
MEGIPEPEKATNHQTPSGQTKPLYGTMEIGGYPTNSCPPKASAIGKSNLNSEKMVEFVAQAEFQKYIYLKVEDPQLASMNQAVHHVPSRRFVAHVAAPLCPRGSW

SEQ ID NO: 181147 - protein, 197 aa, Glycine max
  Coding DNA Sequence Number=SeqID_64369
  Gene Ontology: Mol. function=catalytic activity; Biological process =metabolic process
  Homolog annotation: Hit_ID=Q1RZ28; Match level="QueryCoverage=85%, HitCoverage=35%, E-value=5e-62, Identity=60%"; Hit description=AMP -dependent synthetase and ligase
  Subcellular localization annotation: CTP_CleavageSite=26; ConfidenceScore=5.24e-01
MLFEDSRNNFLQCFSSSSSSSPSFRRAKSRPETSNVDDDMWLSSKAYYSPIVELCGGTELASSYIAGSPLQPQAFGAFSTASMTTGFVIFDENGVPYPDDVACVGEVGLFPLSLGASDRLLNADHEKTSSVEIESVCDGADECILVTAAVGVATANGGPEQLVIFVVLKEGYNSSAETLKMKFTKAIQSNLNPLLKV

SEQ ID NO: 181148 - protein, 299 aa, Glycine max
  Coding DNA Sequence Number=SeqID_64370
  Gene Ontology: Mol. function=binding; Cellular component=membrane; Biological process=transport
  Homolog annotation: Hit_ID=Q1S3Z5; Match level="QueryCoverage=97%, HitCoverage=100%, E-value=1e-136, Identity=86%"; Hit description =Mitochondrial carrier protein
  Pfam annotation: Domain name=Mito_carr; Domain location=107-202; Score=106.8; E_value=6.3e-29; Accession=PF00153.17; Description =Mitochondrial carrier protein
  Pfam annotation: Domain name=Mito_carr; Domain location=16-101; Score= 68.8; E_value=1.8e-17; Accession=PF00153.17; Description =Mitochondrial carrier protein
  Pfam annotation: Domain name=Mito_carr; Domain location=206-298; Score=39.5; E_value=1.1e-08; Accession=PF00153.17; Description =Mitochondrial carrier protein
  Pfam module annotation: Pfam domain module=Mito_carr::Mito_carr::Mito_ carr; Domain location=107-202::16-101::206-298
MGDENKTKSPASGVWSTIKPFVNGGASGMLATCVIQPIDMIKVRIQLGQGSAAQVTSTMLKNEGVAAFYKGLSAGLLRQATYTTARLGSFKILTAKAIEANDGKPLPLYQKALCGLTAGAIGASVGSPADLALIRMQADATLPAAQRRNYTNAFHALYRITADEGVLALWKGAGPTVVRAMALNMGMLASYDQSVEFFRDSVGLGEGATVLGASSVSGFFAAACSLPFDYVKTQIQKMQPDADGKYPYTGSVDCAVKTFKAGGPFKFYTGFPVYYDMDFPEPDTEIAEILRVVVCSSPW

SEQ ID NO: 181149 - protein, 304 aa, Glycine max
  Coding DNA Sequence Number=SeqID_64371
  Gene Ontology: Mol. function=protein domain specific binding; Cellular component=spindle pole body; Biological process =intracellular signaling cascade
  Homolog annotation: Hit_ID=Q96299; Match level="QueryCoverage=79%, HitCoverage=92%, E-value=1e-113, Identity=84%"; Hit description=14-3- 3-like protein GF14 mu
  Pfam annotation: Domain name=14-3-3; Domain location=7-242; Score =509.5; E_value=3.8e-150; Accession=PF00244.10; Description=14-3-3 protein
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQSASTTAEAELPPTHPIRLGLALNFSVFYYEILNSPERACHLAKQAFDEAISELDTLSEESYKDSTLIMQLLRDNLTLWTSDIPEEGEKTKRVSKIKIAKACIPCSTHSSIGHCYRLQWPEGHTTALVFLGSAEEQKVDSARAAGGDNA

SEQ ID NO: 181150 - protein, 371 aa, Glycine max
  Coding DNA Sequence Number=SeqID_64372
  Homolog annotation: Hit_ID=Q1S3Z6; Match level="QueryCoverage=99%, HitCoverage=99%, E-value=1e-124, Identity=64%"; Hit description =Cecropin
  Subcellular localization annotation: CTP_CleavageSite=56; ConfidenceScore=5.21e-01
MLFLQTTVLTRRFSPFCDATLHPLSLLNVQNPMLECAHSFSHYSPVPSNRTVKSISCSVSRKSHSKPEPEPPEPEANSNQRAGPKARSRSHQPKDVESSNDDKSSAETFPTTIPRKPRRGRRSEAVAVEDFVRDSLERTFAAIREQNKDALESHENIMKERDGDSSKSESSDKDDDNDDEEEDGGEGVRNKMVIEEESKNWPLDADVGWGIRASEYFEKHPIKNVVGEDGYEIDWEGEIDDNWVQEINCLEWESFAFHPSPLIVLVFERYNRASDNWKNLKELEKAVKVFWSAKDRLPPRAVKIDIYIERDLAYALKVRECPQILFLRGNRVVYREKELRTADELVQMIAFFYYNAKKPAWIDDKALYFRF

SEQ ID NO: 181151 - protein, 150 aa, Glycine max
  Coding DNA Sequence Number=SeqID_64373
  Gene Ontology: Mol. function=nucleic acid binding; Biological process= DNA integration
MKNWYIHSDRIVVEGNYSVVIQHSLPPKHKDPGVVMIPCSIGEVFVGKALIDLGASINLMPLSMCQRLGEIEIMLTCMTLQLADRSITRPYGVIEHVLVKVKHLIFPTNFVVIDIEEDADIPLIHGRPFMSTASCVVDMGKKMLQMGIED

SEQ ID NO: 181152 - protein, 127 aa, Glycine max
  Coding DNA Sequence Number=SeqID_64374
MTDLVSAEDDNQKVYTDNHSGISASQRDSKVSMTDLVTAEDDVNLRQKVYTDNHSGISARQRDSKVSMIDLVSAEDDRDSKVSMTDLVSAEDDIAKKNVHTEKHSGISARQRDSKFSMTDLVSAEDD

SEQ ID NO: 181153 - protein, 128 aa, Glycine max
  Coding DNA Sequence Number=SeqID_64375
MPQYSFQVLSTSNVFYGPSQRFDITFKTPLSADDLPPSSFYYRDMGHENEEEDNDNNNNNDDDNGCDHVPQQQYTIILEQEEVEVIEQEDNKHMQIQSKKKRDINTYQEELVMGHHLIIKFLKNVIFI

SEQ ID NO: 181154 - protein, 36 aa, Glycine max
  Coding DNA Sequence Number=SeqID_64376
LKMQSIQAMEELRTQCAKTDINQNFNLEIKSSVYVA

SEQ ID NO: 181155 - protein, 212 aa, Glycine max
  Coding DNA Sequence Number=SeqID_64377
  Pfam annotation: Domain name=zf-CCHC; Domain location=107-124; Score =21.6; E_value=0.00027; Accession=PF00098.13; Description=Zinc knuckle
MKEGIGHILDLTPIGEKMKESLKRLTLNSPYFHGKDNVEANLDWEIRVEQQLKRKSTSKSYGSHSYPKKDQGQGILGVRPSKPKDDKGKTIEKQPLKASMQEKTSSMKCFKCLGRGHITSQCPTKKTMIMRGQDIYSSQDEATTSPSSSKSEEAKGEESSEEIYPQEEGQPLMVKEECVEEKSLEFQEPQDLRSNPFQGGGNDAILPRKGIG

SEQ ID NO: 181156 - protein, 119 aa, Glycine max
  Coding DNA Sequence Number=SeqID_64378
MDEFDLQVAWLGAQPSPSGGGGASTAQEPTLEEPEAVAEGEDELTPPKPFYFDADARMAQKEGTSTDQIHEPSPTPIPDDAIPSAPASELEHPISQDSPAAQVLDLDEHAQEQPQEQDI

SEQ ID NO: 181157 - protein, 128 aa, Glycine max
  Coding DNA Sequence Number=SeqID_64379
DSLEEQVTQGSFVPHGRQDILNTAIGRPEHGGRVRAAGSGVTITQYYGRASRTCSSSSTSISQQQLDEVVARLREDMTGQIREELRTQIKEELRTQLEEENKRSLEIMTNALKEAIKKEFLRMVQQGL

SEQ ID NO: 181158 - protein, 138 aa, Glycine max
  Coding DNA Sequence Number=SeqID_64380
TGLTLVELRNMIQYHSYVLSAAPDVWNYNTSSSDSVLIKKIIQIRDFIISKELSTEEANKRIQSWSTNEQLLVGKAYEYIRGVKPTVSWCSAIWNSAIPPKMKSLQVWAHIRDLALFCRRFTSLQCITDSLIWGRSKS

SEQ ID NO: 181159 - protein, 340 aa, Glycine max
  Coding DNA Sequence Number=SeqID_64381
  Homolog annotation: Hit_ID=Q4V082; Match level="QueryCoverage=45%, HitCoverage=35%, E-value=4e-57, Identity=74%"; Hit description=Acyl -CoA thiolase
  Pfam annotation: Domain name=Thiolase_N; Domain location=195-340; Score=-94.6; E_value=1.2e-06; Accession=PF00108.13; Description =Thiolase, N-terminal domain
MRHAVGQQCFFQRIGNCVGGAHVAAGQQERHHAQATAHQAGIGLERQRHITLGIGAERQQARALVAARGTHLQFFQAAMDRPARAQYFGGVEMGGGEHQVQLGHLRHQLGKVAADAFGQFTGPFSAEHRLAGDFAAGQFQGQHAKGIHRGVGFAHGSTVGPSQGGSYTWLHYACSVVQAMLQTPSSMPGISMPNARPVAILGGVRIPFCRQNTAYSDVGNLGMSVRTLGALVERFGLHGQQLGEVAMGAVIKHSSDWNLGREATLSSGLSPLTPGITLQRACGTSLDSIITVANKIAVGQIESGIGGGSDTTSDVPIVYGKKLRARLLAANRAKSTGDKI

SEQ ID NO: 181160 - protein, 67 aa, Glycine max
  Coding DNA Sequence Number=SeqID_64382
MQRGAQSKPFDGEMGDCLEDTICDLGQESFQQAHAPMYDTLQTDSKKPLYPGVQEFLDAVVGGVKSG

SEQ ID NO: 181161 - protein, 121 aa, Glycine max
  Coding DNA Sequence Number=SeqID_64383
AAVSPAKPPERPDPEVDDPLYLMTLTIPQLFLKPLQVMWNATVFRVFNQNFSLYIKHEDLYEIVHGGQCLSISVIQLWILHLTKTSMRAGNFDVYGFLEPQSIQISGQSQFESESYIKSWM

SEQ ID NO: 181162 - protein, 72 aa, Glycine max
  Coding DNA Sequence Number=SeqID_64384
MYTTTITHIRLHCNEHWQMVIFLPKENLVVWFCSLHNMPDNYLKGIINGALKGLDDTPQPKSKAAARWIVVK

SEQ ID NO: 181163 - protein, 276 aa, Glycine max
  Coding DNA Sequence Number=SeqID_64385
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=100%, E-value=2e-38, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RGLHILSFRGLHALTFRGLHILVFRRVHVLTFSRVHVLVFRGLHALNFRGLHPLTYRGIHALTFRGQHALAFRGLHVLAFRGLHVIAIRGLHALAFRGLHVHTFRGLHALALSRLHVLAFSGLHVIAFRGLHVIAFRGLHGLTLRGLHALTFRGLHVLAFRGLHVLDFKGIHALTFRGLHVLAFRWLHVLAFKGLHALAFGGLHVLAFRGLHVLTISGVHVLSFRVLHALAFRGVHVYTFRGPHVLAFRGLHALAFSGLHVLAFRGLHVLTFSGVH

SEQ ID NO: 181164 - protein, 156 aa, Glycine max
  Coding DNA Sequence Number=SeqID_64386
  Gene Ontology: Mol. function=RNA-directed DNA polymerase activity; Cellular component=intracellular; Biological process=RNA-dependent DNA replication
MVALFHDLMHKEIEIYVDDMIAKSKTEEEHLVNLRKLFKRHYKYWLRLNPAKCTFGVKSRKLLGFIISQKGIEVDPDKVKAILEMPEPRTEKQVQVLVPPVPRRPLILYMNVLDESMGCMLGQHDESGKKERVVYNNYSLLERTCCALVWATHRLR

SEQ ID NO: 181165 - protein, 102 aa, Glycine max
  Coding DNA Sequence Number=SeqID_64387
MDYAITPSLASGMLQNFTDCALTRPFNSRHAAELHGLPNDGCQMIEEMKGREELVLLGLWRFLGGDDQQQRWWRKNPFASWMVLPFEGVSAFVIDYSLAVLV

SEQ ID NO: 181166 - protein, 133 aa, Glycine max
  Coding DNA Sequence Number=SeqID_64388
MAERNFESESSAFWVIGSSNSSLQSLWVIILIRGTAYMMVIDQSLFYDLTKLPSEGVPFEGALIDEWKFDFSVHDAHRLVCTNQADMTGRLLAGSLAFESRILHYHIVCILLPRSSNLAQVSEEDLIVMWGLS

SEQ ID NO: 181167 - protein, 49 aa, Glycine max
  Coding DNA Sequence Number=SeqID_64389
  Gene Ontology: Mol. function=electron carrier activity; Cellular component=photosystem II reaction center; Biological process =photosynthetic electron transport
  Homolog annotation: Hit_ID=Q8MAV7; Match level="QueryCoverage=66%, HitCoverage=39%, E-value=6e-11, Identity=96%"; Hit description =Cytochrome b559 alpha subunit
  Pfam annotation: Domain name=Cytochrom_B559; Domain location=6-34; Score=48.5; E_value=2.3e-11; Accession=PF00283.9; Description =Cytochrome b559, alpha (gene psbE) and
MSGSTGERSFADIITSIRYWIIHSITIPSLFIAGKWDKWPILLEGFLFG

SEQ ID NO: 181168 - protein, 125 aa, Glycine max
  Coding DNA Sequence Number=SeqID_64390
MDLITILVALKGSYNCVIAQFIVHNSIHTSHLNTHFYRDSFGFLRENKRLQCEGFSSKLRHNIKISNGGNARNWVAKVVFKFHDDPTVNEPEIVVFLRQVWWAAGKRKGFERRREKTKMRPKRGI

SEQ ID NO: 181169 - protein, 104 aa, Glycine max
  Coding DNA Sequence Number=SeqID_64391
MATARWALKHLVYGIVILRLGIYTDRPNVSKLCSFISSMNSSILISDDVPKWKTPHDSGISKITIDNNEVNTNVTVQTTCKHKTKVNQNEANVSPSVKEKIAYK

SEQ ID NO: 181170 - protein, 492 aa, Glycine max
  Coding DNA Sequence Number=SeqID_64392
  Homolog annotation: Hit_ID=Q8H3W6; Match level="QueryCoverage=89%, HitCoverage=96%, E-value=1e-25, Identity=38%"; Hit description=WD-40 repeat protein-like
  Pfam annotation: Domain name=WD40; Domain location=393-433; Score =16.9; E_value=0.075; Accession=PF00400.22; Description=WD domain, G -beta repeat
  Subcellular localization annotation: CTP_CleavageSite=40; ConfidenceScore=5.12e-01
DVILPFTHSLAPKPRTPYRVSSSDQQTSRSGVVFSDSAVAAHMPQPKELPGFYYDPEKNRYFPIKGPIPGSSSKPKTPALNSPQTSSNQESGGSCCRKLRNRTLSKLLQARELDGHSVVISRYCRSNFTEEFRKMQASRPVVWKYRGTDGMRITALEHLRVDVQTSEGQTETDVLLTGSTNGSMRGGVLQIEHVALQFTVMPGAGFSQVGGVGRNYDGGTKWRADCVKNYVKGRTDEHNEVLKPVFKPNRAALLMSSRISSIRLGPKCSSHAVNDGHIVGRGSVYTLDLVEPLNLGPGILNTWSGLEEIASFRYKFGRCFSGSGNWDDIMGNVILCGLRNGAIVTVDSRESRESLSGRLITHRIPYTSSDKKVGGSNKEWFKMRLYDLRLLQRGAVQCYEGHVNSHTRIQIGVDPSERFVMSGGEDCKLRLWSIKSGELLFEDKFSDSVISTVCYKTYGHSFKAEEENQYKRDSSQGAWLGSLEGLFYMCWL

SEQ ID NO: 181171 - protein, 75 aa, Glycine max
  Coding DNA Sequence Number=SeqID_64393
MSPPKNLIQQKKRIWFDSFARHSHLPLLSHCVSATSGGARCIMAFGGRKNGGQYPKYLSKLEHGTCIYSNLHSST

SEQ ID NO: 181172 - protein, 133 aa, Glycine max
  Coding DNA Sequence Number=SeqID_64394
  Subcellular localization annotation: CTP_CleavageSite=54; ConfidenceScore=5.26e-01
MAGDAAFPSTTCMMTLFFSLLLALHFAMAVPERSLSSLASIKESGTKKRNTMVAASAREAGSTQNIKAEEITPKQTIKDDHVPDHLLNGTNKEGSSQSQRPPLEWQNKIFNASEHEVPSGPNPISNRKIELKE

SEQ ID NO: 181173 - protein, 113 aa, Glycine max
  Coding DNA Sequence Number=SeqID_64395
MGKIEALPFSELDKNTFISRYKTPFLRFGTTEAIGPVAVASLRMRLVIDEQAQKSRFVMHEYRRCVRWLEIVVEGGSPEGEKSNEEEKGIWCGISLTWYNNNEQLKSSTRYMQ

SEQ ID NO: 181174 - protein, 232 aa, Glycine max
  Coding DNA Sequence Number=SeqID_64396
  Gene Ontology: Mol. function=catalytic activity; Cellular component =intracellular; Biological process=superoxide metabolic process
  Homolog annotation: Hit_ID=Q2QX94; Match level="QueryCoverage=93%, HitCoverage=28%, E-value=1e-91, Identity=69%"; Hit description=ZW18 protein, putative, expressed
  Pfam annotation: Domain name=DUF676; Domain location=1-148; Score =100.4; E_value=5.4e-27; Accession=PF05057.5; Description=Protein of unknown function (DUF676)
MSETNEDKTSGDFREMGHRLAQEVISFVRKKMDKASRYGNLGDIRLSFVGHSIGNLIIRTALAESMMEPFLRYLYTYVSVSGPHLGYLYSSNSLFNSGLWLLKKLKGTQCIHQLTFTDDQDIQNTFIYKLCKDGYVPYHSARIELCQAASRDKSKKGRVFLEMLNDCLDQIRANPSEHRVFMRCDVNFDATSYGKNLNSFIGRAAHIEFLESDIFARFSKGFRLTSRDAEKN

SEQ ID NO: 181175 - protein, 561 aa, Glycine max
  Coding DNA Sequence Number=SeqID_64397
  Homolog annotation: Hit_ID=Q1SXR1; Match level="QueryCoverage=19%, HitCoverage=9%, E-value=8e-16, Identity=50%"; Hit description =Integrase, catalytic region; Zinc finger, CCHC-type
  Pfam annotation: Domain name=MFAP1_C; Domain location=41-278; Score= -147.6; E_value=0.1; Accession=PF06991.2; Description=Micro-fibrillar- associated protein 1
  Pfam annotation: Domain name=MSG; Domain location=82-146; Score=4.1; E_value=0.045; Accession=PF02349.6; Description=Major surface glycoprotein
  Pfam annotation: Domain name=zf-CCHC; Domain location=260-277; Score =14.1; E_value=0.0046; Accession=PF00098.13; Description=Zinc knuckle
  Pfam module annotation: Pfam domain module=MFAP1_C::MSG::zf-CCHC; Domain location=41-278::82-146::260-277
MEEQKLRFLLNSKAPNAMLCMLSEEQCTKVHSFRSAKQMWDTLAVTYEGTSQANDSSDDESEEDSDEDEFAFISRKIQKMPGQFKSECLELEKACMTLKEKVPELCLEIETSAREKANLCKNFQELENKLKDLQNDLKELNELHDYQKEERYDLQRECAQAHKDYEDLKMSKHNLWVECKELKRFVKFLNDKLLKNQEVKGQPQDVVKLHEEIRTLKTTLAKFVNGTNNLNKLLGYCRCSLDKFGNGYDGKVYVHDKDTIVCYFYGKTGHMTFKCKDRLKKDVLDNKKQTLIMVLGQWLLMTHDTRKVYVPMLDSLSWWNNHFRRKSKGKDNHSGGYNVSFNKDECAILCKDGSPLFNAKRKGNLYKIRLGDLTDQKNLPFDLPHTIYIKILRNLKGVGGLDDIYYAALINKMLWDQGVYHVFNKMDDDSKHTLIDKGLAIAKQKKFSQTNLKSRKVALEQSQKKAPQLRKKKKAEEEEDEVVVAAMKENDASIQAKVSAKAMDDTIVSSEAIADEVEPNTLELASKNSTTSNEATSRDKGEPLVIIIYSTNSGPTHLNYA

SEQ ID NO: 181176 - protein, 168 aa, Glycine max
  Coding DNA Sequence Number=SeqID_64398
  Homolog annotation: Hit_ID=Q9SLU9; Match level="QueryCoverage=36%, HitCoverage=7%, E-value=4e-21, Identity=75%"; Hit description=ZW18 protein
MPHSLKVRAVAMFEAVQEIAIYIHRFHNLDLFQQGWYQIKITMRWEDDEDVSFGIPARVVQYEGVLTPEITMSLVTCICNKFHVYDIDLAKVELIGCVLVEVLLELLLVCLAMMAERCLRMLAVGNLFSLCSSVKVRDDRGKRNVFYWMKVEDEEFKNPTYFSAILNS

SEQ ID NO: 181177 - protein, 115 aa, Glycine max
  Coding DNA Sequence Number=SeqID_64399
MPNKLSSQLDPESWFGFRGGSMHNSYNKGGNNDDQHGNSNGGYGCTNAVDKGVALAPTYHQTLEPFTQPPSRLFIAKDGIRGHGRSPKRVGARPGELLLHLEVTLSAQASWLLHP

SEQ ID NO: 181178 - protein, 305 aa, Glycine max
  Coding DNA Sequence Number=SeqID_64400
  Homolog annotation: Hit_ID=Q9SLU9; Match level="QueryCoverage=93%, HitCoverage=35%, E-value=7e-80, Identity=56%"; Hit description=ZW18 protein
MPYVTNQGLSDAASVKLKAFMIVKALLTAHGILLEELQKLSKAVDQAIDIPEFVSKRNDMKLINSVPQANQFTTEVEISGQRMPQNGLEGADRALDFETAEKLRSLSKRELLNCYHSVGNRLLYLWNIFLKFHRDNKTKILEFLHDAWAKDRKAEWSIWMVYSKVEMPHHYINSGVHRRVSSLWKLPDEPPQTAATRAELHRRSIAQMRINNRSIQDMHIFGDPSSIPIVIVERVMNAPRRTISDNSYLRQVELVNSHSFQTGLNLDTANKISAPQTSTRVLKIVVFVHGFQASLTLELLFFFLV

SEQ ID NO: 181179 - protein, 352 aa, Glycine max
  Coding DNA Sequence Number=SeqID_64401
  Gene Ontology: Mol. function=oxidoreductase activity; Cellular component=vacuole; Biological process=hydrogen peroxide catabolic process
  Homolog annotation: Hit_ID=Q9SY33; Match level="QueryCoverage=83%, HitCoverage=85%, E-value=8e-99, Identity=60%"; Hit description =Peroxidase 7 precursor
  Pfam annotation: Domain name=peroxidase; Domain location=74-313; Score=377.2; E_value=2.6e-110; Accession=PF00141.13; Description =Peroxidase
MKNSSLPLLLLLVLYTISASSRPYENYDDKSSLSSTISETVFSLQVPALDETTFDNLLSFGYYRKTCPQFESILHNKVKEWIQKDYTLAASLMRLHFHDCSVRGCDGSILLKHDGSERTAQASKTLRGFEVVDDIKAELEKQCPKTVSCADILTAAARDATVELGGPYWAVPYGRRDGKVSIAKEADMVPMGHENVTSLIEFFQSRGMAVLDLVVLSGAHTIGRTSCGSIQYRLYNYQGTGKPDPTLDPKYVNFLQRKCRWASEYVDLDATTPKTFDNVYYINLEKKMGLLSTDQLLYSDARTSPLVSALAASHSVFEHQFAVSMGKLGIVDVLTGLEEGEIRTNCNFVNDY

SEQ ID NO: 181180 - protein, 210 aa, Glycine max
  Coding DNA Sequence Number=SeqID_64402
  Homolog annotation: Hit_ID=Q1S047; Match level="QueryCoverage=32%, HitCoverage=8%, E-value=6e-13, Identity=51%"; Hit description=MCM; Nucleic acid-binding, OB-fold
MIKTKVEHAHVPITKDFFSKEEEEEEEEEEEEEEEEEEEEEEEEEEEEEEEEEEEEEEEEEEEEEEEEEEEEEEETKGGTRYVPATLTSTTDDVLVLSIGFNIDDSRAIFLWGIHISVEDMNNTIKRFLMNFKEAPSSQGDDDYRLPLHTEGKYEKLVKHAIEGDSLDSVGGLVGNYDVLVVVGGNRPPMTVEDLLKLWCKGCTIIGNHL

SEQ ID NO: 181181 - protein, 82 aa, Glycine max
  Coding DNA Sequence Number=SeqID_64403
MKCSKGTDGIFGQATVLTFRSQSGTQRFLQLLELYASVVMGLEAHALIFETEPFLDVMVKAELLSESTAFHVQSLDSVHMNF

SEQ ID NO: 181182 - protein, 138 aa, Glycine max
  Coding DNA Sequence Number=SeqID_64404
  Pfam annotation: Domain name=Rtt106; Domain location=1-132; Score= -15.1; E_value=0.049; Accession=PF08512.2; Description=Histone chaperone Rttp106-like
  Subcellular localization annotation: CTP_CleavageSite=31; ConfidenceScore=5.72e-01
MGQMIVVPSSSVPINFGSSFSVSSGSGHPMRSVNVSRQRSLGWGYASSMRGWWSENARGEKREVYVWILLDGGATSSSNDPLQAIGGLVTRSRRQSTSEEEEEEEEEEEEEEEEEEEEEEEEEEEEEEYSNAKSHGRR

SEQ ID NO: 181183 - protein, 1252 aa, Glycine max
  Coding DNA Sequence Number=SeqID_64405
  Gene Ontology: Mol. function=protein serine/threonine kinase activity; Cellular component=integral to membrane; Biological process=protein amino acid phosphorylation
  Homolog annotation: Hit_ID=Q6L3I5; Match level="QueryCoverage=99%, HitCoverage=99%, E-value=0.0, Identity=57%"; Hit description=Leucine Rich Repeat family protein
  Pfam annotation: Domain name=LRRNT_2; Domain location=24-65; Score =45.8; E_value=1.5e-10; Accession=PF08263.3; Description=Leucine rich repeat N-terminal domain
  Pfam annotation: Domain name=LRR_1; Domain location=100-122; Score =20.3; E_value=0.0069; Accession=PF00560.23; Description=Leucine Rich Repeat
  Pfam annotation: Domain name=LRR_1; Domain location=124-146; Score =15.8; E_value=0.16; Accession=PF00560.23; Description=Leucine Rich Repeat
  Pfam annotation: Domain name=LRR_1; Domain location=148-170; Score =17.2; E_value=0.058; Accession=PF00560.23; Description=Leucine Rich Repeat
  Pfam annotation: Domain name=LRR_1; Domain location=172-194; Score =11.1; E_value=2.4; Accession=PF00560.23; Description=Leucine Rich Repeat
  Pfam annotation: Domain name=LRR_1; Domain location=196-218; Score =10.6; E_value=2.9; Accession=PF00560.23; Description=Leucine Rich Repeat
  Pfam annotation: Domain name=LRR_1; Domain location=220-242; Score =9.5; E_value=4.8; Accession=PF00560.23; Description=Leucine Rich Repeat
  Pfam annotation: Domain name=LRR_1; Domain location=244-266; Score =19.1; E_value=0.016; Accession=PF00560.23; Description=Leucine Rich Repeat
  Pfam annotation: Domain name=LRR_1; Domain location=268-290; Score =11.3; E_value=2.2; Accession=PF00560.23; Description=Leucine Rich Repeat
  Pfam annotation: Domain name=LRR_1; Domain location=292-314; Score =19.8; E_value=0.0097; Accession=PF00560.23; Description=Leucine Rich Repeat
  Pfam annotation: Domain name=LRR_1; Domain location=316-339; Score =12.5; E_value=1.3; Accession=PF00560.23; Description=Leucine Rich Repeat
  Pfam annotation: Domain name=LRR_1; Domain location=341-363; Score =9.0; E_value=5.9; Accession=PF00560.23; Description=Leucine Rich Repeat
  Pfam annotation: Domain name=LRR_1; Domain location=365-387; Score =15.8; E_value=0.16; Accession=PF00560.23; Description=Leucine Rich Repeat
  Pfam annotation: Domain name=LRR_1; Domain location=389-411; Score =5.1; E_value=32; Accession=PF00560.23; Description=Leucine Rich Repeat
  Pfam annotation: Domain name=LRR_1; Domain location=413-435; Score =8.7; E_value=6.7; Accession=PF00560.23; Description=Leucine Rich Repeat
  Pfam annotation: Domain name=LRR_1; Domain location=437-459; Score =10.8; E_value=2.7; Accession=PF00560.23; Description=Leucine Rich Repeat
  Pfam annotation: Domain name=LRR_1; Domain location=461-483; Score =10.8; E_value=2.7; Accession=PF00560.23; Description=Leucine Rich Repeat
  Pfam annotation: Domain name=LRR_1; Domain location=485-507; Score =7.7; E_value=10; Accession=PF00560.23; Description=Leucine Rich Repeat
  Pfam annotation: Domain name=LRR_1; Domain location=509-531; Score =17.4; E_value=0.05; Accession=PF00560.23; Description=Leucine Rich Repeat
  Pfam annotation: Domain name=LRR_1; Domain location=533-555; Score =8.5; E_value=7.3; Accession=PF00560.23; Description=Leucine Rich Repeat
  Pfam annotation: Domain name=LRR_1; Domain location=557-578; Score =7.3; E_value=12; Accession=PF00560.23; Description=Leucine Rich Repeat
  Pfam annotation: Domain name=LRR_1; Domain location=604-626; Score =13.5; E_value=0.77; Accession=PF00560.23; Description=Leucine Rich Repeat
  Pfam annotation: Domain name=LRR_1; Domain location=628-650; Score =14.5; E_value=0.39; Accession=PF00560.23; Description=Leucine Rich Repeat
  Pfam annotation: Domain name=LRR_1; Domain location=652-674; Score =18.7; E_value=0.021; Accession=PF00560.23; Description=Leucine Rich Repeat
  Pfam annotation: Domain name=LRR_1; Domain location=676-699; Score =5.9; E_value=22; Accession=PF00560.23; Description=Leucine Rich Repeat
  Pfam annotation: Domain name=LRR_1; Domain location=700-722; Score =12.7; E_value=1.2; Accession=PF00560.23; Description=Leucine Rich Repeat
  Pfam annotation: Domain name=LRR_1; Domain location=724-746; Score =11.9; E_value=1.7; Accession=PF00560.23; Description=Leucine Rich Repeat
  Pfam annotation: Domain name=LRR_1; Domain location=748-770; Score =10.9; E_value=2.6; Accession=PF00560.23; Description=Leucine Rich Repeat
  Pfam annotation: Domain name=LRR_1; Domain location=76-98; Score=6.5; E_value=17; Accession=PF00560.23; Description=Leucine Rich Repeat
  Pfam annotation: Domain name=LRR_1; Domain location=772-795; Score =2.9; E_value=81; Accession=PF00560.23; Description=Leucine Rich Repeat
  Pfam annotation: Domain name=LRR_1; Domain location=797-819; Score =17.4; E_value=0.052; Accession=PF00560.23; Description=Leucine Rich Repeat
  Pfam annotation: Domain name=LRR_1; Domain location=821-843; Score =8.6; E_value=7.1; Accession=PF00560.23; Description=Leucine Rich Repeat
  Pfam annotation: Domain name=Pkinase; Domain location=950-1233; Score= 139.2; E_value=1.1e-38; Accession=PF00069.15; Description=Protein kinase domain
  Pfam annotation: Domain name=Pkinase_Tyr; Domain location=950-1233; Score=65.5; E_value=1.7e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::Pkinase::Pkinase_Tyr; Domain location=24 -65::100-122::124-146::148-170::172-194::196-218::220-242::244 -266::268-290::292-314::...
  Pfam module annotation: Domain location=316-339::341-363::365 -387::389-411::413-435::437-459::461-483::485-507::509-531::533 -555::557-578::604-626::628-650::652-674::676-699::700-722::724 -746::748-770::76-98::772-795::...
  Pfam module annotation: Domain location=797-819::821-843::950 -1233::950-1233
MRISTLAIVILLFFSFALLLCHGNESTMRVLLEVKTSFTEDPENVLSDWSVNNTDYCSWRGVSCGSKSKPLDHDDSVVGLNLSELSLSGSISPSLGRLKNLIHLDLSSNRLSGPIPPTLSNLTSLESLLLHSNQLTGHIPTEFDSLMSLRVLRIGDNKLTGPIPASFGFMVNLEYIGLASCRLAGPIPSELGRLSLLQYLILQENELTGRIPPELGYCWSLQVFSAAGNRLNDSIPSTLSRLDKLQTLNLANNSLTGSIPSQLGELSQLRYMNVMGNKLEGRIPPSLAQLGNLQNLDLSRNLLSGEIPEELGNMGELQYLVLSENKLSGTIPRTICSNATSLENLMMSGSGIHGEIPAELGRCHSLKQLDLSNNFLNGSIPIEVYGLLGLTDLLLQTNTLVGSISPFIGNLTNMQTLALFHNNLQGDLPREVGRLGKLEIMFLYDNMLSGKIPLEIGNCSSLQMVDLFGNHFSGRIPLTIGRLKELNFFHLRQNGLVGEIPATLGNCHKLSVLDLADNKLSGSIPSTFGFLRELKQFMLYNNSLEGSLPHQLVNVANMTRVNLSNNTLNGSLAALCSSRSFLSFDVTDNEFDGEIPFLLGNSPSLERLRLGNNKFSGEIPRTLGKITMLSLLDLSRNSLTGPIPDELSLCNNLTHIDLNNNLLSGHIPSWLGSLPQLGEVKLSFNQFSGSVPLGLFKQPQLLVLSLNNNSLNGSLPGDIGDLASLGILRLDHNNFSGPIPRSIGKLSNLYEMQLSRNGFSGEIPFEIGSLQNLQISLDLSYNNLSGHIPSTLGMLSKLEVLDLSHNQLTGEVPSIVGEMRSLGKLDISYNNLQGALDKQFSRWPHEAFEGNLLCGASLVSCNSGGDKRAVLSNTSVVIVSALSTLAAIALLILVVIIFLKNKQEFFRRGSELSFVFSSSSRAQKRTLIPLTVPGKRDFRWEDIMDATNNLSEEFIIGCGGSGTVYRVEFPTGETVAVKKISWKNDYLLHKSFIRELKTLGRIKHRHLVKLLGCCSNRFNGGGWNLLIYEYMENGSVWDWLHGEPLKLKRKLDWDTRFRIAVTLAQGVEYLHHDCVPKILHRDIKSSNILLDSNMESHLGDFGLAKTLFENHESITESNSCFAGSYGYIAPEYAYSMKATEKSDMYSMGIVLMELVSGKTPTDAAFRAEMNMVRWVEMHLDMQSTAGEEVIDPKMKPLLPGEEFAAFQVLEIAIQCTKTAPQERPTARQVCDLLLHVSNNKKVEFEKTNLDHY

SEQ ID NO: 181184 - protein, 240 aa, Glycine max
  Coding DNA Sequence Number=SeqID_64406
  Gene Ontology: Mol. function=sulfate porter activity; Cellular component=integral to membrane; Biological process=sulfate transport
  Homolog annotation: Hit_ID=O04722; Match level="QueryCoverage=80%, HitCoverage=31%, E-value=1e-60, Identity=55%"; Hit description =Sulfate transporter 2.1
  Pfam annotation: Domain name=Sulfate_transp; Domain location=54-234; Score=25.0; E_value=4.5e-10; Accession=PF00916.10; Description =Sulfate transporter family
MGTSREIAIGPVAVVSLLLSSMMEKLVDPATDPVGYTKLILLATLFAGIFQTSFGLLRLGFLVDFLSHAAIVGFVAGAAIVIGLQQLKGLLGITNFSTKTDIVSVMKAIWEAVHNLGKRKKKLFWLASISPLVSVVVSTLIVFITRADKNGVKIVKHVKGGLNPRSIHQLDFNNPYIGEVAKIGLVVAVVALTFLKKRKWKRCQSGFSLLILDTSNLVNIDTVGITALEELHKSLSSHGK

SEQ ID NO: 181185 - protein, 313 aa, Glycine max
  Coding DNA Sequence Number=SeqID_64407
MACTKHTTCVSNVKAERQLVTALACRDTEPPFGGDPMDLTLLRSYKDHIASHVLISHPRDKLKLVSHGGKVMDYPTNATVKGYMDRSRLKVREMTITLNDLSCLLHLITGRFLDNTNTTYNKKEIKGLLRLELDIMTVQEADVMTSSGNEVFEHLLIIPCSEKVLNNDRDKPLTARWLLLRGTDKANGTRHCTFATSKLGHTYSRTGRVGIAYGGGGRGCSTWGFMPQPQPSGGQMSDYVLGVVCSCQDQFQIMSASTQRQLGMRVVPEGTNSHQVIQQLLLIAQKGLTVGRRSTEERPPPRKKANKGGRKGT

SEQ ID NO: 181186 - protein, 144 aa, Glycine max
  Coding DNA Sequence Number=SeqID_64408
  Gene Ontology: Mol. function=DNA binding; Biological process=DNA integration
  Homolog annotation: Hit_ID=Q0ZCD0; Match level="QueryCoverage=66%, HitCoverage=8%, E-value=5e-25, Identity=55%"; Hit description =Integrase
MSPYRVVFGKACYLPVEIEHKAYWAVKTYNFSMDQAGEERKLNLNELDEILLEAYENAKFYKEKTKKFHDSLIIKKDFMVGQKVLLYNSRLGLMSGVATYPPAGGRRETHGCVFQERKTREVATNVYSRKTSDKLEKTWSTNFK

SEQ ID NO: 181187 - protein, 136 aa, Glycine max
  Coding DNA Sequence Number=SeqID_64409
MKDETIEQSLLTLSLEEFFTNHFRPPPTVVIQQALLAATPSSESRFADLHYTVDDVLFRSRTCPHILFMFPMVSIGATKKSKLEALLSNFTLSREKLDNSNYSTWASNILLWISGQGYKEHLTSIVDSVPKVEHAK

SEQ ID NO: 181188 - protein, 88 aa, Glycine max
  Coding DNA Sequence Number=SeqID_64410
  Gene Ontology: Mol. function=DNA binding; Biological process=DNA integration
  Homolog annotation: Hit_ID=Q0KIN0; Match level="QueryCoverage=89%, HitCoverage=5%, E-value=3e-25, Identity=58%"; Hit description =Integrase core domain containing protein
MALVTCELIWLKQLIRELKFEGAAQMALICDNQAALHIASNPVFHERTQHIEVDCHFIIQKIESDVFTKSLRGPWVNYICIIALVTNK

SEQ ID NO: 181189 - protein, 62 aa, Glycine max
  Coding DNA Sequence Number=SeqID_64411
MVGKIMSQNFKVDSRLNYQAVVNSCTSKLLPAPCLECLFYILNWSFSKPLRRCRKQLGRCKK

SEQ ID NO: 181190 - protein, 220 aa, Glycine max
  Coding DNA Sequence Number=SeqID_64412
  Homolog annotation: Hit_ID=Q0KIN0; Match level="QueryCoverage=18%, HitCoverage=2%, E-value=1e-10, Identity=75%"; Hit description =Integrase core domain containing protein
MSVIYLKWSILRKILTNGQFRGGCSDESSYDTKGRGGIEITGCENITPKTGRDIAMEKKCLGCFNKMLVFAFNNPILLREQEDQDVPTEHVWQVEMLRKNTLVVRLTVVGGLSVVEELATLVGQVGLLQFPFRDRVDADPLLREARAKVSPTEAKDEAPVCLGGIHRRAEDVLVIEEKVHYSHGMQYGVDQDRRTSSHQTVVEQRQSSTLGTLYRGTERH

SEQ ID NO: 181191 - protein, 117 aa, Glycine max
  Coding DNA Sequence Number=SeqID_64413
MPNTLSATIGENKSDQNQNKISTQIRIITQSSHINHPCNHTCEAMKPSHKTCSSFQRKRVWTEASRAAGVVKRRGVLSGGGGKRVCVAVEQKCNDQAMVVIGRRWHTVEVGTIVGGG

SEQ ID NO: 181192 - protein, 83 aa, Glycine max
  Coding DNA Sequence Number=SeqID_64414
  Homolog annotation: Hit_ID=Q1SW56; Match level="QueryCoverage=86%, HitCoverage=7%, E-value=2e-08, Identity=34%"; Hit description =Polynucleotidyl transferase, Ribonuclease H fold
MNAHPVSKPNPHDLLAFEENMFNSFFNLFTTRAYWINVGHLPLEVLSNWDNILTSSWYQVFALRIHIDLPNVLPKITRGTKTL

SEQ ID NO: 181193 - protein, 297 aa, Glycine max
  Coding DNA Sequence Number=SeqID_64415
  Gene Ontology: Mol. function=protein binding; Cellular component =oxygen evolving complex; Biological process=DNA integration
  Subcellular localization annotation: CTP_CleavageSite=57; ConfidenceScore=5.13e-01
MIDSSLAPITLLDPDPPSNLNLPISLWKGTRSTSNPSPHYVTLSYHHLSPSLYTHLSLMSSVSIPHSTGEAFSHLEWRHTMIDKMCALQRSGTWDLVPLALGRPQLDVVGYTTLKLDPMARFIVLKPAWWQRATTLRSLYGLKQFPRAWFARFCTVVQQFGLVHSEADHLVFDRHSPQGCIYLVYVDDIAITGEDQHGKAQLKQYLFCQFPTKDLGRYFLGIEVAQSKDVSVVSQFLNSSCQDRWDAVIRILKYIKDADRAGSPSDRRSTFGYCVMIGGNLMSWKSKKQNVMARSSA

SEQ ID NO: 181194 - protein, 801 aa, Glycine max
  Coding DNA Sequence Number=SeqID_64416
  Gene Ontology: Mol. function=metal ion binding
  Homolog annotation: Hit_ID=Q9FIZ4; Match level="QueryCoverage=44%, HitCoverage=55%, E-value=2e-20, Identity=26%"; Hit description =Arabidopsis thaliana genomic DNA, chromosome 5, TAC clone:K23L20
MASSQVEIASSSPFGCVLRDRNHREACSRESSNVKGTHHHATFQRNMKNFVMDLNTCMVVSSDSTTNENENNSSSSNNNQRKAPKNSHLERLRITPANPFINNNNINNNETSLASLISPRHSRLLDRWATRQGCQMVSNLENEAELLSMDDNDMLPRTSSSSEEEDSSSETQNLGGASSLVQIWEKRLNQSGVSKPNTPRERIGSTSSSINENANAFSSENANALTGEEQCFDGPSGNEESLFPDWESSDHSLSPSGRSERDRVRVADIIKKLTATNPNQSPTPSFADDNEHEGYGSSVTGSPCRERECGNQQQQQQHSEQNQRVNCSLRIRGRRAYNDLLAQMKNDRHGELNNLVERGAVSKFPQRGRIQALLRLKLLQRGTAANDSTRQKSTASEVNNRQPQGSAIMQLRERFSSGAELRTAVQAEVANPKSPQRGTANKTTQLDNSATTDHLSKDTSNNKGHGNANHATESTQKSASQTRIDHNTEEAHPSSDVKVQETRPSSDVMTPHNDSQETTEASSSTIGSNLNEIMADRAETSNQQNAMAKSSNDETLDEEVESYQKYAETSYEEKVEEASNHNYGDEMEEEVEEIEQNCYETNYDWISEISRPRSYWEERRQAWYREMLETGSQNEDIRRLLERRTVSSFLSSDFRDRMDRLMESHRGTQTHLVSSQEREEDSHGLMAFLQARLHSTIASQDGRDAREEEEEESRNQNEEEEEEEEEDNADEQEQEHEEESLISGLYHEAGDYSNGSSSWSYRDIEAGYDFDRVVSTSPQPYQSQSFYPESRHSPSTNHHSI

SEQ ID NO: 181195 - protein, 429 aa, Glycine max
  Coding DNA Sequence Number=SeqID_64417
  Homolog annotation: Hit_ID=Q6CQF2; Match level="QueryCoverage=12%, HitCoverage=66%, E-value=5e-14, Identity=72%"; Hit description =Kluyveromyces lactis strain NRRL Y-1140 chromosome D of strain NRRL Y- 1140 of Kluyveromyces lactis
HRTPRDVRCSSNRWTLPPAEPFPGWAGWLNRKDNSFRGPPPTSPDSLTLPSAATSRFRNFNPIPFRSTRTERYQTGFPRPLGSTNPCASAVHMEPFPSSAFKICTDDRSARARALGFAATAAPSYSSGLGPCPDGRSFAPIPKSDERFARQYRCGPPPEFPLASPRSGIVHHLSGPDRYALTRPFTEDQGRSAVQPTGGPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 181196 - protein, 255 aa, Glycine max
  Coding DNA Sequence Number=SeqID_64418
  Homolog annotation: Hit_ID=Q6CQF2; Match level="QueryCoverage=16%, HitCoverage=50%, E-value=4e-10, Identity=73%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPHTCRDPKDGELCLSGAKPEETLVEARSDTDVQIVRLTWVGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHGIGLKFLNRDVAADGNVRESGDVGGGPRKELSFLFNQPAHPGNGSAGGRVQRLEEHRTSRGV

SEQ ID NO: 181197 - protein, 56 aa, Glycine max
  Coding DNA Sequence Number=SeqID_64419
MTEPASQGPGALLSQLLPLQINVQIPSHKGYEGTRFQKEIQKLQAASTATSPTSFT

SEQ ID NO: 181198 - protein, 515 aa, Glycine max
  Coding DNA Sequence Number=SeqID_64420
  Subcellular localization annotation: CTP_CleavageSite=26; ConfidenceScore=5.10e-01
MNEDCNSRTASLLLSSSSSPSNSKIVGDKRGSSHAGHGARKRVKMKDLDAVVHSVETNSRYSGFKNDKENTVQWSLGATDGSQQAKTGRKAMSEEFNFAARPLDLNTDVCKSGGCEKQEKGHANLVVSRGINVDLNVEDVTSPVNLEAANSSKGHNPFKSKDVSESGSCVGPLGDKDPMTKWKQMKEYGFWSPSHAGIPKPKQRGRKSKNEVLKRKIELAKREQVNRFTKIAAPSGLLNDLNPGIINHVRNRKQVLSIIENLVRSEKHESTSAGSKQAAHRIHGSVEISKRDQQNVADVGEHQHAFACEEGALHSSSGNRQARKFPVTMDDSSSLILEGKVCDRDTGTLEKGSLKGGVTQSTNVAEDDVLALKLSSETRASMSSTTLSNEESSNVTMVSSLSLKGSYFFEPLLIWMLLCFPAATVASQWLELLQQDIKGRLSALRRSRRKVRSVITTELPFLLSKEFGNNQDYDPCTVEMSAGLPTSKIADMHRARWSSLFDHMDAALSEEEKQL

SEQ ID NO: 181199 - protein, 156 aa, Glycine max
  Coding DNA Sequence Number=SeqID_64421
MDIEEDVEIPLILGRPFMVTAKCVVDMGKEQKANLVGGHLNFVFLKEDEAKPVMNPTNSSSVFLRPKQFLPMLHSLHHGQYLLMQSLHHFSLQQPMMTPKAFLAQVAWPKGQCPSVKVGDTFGVADDDAADTEADDDYVADINDAHRAWDPRPTQD

SEQ ID NO: 181200 - protein, 60 aa, Glycine max
  Coding DNA Sequence Number=SeqID_64422
MFENSLRQHQTKLTNRSLVGHGFESGNSLFAYARAPGWASLWAFPCAKPELCTKPGWRTK

SEQ ID NO: 181201 - protein, 50 aa, Glycine max
  Coding DNA Sequence Number=SeqID_64423
MMAKGWELCLELQWRMKKKRMANLCHMSPFEWSKKGPLSLLIVTYTQPQK

SEQ ID NO: 181202 - protein, 108 aa, Glycine max
  Coding DNA Sequence Number=SeqID_64424
  Subcellular localization annotation: CTP_CleavageSite=85; ConfidenceScore=5.04e-01
MAFMSASIYSCTSSALLITLALAQIFNMVHDISVKVKLEVIGTSTALNVFGIRRRSDVTRSIFCPNFCKMVTSMLQLDSMNLFVKARAWFNPITQGMAIDRQYFINNS

SEQ ID NO: 181203 - protein, 74 aa, Glycine max
  Coding DNA Sequence Number=SeqID_64425
MGDQEETQEQMKANMLALKEQMASMMEAMLGMRQLMENNVATAAAVSSATEAYPTFPATAHHPLPNPVGRGGIL

SEQ ID NO: 181204 - protein, 181 aa, Glycine max
  Coding DNA Sequence Number=SeqID_64426
MPAGLCYSDPGITPPIHSVDPEKSNKALGFPALITSLWQFYGVPVTPTKLIRPPINRSSIEKYCMPRQAQEPRQDQQHPAADAPLPSLQQPPSLESISTHMQRMELYMQHLANQQVANHRSQDPSPYPWPTPGQFRATVAWLGDMPNFQAGASPAEAPGGEDRAEEDSDMADVMDFFLGGD

SEQ ID NO: 181205 - protein, 102 aa, Glycine max
  Coding DNA Sequence Number=SeqID_64427
MEGPTSVAREGLWQELCHLAETLQRPLVVLGFDYPRKVEQAMLDKRDKVTVSKVAAKTYIQNPMGIPFRKILPEDFGLPEADISVNCYCNCFCKDNICYFVK

SEQ ID NO: 181206 - protein, 79 aa, Glycine max
  Coding DNA Sequence Number=SeqID_64428
MSMQCVATSWSSTTTSWQFPTRRGGRAAKNRLFKWHAVVGIDENGGNYILDQTGNCKIHHKPSIRGKEKTCKKIQEVAI

SEQ ID NO: 181207 - protein, 259 aa, Glycine max
  Coding DNA Sequence Number=SeqID_64429
  Gene Ontology: Mol. function=protein heterodimerization activity; Cellular component=cytosol; Biological process=pyridoxine biosynthetic process
  Homolog annotation: Hit_ID=Q45FF0; Match level="QueryCoverage=91%, HitCoverage=76%, E-value=1e-121, Identity=94%"; Hit description =Pyridoxine biosynthesis protein
AVASELHHERGVGGGGDSAGGEVDDGEAAELFGLHDEVVGRSDALGEGEDLVVVHVAENPNVAHDGTHVANGLDDVAGAGLALGADHGGALADTAEGLAEVAAATDEGDAEVVFVDVVGVVGEGEDLALVDVVDADGLEDLGLDEVADAGLGHDGDGDGPLDVLDELRVAHAGHAALGTDVGGDTLKGHDRAGTGLLRDAGLFRVDDVHDDAAAEHLGQAHFNGEGGLLGLGDCTVAVHLRRERKRIRRKKEGLLLCGE

SEQ ID NO: 181208 - protein, 349 aa, Glycine max
  Coding DNA Sequence Number=SeqID_64430
  Homolog annotation: Hit_ID=Q9LU00; Match level="QueryCoverage=74%, HitCoverage=66%, E-value=7e-18, Identity=30%"; Hit description =Arabidopsis thaliana genomic DNA, chromosome 5, TAC clone:K15C23
MASAQVDKTNIEVDDFLVREIEKPRNSTMESLQNEKQIMVDPLSLKGSPIKYTTTMLPTIITTSSSIILHPPPLQPPKPRFLSTSLPNSANSSPRFASPLSKKKQRGESPESQGHGSNLTHKLQHLLQEVHLRKSKSCGGAIAFATSDEFDHWLSKISALEHEKWHHDNFSKIEVVKASPKSVKLKHMKTAHDGFKCSALCLYLPGFGGKLKPVKARKEESEKGGTMSRTVSLEKFECGSWSSAAIFNEIEGDSTNSYFDLPMELIKCSANEVYSPVASSFVFERDLKGILKNGSSRASVRKSDASPRHVRFSTSSSASHPASPASCISPRLRKAREDFNAFLAAAQSA

SEQ ID NO: 181209 - protein, 565 aa, Glycine max
  Coding DNA Sequence Number=SeqID_64431
  Gene Ontology: Mol. function=zinc ion binding
  Homolog annotation: Hit_ID=Q6EUF2; Match level="QueryCoverage=83%, HitCoverage=83%, E-value=1e-165, Identity=59%"; Hit description =LAs17 Binding protein; Lsb3p-like
  Pfam annotation: Domain name=DUF500; Domain location=406-563; Score =154.3; E_value=3.1e-43; Accession=PF04366.3; Description=Family of unknown function (DUF500)
  Pfam annotation: Domain name=FYVE; Domain location=225-293; Score =68.1; E_value=2.8e-17; Accession=PF01363.12; Description=FYVE zinc finger
  Pfam module annotation: Pfam domain module=DUF500::FYVE; Domain location=406-563::225-293
MEGKILDSQNQVKFVENLSARVSSCSLGDKISYSDSPLDDEVDGRRSNCVTKEYCDSFFNDSTEGHCINSSRLYLESPEKQMEKNNEDMESSANLQKRGKYFYYDTPLQEDTGVWIPVSVPPMLEDDHKEWTKGFHSNGGYFPDDDMGWNQYVGDERELTMWDVLAEMLLVARGKVTSLASGDIHTCNFSWISSHVLEQAWREMAQTLTEANFGNVKELLEAEPPKWLADSAASSCMLCGVRFHPIMCSRHHCRFCGGIFCGECSKGRSLLPSKFRVSDPQRVCDVCCVRLDSVQPYLMNHVSNAAQLPTHDLTDLSTLRSWINFPWGQSMEYEIYKATNTIKAYNQIGFLKPEKSIPDAILRQAKGLAIITVVKVGVVVTYNIGTGLVVARREDGSWSPPSAVSTFGVGWGAQAGGELTDFIIVLRTNDAVKTFSGNMHLSLGAGLSAAVGIVGRSVEADVRAGDGGYAACYTYSCSKGISNSSTIDTRAANVPLLSEHSSVEGAFVGCSLEGSMVTTRTQENSLFYGSQSITATDILLGSLPRPPAAAILYRTLVDLYSKFDD

SEQ ID NO: 181210 - protein, 78 aa, Glycine max
  Coding DNA Sequence Number=SeqID_64432
NPNRATRGKVLESTENATIANGERLSNYIEEYECDNLLFMYCLCLDPVMILNLVFMGADDYVDYFKEPYAGGSHDTML

SEQ ID NO: 181211 - protein, 176 aa, Glycine max
  Coding DNA Sequence Number=SeqID_64433
MAFSLFIPSQPFPLVPTLLLLVLLHASLLEPSHGARISKDASTRHLFESRNTKHPNKCGELVALSQCSQNSKCSWCTSEVLDDMCFTKSEAWRLPQQVYSCSLIRLYLGLGASRTRLHLRQRLMEWQMIIAGNGGKDNTELYIELKRLVKPSTFKTPSPMLYCHWKRFIQYAIGFI

SEQ ID NO: 181212 - protein, 295 aa, Glycine max
  Coding DNA Sequence Number=SeqID_64434
  Homolog annotation: Hit_ID=Q47522; Match level="QueryCoverage=17%, HitCoverage=62%, E-value=1e-21, Identity=94%"; Hit description=LacZ protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILEGRYHKEVSENASVQILYEDIPLSNEILKSIQISPRRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 181213 - protein, 60 aa, Glycine max
  Coding DNA Sequence Number=SeqID_64435
MGRIKISHNPDLCEFGKRMGTCFCWPRCPMVAVLVEWVFVFGSVHFGLQCSNGDKYISVD

SEQ ID NO: 181214 - protein, 201 aa, Glycine max
  Coding DNA Sequence Number=SeqID_64436
  Gene Ontology: Cellular component=membrane
  Homolog annotation: Hit_ID=Q5QLF2; Match level="QueryCoverage=89%, HitCoverage=46%, E-value=4e-26, Identity=37%"; Hit description =Purine permease-like protein
  Pfam annotation: Domain name=TPT; Domain location=26-173; Score =136.9; E_value=5.6e-38; Accession=PF03151.7; Description=Triose -phosphate Transporter family
MSSAILAFNSSHEKSEGLTQKDYIIGFSCTIGASFLFSLYLPLMERIYERVYCYEMVMEMQIIMEIAATALVTGGMVYKGGFSEMREEAERVFDKGSTFYWLTVVSSVVTWQCCYMGTAGLVFLTSSVTGGVSANALLSLNVLAGWFVYHDAFNGFKIVATVLCIWGFCSYVYCMYFKRRQEEAAERRNSSGGSTTELVVK

SEQ ID NO: 181215 - protein, 70 aa, Glycine max
  Coding DNA Sequence Number=SeqID_64437
MREQERKKLEMMSLIDKMKKPNIMAKRYEWEALGKIFKKHKDLLDKQIDLHERTPLHYAAHCGRETSSVC

SEQ ID NO: 181216 - protein, 310 aa, Glycine max
  Coding DNA Sequence Number=SeqID_64438
  Gene Ontology: Mol. function=aminoacyl-tRNA ligase activity
  Homolog annotation: Hit_ID=Q2IK46; Match level="QueryCoverage=48%, HitCoverage=17%, E-value=1e-46, Identity=58%"; Hit description =Hypothetical protein precursor
  Subcellular localization annotation: CTP_CleavageSite=32; ConfidenceScore=5.20e-01
LLAGQLRPRLPGALPGSAGRGRRPDRGVRQPVAGTGRRRAVGRPDAPRQRSTEGHDGLPLHRTVPVGPRAGLCAFLAGHGAVVRSGPASAGRSLEPPGRPAGAAWRTLLWLQWPAPLQVEVRSAVAATLSRGARRHASAGRAAGCHAPDLAGSAAELKPRCVGHGLTLRPTLEDHFGQAIVVPPEMVIARQLHLPHAVIGRQVRAQCVLILVAVHAQRFFRRQPGHFRRDRQAVAATAQPVADMEFEVGLPAHRQQHDALQRLAGTGVELVDRGRQHVGALRETDQHHLVSVPLLAVVVDDLLQVARKAL

SEQ ID NO: 181217 - protein, 77 aa, Glycine max
  Coding DNA Sequence Number=SeqID_64439
MDPICLIMAQGSWNSCSESLSHKDMDLIIDMLPPFINSNKVVDLWGEEKDDEDAAEDDKEDDGLYRDFCGYLHLFPQ

SEQ ID NO: 181218 - protein, 59 aa, Glycine max
  Coding DNA Sequence Number=SeqID_64440
MRFHNVHIESSIFVPCNKTHDNTFMNVMGSPKFLQSISKNESVSIFMKLYKVLVSFVVE

SEQ ID NO: 181219 - protein, 170 aa, Glycine max
  Coding DNA Sequence Number=SeqID_64441
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=2e-17, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYTPSPLDGYTPSPSDDYMSSSLEDSTSSPSQDSTSSPLEGCKPLPSKNYTSSPLEGSTPSPSQDYTSSPLEGCTPLPLEDYMSLPSEGCTPSPSEDYTPSPSEDYTSSLSEGYSPLEGYTSSPSEGYMPSPLEDYIPHFQRTTRPHLQRVARARFQRAPHLRL

SEQ ID NO: 181220 - protein, 393 aa, Glycine max
  Coding DNA Sequence Number=SeqID_64442
MVEHSVRVLESAEGVLENTTRVLEPDPGKGEDDLSKATKKVKDKVPETPFEFQTSEGVKGNGANDKSYMDSLLTTGLYQGHGGQDLNLEKKMTWWRIMGRKRMLENRFLTLVRLFKYLMRSLHSSVHLGRGTVLKIDRLMPRGKFARIYVEVDSEKQLVSRIKAREHTYYVEKQQVVGASGGTITEKLVELTSVAKEATRVDFTVNDCTINGNIVDKSGEINEIATEIKSPMLGLEWVDALDQLLTTDPPCAKEFGRNKDVGAINRGKNNTNDRDKGVTYSGNLMKGAQGVPSVIVTRPFLKSRRATRLEKGNYSKEGVPKDYDPRGGIDEHLLDLMRRIKVPLEVLNASLALDQMGADSNLVEMADIQPHVEERNETMGSPNNMDTENLSLN

SEQ ID NO: 181221 - protein, 53 aa, Glycine max
  Coding DNA Sequence Number=SeqID_64443
MPDFYIGCPNNRCRMISILHRVLDFQGMDSIYAHQEQNFDVSKHMPGQCPYDK

SEQ ID NO: 181222 - protein, 201 aa, Glycine max
  Coding DNA Sequence Number=SeqID_64444
  Homolog annotation: Hit_ID=Q2HRX8; Match level="QueryCoverage=69%, HitCoverage=20%, E-value=3e-17, Identity=35%"; Hit description=IMP dehydrogenase/GMP reductase
  Pfam annotation: Domain name=DUF1723; Domain location=124-173; Score =51.0; E_value=3.9e-12; Accession=PF08330.1; Description=Protein of unknown function (DUF1723)
MLTLTHVLAHDSFSLNTRRQRQQQVVVEDPPTAEEELVNDQPKAPIEEGAADVEGFPGGPHDTSVLSDLENHIALKVWNGEERPELKLSSHGRKMVEFGRPTPEIEGLVVASGLSPLIACSLDTGDRGLMSTFVECWPKETSSFHLPVGEVTITLDDVVSLLHLPVVGAFHSFKLLHVDDTIEMLVELLEVNAVEARAETI

SEQ ID NO: 181223 - protein, 101 aa, Glycine max
  Coding DNA Sequence Number=SeqID_64445
MVSFIHGNPNLEIRMGLLADLIQFVISIHIPSVALGDFNAYNFVSKKSGEAPPNQSTMIWVSKDNFVGGVKPFKFHACWLVNNSFHDVVRGTWNGAQHYLA

SEQ ID NO: 181224 - protein, 88 aa, Glycine max
  Coding DNA Sequence Number=SeqID_64446
MGQNTKTSRALKFTHQNINWLPKRQKEEGIEASILYYLNVILFSLSMDIISQIPTVKVWWSAGKREDFGRRREKNENEGKRRHRWSEN

SEQ ID NO: 181225 - protein, 134 aa, Glycine max
  Coding DNA Sequence Number=SeqID_64447
  Gene Ontology: Mol. function=RNA-directed DNA polymerase activity; Biological process=RNA-dependent DNA replication
MSYFTSLFGDTKRIQATNNTIPVISLDEDKMFWETVGDDVWRLVREAFETSMFNPKDVEILIVLIPKNDGAKHLKDFRPISLCFMIYKLISEVLVNRLRPFLSNLASPMQSSFIPGRETTNNAIIHSFLESFAT

SEQ ID NO: 181226 - protein, 81 aa, Glycine max
  Coding DNA Sequence Number=SeqID_64448
GFLQSRGERPFRFIAAWCTHDDYKHMVHNAWNRYANDVLTSLDNVKEETLVFNKEVLESIFCCKERALGKDQRPREVLGER

SEQ ID NO: 181227 - protein, 109 aa, Glycine max
  Coding DNA Sequence Number=SeqID_64449
MCWPKPGCKGSIGEVMAGTRFGNVLGNVMKPGLVIDPVEVVGQWSNRWADFTLCYTLFSRFETLTLLFLFGHHRLTKSPKFDPSQVVDVFVCVIGSEVDAASSLTVQRW

SEQ ID NO: 181228 - protein, 71 aa, Glycine max
  Coding DNA Sequence Number=SeqID_64450
MEKSKFDTLIAISPNTWHASNWKWKLLEIEVGSGSWKLKVGNGSYWKLKVENGSWKLEVGGGSYWKLNVGI

SEQ ID NO: 181229 - protein, 136 aa, Glycine max
  Coding DNA Sequence Number=SeqID_64451
  Gene Ontology: Mol. function=DNA-dependent ATPase activity; Cellular component=nucleus; Biological process=DNA replication initiation
  Homolog annotation: Hit_ID=Q8H1A3; Match level="QueryCoverage=89%, HitCoverage=14%, E-value=6e-50, Identity=77%"; Hit description=Mini -chromosome maintenance protein MCM6
MEAYGGFMVDEKAVRVENAFLDFLKSGISSFKSSSQRNELYYEAEIELMKSNESNTMFIDFDHVIRFSDLLQQTISDEYLRFEPYLKNACKRFVMDLKPSLVSDDSPDKDINIAFYNMPIVKRSMVFPIQCLLSLG

SEQ ID NO: 181230 - protein, 401 aa, Glycine max
  Coding DNA Sequence Number=SeqID_64452
  Gene Ontology: Cellular component=membrane
  Homolog annotation: Hit_ID=Q5QLF2; Match level="QueryCoverage=77%, HitCoverage=79%, E-value=3e-63, Identity=42%"; Hit description =Purine permease-like protein
  Pfam annotation: Domain name=DUF6; Domain location=72-204; Score=7.5; E_value=0.025; Accession=PF00892.11; Description=Integral membrane protein DUF6
  Pfam annotation: Domain name=TPT; Domain location=222-369; Score =125.2; E_value=1.8e-34; Accession=PF03151.7; Description=Triose -phosphate Transporter family
  Pfam module annotation: Pfam domain module=DUF6::TPT; Domain location= 72-204::222-369
MSPCIKINTSEIEFFDQLEAGGEALAHADLVSSMDNTTMQVHADQKGSSSTKKRYININMPLFVINYACLFVGSLSSSLLSKYYFTHNGSSRWVSTWVQTAGFPLLMIPICVPYLFKFTKRVPFTDFTPRMLILSISIGVMLGFNNLFFSWGNSYLPVSTSALLLSSQLLFNLLFSVIIVKQEITFSNVNCVILLTLSSILLALDSSHERPQGLTQKNYFIGFFCTIGAGLMFALYLPLMEKIYKKVNCYQMVMEMQVIMEAAATALAIVGMTWDGGFSEMKVESQMVFDKGSRVYWVTVMGNVVTWQLCFMGTAGMVFLTSSLTGGICMTFLLIMNVLGGVVVFRDAFGGIKVVSTFLCILGFCSYICGIYKYNQMGEHKLAPTRNKNSSDDSSTEMIHI

SEQ ID NO: 181231 - protein, 120 aa, Glycine max
  Coding DNA Sequence Number=SeqID_64453
MRVNLTKNGPARLPTPSWKGKGRRRGIEKEKDGALCAKRGKRWWEVLGKEGEEGGVENLNVRTKETFHQMIEANSKSCRANNKSLYFITDFIRINIGGHHLFQPLIKQNNNDSGWIDEPK

SEQ ID NO: 181232 - protein, 218 aa, Glycine max
  Coding DNA Sequence Number=SeqID_64454
  Homolog annotation: Hit_ID=Q9SMK5; Match level="QueryCoverage=64%, HitCoverage=68%, E-value=9e-48, Identity=72%"; Hit description =Plasma membrane intrinsic polypeptide
  Pfam annotation: Domain name=DREPP; Domain location=1-218; Score =367.4; E_value=2.3e-107; Accession=PF05558.3; Description=DREPP plasma membrane polypeptide
MGYWKSKVLPKIKKVFEKNSTKKAAAAEATKSFDESKEEYNKAFEEKKTELQTKVVEIYEASSTEIKSLVKEPKEAGLKKNSTEVQKFLEELVKIDFPGSKAASEASSKFGPALASGSVFFVFEKVSTFIVTEEKDVEAPPGVETKTEEETSSVVKEREIVVEEEKKKEKKEEEKPQVIETSDEKKVEEKPAETSAKGEEKPAEEAAAVVEQAEPPKP

SEQ ID NO: 181233 - protein, 644 aa, Glycine max
  Coding DNA Sequence Number=SeqID_64455
  Gene Ontology: Mol. function=DNA-dependent ATPase activity; Cellular component=nucleus; Biological process=DNA replication initiation
  Homolog annotation: Hit_ID=Q8H1A3; Match level="QueryCoverage=99%, HitCoverage=75%, E-value=0.0, Identity=78%"; Hit description=Mini -chromosome maintenance protein MCM6
  Pfam annotation: Domain name=AAA_3; Domain location=185-326; Score= -13.8; E_value=0.01; Accession=PF07726.2; Description=ATPase family associated with various
  Pfam annotation: Domain name=AAA_5; Domain location=185-332; Score= -10.6; E_value=0.011; Accession=PF07728.4; Description=ATPase family associated with various
  Pfam annotation: Domain name=MCM; Domain location=127-451; Score =694.4; E_value=8.2e-206; Accession=PF00493.13; Description=MCM235 family
  Pfam annotation: Domain name=Mg_chelatase; Domain location=152-340; Score=-147.5; E_value=0.015; Accession=PF01078.11; Description =Magnesium chelatase, subunit ChlI
  Pfam module annotation: Pfam domain module=AAA_3::AAA_5::MCM::Mg _chelatase; Domain location=185-326::185-332::127-451::152-340
MQETSKEIPAGSLPRSLDIILRHEIVEHARAGDTVIFTGTVVVIPDIMALASPGERSECRRDASQRKGSTAGNEGVSGLKALGVRDLNYRLAFIANSAQICDGRREIDIRNRKKDVDEDNQQFTDQELEEIKRMRSTPDFFTKLVESIAPTVFGHPDIKRAILLMLLGGVHKFTHEGINLRGDINVCVVGDPSCAKSQFLKYTSGIVPRSVYTSGKSSSAAGLTATVAKEPETGEFCIEAGALMLADNGICCIDEFDKMDIRDQVAIHEAMEQQTISITKAGIQATLNARTSILAAANPAGGRYDKSKPLKYNVALPPAILSRFDLVYVMIDDPDDQTDYHIAHHIVRVHQKREGALAPAFTTAELKRYIAYAKTLKPKLSPDARKLLVDSYVALRRGDTNPGSRVAYRMTVRQLEALIRLSEAIARCHLDNEVQPRHVRLAVKLLKTSIISVESSEIDLSEFQEQNHDDGAGGGNENDNNRDANYQEGNDTAQQAAGNGNDQVGNDAAQQATGNNGNPADGSKPQVRKLIMSDEYYQRVTSALIMRLRQHEEAVVQGDGLSGMRQKDLIQWYVDQQNERNNYSSMDEVQAEISKIKAIIESLIRREGHLIVVDNGEAAAAAAEPPGAPRNYRILAVAPNYVID

SEQ ID NO: 181234 - protein, 74 aa, Glycine max
  Coding DNA Sequence Number=SeqID_64456
  Gene Ontology: Mol. function=RNA-directed DNA polymerase activity; Cellular component=nucleus; Biological process=RNA-dependent DNA replication
MVSTSNSIATERPKIIRTERVSSLCSFHSLLDLQEIAPRCMFFADDIVLLGESREELNERLETWRRALETHGFA

SEQ ID NO: 181235 - protein, 122 aa, Glycine max
  Coding DNA Sequence Number=SeqID_64457
MGHRVLFDVPVLFRNQGDAGVVFEHEMRRWVNSGKEGCKGIIPNLREIKQSRVPNFLVNNNKYHLKKPFNAKHKNIGRDWISLRIIRCNCEGHALGVMTASNHALSVFKLIAGRNILYRDAI

SEQ ID NO: 181236 - protein, 55 aa, Glycine max
  Coding DNA Sequence Number=SeqID_64458
MSRCAPKPEENTQMRLSKSYGFLIRSRWTFVGCCKRAWYKVQVRLTKSKISMVNC

SEQ ID NO: 181237 - protein, 87 aa, Glycine max
  Coding DNA Sequence Number=SeqID_64459
  Gene Ontology: Mol. function=hydrolase activity; Biological process =aromatic compound metabolic process
  Homolog annotation: Hit_ID=Q9LVU7; Match level="QueryCoverage=84%, HitCoverage=16%, E-value=4e-29, Identity=82%"; Hit description =Genomic DNA, chromosome 5, P1 clone:MNB8
MVPDRVLSLALLNVTGGGFQCFPKLDQKTISVAYRFLKAKTPEQRAAVDLDTHYSQEYLEEYVGTDKRRAILYQLNSNIPDAFIKTS

SEQ ID NO: 181238 - protein, 239 aa, Glycine max
  Coding DNA Sequence Number=SeqID_64460
  Gene Ontology: Mol. function=DNA binding; Cellular component=nucleus; Biological process=regulation of transcription, DNA-dependent
  Homolog annotation: Hit_ID=Q84XV2; Match level="QueryCoverage=99%, HitCoverage=61%, E-value=8e-61, Identity=50%"; Hit description=IMB1
  Pfam annotation: Domain name=Bromodomain; Domain location=1-72; Score= 53.5; E_value=6.9e-13; Accession=PF00439.15; Description=Bromodomain
MEPVDVEGLGLHDYYQIIEKPMDFGTIKRKMNAKDGSGYKNVREIYSDVRLVFENAMKYNGEKNDVHIMAKTLLEKFEKKWLQLLPKVAQAEREKEEARVLLEAKRAQEATYAKMTKDIRHALCDVDEQLKNLKEMVIKKCRKLSTHEKLALKKNLSRLNGGNLLKAMSIIHEIDPTFQHDAPQVDLDLDRQSDFILWKLNLFTKEALEDQDKAAAEEMAVNHNVNTEDQKNTNKRRKL

SEQ ID NO: 181239 - protein, 143 aa, Glycine max
  Coding DNA Sequence Number=SeqID_64461
  Gene Ontology: Mol. function=hydrolase activity; Biological process =aromatic compound metabolic process
  Homolog annotation: Hit_ID=Q0W9E0; Match level="QueryCoverage=72%, HitCoverage=58%, E-value=2e-24, Identity=53%"; Hit description =Putative hydrolase
MTETEIEVIKSAGFLVSVIHGRHDIIAQIYYAKRLAERLHPVARMVDLHGGHLVNQALFDLIKASEVNMSPHDWTNLPKKESFHPTPPFSVATSKTQFHSKVLTDNWFHTWFDYLSITQQPQVFTKHRDMFHQCIISPRWIYW

SEQ ID NO: 181240 - protein, 95 aa, Glycine max
  Coding DNA Sequence Number=SeqID_64462
TLGAVCAVLQLELENYLSNPHNKGGASNSQRNVRHVDSFGDSDSKDSSEEQNELSEVKESKKKKKKKEKKKNKKRKNSEDPGCAVVKKPKQKFKF

SEQ ID NO: 181241 - protein, 141 aa, Glycine max
  Coding DNA Sequence Number=SeqID_64463
  Gene Ontology: Mol. function=hydrolase activity; Biological process =aromatic compound metabolic process
  Homolog annotation: Hit_ID=Q9LVU7; Match level="QueryCoverage=98%, HitCoverage=30%, E-value=1e-38, Identity=60%"; Hit description =Genomic DNA, chromosome 5, P1 clone:MNB8
MPFCYVGTQPSSPVADAPLNNDIKIFYRTYGGGPTKVLLIIGLAATHEAWGPQIKGLTGTTVSNDDDDDDVRVVWSGEEVNGGIHVCAFDNRGVGRSSVAVSKSEYSTKIMAKDAIALLDHLGWKKAHVFGHSMGEFRVCH

SEQ ID NO: 181242 - protein, 93 aa, Glycine max
  Coding DNA Sequence Number=SeqID_64464
MLLKKSKEGMISLCSFRSRMQGEGRRRVSGGSGREVSGELFSTARGDPARMCESHANGNAWFCKSTTSFNLNMEESEGTHQFGKCIMQNTWPK

SEQ ID NO: 181243 - protein, 98 aa, Glycine max
  Coding DNA Sequence Number=SeqID_64465
MVKEIENLTEDERRALRGSKFAPLPRRSNSKPRLAHPCGPLATNKAAALAKFLERKLKDPNGLASINPDLLELAVNNAKETVYASNTSNSFSFSLPSL

SEQ ID NO: 181244 - protein, 269 aa, Glycine max
  Coding DNA Sequence Number=SeqID_64466
MAKFDPEIVMEFYANAWPTEEGFRDMRSWVRGQWVPLDADALSRFLDHPLILEEGQQCKYGQQRNQANSFDEEAIAQLLCTPGQDFARTAAGRRVRIMCTSMTALTQMWMTLLLSNILSSDHNSDLPLPKCQLVYSSHEIPLGPGEVQQGPGVSDSDHGPLPVLWSARYTQQGTGRSTLATGSGRTATTSAGHFDQSTERGALPATYGSPAGGQPPRTEQFRAAVAWPGDWPDAQTRVGPVGGPGAEEEAQEDEEMTDLFDFLGGGGAR

SEQ ID NO: 181245 - protein, 53 aa, Glycine max
  Coding DNA Sequence Number=SeqID_64467
MGHLFKQLSSVAQVMLYLYESEITRGQKPLKGNITLFGSINKTLYRVKVGSAS

SEQ ID NO: 181246 - protein, 74 aa, Glycine max
  Coding DNA Sequence Number=SeqID_64468
MAKNDGKSLRNHPRKYFRSVTEAPRFEFSLRKRPSPIYREKRVMLAAQLASASSALPGKQVASSGSFLRHPPDS

SEQ ID NO: 181247 - protein, 284 aa, Glycine max
  Coding DNA Sequence Number=SeqID_64469
  Gene Ontology: Mol. function=kinase activity; Biological process =carbohydrate metabolic process
  Homolog annotation: Hit_ID=Q1SCC6; Match level="QueryCoverage=77%, HitCoverage=47%, E-value=1e-100, Identity=81%"; Hit description=CBS
MNKIFPNSRLFQVEFGSFFNLGALNWRGIHWNLRRGSWRSCDEVWCLEGILKVALNSRFNVWSEHGFCKECGWCGRDSANSHAFCVAIWRKECVSQWWLELLPMSPVEGCPTVFQVIYNLPPGYHQYKFFVDGEWRHDEHQPYVPGDYGIVNTVFLATDPNYIPVLPPDVASGNSMDVDNDAFRRMVRLTDGTLSEVLPRISDTDVQISRQRISAFLSSHTAYELLPESGKVVALDVDLPVKQAFHILHEQGIFMAPLWDFCKGQFVGVLSALDFILILRERCH

SEQ ID NO: 181248 - protein, 1513 aa, Glycine max
  Coding DNA Sequence Number=SeqID_64470
  Gene Ontology: Mol. function=zinc ion binding
  Homolog annotation: Hit_ID=Q10LI9; Match level="QueryCoverage=59%, HitCoverage=79%, E-value=7e-28, Identity=26%"; Hit description=CW -type Zinc Finger family protein, expressed
  Pfam annotation: Domain name=zf-CW; Domain location=625-673; Score =71.5; E_value=2.7e-18; Accession=PF07496.5; Description=CW-type Zinc Finger
MVEMKENTELEEGEACYYNGDDEANIDPDSFSYIDEKIQHFLGHFQKDFEGGVSAENLGAKFGGYGSFLPTQERSPCLWSHPRTPQRNHSSPKSNINLHMEVVSHNTKASSNVPHARPENASHSSYSLRDLREASVNDSVKKERGISSSDTAERCTLKDDTTKKTGNSTDQRPLKFRIKMKSNILAQKNAEIYSGLGLDNSPSSSMGNSPVESEGMPPVSQENAEGSPTGIIQVMTSFPILGCVLVSPLHESLLYMMKNEKVISDSKYLSSLKGHQDTCSMSTDESDSFVGNEHLKKRTVRIVRQSEKQLELKHTNGTFSEKDLTLHTKKRLGNRTPDCKDFLSNDLKCTPLSSSICDAGETAEVTAKAFEASKEFNENGVQGRMVPVEALKEESLESISGQDFEKTEKQNSGNGFMKNALEHKLENSRKDNYTDPMNNNTRNTFMISNKFECDAVKHKVDHKYENHQKVKAVSERKTKSKGDQSPRKAEAVARKDSFCGTSDAMVINKVSAGCDNTSKSKMNKSKSLKGKKFSDSNRDSLRGKKSEQKVDSVAGNGAIKNGNISNGKQSAFGAKVKVRPSCHKVANQLLAGPCIKDTSAALLITENSIAPEMISSAGVPQVIAEDWVCCDSCQKWRLLPNGVKPEHLPEKWLCSMLNWLPGMNSCDFSEDETTKALYASYQMPISNGQNNMQSHGTETAIGVSSTDALQYGLNHNMSSSDMLSDRGKKKHVIKEKTMSGINNDVLQFPNSAKTNVQVSGKNRSLNVMNQHPADLNPMKKMSSSKHLSSLDNMIEEKSVPIEKEKQVNEGERKHVKLKRKMDADQYKLGTPKKPKIENVFYADKQLNPGMDLEKVSLYSRNSLATKASGKDMRKHDEYCLSDDVQDSLPVTVKKEGDQAQVLSGGGSLDVINGSKSGLMKKRKLKECMDDEKHNNSCSSHGEKHNNSYSSHGEKQYGEEGNASEFRKEKRYRILNKEAKSLTEGDNKLSKGGMRQVCLSGNRDQMAVGTEVRFVDKGNQPRKHRKNTASLHASDGIGQLGKDLGSRPLSLAATSSSSKVSGSHKAKTYFEDLRGSPVESVTSSPLRAFNSDKNIWAVGGTSAKDDATKGCLSSVGSRRSVDNREGKLSVKLKAGRISRDLHPASHKLSSIEVRVEDAKDTARVQAKKSSELKNSHLLEGGVHVEQPGYCANGKRYEEKVNKDNQESEFSWQKSGKVSSLHSKEKDRKSGSHVGTDKMKISVSETGGYSKKSGKYDSAVDPSNHESGAESKNNAKYISPKSKSEIDCISQKSALRHGPNETGKQTEIKQRDFENSILKMDAQCSTDNNKPIPWQNLTQDFEGENKANLTESRVGKSKVLSSAVDEVKREALSVGSRTVPQHQKGGMSNEHHVHVSGNDDMAKSMRNYADVSNNAGVNYSSGNFAPDQQLTLLSPLRTNSNQTATDTLKEAAKLKDRADNYKNSGFDFESNETYFQAGLKFLHGASLLENCHNESSKHGEMSQMQIFATAAKLFK

SEQ ID NO: 181249 - protein, 42 aa, Glycine max
  Coding DNA Sequence Number=SeqID_64471
MNKRGMRENLEKRVGIGKSGQALKGLSLSLVYDESLKSESGL

SEQ ID NO: 181250 - protein, 67 aa, Glycine max
  Coding DNA Sequence Number=SeqID_64472
MHEMAPKKLSTKRSRKDTPGEGSSAAMDFDSRHFRSAKHQQCFEAIKEWSFHRERRVQLREAEYPDF

SEQ ID NO: 181251 - protein, 112 aa, Glycine max
  Coding DNA Sequence Number=SeqID_64473
MYFMVEATAGESMMFPTVKKTISTAITRRESRDSSEIFFLFFFLRYGEIGSGLELADLEKKKEKRNEKGKKRKGYEKAHWKKQMKYLRKQKKQSWKGIMHGSNSLRVAATIA

SEQ ID NO: 181252 - protein, 200 aa, Glycine max
  Coding DNA Sequence Number=SeqID_64474
  Homolog annotation: Hit_ID=Q1SDS1; Match level="QueryCoverage=52%, HitCoverage=20%, E-value=1e-08, Identity=35%"; Hit description=IMP dehydrogenase/GMP reductase
MGSRKTPPLKKRFYQVKIKGLAAIDTFLAFHHSKESPVNWFPRWKEGRSGILFSCKGFPNVPLMGIRGCINYNFVIAIRQLGYPMRGAPSVESLTPFVTRGFSDPNARMLQGVHKAWEKVQRKDRELRGSGNGIIGDYRKWLRANTQGLDWLLKLRAAKEEEAEAPEESEEENEELRDINIATAKALEQETKRARKEEHD

SEQ ID NO: 181253 - protein, 41 aa, Glycine max
  Coding DNA Sequence Number=SeqID_64475
MTGPNIQRKRDDAMRKKCAWVCGATRRHKIMGCNFVPYEEE

SEQ ID NO: 181254 - protein, 106 aa, Glycine max
  Coding DNA Sequence Number=SeqID_64476
MILKDELKTCLRSKRSLSQQLSETEANMLAIIGKYKEELDLATAHEHKVANEYAQVFAEKEARGRSRSSLITCKGQGDGGHILGPRGNPWAPQLLSAYDRPDDPYN

SEQ ID NO: 181255 - protein, 81 aa, Glycine max
  Coding DNA Sequence Number=SeqID_64477
ARISREWGQCGTRHYFRIHPRPRPSLTTPQFNKNKQQFEDKSLTFLSKHMQFRAPKYINGKLESPRMRGGSPRRAQLAQAS

SEQ ID NO: 181256 - protein, 101 aa, Glycine max
  Coding DNA Sequence Number=SeqID_64478
  Subcellular localization annotation: CTP_CleavageSite=92; ConfidenceScore=5.18e-01
MTRAFSLNPWVSYPNFVRGPLLDDVRPFFGPREKAVASGGSNPARLGELSSPGRAGRQPPPLFSEALPKRFRNVFREEFRKDFNRSSTFFIRSSSFFDLQR

SEQ ID NO: 181257 - protein, 136 aa, Glycine max
  Coding DNA Sequence Number=SeqID_64479
  Homolog annotation: Hit_ID=Q8LEG3; Match level="QueryCoverage=43%, HitCoverage=10%, E-value=2e-11, Identity=51%"; Hit description =Microtubule-associated protein MAP65-1a
MAINLLSLLSAEVTDPGSLTLEIVQQISKAKERASSRKAIMEKVEKWMLACDEERWLEEYSREKIIIRLKEDSPESDEQSVENKTLENRKEHVRENENEPLRERRTHRRESESSEGERESHERKGHWRGSEVREGG

SEQ ID NO: 181258 - protein, 104 aa, Glycine max
  Coding DNA Sequence Number=SeqID_64480
  Gene Ontology: Mol. function=oxidoreductase activity; Biological process=flavonoid biosynthetic process
  Homolog annotation: Hit_ID=Q0EDG6; Match level="QueryCoverage=98%, HitCoverage=45%, E-value=6e-43, Identity=60%"; Hit description =Flavonol synthase
MKVLRVQTIASKSKDAAIPVMFVRGETEQPGITTVQGVNLEVPIIDFSDPDEGKVMHEILEARYGTKLQKEVNGKKGWVDHLFHTVWPPSSIDYRYWPKNPPST

SEQ ID NO: 181259 - protein, 94 aa, Glycine max
  Coding DNA Sequence Number=SeqID_64481
  Gene Ontology: Mol. function=oxidoreductase activity, acting on single donors with incorporation of molecular oxygen, incorporation of two atoms of oxygen; Biological process=flavonoid biosynthetic process
  Homolog annotation: Hit_ID=Q0EDG6; Match level="QueryCoverage=97%, HitCoverage=33%, E-value=9e-41, Identity=75%"; Hit description =Flavonol synthase
MSYLTILVPNEVQGLQVCRDGHCMIRSNGKYKAVFHRTTVNKYETRMSWPVFIKPKKEHEVGPHPKLVNQDNPSKYKTKIYKDYAYCKLNKIPH

SEQ ID NO: 181260 - protein, 123 aa, Glycine max
  Coding DNA Sequence Number=SeqID_64482
MDYVHHVPVTFWNGEECPELKLSSHGRKVEKLDRSIPEIEGLVAATGLSPLIAFSLDTGEVIITLNDVTSLLRLPITGAFHSYEALHVDEVIFLLIELLEVSSEEARVEIVQCHEAYVRLSWM

SEQ ID NO: 181261 - protein, 34 aa, Glycine max
  Coding DNA Sequence Number=SeqID_64483
MWIQSNIDLDQNLDHTSEALQPASSSPSCLLRIM

SEQ ID NO: 181262 - protein, 111 aa, Glycine max
  Coding DNA Sequence Number=SeqID_64484
  Homolog annotation: Hit_ID=Q9SBR5; Match level="QueryCoverage=59%, HitCoverage=77%, E-value=5e-23, Identity=72%"; Hit description =Putative wound-induced protein
MDDIGIDGDGGVVEKTSKGKRTRLASWMREGAWSVAASVGVVEALKDQGICRWNHALRSAQHHLKNHVGSFSQANKLSSTAMISTTLKHEKAKQSEESFRTVMYLSCWGPN

SEQ ID NO: 181263 - protein, 74 aa, Glycine max
  Coding DNA Sequence Number=SeqID_64485
MVMTMLVVALHWCGLDFDRGRCCCNCDTNAFSTFICWNPPRYSQYKLYCDGSVKLNSSQAVADDGVFRDHKGSV

SEQ ID NO: 181264 - protein, 116 aa, Glycine max
  Coding DNA Sequence Number=SeqID_64486
  Homolog annotation: Hit_ID=Q9SBR5; Match level="QueryCoverage=73%, HitCoverage=98%, E-value=1e-31, Identity=75%"; Hit description =Putative wound-induced protein
MDDIGIDGDGGVVEEASNGKRTSIIHHNNKMSSGIRAWSVATSVGVVEALKDQGICRWNHALRSAQHHLKNHVGSFSQANKLSSSAMISTTLKHEKAKQSEESFRTVMYLSCWGPN

SEQ ID NO: 181265 - protein, 318 aa, Glycine max
  Coding DNA Sequence Number=SeqID_64487
  Gene Ontology: Cellular component=mitochondrion
  Homolog annotation: Hit_ID=Q2QXB9; Match level="QueryCoverage=27%, HitCoverage=8%, E-value=9e-12, Identity=35%"; Hit description =Expressed protein
  Pfam annotation: Domain name=DUF537; Domain location=157-297; Score =20.3; E_value=4.5e-06; Accession=PF04396.4; Description=Protein of unknown function, DUF537
GRDNADDALLEHLKRWVSENPPPAHVMLIAGDRGYARTLRQLRENKYNILLVTRDAPPSKVFSDIASILWKWSAILEKKPLGKHLNDPLMDTCLMKVHRRPKKSSNISTVYVFCTVERDNANDALLERRPPRIRPLYSSFWSHYPSSSLSSSPTNLMQICVWWDIKNCLIPSSCDASQIDDYIETALIANKAHDLSRRNQEKLVERPKIRIIFNQGTFLDSVIQHYHTPRVGVFCVVGRDNADDALLKHLKRWVSENPPPAHVMLIASDRGYAPTLRQLREQMARGCITHAATTTMIAAAIEDRVVNRSERFHYAIAL

SEQ ID NO: 181266 - protein, 131 aa, Glycine max
  Coding DNA Sequence Number=SeqID_64488
MKRTVKRIHVRGFWGEKRGWRREVKKEVRVVLVLSVWGWGSAGGTDFGSMRERERVFRRNWTGKVGCVEEYGDGKVLGLKRGCVKEYGLTRVPWDYRLLGATDKRFSEKGARASFCNFSGRFFELHKSPSL

SEQ ID NO: 181267 - protein, 139 aa, Glycine max
  Coding DNA Sequence Number=SeqID_64489
  Homolog annotation: Hit_ID=Q9SBR5; Match level="QueryCoverage=55%, HitCoverage=90%, E-value=6e-19, Identity=65%"; Hit description =Putative wound-induced protein
MSSAQKAWIVATSVGVVEALKDQGICRWNYALRSAQKQVKSHVGSLSQAKKLPSSAMVSTSCGLKGQKQSEESLRTVILVQTQFSSNKRDKEFVAAFELSEYDDDHALSARCASTSLGFFVDLPLSLSGSLSQTSAKSV

SEQ ID NO: 181268 - protein, 189 aa, Glycine max
  Coding DNA Sequence Number=SeqID_64490
  Gene Ontology: Mol. function=RNA-directed DNA polymerase activity; Cellular component=mitochondrion; Biological process=RNA-dependent DNA replication
  Pfam annotation: Domain name=rve; Domain location=46-188; Score=84.3; E_value=3.9e-22; Accession=PF00665.16; Description=Integrase core domain
MPKQSIGRLRHERTSRRDLQSPYPRMLPSHQSDVPHTPLDNLHSRSFLWPFAMWVMDILGPLLKALGAVKYLLVAIDYFTKWIETKPLREITVNEVEKFAWKHLICRYDLSYAIVTDNDTQFKAQTYEDFLTRLGIKHLVTSIKHPQTNGQAEATNRVILKALRIRLDKSKVLWKEELYIILWVYHCTP

SEQ ID NO: 181269 - protein, 127 aa, Glycine max
  Coding DNA Sequence Number=SeqID_64491
  Homolog annotation: Hit_ID=Q9SBR5; Match level="QueryCoverage=67%, HitCoverage=98%, E-value=4e-30, Identity=74%"; Hit description =Putative wound-induced protein
  Subcellular localization annotation: CTP_CleavageSite=47; ConfidenceScore=5.12e-01
DHLPLTSSFIHSYGFLLKHNTKVQQSVLSRRKLQDHHHNNNMSSGIRAWSVATSVGVVEALKDQGICRWNHALRSAQHHLKNHVGSFSQANKLSSSAMSSTTLKHGKTNQSEESLRTVMYLSCWGPN

SEQ ID NO: 181270 - protein, 107 aa, Glycine max
  Coding DNA Sequence Number=SeqID_64492
  Homolog annotation: Hit_ID=Q1S104; Match level="QueryCoverage=48%, HitCoverage=27%, E-value=3e-19, Identity=82%"; Hit description =Embryo-specific 3
  Pfam annotation: Domain name=ATS3; Domain location=32-101; Score=7.0; E_value=1.6e-08; Accession=PF06232.2; Description=Embryo-specific protein 3, (ATS3)
MIKQVLLLVLLFLASGLALSVSESESVSLLPHAADSFNVSYIQMKNAGTCSYSVVITTSCSSPRYTRDQISISFGDAYGNQLMFLASSSHADESWNSSLNILLGPSV

SEQ ID NO: 181271 - protein, 214 aa, Glycine max
  Coding DNA Sequence Number=SeqID_64493
MLSEITHNAEGRTVTPMTIIPNEGASKPNSVRLNTNTLYHPMQGPDIQRDRTSIQHDHHQAFIAFQVLKKHFAGSKPLNLKVLLCDGDNNDDDNVSNNRDTKDDHDDNNDGGDIGGGNDNMMVVVVLVVKAIGDNGAVVAANNGGGVVLVTTSSDSVEVVVAVTVIVIKVVLLVVVVAGSTKMVVAVCSNADGDVGGDDGDNDNKDSGDHDGDN

SEQ ID NO: 181272 - protein, 71 aa, Glycine max
  Coding DNA Sequence Number=SeqID_64494
MSLPSAVHVFSLIKCEASGDWEARYSVVFQIGSFAKRKKKEEVEMRVVIAKRAGRTKSVSYLCFPLISDER

SEQ ID NO: 181273 - protein, 85 aa, Glycine max
  Coding DNA Sequence Number=SeqID_64495
MEGSQQNTHYPKEKLPKIITHKWKFGNLLEAPNTLPMKGLFVTKLESNEMLLSPIALKVVGVGPCGLNNLKRDRLRIQKKQQQSI

SEQ ID NO: 181274 - protein, 105 aa, Glycine max
  Coding DNA Sequence Number=SeqID_64496
  Subcellular localization annotation: CTP_CleavageSite=30; ConfidenceScore=5.04e-01
MGPSRGFWAFSCLRWKQPSSGELGGNHLPRFVKKWASGASGTPTVFWGSIASRLGKLGGNLLPLFPIKRQKGVVLKVPDSPGYAFQLFWVKKIVSVKKIQAEVLP

SEQ ID NO: 181275 - protein, 511 aa, Glycine max
  Coding DNA Sequence Number=SeqID_64497
  Gene Ontology: Mol. function=glucose-6-phosphate isomerase activity; Cellular component=extracellular space; Biological process =gluconeogenesis
  Homolog annotation: Hit_ID=P0A6T1; Match level="QueryCoverage=85%, HitCoverage=79%, E-value=0.0, Identity=87%"; Hit description=Glucose- 6-phosphate isomerase
  Pfam annotation: Domain name=PGI; Domain location=117-508; Score =769.0; E_value=2.9e-228; Accession=PF00342.9; Description =Phosphoglucose isomerase
MRGEPADNRRRIYLKRCGWRHKFFPFSCNCGHTETRASRNKCSACRARQDAPGWNDGSYINKSVAMKNINPTQTAAWKALQQHFDQMKSVEIADLFAQDADRFAKFSATFDDQMLVDFSKNRITQETLDKLQALAKETDLAGAIKSMFSGEKINRTEDRAVLHVALRNRSNTPILVDGKDVMPEVNAVLAKMKAFSERIISGEWKGYTGKPITDVVNIGIGGSDLGPFMVTEALRPYKNHLNMHFVSNVDGTHIAETLKPLSPETTLFLVASKTFTTQETMTNAHSARDWFLNTAGDQQHVAKHFAALSTNAKAVGEFGIDTANMFEFWDWVGGRYSLWSAIGLSIILSIGFENFEQLLSGAHAMDQHFANTPAEQNLPVLLALIGIWYNNFFGAETEAILPYDQYMHRFAAYFQQGNMESNGKYVDRDGNPVDYQTGPIIWGEPGTNGQHAFYQLIHQGTKLIPCDFIAPAQTHNALADHHQKLLSNFFAQTEALAFVKPASVEKSLPMQ

SEQ ID NO: 181276 - protein, 174 aa, Glycine max
  Coding DNA Sequence Number=SeqID_64498
  Gene Ontology: Mol. function=RNA-directed DNA polymerase activity; Cellular component=chromatin; Biological process=RNA-dependent DNA replication
MKFPSSYREIVTSKADQEDAHECYVKTCMIEPYNMVCKSYSSEKTQAWEERRKAIKTKIDSLLKADFICEVNYTNWLANVVMVKKATGKWKMCMDYTNLNKVCPNDAYPLLSIDRLVDGACGFRVLSFLDAYSGYNQIKMYLPNQEKTTFVIDRANFFYKGLVTRAMSKRLQED

SEQ ID NO: 181277 - protein, 92 aa, Glycine max
  Coding DNA Sequence Number=SeqID_64499
  Subcellular localization annotation: CTP_CleavageSite=19; ConfidenceScore=5.36e-01
MTPGTRHNSTMSIVATYPSAGGRRETHRCVFHGRKMRRVATNVYSRKMSKKPERCRGVVFTHGEGVGPLTISCGDRQKRGFCSYISSIVMRK

SEQ ID NO: 181278 - protein, 43 aa, Glycine max
  Coding DNA Sequence Number=SeqID_64500
MEQRKRIHVLEELMDMVMNVGAGYRVSDTTESMVSIKRTSTIK

SEQ ID NO: 181279 - protein, 106 aa, Glycine max
  Coding DNA Sequence Number=SeqID_64501
MEHATPDTARRTRQQQGSAPDVSAFGSALPLGATGSAQRVGATGAWLCPRQGHYQSRPRAGHYQSRPAAGRYQTCPRQGRYPAAASCAALCHVSLAPWKRLPGGAL

SEQ ID NO: 181280 - protein, 93 aa, Glycine max
  Coding DNA Sequence Number=SeqID_64502
  Gene Ontology: Mol. function=protein binding
  Homolog annotation: Hit_ID=Q1T2W0; Match level="QueryCoverage=89%, HitCoverage=10%, E-value=3e-09, Identity=54%"; Hit description =Leucine-rich repeat; Leucine-rich repeat, cysteine-containing type
MSEELHSLGIQPMLVLERSCVEIFLSTCKRMTERFSSLVSEELRGPERLQFGILNSSRLSSGSNALYQSCPHVYAYTVHIQMSNPAEVLDKPL

SEQ ID NO: 181281 - protein, 309 aa, Glycine max
  Coding DNA Sequence Number=SeqID_64503
  Gene Ontology: Mol. function=translation elongation factor activity; Cellular component=intracellular; Biological process=translational initiation
  Homolog annotation: Hit_ID=Q67UH6; Match level="QueryCoverage=60%, HitCoverage=40%, E-value=4e-16, Identity=24%"; Hit description =Mitochondrial transcription termination factor-like
  Pfam annotation: Domain name=mTERF; Domain location=1-225; Score= -53.2; E_value=0.00012; Accession=PF02536.5; Description=mTERF
SDIVELVTKNPRILYANLENNIVPSYELVRRFLESDKKTMDCIRGCGHFFGSDRASQNVKLLIDEGATDSVIAFLLQRRFSVILCSGFKETLDEIKEMGFEPFKKKFGVALIAKKIVPKSHWEAKVDVFKRWGWSEELVIGMFKRQPLFMLVSQDKIDRVMRFWVKQLGWDSLALAKKPEIFGFSLERRIIPRALVVQYLVAKGLRKKSASMIVPFAVSDKEFLEKYVMRFKEEEAELLKLYQGKMSGHGNKEDGAAPLTVVLSMSEGFQVSNNDEDHHDASSSTVHHDNDDDDHNDASNSAGVIFGGE

SEQ ID NO: 181282 - protein, 60 aa, Glycine max
  Coding DNA Sequence Number=SeqID_64504
MKHSYLKAHASASLKQYGEENLGPSMPENNSGVKSNMLRTIPRKLIVAEAVAFKPKTLWV

SEQ ID NO: 181283 - protein, 539 aa, Glycine max
  Coding DNA Sequence Number=SeqID_64505
  Gene Ontology: Mol. function=translation elongation factor activity; Cellular component=intracellular; Biological process=translational initiation
  Homolog annotation: Hit_ID=Q9FF87; Match level="QueryCoverage=51%, HitCoverage=59%, E-value=2e-20, Identity=29%"; Hit description =Arabidopsis thaliana genomic DNA, chromosome 5, P1 clone:MRO11
  Pfam annotation: Domain name=DUF1723; Domain location=102-151; Score =32.0; E_value=2.2e-06; Accession=PF08330.1; Description=Protein of unknown function (DUF1723)
  Pfam annotation: Domain name=mTERF; Domain location=261-529; Score =12.9; E_value=5.9e-09; Accession=PF02536.5; Description=mTERF
  Pfam module annotation: Pfam domain module=DUF1723::mTERF; Domain location=102-151::261-529
MVRTRGLGWALNKIIRRTLGRKVSGDADEVPQRRRPTASGRRQREAAPIAEDVAHVDPVVDEGFPVVLPLKEGREIWRPAPKIEGLVAATRLSPLIACSLDTGDRGLIYTFAERWHKETSSFPLPVGEVIISLDDVVPITGVFHSFEALHVDEVVDLLVDLVEHFPTIVSSIAVEDYHERKSYACRWKSRKGLTTPPSLQTPKPNSPFPSTLFPKHISLTSQQHSFAASYLVNTFGLSPETALKVSERVRFDTPQKPDSVIAFFTSNGFTVPQIKSIVKRVPDVLNCNPHKRLWPKFQFLLSKGASYPSDIVHLVNRCPRIINSSLEKNVIPTFELVKRFLQSDKKTIDCVFANRHFLNYNTASENVNLLLDVGVKDSSITYLFRRRASILLSKDLRKNIDEVKELGFDPSKMSFVMALHAKMSVPKSRWDAKVDACKSWGWSEEMVLDAFRKHPIFMLGSKDKINEVMRFWVDQLGWDPLALAKMPKIFGYSLKGRIIPRGLVVRYLIGKGGNTSTIKGLCGKMSFQENREDGVASGS

SEQ ID NO: 181284 - protein, 446 aa, Glycine max
  Coding DNA Sequence Number=SeqID_64506
  Gene Ontology: Mol. function=translation elongation factor activity; Cellular component=intracellular; Biological process=translational initiation
  Homolog annotation: Hit_ID=Q9FF87; Match level="QueryCoverage=73%, HitCoverage=85%, E-value=6e-31, Identity=26%"; Hit description =Arabidopsis thaliana genomic DNA, chromosome 5, P1 clone:MRO11
  Pfam annotation: Domain name=mTERF; Domain location=137-410; Score =55.4; E_value=1.8e-13; Accession=PF02536.5; Description=mTERF
MARVCIMTLFKCSCHRNYPFAHRDRGTAGKYQKGFEAGTKSELLTTELKLGRFNPINMLNTLLCKCITFAATSRYPLFHHYPLPFSLRFYTTTTSNSRSFAVSYLIHNFGFSPESASKVSENHKIYFRTPEKPESVIRFFRDHGFSDSQINNMVRRVPRLISCNPCKRVLPKFEFLLSKGVSSSEIVDLISKYPLMLTRSLKNFIVPTYELVYRFLQSDKNTVACMFANSSVFGSGYLVAHNVSVMLKNGLSESNIARLLRYRSKAVFRATDILKVVREVKDLGFDPSKVAFVMALLAIKRYDQNLWKEKVDVFKKWGWSDETFLEAFRRHPHCMLTSTDKINIVMNFWVNQMGWDALALVKGPKIFGLSMEKTIIPRASIVQLLLEKGLRKRSASITCPIMIPEKRFLNRFIKCFKEESSDLLKLYAEKLNLAYSREKSGMLCTK

SEQ ID NO: 181285 - protein, 343 aa, Glycine max
  Coding DNA Sequence Number=SeqID_64507
  Gene Ontology: Mol. function=translation elongation factor activity; Cellular component=intracellular; Biological process=translational initiation
  Homolog annotation: Hit_ID=Q9FF87; Match level="QueryCoverage=61%, HitCoverage=45%, E-value=1e-13, Identity=29%"; Hit description =Arabidopsis thaliana genomic DNA, chromosome 5, P1 clone:MRO11
  Pfam annotation: Domain name=mTERF; Domain location=128-343; Score= -74.6; E_value=0.003; Accession=PF02536.5; Description=mTERF
MSVCSSNGDCAGEKAQMCKIKTQISDLARIGLIIASSCGVVGVRRRFNDGDGDAGLLKERMREGETEMWWKREDITNYYFFYLTQFCKISLIRVQQKNIRGVRIEAGTCIVSVSISELKTPEKTESVIRFFRDHGFSNSQIINMVRKVPWLLSCDPCKRVLPKFEFLLSKGVSSSEIIDLVSKHPGLLSPSLENNIVPTYELVHGFLKSDEHTINCLFGNSIFSGGHYVARNIRVLLQNGVGETNIARLLRNRCKGVFSSTDILKVVKEVNDLGFDPSKSTFALALVVKSRSQTSWKEKVDVYKKWGWSDEACHEAFRRCPHCMLTSIDKINTVMKFCVNQLG

SEQ ID NO: 181286 - protein, 45 aa, Glycine max
  Coding DNA Sequence Number=SeqID_64508
MDNMSSCLSTHIHEVFKDMEPPSSHLLPTYIKYEVIIDMSDTYNN

SEQ ID NO: 181287 - protein, 85 aa, Glycine max
  Coding DNA Sequence Number=SeqID_64509
MSEGFQVSNDDEDHHDASSSAVQHGNDDDDHNDASNSAGVIFGGFQKKSATLLSQFCIPEEAFLEKYVKCFKEEEAELLKLYREK

SEQ ID NO: 181288 - protein, 281 aa, Glycine max
  Coding DNA Sequence Number=SeqID_64510
  Gene Ontology: Cellular component=mitochondrion; Biological process =response to cold
  Homolog annotation: Hit_ID=Q1SEY5; Match level="QueryCoverage=23%, HitCoverage=21%, E-value=4e-12, Identity=52%"; Hit description=Heat shock protein Hsp70
MDCIRGCGYFFGSGRASRNVMLLIDEGATDSVIAFLLQKRFSVILCSGFKETLDEIKEMGFEPFKKKFGLALLAKKIVPKSHWEAKVDVFKSWGWSEELVIGMFKRQPLFMLASQDKIDRVMRFWVKQLGWDSLALAKKPEIFGFSLERRIIPRALVVQYLVAKGLRKKSASMIVPFAVSDKEFLEKYVMRFKEEEAELLKLYQGKMSGHGNKEDGAAPLTVVIVVNWSCQYVRVDKCWLGVSLVAMPMPRFCFMTWCSNVQVIETMVVKLMILRRIVEAL

SEQ ID NO: 181289 - protein, 108 aa, Glycine max
  Coding DNA Sequence Number=SeqID_64511
MHKRIGEKLTAAKGKDEYDGFGGHWRHDRRVGTGSRRPDPIRDYATGLENLSCLMHHWCKVEQREATTGMTTVVRQGHHVGVARASPKNKKRRKKNRKEKDDRMRKIS

SEQ ID NO: 181290 - protein, 156 aa, Glycine max
  Coding DNA Sequence Number=SeqID_64512
MKVDMEAMKEQMTMMMEAMMSMRKMMEVNIATTIAASTAIEKDSIHPPDFNQKGRPVLNVAGQGGKAMMNAYGPHYVQEKFDHIKERLRAIEGGGNYGFVEISELCLVPDVVIPPKFKDLMDAFIRQYQYNSNMAPNRMQLQNMYKRDNESFKEYA

SEQ ID NO: 181291 - protein, 119 aa, Glycine max
  Coding DNA Sequence Number=SeqID_64513
  Gene Ontology: Cellular component=mitochondrion; Biological process =response to cold
  Homolog annotation: Hit_ID=Q9FF87; Match level="QueryCoverage=65%, HitCoverage=17%, E-value=3e-07, Identity=37%"; Hit description =Arabidopsis thaliana genomic DNA, chromosome 5, P1 clone:MRO11
MSEPEAPLERKNSNFGKILLWGSHERTLGALLIMLIIWVLEKPWLLNKAMIESGFSGVLNWVNLEILRAVSTEKPQVLTRVLRQLGEGSIEACLADGSGILTRSDHERGCVLGFGRKGG

SEQ ID NO: 181292 - protein, 218 aa, Glycine max
  Coding DNA Sequence Number=SeqID_64514
  Pfam annotation: Domain name=DUF1723; Domain location=55-97; Score =6.3; E_value=0.092; Accession=PF08330.1; Description=Protein of unknown function (DUF1723)
MMQMKPTSGKGPQHPHVGNEKLHMLLRKFSMSTLEIEGLVAATRLSPMIACLLDTGDRGLMSTFVERWHKETSSFHLSVEECWIFEHFPSVGSTIAAKDYDERKPCSCHWKSRKELPILTHCKHLDRLTSDVVCWILYGDHRAFREFETIPPHHASPSLCIEDINDRWIQFSEYIAPVGQICVVPGQCSPDNMEWFYLISHPLMSPAHHWDPPRHPSM

SEQ ID NO: 181293 - protein, 42 aa, Glycine max
  Coding DNA Sequence Number=SeqID_64515
MCSEQQISSTTQHLTLIQFITHHHLATKFWMMPLPVKEDKSR

SEQ ID NO: 181294 - protein, 62 aa, Glycine max
  Coding DNA Sequence Number=SeqID_64516
MFLKIPFIPIEPNRTLTMPLLISSKSIYLNLHSRERRRRAMATSIESEKNEQVVNPCEDSTT

SEQ ID NO: 181295 - protein, 80 aa, Glycine max
  Coding DNA Sequence Number=SeqID_64517
MWVQAIGLFAQATCAPEFGLPRPLNQRLLVFHVGGGAVKQQGQPFPCAQESPTTRDPRSLNPFSEIRRREEEISRKRGRM

SEQ ID NO: 181296 - protein, 54 aa, Glycine max
  Coding DNA Sequence Number=SeqID_64518
MKAMPSEYEVSSSFNVADLTPSFASGDPEDLRENAFQEGGNDENIKVAQKYRDL

SEQ ID NO: 181297 - protein, 224 aa, Glycine max
  Coding DNA Sequence Number=SeqID_64519
MWLATRSILPKWSLQDLAQAIVQVPEAWVGHVQAFVREVGKPLVVNAAENLMPRQKRSHHLIRGQIGGRMASGVITPSCQAEKLSPLRGLLSAIDFEELLLEAAHEIKETYDEVQGYVFLGASRRWNRLKQTVWLLRHFFVDGKSRVIKRMIMDSLNRCISHNVGLPRFILDGIIIAEKFYKILPPSLDCRSDCVQLSDISRGTEQFKAELFAEVMRVLERGSW

SEQ ID NO: 181298 - protein, 183 aa, Glycine max
  Coding DNA Sequence Number=SeqID_64520
  Gene Ontology: Mol. function=transporter activity; Cellular component= mitochondrial inner membrane; Biological process=transport
  Homolog annotation: Hit_ID=Q9FI73; Match level="QueryCoverage=89%, HitCoverage=48%, E-value=1e-62, Identity=73%"; Hit description =Mitochondrial carrier protein-like
  Pfam annotation: Domain name=Mito_carr; Domain location=24-128; Score= 106.8; E_value=6.4e-29; Accession=PF00153.17; Description =Mitochondrial carrier protein
VIVGKKGRVFTLAAMEGEPSQLKRAAIDASAGAISGGISRTITSPLDVIKIRFQVQLEPTSSWTLLCKDLSTPSKYTGMLQATKDIFREEGIRGFWRGNVPALLMVMPYTAIQFTVLHKLKTFASGSSNTENYINLSPYLSYMSGALAGCAATVGSYPFDLLRTILASQGEPKVNDGNCWHAF

SEQ ID NO: 181299 - protein, 270 aa, Glycine max
  Coding DNA Sequence Number=SeqID_64521
  Subcellular localization annotation: CTP_CleavageSite=41; ConfidenceScore=5.40e-01
MTEGDHPTKMPPRKKKKVVLGHKVTKVVEQVVKASMHHATSSSNGVTRSTSTPSEPVAQSGAFVMIPTPLGINSTRMESQGQPPHHYDDVPHDIDHENDLDDDDDVENEEAQLPHALIDLDLVCLETHIRKKDNTWVDKRLEQTYGDFQKKLQEDSSDGTKAINATSRVKLRADIARDKSQGCLYGAGDMSSQTIAPEWVARQISQANERFEQQMKEQQEQHQKIQEEMLNTIREIKASVSELSQHLQSCCRRHPDCEEYSHHDDQYNPT

SEQ ID NO: 181300 - protein, 139 aa, Glycine max
  Coding DNA Sequence Number=SeqID_64522
  Gene Ontology: Mol. function=lyase activity; Cellular component =anchored to membrane
  Homolog annotation: Hit_ID=Q1SGJ9; Match level="QueryCoverage=97%, HitCoverage=37%, E-value=5e-57, Identity=75%"; Hit description =Pectolytic enzyme, Pectin lyase fold
MKVTIVYNHFGPNCNQRMPRIRHGYAHVANNLYQGWVQYAIGGSMEPSLKSEANLFIAPITRSKEVTWRKGSHKNGDRWEFHLVRDAFENGASFAVTKGRRVPKPNYSKEQRFKVFDSKYVRSLTRSSDVLPCNKTSKY

SEQ ID NO: 181301 - protein, 109 aa, Glycine max
  Coding DNA Sequence Number=SeqID_64523
  Gene Ontology: Mol. function=calcium ion binding; Biological process =response to abscisic acid stimulus
  Homolog annotation: Hit_ID=Q70DJ9; Match level="QueryCoverage=82%, HitCoverage=50%, E-value=3e-27, Identity=59%"; Hit description =Calcium binding protein
  Pfam annotation: Domain name=Caleosin; Domain location=2-104; Score =70.1; E_value=7.2e-18; Accession=PF05042.4; Description=Caleosin related protein
MRKSPNQHLFQNGTYEGKFPSILLPIEVQNIHRSKHGSDSGVYDSEGSKHARTHPNSLTSDELMGMLVANRVPKDYAGWLASYTEWKILYVLGKDKDGLLHKRDYSSCL

SEQ ID NO: 181302 - protein, 275 aa, Glycine max
  Coding DNA Sequence Number=SeqID_64524
  Homolog annotation: Hit_ID=Q46SX3; Match level="QueryCoverage=15%, HitCoverage=14%, E-value=2e-08, Identity=68%"; Hit description =Catalase
ILSETDKQSLAAGVTGSKLNWAWGMERYQGTANDKGMLDISLKVVDYAGPEALHAVIICKYDMLRDEFAICMLENFIADKETSLSGKVFIIALVYATTFCAMVGLDDVHICDPVPEAQSRYRSYGFAFVFDAPDKMSSSVEEIQDKIREKVRRAMTAAKRSVAFWSSIDGAKLARVGFAEKDADVIGPEKPSAKARIASRTQGNAVGQGPVTAREKNVSLPGLTERQGDFLLPASAPVIGSISGSDAVRAASASMSRCSSGDSVTEGRPSPPSTA

SEQ ID NO: 181303 - protein, 57 aa, Glycine max
  Coding DNA Sequence Number=SeqID_64525
MFSQLVQPLAQHFVHGLAPLLTKHRIRLGKEVKGLKTLAQYAIRTQRHPIAQWVILT

SEQ ID NO: 181304 - protein, 281 aa, Glycine max
  Coding DNA Sequence Number=SeqID_64526
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=6e-35, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HALTFRGLHILTFRGQHALAFIGLHTFTFRGLCVLAFIGLHALTFRGLHVLTVRGLYVLAFKGLHVLAFRGLHALAIGGLHVLAIRGLHALTFRGLHILAIRGLHALTFRGLHVLANKGLDVLAFRGLHVLAFRGLDVLTFRELHVLAIIGLDVVAFRGLHVLTIRGLHALTFRGLHVLVFRGLHALAFKGLHVLDIRGLNTLTFRGLHILAIRELHALTFRGLHVLAIRGLHALTFRGLHILAIRWLDAFSFRGLHVLLFRGLDVLTFRGLHTLPLRELH

SEQ ID NO: 181305 - protein, 77 aa, Glycine max
  Coding DNA Sequence Number=SeqID_64527
MRGYRMVIRTFCHPETRRQVQWHAGVPYGYPHLLLSRDAKSDDMRGYRMVIRTFCQPGANETVDAERLTSSSAPFVI

SEQ ID NO: 181306 - protein, 215 aa, Glycine max
  Coding DNA Sequence Number=SeqID_64528
MKLLKNVQTGCGHAFLIFHWESGKSWNDPKLPWRAQYLITSLVKKGTNTEDPAVDFEREANRPEVDKDEGVGNEKKEVKVVPKKDGKVRMCVDYRDLNRASPKDNFPLPHIDVLVNNTANFALFCRSKLHDDESNSRKVIKKNQDSREDEFKIQEKKSRSNKSRLHKGSIEKDFVVVTENKRGYISCGSVQVEGFYKVDRNLKNPVVAWGLDVGM

SEQ ID NO: 181307 - protein, 76 aa, Glycine max
  Coding DNA Sequence Number=SeqID_64529
MAKYDPELLMEFYANSWPIKEGVMDKRSWVRGQWIPYDEDATHQFMGHPLVLEEGQHCEYTERRSHVLGFDEEAIG

SEQ ID NO: 181308 - protein, 273 aa, Glycine max
  Coding DNA Sequence Number=SeqID_64530
  Subcellular localization annotation: CTP_CleavageSite=19; ConfidenceScore=5.03e-01
MRRCWRCPPNTSTSSTVSLASTLEGNSSSTGNGDSNDFPAFLNQLLERVADNIGKVLDVGVIATNKILRLLSPKVMEAEADSLDPFVEVVQKKHQCELMEKKVCPPITLSVLKKKEFFYMYECLFQDMHGSWLKLVPTWQHSALLGNVFPMAPVYQTTSLRDSPADITPGLPRSLREKTNIKSHFWAFQSRVEVIAQHLQGFSNTNKLKVDLEKAKSSYDSALQANITLAKDNSNLKWKKSFRLSIKHIMMFTKLMSPTSITTSNKYSSIVRS

SEQ ID NO: 181309 - protein, 168 aa, Glycine max
  Coding DNA Sequence Number=SeqID_64531
  Homolog annotation: Hit_ID=P54797; Match level="QueryCoverage=94%, HitCoverage=59%, E-value=3e-07, Identity=26%"; Hit description =Ser/Thr-rich protein T10 in DGCR region
  Pfam annotation: Domain name=DUF833; Domain location=1-158; Score= -98.0; E_value=0.019; Accession=PF05742.2; Description=Protein of unknown function (DUF833)
MEAHYYNGFNLIVADIPSKCMVYISNSPKGQPITIKEVSPGLHVLSNAKLDSKWHKAQRLEVGFKEQLAKYGEGEIPVKEVVHKLMKDKTKADNSHLPHICSLDWEFNLSSIFVEVETPLGLYGTRSSAALIVTSSEEVSFFEAYLDEGMWKEHLIDFHIQKMTKGHT

SEQ ID NO: 181310 - protein, 165 aa, Glycine max
  Coding DNA Sequence Number=SeqID_64532
RVRWHAETNYGHSASFVIQRDGGLDDMREPFGLALFHLLSSRGGGPDDMRGGGPDEIREPFGPALFHLLSSRGGGPDDMRRQIMVIRTLFKSSDKCAETYYGHSAPFVIQGQLDRGRGHKETNYGHSAPCVDREERIRQYQDDVSVLITFKIFAGSVGREIDRPN

SEQ ID NO: 181311 - protein, 80 aa, Glycine max
  Coding DNA Sequence Number=SeqID_64533
MAALPKNNQQEDEGTGTRKRTKKTNVQGGRRKGSDIVRNVNSDTTQMRGKNLLTPIMQRVKHLKVKGNSMIMENSHVSTF

SEQ ID NO: 181312 - protein, 122 aa, Glycine max
  Coding DNA Sequence Number=SeqID_64534
MEKQLHFFHQLVDVLPWIQKPSQLTLIVGQMFQNHTRMVALICVYDTSLSREQLIANVPNGIHKDQWSSFIDYHLRPEYKDPRCRIQCPDILLENTGVAVQCKIKVKCRSEAAGSTMSDTMS

SEQ ID NO: 181313 - protein, 87 aa, Glycine max
  Coding DNA Sequence Number=SeqID_64535
MAFKDIILFGNNIVAVQCVHRAIKELPHPTSQANRQLPSRCNNHFGAVEVHPGKLMLSPEGMSSPKRAGCLGMKLFHGPGEPDASLG

SEQ ID NO: 181314 - protein, 100 aa, Glycine max
  Coding DNA Sequence Number=SeqID_64536
MGLCRNNDGTTSLLKFAENRGRSDNESCESNDTKDPNDDFEQLVNQAEEEENEDWGLPPDLRRMVEHEEIEMKPHQKETEVVNLGTGGQDWHLCVRECSR

SEQ ID NO: 181315 - protein, 238 aa, Glycine max
  Coding DNA Sequence Number=SeqID_64537
  Homolog annotation: Hit_ID=Q1SKD7; Match level="QueryCoverage=84%, HitCoverage=52%, E-value=2e-14, Identity=28%"; Hit description =Ankyrin
MVGLHSIIGFEGFNMASHMAPKKLAAKRARKATTGEGSSAAPQAEIEFDGHRFRSEEHQHRFEVIKDWSFLKERRVQITEGEYAEFQVEVARRRWTQLTEPMAKYDPEVVMEFYANAWPIEEGVVDKRSWVRGQWIPYDTDVINHFLGHPLVLEEGQRCEYADRRSQFLGFDEEAIGQLLCSPGHYFAQSVARRRVWIMCTSMTTLTQIWMTLLLSNILLVTITLISRYPNVSWSTTS

SEQ ID NO: 181316 - protein, 258 aa, Glycine max
  Coding DNA Sequence Number=SeqID_64538
  Gene Ontology: Mol. function=nucleic acid binding; Cellular component= nucleus; Biological process=DNA integration
MTIVATLDIELEKLNFKTAFLHGRLEEDIIMKQLEGFEEEGKKNFVCRLKKSLYGVIVTITKVVKLKSLLSSEFEMKDMGAAEKILGMEIKRDRVQKKLFLCRKEYIQKLLNHFGMASVNPICTLFTVSICLFELNTTQSKLEKEYMSHVPYGSVVGNLMYTGNPRKEHLQAVKCTLRYLKGTTYIQLVYHGVKSCALDGYSNVDYVGNFDARKSVTRYAFTIGNFLVSWMAILQPPVTLSTIEAEYMALADATKEEI

SEQ ID NO: 181317 - protein, 302 aa, Glycine max
  Coding DNA Sequence Number=SeqID_64539
  Homolog annotation: Hit_ID=Q94FN0; Match level="QueryCoverage=11%, HitCoverage=7%, E-value=1e-10, Identity=85%"; Hit description =Phosphatidylinositol transfer-like protein IV
MVIWDDSDGEKSSSPDDEQANICVMPYTKEKFKVKTYSEFDTSCCSSSNDEEDMPYDISLVGKGYGLSWYLDNGCSRHMTRERNELAKFGLEVDKGIFLGYSDISKAFRVFNSRTLFVEESISVKFNDGLTIDSKLSDLEDDFADMQIACVPSPTFLCTNAAFASLPPFVASPSHWNFLKYTLIGDLTEGTAFASYDCYEQKTRSLHESTKYTTGDKATALDVSIDYFLGFFHFQSSLLILCFDLIDWIVRIILAEVGGVAGAMNEVDSELPGFLGGTCACVDQGGCMRSDKGPWKDVEIMR

SEQ ID NO: 181318 - protein, 245 aa, Glycine max
  Coding DNA Sequence Number=SeqID_64540
MREGLPLKEHLDELNFVLMELCDIDFKMENEDLASRNGDDASTSGLSVTDFSKGKKKKGKCGKKSKADPKDIYNYCKESDHWKMTHHRKTIWFWLLVNNYNNILNNGDNDAPCKFVGMGSVQIVMHNGVVETLTEVELCRSEEKGSLCHASIGLSNYSLWHLRLGNMSEKVLDILSKARCMLSNSGSNMSFWAEAVNTTCYLTNGSLSTGIDFKSFIEPRMDSLWAIKMESKDYESGLYLKERLF

SEQ ID NO: 181319 - protein, 58 aa, Glycine max
  Coding DNA Sequence Number=SeqID_64541
MPKQPARLGFQGSGVERIERKEGKREKEEETKPRHYRITTVIIPYIVLLFYVPRATVG

SEQ ID NO: 181320 - protein, 94 aa, Glycine max
  Coding DNA Sequence Number=SeqID_64542
MSSRVRCMLVSSFVTGSQKVHITFLTAYMGHYAPECAILAIKIAIPWVMGLNQAHAFMKRFIKSSRSMEVTTLQKIGAKDGSSYIAASSTAKHI

SEQ ID NO: 181321 - protein, 149 aa, Glycine max
  Coding DNA Sequence Number=SeqID_64543
MVTWDDSESEKSNSFDNEKANICLMVDTYDKVEGTTPSKSQFISDKCDLCGEMSMFLDMKPHEGGVVAFGGISKGKIFGIDNFGITSLASIDNVLYIEGLGSSSSMESFASWSSMAEEWRMKKDDWRHHFKEKMSQEQAHHHKKPWIRA

SEQ ID NO: 181322 - protein, 333 aa, Glycine max
  Coding DNA Sequence Number=SeqID_64544
VGAGEITGEKRGVVEWWLEALLRMRKMKHEEVVQCDWLLSEGTTGVSLKPLWMVEETHISQGHQASLDKTTPTRRMEWRCTSSPPNIEFGLYIITNGDILIPQLEAEWTYDDLTLMELNTKAKYTMACTKDVRLRKTVTLTRHYESFTVNDEESMDCRSKLHDDESKGTSTWVVVTENKKGYISCGSVQVEGTSTWLFKENKGGLQVLLNNLEAFGQMYIKAQINLKVLDNFPKVWEPKTIVIQEARDLKNLVWDKRLGILRVREESDELDNSDGSIDDEMALVSRKFKQMMKKKGKFQHSFRRKESRFKKKKREENNEIICFECRKPRHKKA

SEQ ID NO: 181323 - protein, 124 aa, Glycine max
  Coding DNA Sequence Number=SeqID_64545
  Homolog annotation: Hit_ID=Q1SBV5; Match level="QueryCoverage=81%, HitCoverage=18%, E-value=4e-08, Identity=36%"; Hit description=RNA -directed DNA polymerase homolog F21E10.5-Arabidopsis thaliana
MKLDLSSFQALLKSLNRQCGSQMLDVCVAAVIFCLWGIWHCRNQVRFRNVNLKPVSMFSKIAANVCLAGNLSKGGSLLKRLTLLKPVGISLFPTGLSAMLMELRKPRACGSWWYLQRRKCHYNG

SEQ ID NO: 181324 - protein, 161 aa, Glycine max
  Coding DNA Sequence Number=SeqID_64546
MEARDLSTCKRERVVLTSSIFDANRNNVVRDFRDHVIQLHDAQQPKREKNVANLAVKKVVEKAEKEKAKAHAKVVATTAKAMGNTTINEILVHLTNIVPMEEKSMASNVEKANEDVPPEATAFWRKQPGSPGRAGWQAPPLFFYKYGEESRRKGFIPSGTS

SEQ ID NO: 181325 - protein, 520 aa, Glycine max
  Coding DNA Sequence Number=SeqID_64547
  Gene Ontology: Mol. function=nucleic acid binding
  Homolog annotation: Hit_ID=Q6K431; Match level="QueryCoverage=17%, HitCoverage=8%, E-value=1e-07, Identity=32%"; Hit description =Trithorax-like
MEGRAQNSNDTTIPKKSRSLDLKSLYKSKLTENTAKKNLKRIGNSSGGGDEKRKKKKARKEVSLSSLENGDGSSELKLGVSQKLSSSSSTLNRVSFSVGDDDVQIPKRKRSFVGRKKSELGLASKVVEQSGLKIGYNDQVPKLGSDDLGSGVESFKIKRKKEFDEFKENRNSDSNSVQHAKENGDCASHSVVNSGDSSLSKSRRQHRKRKASAIDSTKVSKEAEPLVSSSKISDDLQDEEENLEENAARMLSSRFDPSCTGFSMKGSNGLSFFQSSSQSIVNHSLKSPLGSESTSADTAGRVLRPRKQYKNKSNSRKRRHFYEILLGDVDAYWVLNRRIKIFWPLDQSWYYGLVDNYDEGSKLYHIKYDDRDVEWVNLQTERFKLLLLRSEVPGNAKGERALMKRSSFDHQKGSKSRKERQRTEENAGDDRCGESSMDSEPIISWLARSSHRLRSIQGIKKQKTSVTVPSTTSSFLYDEPVTAKGHLAKSSVRDVEKNFSTGSVSQDKFSEDLRISLPLP

SEQ ID NO: 181326 - protein, 1081 aa, Glycine max
  Coding DNA Sequence Number=SeqID_64548
  Gene Ontology: Mol. function=nucleic acid binding
VTCAKDGKQPIVYFRRRWVHKPAPISPHISEENHAIISASGSVALDHMFGGVENVKNPIDSRVEVGGPLFFTYKAGVPKVFWDMKSASFKFGLNFPMRLVLNDFFQSENLWLLYTVLLLRFGTVMAKWPRVYLEMLFVDNVVGLRFLLFEGCLNTAAAFVFFVLRVFHQPDCQGKYVDLQFPCTSIGFKFSSVHVIKKPLVFEFYNFSEVKNSKWMHLDSKLKEHCLLSKQLHLSECTYDNIQALQNGSRRFSITSISGSSSVKVTQKSRPGINIMGVSEVSTQAVQCSDAGERKLPPFALSFAAAPTFFLCLHLKLLMEQSAAHIRYCDQTPIFDQEDPGLMTNGCTSTDNCSNRNSEVILRKGMETLSIGTPGDGGSCADSDHPSTCNDRILIQNYQNIGLNGASTSISHDSEKLCKAHLPEWQSHHLEQELGSLSSSSLKHLDKANDGSHSFIGDLSIQIPAVDQFEKPDEDGDLCDAEHSPDISWNINGCGIPSSNPTARRSSWYRNRNNSLSLGFQSHVWSDGKVDSLCNDLSNGPKKPRTQVSYSVPSAGYEFSSRQRNHHQKGLSHKRVRKAKEKKSSDVDRVPEKNIKCLSCGANVLITLGDKGWRESGAHVVLELFDHNEWRLSVKLLGITRYSYKAHQFLQLGSTNRYTHAMMWKGGKDWILEFPDRSQWALFKEMHEECYNRNIRSASVRNIPIPGVHFIEENDANGSEETFVRSCMYFQQVETDVEMALDPSCVLYDLDSEDEQWISNAQNSLKDNSEFCWISEEMFEKTIDVFEKAAYAKKRDHFTPDEIEELMVNVGPLCVVKIIYDHWQQKRQKKGMALIRHFQPPLWERYQKQVREWELAMTKNNAPSNGCLDKVTTLEKPAMFAFCLKPRGLESLNKGLKHRSQKKISVSGHANSNLDQDGFHTFRRRQNALPFADEKFLYQGHNYDSFDDSSLALTSPRVFLPRDAGSLKYYLTSNGAGYRNHIPKFHKSRYDSPGSRHHILAGPKRQGIEQLDASVLEELRQRDAMAEARFKRHVAMLKRDRAKRLLYKVDVAIHKAMAALMTAEAMKASEDSLVEMKAYED

SEQ ID NO: 181327 - protein, 84 aa, Glycine max
  Coding DNA Sequence Number=SeqID_64549
MKVIYKKMRQFQMCKGRSKLAQYFGLKMDKDDLQIELALGLECNESTPKTNNGKGTNLNRDAVVGVREQSMKIFVLVVATVWEP

SEQ ID NO: 181328 - protein, 145 aa, Glycine max
  Coding DNA Sequence Number=SeqID_64550
MTMCIVVKLTIAGKNIVKEEDFKVLTSEFVKDYDVSKNEVVEKLKSLTAEPRDNTYLRIVLVASGGHFADVVRAKAGKKQSPKDASGRAAHSAGGFTSSYNEIALKVFKSQICCLACQVFYFHASQLLCCTIFELELVIYKLIND

SEQ ID NO: 181329 - protein, 146 aa, Glycine max
  Coding DNA Sequence Number=SeqID_64551
MEQINVHVAQLISDAIHQFVGTKPSRHPVDPEKSKALGFPALIIGLCQFYGVSFTPTKHIWPPINRSFIDKYCMPRQHQQNPDPYPWPTPEQFRATPAWPGDRHIFQEEASLANAQGATQGNGGRAKEDEDMMDLIDYFMGGKGAS

SEQ ID NO: 181330 - protein, 83 aa, Glycine max
  Coding DNA Sequence Number=SeqID_64552
MATTIHMTSIALRRCSMTAASLMKDVLNTVDQLRVDSIRVEWQRFMAGESEYEGEGRFGGELLMWPSNDSRSWRESEGYEKVM

SEQ ID NO: 181331 - protein, 147 aa, Glycine max
  Coding DNA Sequence Number=SeqID_64553
  Gene Ontology: Mol. function=protein serine/threonine kinase activity; Cellular component=integral to membrane; Biological process=protein amino acid phosphorylation
  Homolog annotation: Hit_ID=Q9LFS4; Match level="QueryCoverage=68%, HitCoverage=15%, E-value=3e-41, Identity=82%"; Hit description =Receptor protein kinase-like protein
MMNISRDVKVANILLDDYCEAVVGHFGLEKLLDHQDSHVTTAMRGIVGHIALEYLSTGQSSKKTDVFGFGILLLELITGQRALEFGKAANQKRAMLDWLMTVFEGHAYEDEHGARLVLERGLFYIDCEGTTDVECECSTSVLRLKPM

SEQ ID NO: 181332 - protein, 110 aa, Glycine max
  Coding DNA Sequence Number=SeqID_64554
  Gene Ontology: Mol. function=serine carboxypeptidase activity; Cellular component=cellulose and pectin-containing cell wall; Biological process=proteolysis
  Homolog annotation: Hit_ID=Q5ZA26; Match level="QueryCoverage=66%, HitCoverage=14%, E-value=1e-20, Identity=63%"; Hit description =Putative serine carboxypeptidase II, CP-MII
MEYALNVFPLMWGPGVVLTILGSWETNRPGCSSIGYGAVVEIGPLIVNKNEERLHFNTHSWIQEANLLFVESPMGVGFSYTNTSSNLTILEDNFVGEFPLQKPNLSDFVE

SEQ ID NO: 181333 - protein, 72 aa, Glycine max
  Coding DNA Sequence Number=SeqID_64555
MLRKHTLVQEYETLRMKNGEAILKVLVPCTGPDTLRAETLRYYENLFVSHESVATNPLQGQSITNASGIRHS

SEQ ID NO: 181334 - protein, 190 aa, Glycine max
  Coding DNA Sequence Number=SeqID_64556
  Homolog annotation: Hit_ID=Q2A9L7; Match level="QueryCoverage=35%, HitCoverage=14%, E-value=3e-13, Identity=48%"; Hit description=GATA zinc finger containing protein
  Pfam annotation: Domain name=GATA; Domain location=7-42; Score=53.4; E_value=7.4e-13; Accession=PF00320.17; Description=GATA zinc finger
MVKKGPCSHCGVTHTPLWHDGPTEKPVLCSDCGSQYKLKGNLDNYFPKNPVVQSFHNKFTNVNGGKHLNVDVDQLSNYVPPTDEDNNMSTPNVHCISAQATPLWRNGLVDKSVLHKACELSPQETPASAINAPKKLQLQPLIHKNFINVNGGSSLNVEDEDQLSNHITPASDGDNNKSTPNVQHISPQGM

SEQ ID NO: 181335 - protein, 147 aa, Glycine max
  Coding DNA Sequence Number=SeqID_64557
MQNMSSARGEELMKGVFRKRAIDKGNNVIESNQINDSKKKSNVSGHHNQQNQGGNELMNVVRKGTEKLSIKENKCKSGPHSKVCYCAPTTHEGSFRCRLHRKKSATDDNNKSNLRLNSQYGMVEFQPQMPRCCGVHVTKLSMKPLQF

SEQ ID NO: 181336 - protein, 91 aa, Glycine max
  Coding DNA Sequence Number=SeqID_64558
MSGAKGEELPKSLLRKETTDKGKNVEESKEVKDSEKELVKLVTKGTENLNIKESKGKSGAKPKMCVCAPTTHEDSFKCRLHRKESATHKSK

SEQ ID NO: 181337 - protein, 60 aa, Glycine max
  Coding DNA Sequence Number=SeqID_64559
MPCYTTKKTAEKLKYIARVVPSSAAAAPAAERQQHPAREQEKRVLPWITSSGAMGCHGSS

SEQ ID NO: 181338 - protein, 97 aa, Glycine max
  Coding DNA Sequence Number=SeqID_64560
MNAVVRTRTIYIESSKQGNDDSKKAATTNEVSCKYSSLYSKSSATKNKSNLKLNSKSTHGIVENQPHLPRFSRIRAQLERHKHDSRMKVKLSRVDSL

SEQ ID NO: 181339 - protein, 75 aa, Glycine max
  Coding DNA Sequence Number=SeqID_64561
MQVGVVSVGGGCDIGGCDDEGGISGGGISATASGYSIVGAVFGDDVISSDGDNNGDRDTNGSDVSNDGGNNHNHL

SEQ ID NO: 181340 - protein, 43 aa, Glycine max
  Coding DNA Sequence Number=SeqID_64562
MTGVADEAPVTLDTLKQLMAQFAKERDWDRFHSPRNLLLALFF

SEQ ID NO: 181341 - protein, 69 aa, Glycine max
  Coding DNA Sequence Number=SeqID_64563
  Homolog annotation: Hit_ID=Q9SD67; Match level="QueryCoverage=65%, HitCoverage=5%, E-value=2e-12, Identity=77%"; Hit description=FtsH metalloprotease-like protein
GPDLSITFCVTPDDIDCPYARSLISLQGIEEKTAKLKGSEKALVARHEASHAVVGTAVANLLAGQPHVE

SEQ ID NO: 181342 - protein, 249 aa, Glycine max
  Coding DNA Sequence Number=SeqID_64564
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-43, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLYALAFRGLHALAFKGLHALAFRGLHVLAFKGLHVLTFRGLHFLAFRGLHVLAFRGLHVLAFRGLHTLSFRGLHTLAFRGLHTLAFIGLHSLTFKGLHALAFRGLHVLAVRGLHVLAFRGLHVLAFRGLHALTFRGLHVLAFRGLHALAFRELQALAFRGLHVLAFRGLQVLAFKGLHVLAFRELHILTFRGLHALAFRGLHVLNFRGLHAFTFRGLHVLAFRGLHALAFGGSKSAPLENSKSSTLNA

SEQ ID NO: 181343 - protein, 363 aa, Glycine max
  Coding DNA Sequence Number=SeqID_64565
MTPRINHLSRFALLRPDPQELAAKLCIPGRGFELNADGQPLKILRKNMTILAQTWSVLSFSNLIPTSHTFDVTLDRAKLIYGIIMKMDMNVGYLISHQISITAQHDSSRIGFPALITALCKARGVQSDSRSLESLSPTINLAYIKKNWWNLDDPTVSFKGPTKARGKRSEVPTTLAALETPAPSSSTALVPPIQTPAIPPASTQIPLLASSPFQFPAHLSAGPSDFSFTPQMLHFMLQNLHRGQSIIMQSLQGLGLPSIMSIDEFDVQVAWPKAQPSPSGGGGASAAQEPELEEPTATVEGKDELTPPEPFYFDSGVHMAQEEETATEQILEPSPVPTPDDSMPSAPASELEQPIPQDSPATQ

SEQ ID NO: 181344 - protein, 142 aa, Glycine max
  Coding DNA Sequence Number=SeqID_64566
  Pfam annotation: Domain name=zf-CCHC; Domain location=100-117; Score =8.2; E_value=0.044; Accession=PF00098.13; Description=Zinc knuckle
DLDDTTFDEEDEEEVNLCLMVDTGIEESKLEQDKKNDSLKGQPQDVVNIREEIDTLNEIVAKFVRGSQCLNKLLRYNRSPVDKSCHGYKAKKYVHDEDTIVCYFYGKVRHMTSKCKDLPKKGMSNAFNTSKKGPKKIILVAN

SEQ ID NO: 181345 - protein, 143 aa, Glycine max
  Coding DNA Sequence Number=SeqID_64567
  Gene Ontology: Mol. function=binding
  Homolog annotation: Hit_ID=Q9LUZ0; Match level="QueryCoverage=83%, HitCoverage=13%, E-value=6e-08, Identity=38%"; Hit description =Phosphoinositide-specific phospholipase C-line
MHSYEAVKVLVAALVEVLERETTMVKENATEEEKAMIGRPGAWEEGGVLRGKKDAVTALCLIVREEGTTTARYALCSMTKDNKVRAGVMRALMELMVDLGSSISYLVSLVVVAVAEGRVALVEEGGLPVLVEIVEVGMQRQHS

SEQ ID NO: 181346 - protein, 127 aa, Glycine max
  Coding DNA Sequence Number=SeqID_64568
MLQYVPHNDQRLKQQEWTTYDKANEEGESHSTIGKKAFTEESQEANKEGKKEVLTPPWDTNKMKTIAAKPYPIWGRRTLQGRNSFQKIQDGVRKRDIESHFKLLVMGVDDYTRESMQKRKITLFKGG

SEQ ID NO: 181347 - protein, 67 aa, Glycine max
  Coding DNA Sequence Number=SeqID_64569
DNPLLIECFDFNSSGNHAIMEVGEVIQFYDSDRQSFLLRTLEESYLVAVGVEGIMEAYASALHSVTL

SEQ ID NO: 181348 - protein, 127 aa, Glycine max
  Coding DNA Sequence Number=SeqID_64570
MAQLANRVRRIEKIEYEKERNKRFDKSIREKVAYVETYRDDDNSINFQDLDVNQEDEICVEELQPRSPYTCQICMVQKTIDEGRLQFEEKPMKVDTDPFHIHANYIKPMQIMMMGASIRTPKVSTPC

SEQ ID NO: 181349 - protein, 234 aa, Glycine max
  Coding DNA Sequence Number=SeqID_64571
MGEIEEVQEQMKANMEATKEKMATMMEALMSMKKIMEVNVAVVAATNGVAEVDPTPLSGLNQVNPSVSDMVGQGGETLGSTNSPHVVQSKNPFPPYGFPPNYTPPNVTHTPDENVSNSTPILMESQQPQYDHAHVSQPMGETHEVPHHNLADFEPRLGYAIEGQAFGGVPLPNTLEGPQFRPQPQPLHFTMGRVPPAMMERGKFDHIEERLRVIEGGRDYAFADMEELCLVPNV

SEQ ID NO: 181350 - protein, 76 aa, Glycine max
  Coding DNA Sequence Number=SeqID_64572
MGDPNLPKLAFGSPRPWNHLLAKQPAYLGELITSGLRFRSLRRAPARPSKLKPPQGDYFPINRHDWGVLRGEKGQH

SEQ ID NO: 181351 - protein, 129 aa, Glycine max
  Coding DNA Sequence Number=SeqID_64573
  Homolog annotation: Hit_ID=Q1SP50; Match level="QueryCoverage=41%, HitCoverage=6%, E-value=5e-08, Identity=44%"; Hit description=RNA -directed DNA polymerase
EVITNCNLYDLPMKGKKYTWARRKGKSDGVEEKYDRALALCKKELEELIEFNDEDSIVKYKTTCDKLNNLIAQEEAYRKQRAKVYWLKDGDINLKFFHLDALATKKWILSLLFLVRMGVALAPMYPRVR

SEQ ID NO: 181352 - protein, 64 aa, Glycine max
  Coding DNA Sequence Number=SeqID_64574
MEVEESLLGLWLPLHYRADRGAFFWKIPSLVGALVGALVCVKGEVAFVDDYAFLADRVVGNEKG

SEQ ID NO: 181353 - protein, 119 aa, Glycine max
  Coding DNA Sequence Number=SeqID_64575
MERILHWMMAHKESVAMKMKISKIQISIRTKTHKAFPDVYLMLKGEDYRKLSECELVLNLNYISIWDFLNLNWFLLWEMKVDVGLRHMVWNDEEKAEFYREPNEKEEGGTNREGAYWMR

SEQ ID NO: 181354 - protein, 105 aa, Glycine max
  Coding DNA Sequence Number=SeqID_64576
  Gene Ontology: Mol. function=zinc ion binding
  Homolog annotation: Hit_ID=Q6Z706; Match level="QueryCoverage=56%, HitCoverage=12%, E-value=1e-11, Identity=59%"; Hit description=VacA protein-like
MDSNVEERAHESKNYFGVLAGSADSQQDKDTHENSWKILKSQNGHILKKLLSQFIKEIVEGMIGFVHLPTIMSKLLSDNGSQEFGDFKHTILGMLGTYGFERRIL

SEQ ID NO: 181355 - protein, 187 aa, Glycine max
  Coding DNA Sequence Number=SeqID_64577
MSIHVAQLIADAIYIFAVQQGPGISRLDHRTLPVVRRPVTPSKVIQPPITQAFIEKYCTQRQVQGDAPQAVDAPPRHQAGPAGSFDTEQYLRHLVRQQAANHRAHVQTHDCLYQMSLSLQSQGFTSFPCPTLDQFRAEVVWPGDWPETRAGEAPAEAPAEAPDEADEAREDEEVTDLLDFLGGSGAT

SEQ ID NO: 181356 - protein, 79 aa, Glycine max
  Coding DNA Sequence Number=SeqID_64578
PNNNNNNNNNNNKNIQTFQKMYQQKNHHNFKACCCNLPYNENEGEKPKEHLLERKTRGSHHQHLFEENVRKTKKEVYEF

SEQ ID NO: 181357 - protein, 55 aa, Glycine max
  Coding DNA Sequence Number=SeqID_64579
MVDDSFMYIEVFMTIVMNVAQMINVAHYFCSGTKSRQKALRALRLEDFVNPYCLY

SEQ ID NO: 181358 - protein, 380 aa, Glycine max
  Coding DNA Sequence Number=SeqID_64580
  Gene Ontology: Mol. function=translation elongation factor activity; Cellular component=intracellular; Biological process=translation
  Homolog annotation: Hit_ID=Q6SYB1; Match level="QueryCoverage=98%, HitCoverage=52%, E-value=1e-175, Identity=82%"; Hit description=GTP -binding protein TypA
  Pfam annotation: Domain name=EFG_C; Domain location=157-250; Score =88.4; E_value=2.3e-23; Accession=PF00679.14; Description=Elongation factor G C-terminus
VCTSDDSCRYGRVTELYVYDKFNRVPANKVEAGDICAVCGITDIQIGETIADKVSGKPLPSIKVEEPTVKMSFSINTSPFVGREGKYVTSRNLRDRLYRELERNLAMKVEDGETADTFVVSGRGTLHITILIENMRREGYEFMVGPPKVINKKVDEKLLEPYEELLQIATVEVPEEHMGAVVELLGKRRGQMFDMQGVGLEGTTLLKYKIPTRGLLGLRNSILTASRGTAILNTVFDSYGPWAGEISTRDQGSLVAFEDGTSTSYAISSSQERGQMFIGPGVDVYKGQIVGIHQRPGDLSLNVCKKKAATNIRSNKEQTGFSEYVWFMYPRLTTLLILDTPLDYSLDDCIEYIQEDELVEVTPASIRMSKNPKITNKKTR

SEQ ID NO: 181359 - protein, 66 aa, Glycine max
  Coding DNA Sequence Number=SeqID_64581
  Homolog annotation: Hit_ID=Q6SYB1; Match level="QueryCoverage=76%, HitCoverage=7%, E-value=1e-20, Identity=90%"; Hit description=GTP -binding protein TypA
CDFQVIYASGIKGQAGLTPENLAEDLGPLFESIIRCIPGPRIDKDGALQMLHIFIRINLPPWGKQK

SEQ ID NO: 181360 - protein, 249 aa, Glycine max
  Coding DNA Sequence Number=SeqID_64582
  Gene Ontology: Mol. function=nucleic acid binding; Biological process= DNA integration
MEHKHIDEAMQDDNWVKAMEKELDQFRKNDVWKLFKLPKGKKAVGAKWVFHNKLEEDDKVVRNKTRKFMLNYLLNLKVKPFLNMLLNSTKPYMDLNKLLELVNVGDIIFGATNEMLCEDFSKLMQTEFKMSMMGELKFFLGLQIKKTPQGIYIHHNQYLIGTHNLGLMFKRSESFRLTSYCDVDYAKDKVERKSTSESCHFIGGNLVTCDAILPRKGLVTRAMSKRLQEDWARTAEEGPRVLMNLRVDF

SEQ ID NO: 181361 - protein, 200 aa, Glycine max
  Coding DNA Sequence Number=SeqID_64583
GRQRYPSGYPYKMISVNPDPRSQTNVVICTLCQQGASEPVDTQRLTSSSAPLSSRDGESDDMRRYPSGHPYKMISVNPDPRSQVAGRDTQVVIKTNVVICTLCQLGASKPVDTQRLMSSSAPLSSRDGEFNDTWRYPSGGDTQVVIRTKRFMLILTQEVRWQAEIPYGASEAVDTQRLTSSSAPFSSRDNESDDMRRYPS

SEQ ID NO: 181362 - protein, 49 aa, Glycine max
  Coding DNA Sequence Number=SeqID_64584
  Gene Ontology: Mol. function=ribokinase activity; Biological process =D-ribose metabolic process
  Homolog annotation: Hit_ID=Q1SXC4; Match level="QueryCoverage=100%, HitCoverage=13%, E-value=7e-14, Identity=73%"; Hit description =Carbohydrate kinase, PfkB
MDFLATVAAYPMPDDKIRSTTLKGEGGGNVGNALTCLARLGLNPRLISK

SEQ ID NO: 181363 - protein, 136 aa, Glycine max
  Coding DNA Sequence Number=SeqID_64585
  Homolog annotation: Hit_ID=Q1T3Y0; Match level="QueryCoverage=37%, HitCoverage=7%, E-value=3e-14, Identity=72%"; Hit description =Targeting for Xklp2
MAGEVEESFSMNFQGYNNNKALSHMSRSQARVKEEGCVWPLAANIKLTVDSIHSGCISFGRFENEPLSWERRSSFSHNRYLEEVEKCSKPGSVIEKKAYFEAHFKRKDMFGFIPSTGHKGSSDRATSENDGSERNA

SEQ ID NO: 181364 - protein, 399 aa, Glycine max
  Coding DNA Sequence Number=SeqID_64586
  Pfam annotation: Domain name=Transposase_23; Domain location=93-157; Score=-13.7; E_value=0.036; Accession=PF03017.5; Description =TNP1ENSPM transposase
MTGQIREELRTQIKEELRAQLEEENKRSLEIMTMALKEAIKKELSHKGSPESPQIQPDIQQLGARVSTKGSNVVINVQPSQEHDADVIPMMGLYVQRKDGTLGLVAMGKIMEGDSIIHIVAYADDVVQVTVETIIDPEAEVPYATSEIQYVKQAVDTFVAWPTDLVKAIVDEEPAIIPHNKDAHVPKPANVDADDPLCGLIKYSFDIYDKPVEINFDGSCFGIVHAPTSIFITYSDASEIIAGDKSLNIYVQQLWYMHEWSQTLGQGSMYAFLEPHLLVVSKDRRSECQQYLEKWIKESDREVYIGPYFHHVMTKLKTTLSPETKAAAPKWIEVKSHVQPRCYECGYYVMHWMWNIITNEIKSDWSMWFADETPLDIGNITTIRKKWATYFLKTACKKG

SEQ ID NO: 181365 - protein, 286 aa, Glycine max
  Coding DNA Sequence Number=SeqID_64587
  Gene Ontology: Mol. function=RNA-directed DNA polymerase activity; Cellular component=chromatin; Biological process=chromatin assembly or disassembly
  Subcellular localization annotation: CTP_CleavageSite=43; ConfidenceScore=5.15e-01
MVGIGKRSFTVTALRALQSTQNCQVPPFFFTNSTDEENGLWLRVMRPVDRSEFGGKLVTGVVRMWGSGIGENIEEEGGGLRGEGGVRGGGWCISVEGTFMGQLVRGSGRRGGGVGWVGVVGMGRAKQEGGGKTCDPVRELFKLVEVIVHRASLSKLGQCALGVIIKCRGKASLERVEQGRPGSDQMVAVHPLKPAQSWSIHIKRSNRDAFLLRGLMIVEKLGDLKDPSHGVLVVEARHIKLKGMAVWGVKLKFKELVLDGIETKGEVMVSVGKGGLVLGKATDGLF

SEQ ID NO: 181366 - protein, 237 aa, Glycine max
  Coding DNA Sequence Number=SeqID_64588
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=99%, HitCoverage=84%, E-value=2e-58, Identity=47%"; Hit description =Cysteine protease 8
  Pfam annotation: Domain name=Peptidase_C1; Domain location=78-237; Score=79.0; E_value=1.5e-20; Accession=PF00112.13; Description =Papain family cysteine protease
MAFLASQVTCRTLQDASMYERHEEWMSRYGKEYELERDDRLPFSFFLDQDPTDLVHILVTLIRWRLEKVGERICIYGKPRYVFLGHKKGAVTPVKDQGHCGFCWAFYDVASTEGILALTAGKLISLSEQELVDCDTKGVDQGCECGLMDDAFKFIIQNHGVKMPITLIRVLMESAMQMKKPTLLLLLLAIDACDSDFQFYKSGVFTGSCETELNHGVTTMGYGVSHDGTQYWLVKNS

SEQ ID NO: 181367 - protein, 124 aa, Glycine max
  Coding DNA Sequence Number=SeqID_64589
  Gene Ontology: Mol. function=catalytic activity; Biological process =auxin mediated signaling pathway
  Homolog annotation: Hit_ID=P33080; Match level="QueryCoverage=72%, HitCoverage=97%, E-value=1e-27, Identity=66%"; Hit description=Auxin- induced protein X10A
  Pfam annotation: Domain name=Auxin_inducible; Domain location=35-124; Score=149.0; E_value=1.3e-41; Accession=PF02519.5; Description=Auxin responsive protein
  Subcellular localization annotation: CTP_CleavageSite=43; ConfidenceScore=5.17e-01
MTDGMEPRGRQGNMLQGSFFENLRFFFFLQSSKNMGFHLPAIRQASLAASQASSKFVEVPKGYLAVYVGEKEKRFMIAISYLNQPSFQDLLYQAEEEFGYDHLLGGHTIPCSEDFFQCITSHLN

SEQ ID NO: 181368 - protein, 137 aa, Glycine max
  Coding DNA Sequence Number=SeqID_64590
  Gene Ontology: Mol. function=nucleic acid binding; Biological process= DNA integration
  Homolog annotation: Hit_ID=Q1S9K1; Match level="QueryCoverage=97%, HitCoverage=20%, E-value=2e-29, Identity=64%"; Hit description =Integrase, catalytic region; Zinc finger, CCHC-type; Peptidase aspartic, catalytic
MEDEKAMEDLINGVEFAKRALMKRKIAGTKASHNVTIAKENSEGNLFFACQKATEEYKNVWYLDSGCSSHMMRDKDAFIDMDSSFGSKVKLGNGEFVEVEGKGSIGVATKQGDENLLSILGSFWRMVILFNLRIGSA

SEQ ID NO: 181369 - protein, 81 aa, Glycine max
  Coding DNA Sequence Number=SeqID_64591
  Gene Ontology: Mol. function=ATP binding; Biological process=defense response
  Homolog annotation: Hit_ID=Q1SWW3; Match level="QueryCoverage=96%, HitCoverage=6%, E-value=4e-23, Identity=63%"; Hit description =Disease resistance protein
MEIAEERTKFHLTNMVRERRSGVPEWRQSVSLITEPKFYGREEDKDRILDFLIHDASHFEDLSVYPIVGLGGLGKTTLVEH

SEQ ID NO: 181370 - protein, 44 aa, Glycine max
  Coding DNA Sequence Number=SeqID_64592
MDCFYSGIAPKFTTAMDEDVTKLGGHEIGITPICRIIDAKPHHT

SEQ ID NO: 181371 - protein, 67 aa, Glycine max
  Coding DNA Sequence Number=SeqID_64593
  Gene Ontology: Mol. function=catalytic activity; Biological process =auxin mediated signaling pathway
  Homolog annotation: Hit_ID=Q1S382; Match level="QueryCoverage=99%, HitCoverage=90%, E-value=4e-19, Identity=60%"; Hit description=Auxin responsive SAUR protein
  Pfam annotation: Domain name=Auxin_inducible; Domain location=1-67; Score=57.8; E_value=3.5e-14; Accession=PF02519.5; Description=Auxin responsive protein
MGFRFPSIRQASFMASQATSKFVDAPKGYFAVYVGEKQAVHDSPEEEFGYDHPMGGLTIPCSEDVFQ

SEQ ID NO: 181372 - protein, 121 aa, Glycine max
  Coding DNA Sequence Number=SeqID_64594
  Gene Ontology: Mol. function=cysteine-type endopeptidase activity; Cellular component=vacuole; Biological process=proteolysis
  Homolog annotation: Hit_ID=Q6Y1E4; Match level="QueryCoverage=91%, HitCoverage=33%, E-value=2e-30, Identity=58%"; Hit description =Cysteine protease 12
  Pfam annotation: Domain name=Inhibitor_I29; Domain location=10-62; Score=50.5; E_value=5.8e-12; Accession=PF08246.2; Description =Cathepsin propeptide inhibitor domain (
MDSLLFKPHVALSKMHPGPQEREKRFKIFKEDVNYIEALNNAANKPYKLGINRFADLTIEEFIAPRNRFNGHTRFSFITTTTFKYENVTALPDSIDWRQKEAVTPIKNQDSVGKEKLIGSI

SEQ ID NO: 181373 - protein, 106 aa, Glycine max
  Coding DNA Sequence Number=SeqID_64595
  Gene Ontology: Mol. function=catalytic activity; Biological process =auxin mediated signaling pathway
  Homolog annotation: Hit_ID=P33081; Match level="QueryCoverage=57%, HitCoverage=75%, E-value=6e-24, Identity=85%"; Hit description=Auxin- induced protein 15A
  Pfam annotation: Domain name=Auxin_inducible; Domain location=15-106; Score=130.1; E_value=6e-36; Accession=PF02519.5; Description=Auxin responsive protein
MKAPPQSDHEEKSRALNTLKTMCELNCIICSKSSIFKSGGSIKGYLAVYVDEKMKQFVIPVSHLNQPSFQELLSRAEVEFGYYHPMGGLTIPCSEDVFQRITSCLN

SEQ ID NO: 181374 - protein, 136 aa, Glycine max
  Coding DNA Sequence Number=SeqID_64596
  Homolog annotation: Hit_ID=UPI0000162C19; Match level="QueryCoverage =42%, HitCoverage=8%, E-value=9e-15, Identity=67%"; Hit description =ATP binding / ATP-dependent helicase/ DNA binding / helicase/ nucleic acid binding
MSETAEAPSDLTMPLLRYQKEWLAWGLKQESSVSKGGILADEMGMGKTVQAIALVLAKLFKQLHGKEQQPVDDAVGGDETTTGKGSNNKDKGVDVISSDSDIVSGPDSDSDFEDLGFMLPCILYSDSDSDIHTHSG

SEQ ID NO: 181375 - protein, 225 aa, Glycine max
  Coding DNA Sequence Number=SeqID_64597
  Gene Ontology: Mol. function=cysteine-type endopeptidase activity; Cellular component=vacuole; Biological process=proteolysis
  Homolog annotation: Hit_ID=Q6Y1E4; Match level="QueryCoverage=72%, HitCoverage=65%, E-value=3e-41, Identity=44%"; Hit description =Cysteine protease 12
  Pfam annotation: Domain name=Inhibitor_I29; Domain location=22-79; Score=71.6; E_value=2.5e-18; Accession=PF08246.2; Description =Cathepsin propeptide inhibitor domain (
  Pfam annotation: Domain name=Peptidase_C1; Domain location=78-208; Score=-44.1; E_value=1.7e-08; Accession=PF00112.13; Description =Papain family cysteine protease
  Pfam module annotation: Pfam domain module=Inhibitor_I29::Peptidase _C1; Domain location=22-79::78-208
MAFLASQVTCRTLQDASMYERHEEWMSCYGKVYKDPREREKRFRIFKENMNYIETSKNAAIKPYKLVINQFADLNNEDHKKGAVTPVKDQGHCGFCWAFYDVASTEGILALTAGKLISLSEQELVDCDRGQDANYPYKGVDGKCNANEEANPAATITGIPWVSAYMVLLGGLRPKQPHQGLPKGYLAVYVGDKMRRFRIPSPSVSFVVNSSKKLYVGIHLHCKEL

SEQ ID NO: 181376 - protein, 460 aa, Glycine max
  Coding DNA Sequence Number=SeqID_64598
  Gene Ontology: Mol. function=nucleic acid binding; Cellular component= beta-galactosidase complex; Biological process=DNA integration
  Homolog annotation: Hit_ID=Q1S4N1; Match level="QueryCoverage=98%, HitCoverage=35%, E-value=0.0, Identity=76%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam module annotation: Pfam domain module=RVT_1::RVT_2; Domain location=8-196::1-223
TKLNADGSINKHKARLVVKGYAQIFGVDYSDTFAPVARLDTIRILLAVVAQMNWKVYQLDVKSAFLNGVLHEEIYVEQPEGFLKNEEKDKVYLLKKALYGLKQAPRAWYSKIDDHLLSIDFKKNLSEATLYVKHWSNEVLMISLYVDDLLVTGNNAGMIQEFKQEMMKVFEMTDLGLMTFFLGLEIKQAEYEVFICQKKYVKEILKKFNFQECKEVSTPMDQKEKLCKEDGADKADERYFRSLIGCLMYLTATRPDILNAVSILSRFMHNASELHLRAAKRIIRYVKGTSDFGVKFTWSKEFKLVGFSDSDWGGSIDDMRSTSGYYFTLGSSVFSWSSKKQETVAQFTAEAEFIAATAAVNQALWLRKILMDLNLEQKESTKIFVDNQAAISISYNPVFHGKTKHFNIKLFFLREVQKEGLVTLVYCKSENQLADLLTKPLPVSRFEFLREKIGVCKEEC

SEQ ID NO: 181377 - protein, 99 aa, Glycine max
  Coding DNA Sequence Number=SeqID_64599
  Gene Ontology: Mol. function=palmitoyl-(protein) hydrolase activity; Biological process=protein modification process
  Homolog annotation: Hit_ID=Q10T54; Match level="QueryCoverage=56%, HitCoverage=17%, E-value=4e-13, Identity=56%"; Hit description =Palmitoyl protein thioesterase containing protein, expressed
MIHVDELTVGENMDVKFSFGEGSLFGFDSWEGVTQGIGDACKHSGIRNFIKELSKWSGSPGYCLEIGNGSWDSWTKPLLKQTSIACEKVVNLFGNFLFQ

SEQ ID NO: 181378 - protein, 99 aa, Glycine max
  Coding DNA Sequence Number=SeqID_64600
  Homolog annotation: Hit_ID=Q1RTL8; Match level="QueryCoverage=51%, HitCoverage=7%, E-value=1e-18, Identity=80%"; Hit description=IMP dehydrogenase/GMP reductase
MARSATAFLPSAPMVYAVISDPGIVDNPDIPSYQPHVYGRCDPPALIPLQMNARNVHNPVNQPEWRSPGTDTGLEESMWHLTLVLLFCCLSYLSRITDC

SEQ ID NO: 181379 - protein, 209 aa, Glycine max
  Coding DNA Sequence Number=SeqID_64601
  Gene Ontology: Mol. function=nucleic acid binding; Biological process= DNA integration
  Homolog annotation: Hit_ID=Q1S6N9; Match level="QueryCoverage=98%, HitCoverage=15%, E-value=1e-70, Identity=65%"; Hit description =Integrase, catalytic region; Zinc finger, CCHC-type; Peptidase aspartic, catalytic
  Pfam annotation: Domain name=zf-CCHC; Domain location=139-156; Score =7.3; E_value=0.063; Accession=PF00098.13; Description=Zinc knuckle
  Pfam annotation: Domain name=zf-CCHC; Domain location=160-177; Score =13.0; E_value=0.0072; Accession=PF00098.13; Description=Zinc knuckle
  Pfam module annotation: Pfam domain module=zf-CCHC::zf-CCHC; Domain location=139-156::160-177
MQVLNLMREFELQRMKESNTIKEYSDKLLGIANKIKLLGSDFADSKIVEKILVTVPERYEESIASLENTKDLSKITFSEVLHAFQAQEQRRLMREDHAIEGALLAKSQQAKNYKKNHPVSSQSSANNYNKGKGEKKSYPPCQHCGKMGHPPFRCWQRPDAKCIKCNQMGHEAVICKSKNQQQEEEAKVADQEEEEEDQLFVATCFASSE

SEQ ID NO: 181380 - protein, 79 aa, Glycine max
  Coding DNA Sequence Number=SeqID_64602
  Homolog annotation: Hit_ID=Q1S4N1; Match level="QueryCoverage=54%, HitCoverage=3%, E-value=3e-14, Identity=76%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAADFPELDDHVPTCKACLFGKQKRKNKRDKLDKRASPGIFIGYSTVSKAYKIFQPQTGSIVVSRDVHFIEDEEWNWDE

SEQ ID NO: 181381 - protein, 93 aa, Glycine max
  Coding DNA Sequence Number=SeqID_64603
  Gene Ontology: Mol. function=catalytic activity; Biological process =auxin mediated signaling pathway
  Homolog annotation: Hit_ID=Q1S384; Match level="QueryCoverage=57%, HitCoverage=55%, E-value=4e-15, Identity=74%"; Hit description=Auxin responsive SAUR protein
  Pfam annotation: Domain name=Auxin_inducible; Domain location=1-93; Score=28.4; E_value=3.5e-08; Accession=PF02519.5; Description=Auxin responsive protein
MIWDNKPLHFLSNIDCKVAFGTSTAFEGANLFSATDVFLMPEKWVSVYLLFDGHQKRFIIAISYLNLPSFQDLLSQAEEEFGYDHSMGGLTIP

SEQ ID NO: 181382 - protein, 297 aa, Glycine max
  Coding DNA Sequence Number=SeqID_64604
  Homolog annotation: Hit_ID=Q9NQZ8; Match level="QueryCoverage=22%, HitCoverage=70%, E-value=2e-19, Identity=67%"; Hit description =Endothelial zinc finger protein induced by tumor necrosis factor alpha
  Pfam annotation: Domain name=zf-C2H2; Domain location=127-149; Score =36.3; E_value=1e-07; Accession=PF00096.16; Description=Zinc finger, C2H2 type
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPEFDLTQHERIHTGEKPYACGDCGKAFSQNMHLIVHQRTHTGEKPYVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 181383 - protein, 155 aa, Glycine max
  Coding DNA Sequence Number=SeqID_64605
RERSLSICLALVDFPQRNPYKFHEPPPLVDKSDDSAAVRNGVSRLVDLIFRGQYIPKGALVIFDGLNKELCVGIHLVVIRIVHLGRKSGWLFCAFYFKQAASSLMMAYGGDEFVHPDNAVPVSLTRSGYPRIIPSHHRRMILKKDEKADMLVKFY

SEQ ID NO: 181384 - protein, 204 aa, Glycine max
  Coding DNA Sequence Number=SeqID_64606
  Gene Ontology: Mol. function=protein binding; Cellular component =apoplast; Biological process=response to biotic stimulus
  Homolog annotation: Hit_ID=Q9ZP52; Match level="QueryCoverage=51%, HitCoverage=43%, E-value=1e-32, Identity=61%"; Hit description =Thaumatin-like protein SE39b
  Pfam annotation: Domain name=Thaumatin; Domain location=40-200; Score= 74.0; E_value=4.7e-19; Accession=PF00314.8; Description=Thaumatin family
  Subcellular localization annotation: CTP_CleavageSite=49; ConfidenceScore=5.54e-01
QKHRRTSALASVAVTLRVTTTPAALNAPLQGASHSPFRLRNCWEGRSVRASSLLRQLAKGGCAARRLSWAINITAPKGWSGRIWGRRGCTFHSYGSGTCITGDCGGKLKCDGVGGAPPASLAEFTLDSQEGGFYDVSLVNGYNLPVSIFPTGGSGQCKAVTCQSDLNRNCPNGLEVRNQSQSSLSIPSTSRGGPVPAFVPFSEG

SEQ ID NO: 181385 - protein, 305 aa, Glycine max
  Coding DNA Sequence Number=SeqID_64607
  Homolog annotation: Hit_ID=Q4UZJ8; Match level="QueryCoverage=32%, HitCoverage=31%, E-value=2e-23, Identity=58%"; Hit description =Pyruvate dehydrogenase E1 beta subunit
  Pfam annotation: Domain name=Transketolase_C; Domain location=74-189; Score=20.1; E_value=7.9e-05; Accession=PF02780.10; Description =Transketolase, C-terminal domain
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIRCVIVQEAPKTAGFGAEIAARLAEESIYDLLAPVERVTGYDTHIPLFRLEMKYLPSVEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 181386 - protein, 76 aa, Glycine max
  Coding DNA Sequence Number=SeqID_64608
MRLHYYQASRRPNMTTYQPPLLMTHIDPSIRPNISMSPVESPTVATYPSAGRRGENKKRVFQNGKRMGVTTNVYSR

SEQ ID NO: 181387 - protein, 83 aa, Glycine max
  Coding DNA Sequence Number=SeqID_64609
MSGFTRNSPQISASPHQLDLAPYASEPYNAQWNAPGLLRDKHTLRSSRILGEMEVDEPWLGLWLPLNYQVVFVIGSAVDRLCG

SEQ ID NO: 181388 - protein, 82 aa, Glycine max
  Coding DNA Sequence Number=SeqID_64610
  Gene Ontology: Mol. function=RNA-directed DNA polymerase activity; Biological process=RNA-dependent DNA replication
MTLLLSNIMPSTRNANLPLRKYQLVCAVLKKHKKAIGYTLVDIPGISPSTCMHRINLEDGAKPVRQPQRRLNPVILDVVKKE

SEQ ID NO: 181389 - protein, 123 aa, Glycine max
  Coding DNA Sequence Number=SeqID_64611
IIPFDKHIAAVKTTSNNMLSKRKTLDEGSLLSSKSETQHDHRFTSTPYVPMDPREPTKEEVMILHEIRRPNSLKTIPTGVANCRNLPFGGRATRGLTGVSSKKGKCAELPPTFIRGKRRKNWK

SEQ ID NO: 181390 - protein, 152 aa, Glycine max
  Coding DNA Sequence Number=SeqID_64612
MENCTKQSLRMAPKKWGGCMNKNVIHGAPKKGREWRIALSNHYAWLQLVGGGCMNENAIHGATKKGREWRIALSNHYAWLQTRGWRMHERKRNSWGSEKRGREWRIAISNHCAWLQTCGWRMHERKRNSWGFEKKRRMENCRTTLRNNVAGL

SEQ ID NO: 181391 - protein, 63 aa, Glycine max
  Coding DNA Sequence Number=SeqID_64613
MVVSLFLTHLLLEVASLITFPISPPLPLVFKKQRTPLMKKIHGLQALHGATSCGMRASSSSLE

SEQ ID NO: 181392 - protein, 104 aa, Glycine max
  Coding DNA Sequence Number=SeqID_64614
MEDQIPDNKTCKRGVQKVKWEKRKSLESVDEWGKAGVIKLIDTVDLEGGPVGKPVVPAALMNRPTRGERRFAYWALAECILAYYVGTDEGVSEVLHVAGEKRLH

SEQ ID NO: 181393 - protein, 105 aa, Glycine max
  Coding DNA Sequence Number=SeqID_64615
GSTGSNKDRRKSLKVYQSHTVRGEKVASAQDFVSNQRERTTLGRGFLFLVYLVTILYCSDIVWSKDLSGWQGLTFSPWVKVYDKLGFWLKACRTAGHDICQGLAS

SEQ ID NO: 181394 - protein, 192 aa, Glycine max
  Coding DNA Sequence Number=SeqID_64616
  Pfam annotation: Domain name=EAL; Domain location=1-192; Score=-86.6; E_value=6.9e-05; Accession=PF00563.11; Description=EAL domain
MSLTTGQLHGYEVLSEPPAEVNIAEWFEQCSSAQLLQLRKWQLNTLARQRIPVKLFVNLTTTILASEEGAAALLQDPLPGVIELQDPMAIARLDASRLALLDENLRRLQHAGMEVWLDDYLSDYDSTLADSGLVFDGVKLDCAAFQQYRNDCAGLAQLIAEARRFGTVVLAEGVESQSDVRTASLAGADLAQ

SEQ ID NO: 181395 - protein, 170 aa, Glycine max
  Coding DNA Sequence Number=SeqID_64617
VTSTGISQPLSGSVDGIIDPPSPVRRHDSFEEQASQGSFVPHRRQDVLTIAIGCPEHPGRVHVAGAGVTIMKYFRSAPRMSRNSSSLPLEELHQLTQQIRDQLEELITEKVTRQLMTSFSQMQSHFRSQMQSQGLALPPEPLVGSSGPRVSTIESCVDPSGNDPETGDSD

SEQ ID NO: 181396 - protein, 99 aa, Glycine max
  Coding DNA Sequence Number=SeqID_64618
MVSHTRPSHFNPIARPSFTNMLNLEMKGSHIQNNQFHEHSHENSYTHFSAFIDVCNTVKINHVLDEALCLCLFPFSLAGDAISWLRSFLLTNFLGGMMW

SEQ ID NO: 181397 - protein, 101 aa, Glycine max
  Coding DNA Sequence Number=SeqID_64619
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=90%, HitCoverage=20%, E-value=7e-39, Identity=65%"; Hit description=DNA -directed RNA polymerase beta' chain
MAVHVPLSLEAQAEARLLRFSHTNLLSPAIGDPISVPTQDMLIGLYILTSGNRRAYQQKRINFDSPLWLRWRLDQRIISSREVPIEVHYESLDHIDGWYLR

SEQ ID NO: 181398 - protein, 259 aa, Glycine max
  Coding DNA Sequence Number=SeqID_64620
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=47%, E-value=1e-78, Identity=78%"; Hit description =Photosystem I P700 chlorophyll a apoprotein A1
  Pfam annotation: Domain name=PsaA_PsaB; Domain location=1-259; Score =10.2; E_value=2e-06; Accession=PF00223.9; Description=Photosystem I psaApsaB protein
GMYFHGARFSNYEAWLSDPTHIRPSAQIWRASGITSELQLYCTAIGALVFAALMLFAGWFHYHKAAPKLAWFQDVESMLNHHLTGLLGLGSLSWAGHQIHVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNW

SEQ ID NO: 181399 - protein, 132 aa, Glycine max
  Coding DNA Sequence Number=SeqID_64621
MQSQGLVLPLEPVVGPSAAHVNTKKSCVDPIGNNPNTSDSEKCRLYVKENPPRLVSLGRLYEWSTIVHNITLRNDQVKVGVEEVRDAGAPILVPTQEGVVGPIKPVDRPDHDVDDPLYLMTWTIPQLFLKLL

SEQ ID NO: 181400 - protein, 141 aa, Glycine max
  Coding DNA Sequence Number=SeqID_64622
  Homolog annotation: Hit_ID=Q9AVH2; Match level="QueryCoverage=95%, HitCoverage=53%, E-value=2e-35, Identity=60%"; Hit description =Putative senescence-associated protein
FKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 181401 - protein, 61 aa, Glycine max
  Coding DNA Sequence Number=SeqID_64623
  Homolog annotation: Hit_ID=UPI00006A2901; Match level="QueryCoverage =51%, HitCoverage=20%, E-value=2e-10, Identity=96%"; Hit description =UPI00006A2901 related cluster
AGRRVPVGGRIGNGPFGASSPGVEQSTQNCALNVKVKKFNQARVNGGSNYDSLKVAKCLVI

SEQ ID NO: 181402 - protein, 84 aa, Glycine max
  Coding DNA Sequence Number=SeqID_64624
  Gene Ontology: Cellular component=chloroplast
MDEYASIRFMLVWLGFPEEDAIRLMRNKKGYRKFEWLKLKQLTFEVTERKATTGVGESESKRGFLTSFSHSKPCMRLSSRTAPK

SEQ ID NO: 181403 - protein, 71 aa, Glycine max
  Coding DNA Sequence Number=SeqID_64625
MLHSWYSSFRDYEYNRSIRQQKDHPKDDHLVAIENESNQMEQVIEIEKNRSFTTTDEGYLEKLRISNPFEN

SEQ ID NO: 181404 - protein, 220 aa, Glycine max
  Coding DNA Sequence Number=SeqID_64626
  Subcellular localization annotation: CTP_CleavageSite=47; ConfidenceScore=5.09e-01
ERARLIFGLVSHMDMNIGALISGQMTSTAQSNTSRLGFPALITALCRSRGVVSDSLTFERLSPVINLAYIRKNCWNPKALTISIRGVRRVRARPAELPSTFAAPTPASMSVVAPLGSIPSVEQFKEMVVWSRNQPSLHKEDKGPTAQVPQNMEDEFSEATIPEPFTAGEEAGDTQMTQVATATSERSLEATSEPPASAVDLPSPQHATDPSTPVLEIPKD

SEQ ID NO: 181405 - protein, 77 aa, Glycine max
  Coding DNA Sequence Number=SeqID_64627
MFNMLIDYENQVTYDLLDYEMKTEIPFSNVLKLPQRSSPPTIVVQEPAIVQDQVNEPILKPTQQPMNPMHEPSRKSN

SEQ ID NO: 181406 - protein, 119 aa, Glycine max
  Coding DNA Sequence Number=SeqID_64628
MSNMQCYYSDENGHVQERCKQMKEDLKKLIDMNKDGANSQANVVKSVENEDDLFLATNDEVAKTKSQENDFKIESRTIQESRVLSFKIQESSFKFQESRIKNNQDQDSRIKKRLNQDKY

SEQ ID NO: 181407 - protein, 82 aa, Glycine max
  Coding DNA Sequence Number=SeqID_64629
MGAILKKKKKKYEKIHDEEIYRYASGKYHTKPQESDKMTPSKVSYQNIKHKMKFDNQELSVITNEFHYPGREAINDKFNCTY

SEQ ID NO: 181408 - protein, 108 aa, Glycine max
  Coding DNA Sequence Number=SeqID_64630
MYIKYGPKYITKHSQQNKLSNETKPPHTYSQNNSKAPKFLKDMVISWKGKQGSKGLSKELIQGKSIWLEAYKNKIASIISKYACELGSINKNQAKAIVQAINGAKHIK

SEQ ID NO: 181409 - protein, 56 aa, Glycine max
  Coding DNA Sequence Number=SeqID_64631
MGRRLKWSCNTPLESHQNERDPKVVQDQSMILEANKTDSRGLGKSYLQRVLTGEGF

SEQ ID NO: 181410 - protein, 256 aa, Glycine max
  Coding DNA Sequence Number=SeqID_64632
  Gene Ontology: Mol. function=monooxygenase activity; Cellular component=membrane; Biological process=electron transport
  Homolog annotation: Hit_ID=Q1SJ90; Match level="QueryCoverage=82%, HitCoverage=45%, E-value=4e-21, Identity=30%"; Hit description=E -class P450, group I
MKDDMQVAMKIQYPGVADSINSDIENGTLLGGQDVAVKRLLGVSTQGLHEFKNEYLKELDELRTQLVATRATADAMESSQKQLKDEVLRIEHDIMQLKTKELAQEWLHAEEWLQLKLKTKEFKANFYHKNIDIKIISNHNSNDMFIGGIDTTTVTLQCSLAELINHPTVMEKARKEIDSIIGKEKMAIGRDPKYWDGPLEFRPERFLSNDNESGKMGQVGVRGQHYQRLPFGSGRKGCPRASLALKVAHTTLAVMI

SEQ ID NO: 181411 - protein, 123 aa, Glycine max
  Coding DNA Sequence Number=SeqID_64633
  Gene Ontology: Mol. function=asparagine-tRNA ligase activity; Cellular component=cytoplasm; Biological process=tRNA aminoacylation for protein translation
  Homolog annotation: Hit_ID=Q1SZA9; Match level="QueryCoverage=96%, HitCoverage=22%, E-value=9e-37, Identity=69%"; Hit description =Aspartyl-tRNA synthetase, class IIb; tRNA synthetase, class II
MEPTWRTLSARREFEVAVNDDACSGGNELAEFTQPDFDDDLEVAGATSVVDFQERESVLVGFASRLHPAANARLPTGKARAAIDVGDDGLDGDVVGEIIFGNLVEGDGGELIHQWRRCVCHWC

SEQ ID NO: 181412 - protein, 142 aa, Glycine max
  Coding DNA Sequence Number=SeqID_64634
  Gene Ontology: Mol. function=asparagine-tRNA ligase activity; Cellular component=cytoplasm; Biological process=tRNA aminoacylation for protein translation
  Homolog annotation: Hit_ID=Q1SEB4; Match level="QueryCoverage=86%, HitCoverage=27%, E-value=2e-32, Identity=52%"; Hit description =Aspartyl-tRNA synthetase, class IIb; tRNA synthetase, class II
  Pfam annotation: Domain name=WHEP-TRS; Domain location=66-135; Score=- 3.1; E_value=0.032; Accession=PF00458.10; Description=WHEP-TRS domain
MRLTLEFLRDFIHLHSKTNTIFAVARIRNSLTCATHTFFNKEGFLYVHTPIVSTSDCEGVGEMFQIGEGVVVQEKGKVMSQLKAAKASKKEIGAAVDQLKKANESLAKVDQLKPEILKKDDGKDYFATPPTIVPRWIVYVVL

SEQ ID NO: 181413 - protein, 217 aa, Glycine max
  Coding DNA Sequence Number=SeqID_64635
  Homolog annotation: Hit_ID=Q1SP02; Match level="QueryCoverage=71%, HitCoverage=33%, E-value=2e-15, Identity=34%"; Hit description=IMP dehydrogenase/GMP reductase
CNADLDYDEVSPRACRWIATKKTVKKVSTATYRQCLDRLRIPDVCWMPYAEHRPVQNFHLILCFSGQLRWGPIVVRYRPERVIRQFGYVQCIPAHPVHSWVSYDDVDDTWTHYSDHLATAGDLCVVPGQCAPDYIDWFFVISHPFMTMPQTDPPRDAYATQPSHIPPEATSASTHADPDADEPRHAVEACHAIMEVLEQDLNAPGLLGVSHKTAMCM

SEQ ID NO: 181414 - protein, 285 aa, Glycine max
  Coding DNA Sequence Number=SeqID_64636
  Subcellular localization annotation: CTP_CleavageSite=35; ConfidenceScore=5.23e-01
MVKKEALPNQNKLPTWRVDPTQSTVVKPCSAPPVRSVQLGPGGLTRPIPLLDRLANQVRIKLIRESFTDQVDPRVFPRIKLIRQSSTDQLDPYVDFTSTDQVWLTDQVDPFQENLGDRVLGHARKVEGSVRKKTNARKEQRKRKEERMAIEQKEKEEELKHLKNLKKQEIQEKVKKIMKTTGIHGDDIIPLSMAEIEEEFDPEEYDRMMKKAFDEKYYNAEDADPDFCSDMMTMRSQIFKKEDELLGLPKGWDACRSNINRDNLSRKAKRRQQVANLKLSQSTSV

SEQ ID NO: 181415 - protein, 602 aa, Glycine max
  Coding DNA Sequence Number=SeqID_64637
  Gene Ontology: Mol. function=microtubule motor activity; Cellular component=microtubule associated complex; Biological process =microtubule-based movement
  Homolog annotation: Hit_ID=Q2HU33; Match level="QueryCoverage=60%, HitCoverage=75%, E-value=1e-103, Identity=48%"; Hit description =Kinesin, motor region
  Pfam annotation: Domain name=Kinesin; Domain location=75-302; Score =145.8; E_value=1.2e-40; Accession=PF00225.13; Description=Kinesin motor domain
MTPRLIAIHRTDLESGTAMEPAQRRLGGGMVSLSPSQTPRSSDKPMLDLGSADSNSNSHNKYDKDKGVNVQVLVRCRPLSEDEMRLHTSVVISCNEDRREVFGPNSQQKELYDQAVSPIVYEVLKGYNCTIFAYGQTGIGKTYTMEGGARKKNGEFSSDAGVIPRAETYCSNVGREGGVFVRGLEEEIVCTANEIYKILEKGSAKRHTAETLLNKQNSHSHSIFSITIHIKECTPEGEEIIKCGKLNLVDLAGSENISRSGAREGRAREAYAHRGLCLDNYIHCLEETLSTLDYAHRAKNIKNKPEINQKMMKSAMIKDLYSEIDRLKQALVLGVQTIYFLSRPVAFQVVECTAYEEKQLLEKVAEMLASSNARKKQLVQIAVNGQIYAKGSYLKTIYAKRVSPVVLAILATWREPLFPLATYRECTCALDACRNLVATKVNHFSGSTAKIRLENYRDGENFGVRRDLNRTGSRSFPPIVPHEEEFLSDAAPRKLGIRPEDLRFGGGDGGDNGGRNLTGGNGCEWIKIGAYYEEMLRSNPTDALLLRNYGILLISCCVYAANAKSGSLHTVSIARATGGTLQPVSHVSTVSLLAMAVHAFSP

SEQ ID NO: 181416 - protein, 85 aa, Glycine max
  Coding DNA Sequence Number=SeqID_64638
  Homolog annotation: Hit_ID=O04084; Match level="QueryCoverage=33%, HitCoverage=6%, E-value=5e-07, Identity=82%"; Hit description=Serine carboxypeptidase isolog; 30227-33069
MLGNPETSDAEDWMGLVDYAWSHVVISYEHFKTQATVVATYPSAGGRRVTRGCVFQERKMRGVATNVYLRKTSEKPEKTWSTNFK

SEQ ID NO: 181417 - protein, 82 aa, Glycine max
  Coding DNA Sequence Number=SeqID_64639
  Gene Ontology: Biological process=multicellular organismal development
  Homolog annotation: Hit_ID=Q8L8Q3; Match level="QueryCoverage=85%, HitCoverage=39%, E-value=8e-16, Identity=56%"; Hit description=LOB domain-containing protein 25
  Pfam annotation: Domain name=DUF260; Domain location=45-81; Score= -27.2; E_value=0.005; Accession=PF03195.5; Description=Protein of unknown function DUF260
MNYFLIIDINIKEDPYVSGVHQSVVPIINLKIMASSSYSNSPYDACKFLRRKCMLDCIFSPYFPPKEPQKFTNVHKIFRASF

SEQ ID NO: 181418 - protein, 111 aa, Glycine max
  Coding DNA Sequence Number=SeqID_64640
  Gene Ontology: Mol. function=FAD binding; Cellular component =mitochondrion; Biological process=tRNA processing
  Homolog annotation: Hit_ID=Q5JN40; Match level="QueryCoverage=59%, HitCoverage=9%, E-value=2e-23, Identity=79%"; Hit description =Putative glucose inhibited division protein A
  Subcellular localization annotation: CTP_CleavageSite=24; ConfidenceScore=5.15e-01
MKFYASPIILTTGTFMSGKIWVSRTSMPAGRAGESASLGLTKNLQRLGFEIDRLKTGTPARVDIHTVIQHLTLVLTSPTMLKHAGYSTFNIGAYITTNVKTHIFYIVDEYH

SEQ ID NO: 181419 - protein, 149 aa, Glycine max
  Coding DNA Sequence Number=SeqID_64641
MDVSVGSMHTQNFVCKLLDRSHGAVWTTTAPPSGPLTLISTGQDNYKLFVKLEFRYDATSKGRSNKLYKKIITSNSIPNDKDEECLSLPTIQWETLASNLEDFSKVAEKFAISKSAVEVAVSMKLQDDAIPALEKLRKVWTSFSLVFDY

SEQ ID NO: 181420 - protein, 149 aa, Glycine max
  Coding DNA Sequence Number=SeqID_64642
  Homolog annotation: Hit_ID=P32746; Match level="QueryCoverage=42%, HitCoverage=13%, E-value=7e-14, Identity=64%"; Hit description =Dihydroorotate dehydrogenase, mitochondrial precursor
  Subcellular localization annotation: CTP_CleavageSite=19; ConfidenceScore=5.16e-01
MRMQRSTTKILPKRLLSSRSSTNTANNSTMPDIGFLCVILIQLTSKKSVGEVFIDQGMAGTVSEESGVGKTSSTSPSSKNEVKHDGKAGSGFLGVNGVNLGKNKTSEDATADYDQEVHTLSQYADYLVISLFLYPFIEKEGKDRQPSIL

SEQ ID NO: 181421 - protein, 81 aa, Glycine max
  Coding DNA Sequence Number=SeqID_64643
MHRSSSGMRISQDKRWKSLEFARDRLLMELAREQAMSIEASRDAQAKANSLNSAAVGASVGAGLGLVLAIVMGAASALRKP

SEQ ID NO: 181422 - protein, 189 aa, Glycine max
  Coding DNA Sequence Number=SeqID_64644
  Homolog annotation: Hit_ID=Q5QMQ5; Match level="QueryCoverage=28%, HitCoverage=23%, E-value=2e-08, Identity=55%"; Hit description =Homeobox transcription factor-like
MEAEAENNDVKKEENNNDNNNNKNESNNKIRNSKLPVGDYEGGVVREVGVVGSIVVDVVLSPIVEGQEGVADKEAAKGSAAAGFSGGGAQVIMGQAAVQRCNGNVNFHDEEKPLYPPTRCRGAPLHSPYLVINEDGLPYGATLHASLATSYLTNYQQDIARKLTYEDRKVKFTSRVTALNSAADNDEDD

SEQ ID NO: 181423 - protein, 788 aa, Glycine max
  Coding DNA Sequence Number=SeqID_64645
  Gene Ontology: Mol. function=GTP binding; Cellular component=exocyst; Biological process=vesicle docking during exocytosis
  Homolog annotation: Hit_ID=Q9LXX6; Match level="QueryCoverage=99%, HitCoverage=100%, E-value=0.0, Identity=71%"; Hit description =Probable exocyst complex component 6
  Pfam annotation: Domain name=Sec15; Domain location=429-785; Score =37.6; E_value=2e-11; Accession=PF04091.3; Description=Exocyst complex subunit Sec15-like
MDVKTKRRADVENGDEGEDLVLATLVANGDDISPLVRHAFEMGRPKGLLRQLDFVVKKKEAEIEAMCKTHYEEFILAVDELRGVLVDAEELKSELQSDNFKLQQVGSTLLIKLEELLESYTVKKNVTEAIKMSKNCIKVLELCVKCNNHISESQFYPALKTVDLLEKCYIQNIPARALKRVIEKKIPSIKSHIEKKVCSQVNEWMVQIRSSCKIIGQTAIGRAAQVRQRDEEMLERKRKAEGLNISGVDDQAYNLVVEEDEDSAMKFDLTPLYRACHIHSCLGILEQFHDYYYKNRLLQLNSDLEISSAQPFVESHQTFLAQIAGYFIVEDKVLRTAGGLLVPDKVETMWETALAKITSMLDTQFSHMNSATNLLLVKDYVTLLGSTLRQYGYDIGQLLDVLDNSRDKYHRLLLQECQKQIVDVLGNDSYEQMVIKRDTDYENNVLSFNIQTSDIMPAFPYVAPFSSMVPDACRIVRSFIKGSVDYLSNGVRTGFFDFLRKYLDKFLIEVLNETLLDTINSGNISVSQAMQLAANITVLERACDYFLRHAAQQCCISVRSAEKPQATLTAKVLLKTSRDAVYITLLSLVNTKLDEYMNLVESINWTSEEAKPNGNDYINEVIFYLDSLMSTAQQILPLDAMYKVGTSAIEHISNTIVAAFLSDNVKRFNANAVMNFNNDLRMLESFADERFHSSGLAEIYSGDSFKSCMIEARQLINLLSSSQPENFMNPVIREKNYYALDYKRVASICDKFKDSPDGIFGSLSNKNTKQSAKKKSMDMLKKRLKDFN

SEQ ID NO: 181424 - protein, 624 aa, Glycine max
  Coding DNA Sequence Number=SeqID_64646
  Gene Ontology: Mol. function=aminoacyl-tRNA ligase activity; Cellular component=cytoplasm; Biological process=tRNA aminoacylation for protein translation
  Homolog annotation: Hit_ID=Q1SZT2; Match level="QueryCoverage=97%, HitCoverage=96%, E-value=0.0, Identity=72%"; Hit description=TRNA synthetase, class II (D, K and N); Nucleic acid-binding, OB- fold
  Pfam annotation: Domain name=tRNA-synt_2; Domain location=203-620; Score=15.9; E_value=6.9e-16; Accession=PF00152.11; Description=tRNA synthetases class II (D, K and N)
MAAAATTTTAQDTSSVPPLAYSGRVQLKELLDRSEAAVGQRVVVGGWVKSAKEVEKTAPPPSIATTDDTAREGGKGKDVSCVEILQSRIPLIRSILDVFGGGGYGQRKKRENVTAPNDKVLPPKASTAYLLLTDGSCAPSLQVVVDSSVATPSRLVPTGTCLLVEGQLERAEGKHAIELIAEKVLHIGTVDFDKYPLSKKRIPLDKLRDYSQFRPRTTTVATVMRIRSSLSFATHTFFNEHAFIDVQVPIITSTDSEGFSNMFRVNTLEQKAEKEKLETVYETEGVSLEHVKAAAKEKSNIVEHLERTESNREALAAAVQDLRKTNELASQLEAREKRKLGASFKDDKVDSSKEFFPFQTYLTVSGRLHLESYACALGNVYSFGPRFLADKTNSAKHAAEMWMIEVEMAFSQLKDSMICANDFFKYLCNWVLVHCSEEMTFVAKRIDNTCMNRLRQIISGSPEMMTYHKAIDVLRKSSSQAEDKKFETNFESGFVLTSEHLSYLTDMIYQKPVMIYNYPKEAKPFYARQNDDGTVAAFDLVVPKLGTIISGSQNEERLNMISSRIDELGLPREKYEWYLDLRRNGTVNNSGFTLRFDLMVLFATGLGNVRDVIPFPRSYGKAYT

SEQ ID NO: 181425 - protein, 318 aa, Glycine max
  Coding DNA Sequence Number=SeqID_64647
  Homolog annotation: Hit_ID=Q1SKC8; Match level="QueryCoverage=11%, HitCoverage=9%, E-value=8e-08, Identity=68%"; Hit description =Integrase, catalytic region
MEKMMKNKELKPWIFFINGVLCFLKINGSGMEKEERLKVFPGKLKSKWSGPFTIKEVKPYGAVEPIDLASRSAERDPVNHKKGIPLGIPPVLLQRKPGSTTRITLTRQPEKQIDVALVKEFYSNMDPCHPSGGGATDYILPHGSNPPDIQSRDEDGRGEHDFFVDYLDHPVQYIKARLPCFDCNTVQCIRDQFRHFNLLVPHPVINLTYIKKNCWNPIGPSIVFPGPRRSSSSPCCKASTMASIVDVEPSLVISLATSDDTRGIPILGCLARSPTSFCNVGDTSSTSNDHAAETGADDDYVADITAAQGAWDPWPPQD

SEQ ID NO: 181426 - protein, 322 aa, Glycine max
  Coding DNA Sequence Number=SeqID_64648
  Homolog annotation: Hit_ID=Q9FQ13; Match level="QueryCoverage=24%, HitCoverage=81%, E-value=8e-13, Identity=40%"; Hit description =Cystatin-like protein
MDLRTKGFEGSGIPEMEPRLLQHGGLVTGRGGSILDLEDQARQLCPRTLVVLAHRVVRDLRHVAVVHVLDGAPAAQRRFRPSGSVGDQDEGEEKETVHWKNAVNGLVLSILVWASALAKPTTFDGVEVGSQKANSVAIPPGIIRIRGIGDTLGKYLKVDRLTSLQYREKFARICVELDLEKPLLAVTTMTHTTESADNGDEVNTVTQSLGSMLVGVGLPSTNLRGPKELMIILKRLMMREKTVMVNGCWFNDLSREISGDGSNKGGRAKDIGTKKKSFGVDEGKFAKDVAGEGSKFAGGKTLTVKIRDYGVGGKSNFKKNFN

SEQ ID NO: 181427 - protein, 90 aa, Glycine max
  Coding DNA Sequence Number=SeqID_64649
  Subcellular localization annotation: CTP_CleavageSite=2; ConfidenceScore=5.47e-01
MVASPPSKAATPAPMATPPITTPPAATPPKGHGVPPPQFCPRFCHQENPNRPPSLPRRTPPQENHPPPPHPSNPHPYNHSIGKKRGISGF

SEQ ID NO: 181428 - protein, 164 aa, Glycine max
  Coding DNA Sequence Number=SeqID_64650
MSNMQCYYSDENGYVQERCKQMKEDLKKLIDMNKDGANSQANVVKSVENEDGLLFATNDEVAKTKCEMDFVSSKHICRDRKIFDTLKTNGEFSHFMLENGGKIKVEGIGSMRMKLYNGAIQTFSNMTSQGYKYVGSKWACKVYRGRHLVLRGKKNKGNLCCLDE

SEQ ID NO: 181429 - protein, 294 aa, Glycine max
  Coding DNA Sequence Number=SeqID_64651
ESSWLANFSCRCRATTLAAELATVGGDEGDPALWLRLLRGETLTSPLPFFLAPPKAEGGRIMVTGTGSPSKEVAEGHALLRWQEAPPPTQHKFANLLEKVDFLSEAPWCVSFEEELLIRMTSRSNRESEMKDMMERKCILKAKKIIRGEWKITNREQKARKFQERERAEMMPWKFAPQCNPTNPHTASPVCVHSTGDTYARVACLCCTHLQQKKNETHAFNVFSNEIARTTLVQAGGLDKLDKPTTLAPGLDKLATLLLVKATTFDTINLFCQQANSKLGGLCTARGPQNGRGK

SEQ ID NO: 181430 - protein, 140 aa, Glycine max
  Coding DNA Sequence Number=SeqID_64652
MGRKCSMAFKLYMSKAYGRVEWIILRRVLEQLDDSILFSRAAVEEVGIIRNILHQYELAFGQMVDQSHKFSALFEKGLEREDSVKEIKVDSTDMKYLEIGSASGVKVYGDKWLASLLGATVSQHECTIMDRNFHVSDLID

SEQ ID NO: 181431 - protein, 246 aa, Glycine max
  Coding DNA Sequence Number=SeqID_64653
MKKDLIQPRMMSEPNATHGGLPYAYCKELEPVDGGNKHKDQMEPCDVGECSCGHGAGFDHAHGAKFGVHEGACLHDDDDRRCHSHVHKCDCGKGNSLYAHDKDAKSCEAVHEYKGQPDIDLGDVADGFMEKDDDNVEDCAEETTVAWTNFVRLLLHGFFHQGSHFCDNNLEGVIGEKGVKMLCGGAEEKGEMLGVGGNCSGGHGNCEGYVGSCVRVNIKVIEMVVLFVVMGGGGCADGSSWGCGGH

SEQ ID NO: 181432 - protein, 141 aa, Glycine max
  Coding DNA Sequence Number=SeqID_64654
MAAEWRRKRERKCHFKEKMSLEEAHHHRRPWIRAWRKKEMNEGRGREEHEILCSKRALKSEGGLHQQGTTTNMNGDRKKKHRRKRKTNKKHRRKKTNHRRKRKMKGCKKRKRKRKRKRKRKKKDAHDGRRKRKKKDGATTI

SEQ ID NO: 181433 - protein, 96 aa, Glycine max
  Coding DNA Sequence Number=SeqID_64655
MEVCARFSRMRLIFVHVGHCSVSISRLGDEDKARNKGKESLEGLGGPMARARTKKAKEALQQVLTMFQVTSGETLECQLHHVPRRVEDANFVEWFY

SEQ ID NO: 181434 - protein, 320 aa, Glycine max
  Coding DNA Sequence Number=SeqID_64656
  Subcellular localization annotation: CTP_CleavageSite=37; ConfidenceScore=5.49e-01
MAESLKKQKGSSTSFAIAAHRHHGPSRAPTTPLPPSLSSQRSSTLFSSDDQCAPFEGTIIDDWKFDYSSHDARRMVCNDQADMTGRLLVGSLTFDYRIMHYIIVRILLPRSSNLAQASEEDLILMWAFFTGRQIDWAHLVRDRMLKALRANAPLPYPQLVTLFLHHFQIPLDDEPFVQVKRSIAISVSAVTSFGYCKDRDGQWLKKDAQPLQDERTPSPPPQRDDSSALINEVLSELRGLRTYVSERFDSLDGRFEGMDTCITQLEEDELNCHHQKEGDCRSKSKDFDYDVLMMPCGHALLKFNSRQKSKKYKIHHQEDL

SEQ ID NO: 181435 - protein, 75 aa, Glycine max
  Coding DNA Sequence Number=SeqID_64657
MVLRCFMCLPHGLRDFCMTRLGMLALNGCRNLPFGGRATRGSWVRLPWEENARSRHQRLFEENVKKTEKDAIYEL

SEQ ID NO: 181436 - protein, 120 aa, Glycine max
  Coding DNA Sequence Number=SeqID_64658
MIIWKQRAKLVMATARWVLKHPVYGIVILRLGIYTRRRSYRKTLQGSRISRNIIDNNEKQDNIQMINDGTYEFVDPTVMWLCMPPDSWVTVTKGGLVDKSKAFAPTYPQFVMRNSDLHSS

SEQ ID NO: 181437 - protein, 64 aa, Glycine max
  Coding DNA Sequence Number=SeqID_64659
MIDISKPYTEEMRGTVHEPQANLETGLQVLSFRGLHVLTFRGLDVLTFRGLKILAFRELKVIYH

SEQ ID NO: 181438 - protein, 203 aa, Glycine max
  Coding DNA Sequence Number=SeqID_64660
NILPERNVVLYVTEYNEFRWELERGTLEAPEEGPHHFGVGDEDGYGLGLAHFWVDLLDGPDQLLSAWLSYTHHNLASTSAPSSSAPAPSAPIPPPPASAPTPSGTSAQSRVISVDVTKPTPWLMPSDAEYPRLGSALAHHEHGGIYGLGEAPTAQEPHPESQPQPEVTPEATPQTSPAATPLVEVSEDEDGTKDTDYAANLAA

SEQ ID NO: 181439 - protein, 174 aa, Glycine max
  Coding DNA Sequence Number=SeqID_64661
MDVPCKSCGDPAVSDSQDSMMSSRRSASRLPPDEASNIKTLIHVLFAQLLRPPPPCALPPQAPLTAETRSFSAPRKAATPPWEPHKRIPKQNDMLEIEHLATKLVGVDWDEVVGEVPSEDEKGRIREKGRVAHTDAILPRKGPVTRAMSKRFQEDWARAAEEGPRVLMNLRVDF

SEQ ID NO: 181440 - protein, 253 aa, Glycine max
  Coding DNA Sequence Number=SeqID_64662
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=2e-35, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGTVHEPQVNIGADQKFSPIEDGPSGTSTLVFRGLHVLANRGLHAFTFRGLRVLTFRGLHVHTFRGLHALAIRGLHVLTFRGLHVLTFVWLHALTFRGPHVLTFRGLHALAIRGLHVLTFRGLHVLTFVGLHALTFRGPHVLTFRGLHALAIRGLHVLTFRGLHALAIRGLHVLTFVGLHALTFRGPHVLTFRGLHALAIRGLHVLTFRGLHALAIKGLHVFTFRGLHALAIRGLHVLTFRGLHALAIRGLH

SEQ ID NO: 181441 - protein, 204 aa, Glycine max
  Coding DNA Sequence Number=SeqID_64663
  Homolog annotation: Hit_ID=Q6CQF3; Match level="QueryCoverage=27%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPVMRKEADWWDPPVAGRSQRKLWWRPAAILTIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 181442 - protein, 141 aa, Glycine max
  Coding DNA Sequence Number=SeqID_64664
MKKEEQESNASSSSRQWFVAEEEEEEEGSAREIGPRGHQHYTKMALRKKKNQRLCEEEEESKGLCEEEEEETATERESSGRESHTFVLKNYPGVLRPFHIKCWVHQQKCWVHLAALPAFLSLVMGKGYKPYSLQNMIKVTN

SEQ ID NO: 181443 - protein, 372 aa, Glycine max
  Coding DNA Sequence Number=SeqID_64665
MGGQHSYRNICKDESVEYNCKECDLRKRRLKNTNKKEDREDVRWGYDIRMEENNTNQLARSLIATVLVVKLIQNAKELSFFGRDAIDSNEGVDLNEVLKGVEEWMNKIQLTNQDWSMLGCSLEPLDWGGFKKSKGYEDSDLESSVKVLHMGEGPSVVECSDDKGQLPTQIEKEVYGGSATILVGANKQQGKGLANAAVFSYDKKIQHFNNGNKDERTNIDNMMRKNAKDVMGETKNKKCGITMRDATCGSATKRFGDYVIEEDEAESRTIWNIAEDIGVVCNGEKVDIEWKGGVNITYIGKGYVGVQGVWKEDMGEFNQFIDDMEIKDIPLVDKKLTWYRSSTHSKSRLDIDFVCQWGGYIGGRVALKLLGS

SEQ ID NO: 181444 - protein, 462 aa, Glycine max
  Coding DNA Sequence Number=SeqID_64666
  Gene Ontology: Mol. function=RNA-directed DNA polymerase activity; Biological process=RNA-dependent DNA replication
MGKVESLWKSYDVQGRVAYVIKKKLKLLKIDLKKWNMESFENLEKQCKKLIAKVNFLEERDKVLGLTNEELETRRRENGIKGLQLERGWVEEPLFVKRGILDFFDKRIQEETFDRPKLDGVASNKLEGGEGEDNALLFDPGLDRINFNFIKKCWATLKVDFINMLQEFWENGAIPRRENPSFIILISKKDDPQGLNNFRPISLIGCLYKILSKVLARRLRVVLPKIIGEKQIAFMGEQNMLDSVAIANEVVDDAKRRKKSCLVLKVNFEKGSETRRPYCPFLIPHCSKRDKWLHEISLTLREDSTHNVLCIKAIMRNFEMVSGLKGGEEGKKKIVWVNWEDVEDDEQKRFFMGLGEGVWEKERGFMDAILGDVWRWRFEWRRQWFNWELPIVESFLTELEGLYTVKIAYEYVSSSLYPFEDPFHSYLWKLFIPKSVVIFIWRLSANRLPALDNLMARGVVLQ

SEQ ID NO: 181445 - protein, 229 aa, Glycine max
  Coding DNA Sequence Number=SeqID_64667
MGAQTDDFGFTLVDMKKPFIIGLNLEDDDSTLDTCLTPFSTQMANVNEEEEEVDDHMTTPPSSPPPPELATWLRSLAIRLVRMERPMVHVDPTTGKADGPHRKKLRMYLGIVARDKAEFDILEASDQRTKKKILKMGEGNVCKKYNISKEKWQQFCRSCRDPSWEDVRKKAQAIQKLNTTLHVLSHRGYDLLKERLMEEKQKKRLEQAAQSGSTKTIVDPPSPIRRQVK

SEQ ID NO: 181446 - protein, 115 aa, Glycine max
  Coding DNA Sequence Number=SeqID_64668
  Gene Ontology: Mol. function=RNA-directed DNA polymerase activity; Biological process=RNA-dependent DNA replication
  Pfam annotation: Domain name=rve; Domain location=16-115; Score=-0.9; E_value=0.0071; Accession=PF00665.16; Description=Integrase core domain
MGGISRRNEMPLQNIMEVEVFDCWGIDFMGPFPSSVGNEYILVVVDYVSKWVEAVATPRNDAKAVILISDGGSHFCNAQLQKVLSQYHVHHKVTSPYHPQTNGQAEVSSRELKKM

SEQ ID NO: 181447 - protein, 154 aa, Glycine max
  Coding DNA Sequence Number=SeqID_64669
TRSVSKSNLTIIPHPKPYKLQWLNEQGEMIVNQQVKVAKDQLTMTDKRGEEEKQKKKKDSKALSSKAKGKEKEEKDSSKKIVKKENHFETKGDIKRALILKQSFYLLLSRETSLSTAIIPTFETLPPKVQELLHEFGDIFPKEIPLGLPPLKGI

SEQ ID NO: 181448 - protein, 41 aa, Glycine max
  Coding DNA Sequence Number=SeqID_64670
NLAFGLTNVNERGLRATQRGNDVELTIDLCCLTTWECESQA

SEQ ID NO: 181449 - protein, 122 aa, Glycine max
  Coding DNA Sequence Number=SeqID_64671
MTQELVARGDTLRLSAPHHSVTPSVIDEQRPMWSFVPFPEMSASSGGDFFKSHKLSRTTGGGPDDMRRQNLVNLHPFVIQTQLCPMARRDKLWSFCTLLSSRGGGPDDMRRQNLVIPHPFAI

SEQ ID NO: 181450 - protein, 129 aa, Glycine max
  Coding DNA Sequence Number=SeqID_64672
  Gene Ontology: Mol. function=nucleic acid binding; Biological process= transport
  Homolog annotation: Hit_ID=Q8H6Q8; Match level="QueryCoverage=100%, HitCoverage=42%, E-value=7e-15, Identity=41%"; Hit description=CTV.20
MVATTYQTSHECPEETIIDILVEGFSRQLKGCVVKTNLNGKVITNDDNKKIPDAVNTLIFTIAQHFIGDRSLWKDRSAELLSNLKCRTLADFRWYRDTFLTRVYTREDSQQPFWKEKFLAGLPRSLGDK

SEQ ID NO: 181451 - protein, 138 aa, Glycine max
  Coding DNA Sequence Number=SeqID_64673
MDADEAMSRETNEVEFMGLGVTAIDLEEPSSNTKGKRQCSTSSGTHPHKRKMGEKDGIAASLDKMANSFNRMVEKMDGKVDDEDIQEVLREAALIPDLSRQQWAKAIKWLADDPKQLAIVKALPIHQKTDYVLTHLGE

SEQ ID NO: 181452 - protein, 264 aa, Glycine max
  Coding DNA Sequence Number=SeqID_64674
  Gene Ontology: Mol. function=DNA binding
  Homolog annotation: Hit_ID=Q1S0F5; Match level="QueryCoverage=90%, HitCoverage=47%, E-value=1e-27, Identity=36%"; Hit description=IMP dehydrogenase/GMP reductase
MVEEFEEILGCPLGARKPYLFSGFYPSLARISKIVQISAQELDHRKQVENGVVGVPRKCLETKARILAGRGEWAPFIDILTLLIFGGVLFPNVDGLVDLAAIDAFLAFHDRKESPVVAILADLYDTFDRRCEKSSTRIVCCTPALYVWLVSHLFCQEVRHACPLESHRSCTEKKKASWDRLLASKEGASINWFPRWKEGRTGVLISCGGFPNVPLMGTRGCISYNLVPSIRQLGYPMRGAPLEEELAPIIARGFNNTNAEALQK

SEQ ID NO: 181453 - protein, 302 aa, Glycine max
  Coding DNA Sequence Number=SeqID_64675
  Gene Ontology: Mol. function=transcription factor activity; Biological process=regulation of transcription, DNA-dependent
  Homolog annotation: Hit_ID=Q0LZY2; Match level="QueryCoverage=96%, HitCoverage=98%, E-value=2e-70, Identity=50%"; Hit description =Regulatory protein, LysR:LysR, substrate-binding
  Pfam annotation: Domain name=HTH_1; Domain location=4-63; Score=70.8; E_value=4.5e-18; Accession=PF00126.17; Description=Bacterial regulatory helix-turn-helix protein, lysR family
  Pfam annotation: Domain name=LysR_substrate; Domain location=85-286; Score=148.0; E_value=2.5e-41; Accession=PF03466.10; Description=LysR substrate binding domain
  Pfam module annotation: Pfam domain module=HTH_1::LysR_substrate; Domain location=4-63::85-286
  Subcellular localization annotation: CTP_CleavageSite=58; ConfidenceScore=5.07e-01
MDRFDELQVFVAVIQQGSLAGAARVLQRSPPVITRTLNALEARFGTTLIERTTRQLAPTESGWQLFEQAQRLLNDYQSALDSAHHSGLHGLLRITAPVMCGRRHVMPLVNAFLQQHPEMQIELILSDSYQDLIENGLDIAVRIGELQDSSMVARNVGSVRSMLVASPDYLRQAGIPAHPAELSMHALVAGVRHTREWRFAHDLRVRITPRLRVNDIASQLDALRSGQGIGRLLSYQVIDELQAGTLIRLLSEWEPAPLPVHLVAQRVKNMAPKVRCFWDFALTALPPRLQAAAEFPAPARNS

SEQ ID NO: 181454 - protein, 46 aa, Glycine max
  Coding DNA Sequence Number=SeqID_64676
MENNVVNFVGLNQVVLGIKWMNGMNKGEDERKERITLSSEGNTQRL

SEQ ID NO: 181455 - protein, 146 aa, Glycine max
  Coding DNA Sequence Number=SeqID_64677
  Gene Ontology: Mol. function=nucleic acid binding; Biological process= DNA integration
  Homolog annotation: Hit_ID=Q1SKA8; Match level="QueryCoverage=88%, HitCoverage=51%, E-value=7e-14, Identity=31%"; Hit description=Zinc finger, CCHC-type
  Pfam annotation: Domain name=zf-CCHC; Domain location=105-122; Score =33.4; E_value=8e-07; Accession=PF00098.13; Description=Zinc knuckle
MAITESRDLSNMSLATLFGKLQEHEMELIRLNQHEENDKKKKGITLKASSSIQEGSDKKDLNEIDEDDDFSFLIKRFNKFLRNKGNQRRSNFKSKKRAEDSSSLPKCYKCNQPGHLRVDCPSFKKRIERSEKKTLNKKKAKKAYIT

SEQ ID NO: 181456 - protein, 619 aa, Glycine max
  Coding DNA Sequence Number=SeqID_64678
  Gene Ontology: Cellular component=periplasmic space; Biological process=polysaccharide biosynthetic process
  Homolog annotation: Hit_ID=Q86AH5; Match level="QueryCoverage=88%, HitCoverage=93%, E-value=2e-97, Identity=36%"; Hit description =Similar to Erwinia amylovora. Amylovoran biosynthesis protein amsF
MANTSGTTSTTTPSATGMVIQLHTIDDLRKQEPVSIGEIASVLEYSRGSRMGGGVFVYDATDNSTPDDGGLNFVTSGKKRWKRVVLDYSAVTVVDFGAIADGTTDCIDAVIRMFKWSQRVLPSAGIRFTAGEFSLSGFDLAEVLGSDREINRFKISGAPVNFGYFPTTTLKFNWGPKPRKTHFFSVRARYVEISGFVVKGMSSDSGEDGGTAFNNVGFFTNSIIGGQFLRVSSMEFRYLGGRALELIDTLDCKIDQFYSRGCQGSIVYARWSDREKGAWDHSTAIELSNFNLQRSTRQPVFDLPRCTQSFIRNGWIEHSEFAGDLTNGQWTIEGLVIESTQNPMKMGYCRAMIIQKSVHRDSAGFDFSKEGIEPWTLLAEGDRGVMEISDLGAIIQGSLSYDFTTSQHHMDNRGKDAKWFYVGEFNFSDATSQIHVRIVGSAQYVSQSETQTDYSYRTPEGVAHIYLQARNDDNTIGSWYSEGSSPVIKVHIEGKGAHTKLYVKIPAYTGFSIALVETNGRDRYQSGQCFIFRKSFTACSAEEATALDNQPVVAFEQHWVGNKDVGFGYNNNKELLLRGPFFERQEQDATGKWITRRFLKVRVNGVPRSIELLDPDNPR

SEQ ID NO: 181457 - protein, 123 aa, Glycine max
  Coding DNA Sequence Number=SeqID_64679
  Gene Ontology: Mol. function=catalytic activity; Cellular component =membrane; Biological process=carbohydrate metabolic process
  Homolog annotation: Hit_ID=P64426; Match level="QueryCoverage=97%, HitCoverage=27%, E-value=5e-48, Identity=77%"; Hit description =Hypothetical lipoprotein yddW precursor
MMKPMRTRAAGCSLACWITSRRSYTARLPDQAARYDVLARWWANVVQPTHTRLYIGVALYKVGEASKSEPDWTVQGGVPELKKQLDLNESLPHIDGTILFREDYLNQPQTQQAVDYLRQRWGK

SEQ ID NO: 181458 - protein, 83 aa, Glycine max
  Coding DNA Sequence Number=SeqID_64680
MASRKRKSIGARPTAQYDTRWFHSLNAWNRYTDNVLGRSILPERKVEIYHKKFDDFKTKLERRNLHKRLTNLVDGTIDVALVK

SEQ ID NO: 181459 - protein, 237 aa, Glycine max
  Coding DNA Sequence Number=SeqID_64681
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=2e-36, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MATRPHLQGPHALALRGLHVFALIGLHALSFRGLHVLAVRGLKALTDRGQHVLAFRGIHALTFRGLRDLTIRGLHVLAFRGVHALALRGLQVLALRGLHALTFRELHVLALRGLHALAFKGLYILAIRGGLHALTFRGLHILALRGPHALALRGPHALALSGLHVLALRGLHALTFRGLHILALKGLHALTFRGLHVLAFRGLHALTFRGLHTLAFRGLHVLAFRGLHICAFGELNA

SEQ ID NO: 181460 - protein, 189 aa, Glycine max
  Coding DNA Sequence Number=SeqID_64682
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=2e-28, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
NVLAVRGLKALTVKGQHVFAFRGLQALTFRGLHVLTFRGLHILALTGLHALAFRGLHVLSFRGLQVFAFRGLHAVSFRGLHVLTFRGLHVLAFRGHHALTFRGLHVLAFRGLHAPTFRGLHVLTIRGGLPVLAFIGLHVLAFRGVHVLAFKGLHVLAFRGLHVLIFRGLHVLAIRGLHALIFRGRTPSP

SEQ ID NO: 181461 - protein, 132 aa, Glycine max
  Coding DNA Sequence Number=SeqID_64683
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-18, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=91; ConfidenceScore=5.64e-01
MARTCNPLKVRTCSPLNAKTCSPLKARTCSPLKARTGKPLMARTCSPLKMRTCTPLKARPCNPLMARTCSPLKAGACNPLKVRTCSPLKVRACSPLKAKTCYPLTVRAFSPLTARTFSPLKVRACNPLKVKT

SEQ ID NO: 181462 - protein, 95 aa, Glycine max
  Coding DNA Sequence Number=SeqID_64684
MCLSGKESMLMKFSHEILDVSILFLNDHLEETLGSTKIEENHSKCINLTQGKVYDKLGFWLKACRMAGHDICQGLASGLGIKGMSHIISMTHMQR

SEQ ID NO: 181463 - protein, 101 aa, Glycine max
  Coding DNA Sequence Number=SeqID_64685
MNPFSLFTPPPIYSKIGEELATQLAQASKVASSRSNSLLEEESGRPNFRRSYENSRIAKNTSFRFPSHYGIFTDRVSSFDDARKNSLDTGVIIKKGENVNV

SEQ ID NO: 181464 - protein, 118 aa, Glycine max
  Coding DNA Sequence Number=SeqID_64686
MLQPYGISIGLKEYSNPVTPKAYTPKSPSGPLPPDSGNLHFLFNTAHLHFSQDNTGRVIVQFPAYNTNNVTSRVNHTLIHNQNSLTISHLIMSQSTITCFHVSHNSTHVLLYTFTQSQ

SEQ ID NO: 181465 - protein, 81 aa, Glycine max
  Coding DNA Sequence Number=SeqID_64687
MHPEFPDEDIMALFEEKLDKDKDKLGFDCTNNKAEYEACALGVQAAIDFNVKLLKVYGDSALVIHQLRGEWETRDHKLIPY

SEQ ID NO: 181466 - protein, 96 aa, Glycine max
  Coding DNA Sequence Number=SeqID_64688
MTKACCHTLISSGDHLLLGCDPRLTTSRMFLQKAVASGGSNLARLGELGGKLLAYFPINKGRSEGEKYPTLLVSEVHLKLMRKIVSVKKIQAKALP

SEQ ID NO: 181467 - protein, 84 aa, Glycine max
  Coding DNA Sequence Number=SeqID_64689
MVEDARTTLGNQFVGLRTQWWRMHVGNQLMGLRAINSWGFGLNGGGCMNDNQFMGFRIRFDDGGCTNSARQSILGAPDAMVEDA

SEQ ID NO: 181468 - protein, 294 aa, Glycine max
  Coding DNA Sequence Number=SeqID_64690
  Gene Ontology: Mol. function=RNA-directed DNA polymerase activity; Biological process=RNA-dependent DNA replication
MPYTDLVPYLLNNQLAVVSLGKVYQPPFLRWYNPNTICTYHGSVPGHSVEQCVAFKHKVQSLIDARWLTIQEDSPNVRTNPHANHGSSTVNAVKEWKSQELKRMRDVSTPRRFILEALCKAGVIKYDGNKEDPCLMHPGALHDVERCPIAEEVLQGLMSRGQIEIHGAKKEEGEVFMQSSDRNPTKMLAPFLYKSDKVVPWKYGIEGPDRRQNASVIHVGNGMPAAKITNIFGTSGMTCNGRIFAPPELLTRSKDKGKVKTDMGETEKTGLTVNDEAPVGKLAKEGDDLSKREI

SEQ ID NO: 181469 - protein, 89 aa, Glycine max
  Coding DNA Sequence Number=SeqID_64691
MISDPKFVQASNHLVWAKDLTSALSKQLAWANGCLQQETNMQQKKNREKNAERAKKKKERRKSGAEALQSCDHGSHPSSFLLLVLCFVQ

SEQ ID NO: 181470 - protein, 177 aa, Glycine max
  Coding DNA Sequence Number=SeqID_64692
  Gene Ontology: Mol. function=unspecific monooxygenase activity
  Homolog annotation: Hit_ID=O04892; Match level="QueryCoverage=54%, HitCoverage=17%, E-value=4e-14, Identity=56%"; Hit description =Cytochrome P450 like_TBP
MSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSPVPNLVGCRWTARAASAARAGRRVLGRGRIGNGLLRGPLSSGRRTVNSELVRTRGNLDCLIKTKHCDGPCGC

SEQ ID NO: 181471 - protein, 93 aa, Glycine max
  Coding DNA Sequence Number=SeqID_64693
MAELINKTQLSPQNNPNVITLAWRLLHIISCLHPTAVILLPRTRLFLQKAVASGGSNLARLGELGGKLLPYFAINRGRSEGRRGSAFLALLIL

SEQ ID NO: 181472 - protein, 210 aa, Glycine max
  Coding DNA Sequence Number=SeqID_64694
  Gene Ontology: Mol. function=oxidoreductase activity, acting on single donors with incorporation of molecular oxygen, incorporation of two atoms of oxygen
  Homolog annotation: Hit_ID=Q1BHE8; Match level="QueryCoverage=62%, HitCoverage=98%, E-value=5e-40, Identity=60%"; Hit description =Glyoxalase/bleomycin resistance protein/dioxygenase
  Pfam annotation: Domain name=Glyoxalase; Domain location=78-203; Score=32.5; E_value=1.5e-06; Accession=PF00903.15; Description =GlyoxalaseBleomycin resistance proteinDioxygenase superfamily
MERPDSSEHPAKDRQVASSSTAVMSFIGFFHLHRKVTPERGAVDARMAAREQYCRTMGPHRLAILTRQPRKDTRQNPMFSHITVGTNDLDTAAIFYDALLTPLGMRRRPVTPDGGPAAACWVTAHVALPRFYVYAPYDREPASHGNGSMVAFLAPSADAVDAAHAAGLAAGGTDEGAPGLRPHYGAGYYGAYLRDPDGNKCHIVHRGDLA

SEQ ID NO: 181473 - protein, 191 aa, Glycine max
  Coding DNA Sequence Number=SeqID_64695
  Homolog annotation: Hit_ID=Q1R9V0; Match level="QueryCoverage=78%, HitCoverage=85%, E-value=2e-37, Identity=50%"; Hit description =Hypothetical protein yehS
  Pfam annotation: Domain name=DUF1456; Domain location=123-190; Score =131.3; E_value=2.6e-36; Accession=PF07308.3; Description=Protein of unknown function (DUF1456)
  Pfam annotation: Domain name=DUF1456; Domain location=40-107; Score =114.5; E_value=3e-31; Accession=PF07308.3; Description=Protein of unknown function (DUF1456)
  Pfam module annotation: Pfam domain module=DUF1456::DUF1456; Domain location=123-190::40-107
  Subcellular localization annotation: CTP_CleavageSite=23; ConfidenceScore=5.12e-01
MVVMVMIMDKVSSMLRNNHFVSQCAHVPVRQIRQCNPMMNNDVLRSVRYMLSINNAKMVEIIKLDDFEVAVSAMDAYVIKEGEPGYEKCPDEVMAHFLNGLVFFKRGKDDKFPAPAVELPITNNLVLKKLRVAFELKDTDMHQIFTAVDFRISKPELSALFRKEGTKNYRPCGDQMLRYFLKGLAQRVRGE

SEQ ID NO: 181474 - protein, 98 aa, Glycine max
  Coding DNA Sequence Number=SeqID_64696
  Homolog annotation: Hit_ID=Q94D97; Match level="QueryCoverage=67%, HitCoverage=12%, E-value=8e-16, Identity=60%"; Hit description =Nodulin-like protein
  Subcellular localization annotation: CTP_CleavageSite=58; ConfidenceScore=5.29e-01
MAPTAGAFLLLLNNTNLALYVGTAIIGVCTRAMTTISVSTTTELFGTKNFSVNHNVLVANIPVGCFGLNFCFDAWGKVGLASIVDLHMLLGPSINQGD

SEQ ID NO: 181475 - protein, 71 aa, Glycine max
  Coding DNA Sequence Number=SeqID_64697
MSKGLIVVFPSKYSIHHADNSDGKVAAIVICIAEFLRFAILTPSAIAAAMGVEVVAWVLHPLVISGKSQAN

SEQ ID NO: 181476 - protein, 1071 aa, Glycine max
  Coding DNA Sequence Number=SeqID_64698
  Gene Ontology: Mol. function=metal ion binding
  Homolog annotation: Hit_ID=UPI0000586805; Match level="QueryCoverage =96%, HitCoverage=66%, E-value=5e-54, Identity=23%"; Hit description =PREDICTED: similar to vacuolar protein sorting 8 homolog
  Pfam annotation: Domain name=WD40; Domain location=2-39; Score=19.6; E_value=0.011; Accession=PF00400.22; Description=WD domain, G-beta repeat
MMLAIQGDRLHAPVTSMSFNQQGDLLLAGYGDGHLTLWDVQKGVVVKVISGEHTAPVVHTLFLGQDPQNTRQFKAVTGDCKGLVLFHIISVVPLFSRFSIKTQCLLDGQSTGLVLSASPLLFDDFSGSASPFTRGNTSAPASSISSMMGGVVGGDAGWKLFNEAPSLVEEGVVVFVTHQTALVVRLSPTLQVYAQLSRPDGVREGSMPYTAWKYMTQTCSSTEAVERVSLLAIAWERKVLVAKLVKSELKVYGRWSLDGAALGLAWLDDQMLVVLTSNGQLYLFSKDGTVIHQTSFSIDGIGGDDLVSYHTHFINIFGNPEKAYHNSVAVRGASIYILGPTHLLVSRLLPWKERISVLRKAGDWMGALNMAMILYDGHAHGVVDLPRTLDAVHEAIMPFLMELLTSYVDEVFSYISVAFCNQIGKLDQSNDSNSRSNSVHSEIKEQYARVGGVAVEFCCHIKRTDILFDEIFNKFVDVQQRETFLELLEPYILKDMLGSLPPEGGYSGLSNVYFTWIYHPWILIRLCREHGLYSALVYVFNKGLDDFTAPLEELFAVLQNSQKESATVLGYRMLVYLKYCFTGLPFPPGRGSIPPTRLPSLRRELVEFLLKDSCTPKSQTVSDFVSRRPCLNLYLLLKLDTEATLDVLRCAFMEDGISNASSSSPDSANKPIEEAKKENDITETQNALVQNTVDALIQIIDVNIVPTDTTSGSGDDGLIKECPSKDIGYVFEFIAYYVALQRAKISKGVLCQILEYLTSDSQFSTNVSVQGSTPKNREKQVLALLEVLPEPDWDASFVLDLCERAKYHKVCGLIHSIRHEYVAALDSYMKDVDEPVHAFSFINRAFSQLTDNNHAAFRSAIILRIPELVELSREGAFHMVISHFRDESSRIITELHSHPRSLFLYLKTLIELHLFGTLDLSNLRKDDTMNPLNRKQVKDHPQGVKDYLENISNFPKYICENPIQVPDDLIELYLELLCKYEGGSVLKFLEMFDSYRVEHCLRLCQEYGIIDASAFLLERVGDVGSALSLTLSDLNDKFVDLDASVEAVVLNHRRDGSSHMEIFNSVLKTKE

SEQ ID NO: 181477 - protein, 131 aa, Glycine max
  Coding DNA Sequence Number=SeqID_64699
  Gene Ontology: Mol. function=helicase activity
  Homolog annotation: Hit_ID=Q1SRJ5; Match level="QueryCoverage=96%, HitCoverage=15%, E-value=7e-27, Identity=43%"; Hit description =Probable helicase [imported]-Arabidopsis thaliana-related
MDIWFKDTKEIGSVLSKSTIKESMFTAWMDSNKRYPHGLDLMYAEYLFKLVYVAHRRCWQPRKQGYTIGRLIWVPPSSGKLFYMGMMLSSAKGSQSYKDIRTVGNVVYGTFREACFAKGFLGNDQEFVGAL

SEQ ID NO: 181478 - protein, 211 aa, Glycine max
  Coding DNA Sequence Number=SeqID_64700
  Gene Ontology: Mol. function=nucleic acid binding
  Homolog annotation: Hit_ID=O81034; Match level="QueryCoverage=40%, HitCoverage=32%, E-value=7e-15, Identity=49%"; Hit description =Putative RNA-binding protein
  Subcellular localization annotation: CTP_CleavageSite=19; ConfidenceScore=5.00e-01
MNACQNPSPIIDGRRANCNIAAIGANKNRTQAPQHGQSRAAPGVLASPAFHGPSSTFVNQNIGQYTFPNSSFGIYTGYSQDTMYPMVGVCLNCYGIFGGQQLSTYYPSNGASGQVGLVHNIYPFSAHYPYNSQAHGFGVQYPQMMQFPILPRHYGSAGILALPSSMAMPITSAVTTTATTTTTEALRTSVGASQTAGTTSEQNSSAESLHR

SEQ ID NO: 181479 - protein, 62 aa, Glycine max
  Coding DNA Sequence Number=SeqID_64701
  Gene Ontology: Mol. function=nucleic acid binding; Cellular component= nucleus; Biological process=type I hypersensitivity
  Homolog annotation: Hit_ID=O81034; Match level="QueryCoverage=100%, HitCoverage=19%, E-value=3e-21, Identity=82%"; Hit description =Putative RNA-binding protein
  Pfam annotation: Domain name=RRM_1; Domain location=19-62; Score =15.1; E_value=0.0057; Accession=PF00076.12; Description=RNA recognition motif. (a.k.a. RRM, R
MVGGNINSRQYNDTTSTKIFVGGLAWETQRDTMRRYFEQFGEILEAVVITDKNTGKSKGYGF

SEQ ID NO: 181480 - protein, 172 aa, Glycine max
  Coding DNA Sequence Number=SeqID_64702
  Subcellular localization annotation: CTP_CleavageSite=55; ConfidenceScore=5.71e-01
MATPPASPPPPVPLPPPPADASVSLFTLKRTRKATQLRSLATRPPGAKRPMVNVDSATGKVDGPHKKKLRTYLVIVARDKVDVTYDTWKEVPTGQKDLIWKDIQAEFEIPEASDTDKDGVDDIVCEKYGISKEKWAQFCQTHRDPSWEDVRKKAQVIQKQNTAPPRIVSWGL

SEQ ID NO: 181481 - protein, 58 aa, Glycine max
  Coding DNA Sequence Number=SeqID_64703
MSRRLRKMPWPGNSLVMHSTVMGEKSSMMPPFEGLVLGVLRRFLEGFLFMVGKGKKVE

SEQ ID NO: 181482 - protein, 87 aa, Glycine max
  Coding DNA Sequence Number=SeqID_64704
  Homolog annotation: Hit_ID=Q2QX93; Match level="QueryCoverage=58%, HitCoverage=7%, E-value=5e-11, Identity=71%"; Hit description=WD repeat domain 48, putative, expressed
  Subcellular localization annotation: CTP_CleavageSite=56; ConfidenceScore=5.13e-01
MDDDDNSNDINVSGNSLPMTSLRNISSSNSISMHTTQSKGYNPIVAKGHKESVYALAMNEGGTLLVSGGCAYLGSEIWIKDFESKRA

SEQ ID NO: 181483 - protein, 72 aa, Glycine max
  Coding DNA Sequence Number=SeqID_64705
MEEMNVHIITKGTPKEHRTRNDVGTYRGRDLVASRLRFDVAPCGACRPWIFLINGVFCFLKMNGSRMEKEER

SEQ ID NO: 181484 - protein, 491 aa, Glycine max
  Coding DNA Sequence Number=SeqID_64706
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=35%, E-value=1e-132, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=276-293; Score =26.2; E_value=4.7e-05; Accession=PF00098.13; Description=Zinc knuckle
MNGNSGFNTHLPVFDGKNWSRWSIQMRVLFGAQDVLEFVNDGVPDLAENATEAQRNLHREKKKKDQKALFYIHQCVDAKIFEKIAESTTAKAAWDTLVRCYGGDATVKKVKLQSLRKQYENLNMKHNEKVADYVSRIITVTNEMKTCGETISEQMIVEKVLRSLTAQFDHIVVAIEQSKDTSTMKIDELQGSLEALELRVIERGNGKETDQALQAASKENWREIKKKQWLDKKAKQNPNSSDKDKGKSLADKAESSNKGGYNSKFNKKKNFDKRKIQCYNCDRFGHFADECWSGAGKWKKPEKGTEQANLAQDSSDTEPVMLMVTTNDEGVVVDWWYLDTGCSNHLTGNRQWLINYDSSKESRIRCADDEYLVAEGMGDVLVKLKDGGTVLIENVWYVPGMKSNLMSVGQLLEKGYSVTMRDAVLQLFDNSDKLVLKSKLSRNRTFKCNVKDSGVKVLSTVTESQSWLWHRRFGHLNFKSLTQLSEKELVT

SEQ ID NO: 181485 - protein, 85 aa, Glycine max
  Coding DNA Sequence Number=SeqID_64707
MDAMCMIFLKSCMFYALWLFVDAKGGEKIGIKSRTHTIKFVIIKKEEIVEASFMMMNQVDSSSFDDDKKLKRMISRLSQQVQDQD

SEQ ID NO: 181486 - protein, 735 aa, Glycine max
  Coding DNA Sequence Number=SeqID_64708
  Gene Ontology: Mol. function=identical protein binding; Cellular component=cellulose and pectin-containing cell wall; Biological process=negative regulation of enzyme activity
  Homolog annotation: Hit_ID=Q1SHG8; Match level="QueryCoverage=97%, HitCoverage=95%, E-value=0.0, Identity=63%"; Hit description =Protease-associated PA; Proteinase inhibitor I9, subtilisin propeptide
  Pfam annotation: Domain name=PA; Domain location=335-448; Score=23.9; E_value=0.00059; Accession=PF02225.12; Description=PA domain
  Pfam annotation: Domain name=Peptidase_S8; Domain location=120-584; Score=66.3; E_value=1e-16; Accession=PF00082.12; Description =Subtilase family
  Pfam annotation: Domain name=Subtilisin_N; Domain location=28-113; Score=65.7; E_value=1.5e-16; Accession=PF05922.7; Description =Subtilisin N-terminal Region
  Pfam module annotation: Pfam domain module=PA::Peptidase _S8::Subtilisin_N; Domain location=335-448::120-584::28-113
MGINICLSLCFFYITTLHRTISTLAQSENYIIHMDISAMPKAYSSHHTWYLSTLSSALENSKATTDNLNSKLIYIYTNVINGFSANLSPKELEALKTSPGYVSSMRDLRAKRDTTHSPQFLGLNKNVGAWPASQFGKDIIVGLVDTGISPESKSYNDEGLTKIPSRWKGQCESSIKCNNKLIGARFFIKGFLAKHPNTTNNVSSTRDTDGHGTHTSSTAAGSVVEGASYYGYASGSATGIASRARVAMYKALWDEGDYASDIIAAIDSAISDGVDVLSLSFGFDDVPLYEDPVAIATFSAMEKGIFVSTSAGNEGPFLGRLHNGIPWVITVAAGTLDREFHGTLTLGNGVQITGMSLYHGNFSSSNVPIVFMGLCDNVKELAKVKSKIVVCEDKNGTIIDVQAAKLIDANVVAAVLISNSSYSSFFLDNSFASIIVSPINGETVKAYIKSTNYGTKGTLSFKKTVLGSRPAPSVDDYSSRGPSSSVPFVLKPDITAPGTSILAAWPQNVPVEVFGSQNIFSNFNLLSGTSMACPHVAGVAALLRGAHPDWSVAAIRSAIMTTSDMFDNTMGLIKDVGDDYKPATPLAMGAGHVNPNRALDPGLVYDVGVQDYVNLLCALGYTQKNITVITGTSSNDCSKPSLDLNYPSFIAFFKSNSSSTTQEFERTVTNVGEGQTIYVASVTPVKGYHVSVIPKKLVFKEKNEKQSYKLRIEGPIKKKEKNVAFGYLTWTDLKH

SEQ ID NO: 181487 - protein, 753 aa, Glycine max
  Coding DNA Sequence Number=SeqID_64709
  Gene Ontology: Mol. function=identical protein binding; Cellular component=cytoplasm; Biological process=negative regulation of enzyme activity
  Homolog annotation: Hit_ID=Q1SHG8; Match level="QueryCoverage=99%, HitCoverage=99%, E-value=0.0, Identity=59%"; Hit description =Protease-associated PA; Proteinase inhibitor I9, subtilisin propeptide
  Pfam annotation: Domain name=PA; Domain location=337-450; Score=35.7; E_value=1.6e-07; Accession=PF02225.12; Description=PA domain
  Pfam annotation: Domain name=Peptidase_S8; Domain location=118-594; Score=57.0; E_value=6.2e-14; Accession=PF00082.12; Description =Subtilase family
  Pfam annotation: Domain name=Subtilisin_N; Domain location=27-115; Score=57.1; E_value=5.7e-14; Accession=PF05922.7; Description =Subtilisin N-terminal Region
  Pfam module annotation: Pfam domain module=PA::Peptidase _S8::Subtilisin_N; Domain location=337-450::118-594::27-115
MATHICLSLCFLYITTLNLVSTLAQSDNYIIHMDISAMPKTFSTQHSWYLSTLSSALDNSKATNNLNSVSSSKLIYTYTNAINGFSANLSPKELESLKTSPGYVSYMRDLPAKRDTTHSPQFLGLNPNEGAWPVSEFGKDVIVGLVDTGIWPESKSFNDKGMTEIPSRWKGQCESTIKCNKKLIGAQFFNKGMLANSPNITIAANSTRDTEGHGTHTSSTAAGSVVEGASYFGYASGSATGIASGARVAMYKALGEEGDLASDIIAAIDSAILDGVDVLSLSFGFDYVPLYEDPVAIATFAAMEKGIFVSTSAGNEGPYLGRLHNGIPWVITVAAGTLDREFHGTLTLGNGVQVTGMSLYHGNFSSSNVPIVFMGLCDNVKELAKVRRNIVVCEDKDGTFIEAQVSNVFNANVVAAVFISNSSDSIFFYDNSFASIFVTPINGEIVKAYIKITNSGANGTLSFKTTALGTRPAPSVDSYSSRGPSSSAPFVLKPDITAPGTSILAAWPPNVPVDVFIAPKNVFTDFNLLSGTSMACPHVAGVAALLRGAHPEWSVAAIRSAIMTTSDMFDNTMGLIKDIGDDYKPATPLAMGAGHVNPNRALDPGLVYDVGVQDYVNLLCALGYTQKNITVITGNSSNDCSKPSLDLNYPSFIAFFNSNSSSASQEFQRTVTNVGEGQTIYVASVTPVKGYYVSVIPNKLVFKEKNEKLSYKLRIEGPTNKKVENVAFGYFTWTDVKHVVRSPIVVTTLKVNF

SEQ ID NO: 181488 - protein, 90 aa, Glycine max
  Coding DNA Sequence Number=SeqID_64710
  Gene Ontology: Mol. function=DNA binding; Biological process=DNA integration
MDPSARYLILYTHLQPIAVLCGGREVSLHVLFNWRACNSASIALIQKSWREASAYEEGSMLEEILMTRYLPEKGTGEGAGLFESNCWVSE

SEQ ID NO: 181489 - protein, 106 aa, Glycine max
  Coding DNA Sequence Number=SeqID_64711
  Homolog annotation: Hit_ID=Q1T0T1; Match level="QueryCoverage=48%, HitCoverage=29%, E-value=2e-08, Identity=53%"; Hit description =Transcription factor, K-box
MHKITNILRTQAIDGRTAIWSECEKPTRSRESTGTESPRCPYEKGEPDLSGKCGTLQEDMATTSRNAFVPLSYGMHAAGGNPQELVQLQLCQPEQEVCETSDTATK

SEQ ID NO: 181490 - protein, 444 aa, Glycine max
  Coding DNA Sequence Number=SeqID_64712
  Gene Ontology: Mol. function=DNA binding; Cellular component=beta -galactosidase complex; Biological process=DNA integration
  Homolog annotation: Hit_ID=Q1SLU3; Match level="QueryCoverage=98%, HitCoverage=30%, E-value=1e-143, Identity=57%"; Hit description =Integrase, catalytic region
MEGLDYLDTFSPVAKLTTVLLLLALASLNQWHLRQLDVNNAFLHGELDEEVYMQIPPGLSVDNPQLVCRLQRSLYGLKQASRQWFTKLSSFLCSHGFQQSNADHSLFLRFNGDITTILLVYVDDIILTGNNMAEIQTITILLDREFKVKDLGDLKFFLGLEIARTSKGIHLCQRKYTLDLLNDSGMLGCKPNSTPMDYSTKLQANSGNLLSTDSSSTYRRLIGKLIYLTNTRPDITYAVQQLSQYMAAPTDTHLQAAFRVLRYLKGTPGSGLFFPATGTPQLRAFSDSDWAGCKDSRKSTTGYLVYLGSSLVSWQSKKQSTVSRSSSEAEYRALASTTCELQWLTFLLHDFQVIFTQPTALYCDNQSAIQIATNPVFHERTKHIEIDCHLVRQKLHSGLIKLLPVASSLQLADIFTKPLTPAVFHHLCTKLGMMNIHSQLEGGS

SEQ ID NO: 181491 - protein, 122 aa, Glycine max
  Coding DNA Sequence Number=SeqID_64713
  Gene Ontology: Mol. function=identical protein binding; Biological process=negative regulation of enzyme activity
  Homolog annotation: Hit_ID=Q1SHG8; Match level="QueryCoverage=95%, HitCoverage=15%, E-value=9e-36, Identity=64%"; Hit description =Protease-associated PA; Proteinase inhibitor I9, subtilisin propeptide
  Subcellular localization annotation: CTP_CleavageSite=31; ConfidenceScore=5.19e-01
MTRSSNNDCSKPSLDHNYPSFIAFFNSNGSRAAQEFQRTMTNVGDGQTIYVASITPAKGYHVSVNPKKLVFEAKNEKQSYKLRIEGPRKKKEKNMAHGYLAWTVMKHVVRSPIVVTTLTFDF

SEQ ID NO: 181492 - protein, 61 aa, Glycine max
  Coding DNA Sequence Number=SeqID_64714
MQELPHKWWSGAAQEDGVWSAEREHEIRVEGGTGVKTRATTAWARFERSTTVPQPKALSLN

SEQ ID NO: 181493 - protein, 352 aa, Glycine max
  Coding DNA Sequence Number=SeqID_64715
  Gene Ontology: Mol. function=DNA binding; Cellular component =membrane; Biological process=DNA integration
  Homolog annotation: Hit_ID=Q1SS72; Match level="QueryCoverage=96%, HitCoverage=23%, E-value=1e-74, Identity=40%"; Hit description =Integrase, catalytic region
  Pfam annotation: Domain name=zf-CCHC; Domain location=246-263; Score =13.7; E_value=0.0054; Accession=PF00098.13; Description=Zinc knuckle
  Pfam annotation: Domain name=zf-CCHC; Domain location=282-299; Score =15.3; E_value=0.0029; Accession=PF00098.13; Description=Zinc knuckle
  Pfam module annotation: Pfam domain module=Retrotrans_gag::zf -CCHC::zf-CCHC; Domain location=77-192::246-263::282-299
MSEVIINNMESYLYLHPGENPTTALVSPVLDSTNYHSWSRSMITALSAKNKVEFIDGSAPEPLKTDRMHGAWRRCNNMVVSWIVHSVATSIHQSILWMDKAEEIWRDLKSRYSQGDLLRISDLQQEASMMKQGSLTVTEYFTRLRVIWDEIENFRPDPVCSCNIRCSCNVFTIIAQRKLEDRAMQFLRGLNEQYTNIRSHVLLMDPIPAISKIFSYVAQQERQLLGNAGPGINFEPKDISINAAKTVCEFCGRTGHMENVCYKKHGVPSNYNSRNKNNGGRKTCTHCGKIGHTVDVCYQKHGYPPGYKPYGGRTTVNSAMTVENKGNDDQAQHHESHELVHSPPSSTRHSLP

SEQ ID NO: 181494 - protein, 55 aa, Glycine max
  Coding DNA Sequence Number=SeqID_64716
MEGLASHCHEMLYNCKRVMGKKEGEVCLKFMQHRAKRNRRAYGESMVTHLAHDLR

SEQ ID NO: 181495 - protein, 292 aa, Glycine max
  Coding DNA Sequence Number=SeqID_64717
  Gene Ontology: Mol. function=calcium ion binding; Cellular component =cellular_component; Biological process=protein amino acid phosphorylation
  Homolog annotation: Hit_ID=Q2PP78; Match level="QueryCoverage=91%, HitCoverage=96%, E-value=2e-95, Identity=66%"; Hit description =Lectin-like protein
  Pfam annotation: Domain name=Lectin_leg-like; Domain location=44-292; Score=-111.2; E_value=0.062; Accession=PF03388.4; Description=Legume -like lectin family
  Pfam annotation: Domain name=Lectin_legB; Domain location=46-289; Score=245.6; E_value=1e-70; Accession=PF00139.10; Description=Legume lectin domain
  Pfam module annotation: Pfam domain module=Lectin_leg-like::Lectin _legB; Domain location=44-292::46-289
  Subcellular localization annotation: CTP_CleavageSite=43; ConfidenceScore=5.37e-01
LHSSLVLSITIIHINNNNNNTMASHAAQNPKSVFLMTFLLLITSAKSDSFSFNLPRFEPDALNILLDGSAKTTGGVLQLTKKDKRGNPTQHSVGLSAFYAALHLSDAKTGRVANFATEFSFVVNTKGAPLHGDGFTFYLASLDFDFPDNSSGGFLGLFNKKTAFNTSLNQVVAVEFDSFANEWDPNFPESDSPHIGIDINSIRSVATAPWPLDIQPQGSIGKARISYQSSTKILSVSVAYPNSPVKLNATVLSYPVNLGAVLPERVLFGFSAATGDLVETHDILSWSFNSFL

SEQ ID NO: 181496 - protein, 185 aa, Glycine max
  Coding DNA Sequence Number=SeqID_64718
MHSSLSHKSIENVMKKCFSRGHLPPIHGVLNERNIDVEEIEQGHFGIVKVRVGVKGQYFLSQKVWNEAEVNEGQGENLVGRLRRAMNFAVLMEWQSWICAVRKLRGVYFSGYFRGKGLKGSVLKEGANNNLLILVILVYSPVASPAQRKPGLAFTRHSTPWHLLLACPYLLPALPNFFNISKLPF

SEQ ID NO: 181497 - protein, 551 aa, Glycine max
  Coding DNA Sequence Number=SeqID_64719
  Gene Ontology: Mol. function=identical protein binding; Cellular component=cytoplasm; Biological process=negative regulation of enzyme activity
  Homolog annotation: Hit_ID=Q1SHG8; Match level="QueryCoverage=98%, HitCoverage=71%, E-value=0.0, Identity=64%"; Hit description =Protease-associated PA; Proteinase inhibitor I9, subtilisin propeptide
  Pfam annotation: Domain name=PA; Domain location=133-247; Score=6.9; E_value=0.064; Accession=PF02225.12; Description=PA domain
  Pfam annotation: Domain name=Peptidase_S8; Domain location=6-382; Score=-1.5; E_value=1.1e-06; Accession=PF00082.12; Description =Subtilase family
  Pfam module annotation: Pfam domain module=PA::Peptidase_S8; Domain location=133-247::6-382
NSTRDTEGHGTHTSSIAVGSQVENASFFGFANGTAQGIASRARIAMYKAVWDGKAHSTDVLAAIDSAISDGVDVLSLSFGFGNISMYSDPIAIATFAAMEKGIFVSTSAGNSGPDRGTLNSAIPWVINVGASTLDREFRGTLALGNGVNIPGLSLYLGNFSAHQVPIVFMDSCDTLEKLANASGKIVVCSEDKNNVPLSFQVYNVHWSNAAAGVFISSTIDTSFFLRNGSAGIIINPGNGQIVKAYIKSNPNAKASMSFKTTTLATKPAPSVDVYSSRGPSSSCPFVLKPDITAPGTSILAAWPPNLPVAQFGSQNLSSNFNLLTGTSMACPHVAGVGALLRGAHPDWSPAAIRSAIMTTSDIFDNTKELIKDIADDYKPASPLALGSGHVNPNKALDPGLVYDVGVQDYVNLLCAMSSTQQNISIITRSSTNNCSNPSLDLNYPSFIGFFSSNGSSNESRVAWAFQRTVTNVGEKQTIYSANVTPIKGFNVSVVPSKLVFKEKNEKLSYKLRIEGPMVEGFGYLTWTDMKHAVRSPIVVTNQAPSNSISI

SEQ ID NO: 181498 - protein, 288 aa, Glycine max
  Coding DNA Sequence Number=SeqID_64720
  Gene Ontology: Mol. function=sugar binding; Cellular component =cellular_component; Biological process=protein amino acid phosphorylation
  Homolog annotation: Hit_ID=Q2PP74; Match level="QueryCoverage=89%, HitCoverage=93%, E-value=3e-84, Identity=60%"; Hit description =Lectin-like protein
  Pfam annotation: Domain name=Lectin_leg-like; Domain location=47-286; Score=-75.8; E_value=0.00022; Accession=PF03388.4; Description=Legume- like lectin family
  Pfam annotation: Domain name=Lectin_legB; Domain location=47-285; Score=250.2; E_value=4.3e-72; Accession=PF00139.10; Description =Legume lectin domain
  Pfam module annotation: Pfam domain module=Lectin_leg-like::Lectin _legB; Domain location=47-286::47-285
MAFPNSKPNLLQSLSPLIKFFIPFLLLLQHHSVKSQQQPPSPMSAYETVGIDFSFFDKDDPNVLLIGNASVSGGALRLTNTDQLGKPVPHSVGRVVHITPIHLWNKNNGHLADFTSDFSFVVNPKGSALRGDGFAFFLTSANLNFLIPKNSSGGYLGLFKPETALDPSKNQIVAIEFDSFTNDWDPNSPNQSPHVGIDVDSIKSVATVPWPSELEPDNAVAHASLNYNSEDKRLSVFVGYPDNRNATVSAIVDLRNVLPEWISVGFSASTGDLVETHDILNWSFEAAL

SEQ ID NO: 181499 - protein, 44 aa, Glycine max
  Coding DNA Sequence Number=SeqID_64721
MVGTFSQNGVTLTGHLTILLSESDLTYPLCDDFKEPRATRARGR

SEQ ID NO: 181500 - protein, 65 aa, Glycine max
  Coding DNA Sequence Number=SeqID_64722
MYKRMHYHNLKTQRAHFQTQSKGNAQIGLTWGGSREGIGHETKYGFFITRYREDETTLASQQNVG

SEQ ID NO: 181501 - protein, 54 aa, Glycine max
  Coding DNA Sequence Number=SeqID_64723
MDEHQQNWKKMANTMMKIHKKAEEMFNIVHAMDQPYGEVNRSFVVRWKDELEPT

SEQ ID NO: 181502 - protein, 112 aa, Glycine max
  Coding DNA Sequence Number=SeqID_64724
  Gene Ontology: Mol. function=nucleic acid binding; Biological process= DNA integration
MSAMDMIKSLSSKPEKFTGENFFCWQQQMKFWLTELDLYSVISKREIKTSTSSTDIVQTDATIKHDVSDKDILCHGRILSALADNIYKIFCHTKTSVELWEALELKYGSAEK

SEQ ID NO: 181503 - protein, 72 aa, Glycine max
  Coding DNA Sequence Number=SeqID_64725
  Gene Ontology: Mol. function=DNA binding; Cellular component=nucleus; Biological process=regulation of transcription, DNA-dependent
  Homolog annotation: Hit_ID=Q8L5P7; Match level="QueryCoverage=68%, HitCoverage=6%, E-value=1e-22, Identity=100%"; Hit description=LHY protein
  Pfam annotation: Domain name=Myb_DNA-binding; Domain location=24-58; Score=18.7; E_value=0.02; Accession=PF00249.21; Description=Myb-like DNA-binding domain
MDAYSSGEEVVVKTRKPYTITKQRERWTEEEHNRFLEALKLHGRAWQRIEGDSVLYLKIISCSSYIKIGVIF

SEQ ID NO: 181504 - protein, 143 aa, Glycine max
  Coding DNA Sequence Number=SeqID_64726
MTSKNNNDNLNNLSRERSSPDTCRRTHFPAIANRIEFRSETEKEENKRKSKNREVTWRGRPAVPGHPVAQRVGHLGLVVGYSPSVATHFPVTDTWQFFGGLLVGVPFVRAVDTCAFLVSENVSYTVIRPSGKAVTDPTEHRPS

SEQ ID NO: 181505 - protein, 349 aa, Glycine max
  Coding DNA Sequence Number=SeqID_64727
  Gene Ontology: Mol. function=nucleic acid binding; Cellular component= chromatin; Biological process=DNA integration
  Homolog annotation: Hit_ID=Q1S7C5; Match level="QueryCoverage=72%, HitCoverage=26%, E-value=3e-71, Identity=50%"; Hit description =Integrase, catalytic region
MASASPSFVSQSFPNSIAEKLDDLNYLHWRQHVEHCFVVNPVVPPRYLTEDDHIADRVNPEYEAWEVQDQTLLVFQTFKSMPKTVKQALENPDWFAAMQQEYDALLKNRTWDLVSLPSNRQAIGSRLVAKGFHQVYGSDFHENFSRVLKESMFMTQPPDFEVGDRFLVCKLNKALYGLKQAPRQWFDRLKSTLLQFGFVGSKCDSSLFIYKHQTHTVYLLVYVDDIIITGSSTSLIQQLTTKLHIAFSLKQLGHLDYFLGLEIKYLPNNNSIVMTQNKYVIYFTKLTWQKPILFPLPWFLIASYPSKASNVDDRHSTSGAAIFLGPNLISWWSRKQKVTARSNTEAEYH

SEQ ID NO: 181506 - protein, 221 aa, Glycine max
  Coding DNA Sequence Number=SeqID_64728
ESCRDIVRVTVHIKNPVETLCTSLCTSGILQRHYACHYARYCARQESCKDIVHIKNPTEMQRHCVCQESCRDIVHRHCARHESYSDIVQTLFMVLCVINLDADVPSDLNVQPTTQIHVAQSQSNEISHDYHAKNGLPDEVVGDFSDNEDEILAVNDDNNINDNNDNDIQFLFQPATTKNVYRPYPNCVDIGDNQVIDNPNYRHFLDLPQQSKSQDGELYVG

SEQ ID NO: 181507 - protein, 33 aa, Glycine max
  Coding DNA Sequence Number=SeqID_64729
MWKVKRYIPRAGKCILTLGEFHLHNKRNPYFGE

SEQ ID NO: 181508 - protein, 220 aa, Glycine max
  Coding DNA Sequence Number=SeqID_64730
  Gene Ontology: Mol. function=protein serine/threonine kinase activity; Cellular component=integral to membrane; Biological process=protein amino acid phosphorylation
  Homolog annotation: Hit_ID=UPI00001630F6; Match level="QueryCoverage =85%, HitCoverage=21%, E-value=2e-59, Identity=60%"; Hit description =kinase
  Pfam annotation: Domain name=Pkinase; Domain location=1-188; Score= -19.4; E_value=2.1e-07; Accession=PF00069.15; Description=Protein kinase domain
  Pfam annotation: Domain name=Pkinase_Tyr; Domain location=1-188; Score=-86.3; E_value=3.6e-07; Accession=PF07714.7; Description =Protein tyrosine kinase
  Pfam module annotation: Pfam domain module=Pkinase::Pkinase_Tyr; Domain location=1-188::1-188
MAIHADKNQILLSWKQRLQIALDSATGLEYLHKYCKPPIVHRDVKTSNILLDEDFHAKVSDFGLSKIFSNECDTHVLTKIAGTPGYMDPEYQITNKLTEKSDVYSFGIVLLEIITGHPAILKTHENTHIVQWVNSMLADEGEIDSIMDPRLQGIYDSETASQVVHVAMACLAPSSIKRPTMDQVVKELKQCFPMENIDDSICIFTEFSVASISGESSLAR

SEQ ID NO: 181509 - protein, 257 aa, Glycine max
  Coding DNA Sequence Number=SeqID_64731
  Gene Ontology: Mol. function=inositol oxygenase activity; Cellular component=inclusion body; Biological process=L-ascorbic acid biosynthetic process
  Homolog annotation: Hit_ID=Q8L799; Match level="QueryCoverage=94%, HitCoverage=67%, E-value=1e-92, Identity=69%"; Hit description =Inositol oxygenase 1
  Pfam annotation: Domain name=DUF706; Domain location=14-257; Score =428.2; E_value=1.1e-125; Accession=PF05153.6; Description=Family of unknown function (DUF706)
MLGNISNSYWAYNDAESERHEGVENFYRKNHTYQSIDFVKKMREEYAKLNRVEMSIWECCELLNEVVDESDPDLDEPQIEHLLQTAEAIRRDYPDEDWLHLTGLIHDRKLQENFHLYHKHLPICFNADLGKVLNLPSFGGLPQWAVVGDIFPVGCRFDESIVHHKYFKENPDYNNPAYNTKYGIYSERCGLNNVMMSWGHDDYMYLEILKTLGACLRWQRRMILHCPLRLCFIIRYHSFYALHKEGAYKHLMNDEDF

SEQ ID NO: 181510 - protein, 131 aa, Glycine max
  Coding DNA Sequence Number=SeqID_64732
  Gene Ontology: Mol. function=peptidase activity; Cellular component =anchored to membrane; Biological process=lipid transport
  Homolog annotation: Hit_ID=Q1S9L0; Match level="QueryCoverage=94%, HitCoverage=65%, E-value=6e-39, Identity=60%"; Hit description=Plant lipid transfer protein/Par allergen
  Pfam annotation: Domain name=Tryp_alpha_amyl; Domain location=43-121; Score=41.7; E_value=2.5e-09; Accession=PF00234.12; Description =Protease inhibitorseed storageLTP f
  Subcellular localization annotation: CTP_CleavageSite=32; ConfidenceScore=5.17e-01
MASIVTMATIVTLVLALACCGMSAPTSVPKTTAAAPAPESNGCLMALANMSDCLTYVEDGSKLSKPDKGCCPELAGLVDSNPICLCEMLGKPDSIGIKIDLNKALKLPSVCGVTTPPVSTCSDHGKYKMNF

SEQ ID NO: 181511 - protein, 38 aa, Glycine max
  Coding DNA Sequence Number=SeqID_64733
MSEGPSIAPGAFSPSNADAANPASSPNSASSPAELVFK

SEQ ID NO: 181512 - protein, 211 aa, Glycine max
  Coding DNA Sequence Number=SeqID_64734
  Homolog annotation: Hit_ID=Q9AVH2; Match level="QueryCoverage=12%, HitCoverage=9%, E-value=2e-07, Identity=100%"; Hit description =Putative senescence-associated protein
LGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHEGHQRARAFWGAEAPYCWSANGRRAHASASSPDSDLEAFSHNPTHGSFAPLAFQRADDQ

SEQ ID NO: 181513 - protein, 588 aa, Glycine max
  Coding DNA Sequence Number=SeqID_64735
  Gene Ontology: Mol. function=glucose-6-phosphate 1-dehydrogenase activity; Cellular component=chloroplast; Biological process =carbohydrate metabolic process
  Homolog annotation: Hit_ID=Q43839; Match level="QueryCoverage=98%, HitCoverage=98%, E-value=0.0, Identity=76%"; Hit description=Glucose- 6-phosphate 1-dehydrogenase, chloroplast precursor
  Pfam annotation: Domain name=G6PD_C; Domain location=288-585; Score =529.1; E_value=4.7e-156; Accession=PF02781.6; Description=Glucose-6 -phosphate dehydrogenase, C-terminal domain
  Pfam annotation: Domain name=G6PD_N; Domain location=106-285; Score =314.8; E_value=1.6e-91; Accession=PF00479.12; Description=Glucose-6 -phosphate dehydrogenase, NAD bin
  Pfam module annotation: Pfam domain module=G6PD_C::G6PD_N; Domain location=288-585::106-285
  Subcellular localization annotation: CTP_CleavageSite=62; ConfidenceScore=5.41e-01
MASILCPSLTIVTSYASRNEPKLVCKLTAVTGNSHSPLWFSCTRPGNSARNHFLLKSSNGLPLNAVSSNDGLAGSSTAKEDGKPQPLEGPFPFPDSECTGSNLSITVVGASGDLAKKKIFPALFALFYEDWLPKNFLVFGFARTKMTDEELRNMISKTLTCRIDTRENCQDKMDQFLKRCFYHSGQYNSEDHFSELGSKLREKEGGKLSNRLFYLSIPPNIFVDVVRCASLKASSKDGWTRVIVEKPFGRDSESSSELTKSLKQHLTEDQIFRIDHYLGKELVENLSVLRFSNLVFEPLWSRNYIRNVQIIFSEDFGTEGRGGYFDHYGIIRHIMQNHLLQILALFAMETPVSLAAEDIRNEKVKVLRSMRPLELENVVVGQYKGHSKGGKSHPAYTDDPTVPKGSLTPTFAAAALFIDNARWDGVPFLMKAGKALHTKRAEIRVQFRHVPGNLYKRNFGTDLDKATNELVLRVQPDEAIYLKINNKVPGLGMRLDRSDLNLLFRARYPREIPDAYERLLLDAIEGERRLFIRSDELDAAWALFTPLLKEIENKKIAPELYPYGSRGPVGAHYLAARHNVRWGDLGED

SEQ ID NO: 181514 - protein, 573 aa, Glycine max
  Coding DNA Sequence Number=SeqID_64736
  Gene Ontology: Mol. function=transferase activity; Cellular component= intracellular; Biological process=metabolic process
  Homolog annotation: Hit_ID=Q1T1H0; Match level="QueryCoverage=90%, HitCoverage=98%, E-value=0.0, Identity=64%"; Hit description=Protein prenyltransferase
  Pfam annotation: Domain name=PPR; Domain location=155-189; Score =14.7; E_value=0.14; Accession=PF01535.11; Description=PPR repeat
  Pfam annotation: Domain name=PPR; Domain location=190-224; Score =11.5; E_value=0.33; Accession=PF01535.11; Description=PPR repeat
  Pfam annotation: Domain name=PPR; Domain location=226-260; Score =39.4; E_value=1.2e-08; Accession=PF01535.11; Description=PPR repeat
  Pfam annotation: Domain name=PPR; Domain location=261-295; Score =44.3; E_value=4.1e-10; Accession=PF01535.11; Description=PPR repeat
  Pfam annotation: Domain name=PPR; Domain location=296-330; Score =47.6; E_value=4.3e-11; Accession=PF01535.11; Description=PPR repeat
  Pfam annotation: Domain name=PPR; Domain location=331-365; Score =46.9; E_value=7e-11; Accession=PF01535.11; Description=PPR repeat
  Pfam annotation: Domain name=PPR; Domain location=366-400; Score =33.7; E_value=6.5e-07; Accession=PF01535.11; Description=PPR repeat
  Pfam annotation: Domain name=PPR; Domain location=401-435; Score =29.4; E_value=1.3e-05; Accession=PF01535.11; Description=PPR repeat
  Pfam annotation: Domain name=PPR; Domain location=436-470; Score =28.4; E_value=2.5e-05; Accession=PF01535.11; Description=PPR repeat
  Pfam annotation: Domain name=PPR; Domain location=471-505; Score =14.6; E_value=0.14; Accession=PF01535.11; Description=PPR repeat
  Pfam module annotation: Pfam domain module=PPR::PPR::PPR::PPR::PPR::PP R::PPR::PPR::PPR::PPR; Domain location=155-189::190-224::226-260::261- 295::296-330::331-365::366-400::401-435::436-470::471-505
MRNIQPHRFSTLIEPPNKTPTSKPFFLPIPHRTIPEPRGQDLDFICVAHRHVINSHWEKLLPLSTSLTPFRLKHLLLALQNDHVSSLKLSTWVLKHNPSSHTLDTHSILLHTLSKHRQFKTTQKFLTQTLSSHPPHTLFDALLFSYRLCNSSSPLVFDSLFKTLAHTNKFRHATHIYTLMKEHGFSPTVQSCNAFLSSLLRLRRADIALAFYREIRRRSCVSPNVYTLNMIIRAYCMLGEVQKGFDMLEKMMDMGLSPNVVSFNTLISGYCNKGLFGLALKVKSLMVENGVQPNVVTFNTLINGFCKERKLHEANRVFNEMKVANVDPSVVTYNTLLNGYGQVGDSEMGVRVYEEMMRNGLKADILTYNALILGLCKDGKTKKAAGFVRELDKENLVPNASTFSALITGQCVRNNSERAFLIYRSMVRSGCSPNGQTFQMLISAFCKNEDFDGAVQVLRDMLGRLMSPDLSTMSELCDGLCRCGKNQLALALCSEMEVRRLLPDGFDKEKIAITHPENETNFEVELHLLQLTMLQMWTMDTSLNGDFNSSLLRYGDKFLPLNLTPIGGTHQVA

SEQ ID NO: 181515 - protein, 49 aa, Glycine max
  Coding DNA Sequence Number=SeqID_64737
MAGWEGKPPPCWNQCSTAVNAAATIRPKTITVVANVYVSIIRRSGQGLE

SEQ ID NO: 181516 - protein, 146 aa, Glycine max
  Coding DNA Sequence Number=SeqID_64738
  Homolog annotation: Hit_ID=Q1SQV4; Match level="QueryCoverage=29%, HitCoverage=13%, E-value=4e-11, Identity=81%"; Hit description =PspA/IM30; Prefoldin
MEHSHQPPSLPPGNGDDGRYQLAEPFSLRTETPRWRRMVKMEGEKQQKFDVDLDNLMAFDSYHTFPSQPSLSRCPLYLTINRRFGWTLVTLPPPLTQLLREKHDNATALKMQLDQQKNVTDDLVSKTQLLESKIQEAKSKKDTLKA

SEQ ID NO: 181517 - protein, 1128 aa, Glycine max
  Coding DNA Sequence Number=SeqID_64739
  Gene Ontology: Mol. function=oxidoreductase activity, acting on the CH-NH2 group of donors, NAD or NADP as acceptor; Cellular component =membrane; Biological process=nitrogen compound metabolic process
  Homolog annotation: Hit_ID=Q93WZ7; Match level="QueryCoverage=99%, HitCoverage=48%, E-value=0.0, Identity=81%"; Hit description=NADH glutamate synthase precursor
  Pfam annotation: Domain name=GATase_2; Domain location=98-542; Score =620.5; E_value=1.4e-183; Accession=PF00310.11; Description=Glutamine amidotransferases class-II
  Pfam annotation: Domain name=Glu_syn_central; Domain location=638 -931; Score=635.6; E_value=4.2e-188; Accession=PF04898.4; Description= Glutamate synthase central domain
  Pfam annotation: Domain name=Glu_synthase; Domain location=995-1128; Score=-102.5; E_value=2.5e-09; Accession=PF01645.7; Description =Conserved region in glutamate synthase
  Pfam module annotation: Pfam domain module=GATase_2::Glu_syn _central::Glu_synthase; Domain location=98-542::638-931::995-1128
  Subcellular localization annotation: CTP_CleavageSite=37; ConfidenceScore=5.58e-01
MSNALSFTLPALNNPQLNALNSPNKARLRHGLRIRVVASCIERKRFLGTRVRPSGSDRIWLLQSGRVPKLRVAVRSAFSAVPEKPLGLYDPAMDKDSCGVGFVAELSGESSRKTVTDALEMLVRMTHRGACGCEANTGDGAGILVALPHVVDFELPPQGKYAVGMLFLPKSEKRREESKKMFSKVAESLGHTILGWRSVPTDNAGLGKSALQTEPVIEQVFLTPSAKSKVDLERQMYILRKLSMAAITSALNLQNDGITDFYICSLSSRCVLKRQPHFLEKTVVYKGQLTPAQLRDYYFADIGNERFTSYMALHGKQPVTEEKQGWGMTSEALSLDAGLDAMVELIHSRFSTNTFPSWDRAQPMRVLGHNGEINTLRGNVNWMKAREGLLKCKELGLSENELKKLLPIVDANSSDSGAFDGVLEFLLHSGKSLPEAVMMMIPEAWQNDKNMDSQRKAFYEYFSALMEPWDGPALISCNILGLWFYHMSMFSSFWFYDLALIQSNITTVTDGHYLGATLDRNGLRPGRFYVTHSGRVIMASEVGVVDIPPEDVRRKGRLNPGMMLLVDFEKHIVVNDDALKEQYSLARPYEDWLKRQKIELKDIVNSVDESERVPPPIAGVAPLSNDDADMENMGIHGLLAPLKAFGYTVESLEMLLLPMAKDGVEALGSMGNDTPLAVMSKREKLTFEYFKQMFAQVTNPPIDPIREKIVTSMQCMVGPEGDLTEITEEQCNRLSLKGPLLSTEEMEAIKKLNYKGWRSKVIDITYSKECGKRGLEEALDRICAEAHHGISEGYTTLVLSDRAFSKKRVAVSSLLAVGAVHQHLVKNLERTRVALIVESAEPREVHHFCTLVGFGADAICPYLAVDAIWRLQVDGKIPPKASGEFHSKDELVKKYFKASNYGMMKVLAKMGISTLASYKGAQIFEALGLSSEVIAKCFAGTPSRVEGATFEMLARDAFQLHELAFPSWVFSPGSAEAVALPNPGDYHWRKGGEVHLNDPLAMAKLQEAARTNSVDAYKQYSKLIHELNKACNLRGLLKFKETAVKIPIDEVEPASEIVKRFCTGAMSYGSISLEAHTALAMAMNKMGGKSNTGEGGEQPSRMEPLPNGSMNPKRSAIKQVASGRFGVS

SEQ ID NO: 181518 - protein, 113 aa, Glycine max
  Coding DNA Sequence Number=SeqID_64740
  Subcellular localization annotation: CTP_CleavageSite=27; ConfidenceScore=5.14e-01
MVVGYNLYCFQVFLSPPLNRNLYTTVRFAVKKRDGSIGKRCRLEFRSILQSQSLVRTCSNRKERRVFKKEFPGSEKYLRSTKPRQERGLRAIGQFELVYGRVEVEAARVLDLA

SEQ ID NO: 181519 - protein, 60 aa, Glycine max
  Coding DNA Sequence Number=SeqID_64741
MELHNIDVKIEYEDRAMILLAFLLTSYGNFMTEEEERQRHSKKIKVEPRDICNYYEQVGH

SEQ ID NO: 181520 - protein, 125 aa, Glycine max
  Coding DNA Sequence Number=SeqID_64742
MDIKQRRRRVSGARKKKGFLKQEAEGVFWGSLYYLWDFTFKKGKKQYNKNQGCRLEFRSILQSQSLVRTCSNRKERRVFKKEFPGSEKYLRSIKPRQERGLRAIGQFELVYGRVEVEAARVLDLA

SEQ ID NO: 181521 - protein, 289 aa, Glycine max
  Coding DNA Sequence Number=SeqID_64743
  Gene Ontology: Mol. function=nucleic acid binding; Cellular component= nucleus; Biological process=type I hypersensitivity
  Homolog annotation: Hit_ID=Q5N8W4; Match level="QueryCoverage=72%, HitCoverage=74%, E-value=2e-57, Identity=53%"; Hit description =Putative RRM-containing protein SEB-4
  Pfam annotation: Domain name=RRM_1; Domain location=18-88; Score =78.5; E_value=2.1e-20; Accession=PF00076.12; Description=RNA recognition motif. (a.k.a. RRM, R
MVGGNNPDQYNDTTFTKIFVGGLAWETQRDTMRRYFEQFGEILEAVVITDKNTGRSKGYGFVTFKDPESAMRACQNPSPVIDGRRANCNLASLGASKNRPPTFQHGRFRPPPGLVTSSPAYHGSSSSTFFHQPPREYAFPYSAYGYSGYSQDTLYPTVAVNSYYNVYGVQQFSSPYYPSAGASGALGLIHNIYPFYGQYAQSIQAPGFGVQYPQMAQFPFLPQHYGSTGILSYPSSVAVATTSAGIAATTTTTTTSTSVAATVAGTASQASQAASEQNSTSTRTKNLQG

SEQ ID NO: 181522 - protein, 99 aa, Glycine max
  Coding DNA Sequence Number=SeqID_64744
  Gene Ontology: Mol. function=DNA binding; Biological process=DNA integration
  Homolog annotation: Hit_ID=Q1S3Z1; Match level="QueryCoverage=82%, HitCoverage=6%, E-value=2e-21, Identity=56%"; Hit description =Integrase, catalytic region; Zinc finger, CCHC-type
MKALQDDIFHAILHNIIESFWVEEVSTTCYLVNRSPSTTIDFRTPIEVWSNGPAEYSKLKVFGGQPYCDVSEGKLEPRTKKGVFMGFGDGVKGFRILSL

SEQ ID NO: 181523 - protein, 97 aa, Glycine max
  Coding DNA Sequence Number=SeqID_64745
DFEPCLGYATEGQAVGGIPLQNTLEGPQFRPQPQPFYGKMVGYTPSSFADLVFTGERIKVGMEKGKFDHPALVNAKTVANEEDENEGQTLAMTVIPT

SEQ ID NO: 181524 - protein, 550 aa, Glycine max
  Coding DNA Sequence Number=SeqID_64746
  Homolog annotation: Hit_ID=Q6YXT2; Match level="QueryCoverage=99%, HitCoverage=100%, E-value=1e-110, Identity=46%"; Hit description =Calmodulin-binding protein family-like
  Pfam annotation: Domain name=IQ; Domain location=129-149; Score=30.0; E_value=8.2e-06; Accession=PF00612.17; Description=IQ calmodulin -binding motif
  Pfam annotation: Domain name=IQ; Domain location=151-171; Score=17.9; E_value=0.036; Accession=PF00612.17; Description=IQ calmodulin -binding motif
  Pfam module annotation: Pfam domain module=IQ::IQ; Domain location =129-149::151-171
MGKKGSGSSWLTAVKRAFRSPTKDSDKRSGRRREDCDQEEDEEKKREKRRWIFRKTHMSHEGVNNNSNHTTQQKVQHDVAASGGGSRTDQDQKHALAVAMATAEAAMATAQAAAEVARLSKPASHAREHFAAVVIQTAFRGYLARRALRALKGLVKLQALVRGHNVRKQAKMTLRCMQALVRVQARVLDQRIRSSLEGSRKSTFSDTASVWDSRYLQDISDRKSISREGSSIADDWDERHHSVEEVKAMLMQRKEAAAMKRDKTLSQAFSEQIWRNGRTSSIGNEDELEERPKWLDRWMATKPWENRGRASTDQRDPIKTVEIDTSQPYSYLGTNYRRSHPNYQYNPNHHQPQRHSIASPLHRSHQNGSSLHQSPATPSPAKSRPIQVRSASPRCVRDDRSYHTSQTPSLRSNYHYTGNLYQNGRIVSTGTSSGGATATLPNYMAATESAKARIRSQSAPRQRPSTPERDRVGSAKKRLSFPAPDPYGVGVSYGNYGHSLRSPSFKSVSGSHFGGLEQQSNYSSCYTESIGGGGGEVSPSSTGDLRRWLR

SEQ ID NO: 181525 - protein, 146 aa, Glycine max
  Coding DNA Sequence Number=SeqID_64747
  Gene Ontology: Mol. function=RNA-directed DNA polymerase activity; Biological process=RNA-dependent DNA replication
  Homolog annotation: Hit_ID=Q1SAS4; Match level="QueryCoverage=98%, HitCoverage=7%, E-value=2e-44, Identity=54%"; Hit description=RNase H, putative
MTVSYKDWHEMLPFSLHGYRTLVRSSIGAIPYSLVYEMEAVLPFEVEVPSQKILAESGQEESEWAQSCYDQLNLIEGAPAPVPSGGPSPEKISHAVKDNRGKWAPNYEGPIVVKRAFSGGALVLTNMDGEELPSPVNSDVVRRYYA

SEQ ID NO: 181526 - protein, 247 aa, Glycine max
  Coding DNA Sequence Number=SeqID_64748
  Gene Ontology: Mol. function=oxidoreductase activity, acting on the CH-OH group of donors, oxygen as acceptor; Cellular component =mitochondrion; Biological process=electron transport
  Homolog annotation: Hit_ID=Q1T3J7; Match level="QueryCoverage=89%, HitCoverage=62%, E-value=3e-82, Identity=68%"; Hit description=FAD linked oxidase, N-terminal
  Pfam annotation: Domain name=FAD_binding_4; Domain location=55-195; Score=88.0; E_value=2.8e-23; Accession=PF01565.13; Description=FAD binding domain
MMSNIAFRLTLVFLLFSAVLSTPPEDPIKCATSENTTCTITNSYGAFPDRSICKAAQVLYPTTEQELVSVVASATRNKTKMKVATRFSHSIPKLVCPEGENGLLISTKYLNKILKVDVETRTMTVESGVTLQQLINEAAKVGLALPYAPYWWGLTIGGLMGTGAHGSTLRGKGSAVHDYVVGIRIVRPAGSEDGYAKVEILNEQHQDLSAAKVSLGVLGVISQVPSIQIIAYDEVYRIEKLSHHQCE

SEQ ID NO: 181527 - protein, 153 aa, Glycine max
  Coding DNA Sequence Number=SeqID_64749
MKMKANKTRNELKVSDSKTYRLKNEERMKNGEERRKTFTDSLTKTSQKRYRSTLAWIFFTEIIFSPKTVEMHSPPPLFIGKKENVAKLNGLRNNALFDFQNVAKLYGLRINALFPSGMSRNFTNYLTMGVKYLEVVKRRLHATKQWSPDEIRV

SEQ ID NO: 181528 - protein, 246 aa, Glycine max
  Coding DNA Sequence Number=SeqID_64750
  Gene Ontology: Mol. function=RNA-directed DNA polymerase activity; Biological process=RNA-dependent DNA replication
  Homolog annotation: Hit_ID=Q8H6Q8; Match level="QueryCoverage=81%, HitCoverage=45%, E-value=9e-37, Identity=45%"; Hit description=CTV.20
MKYNIMNTLQHMTMVATAYQTSHECSENTIIDILVAGFSGQLKGCAVKTDLNGKVITNDDDKEIPDAVNTLIFTIAQHFIGDPSLWKDRFAELLSNLKCRTLADFRWYRDTFLTRVYTREDSQQPLWKEKFLASLPRSLGDKVRDKIRSQSSNGDIPFENLSYSQLISYVQKVALKIFQDDKIQRQLAKEKAQTRKDLGSFCEQFGLPTCPKQKKKQRKKSRIINQPIEGDFQKEDTLKNPQLVRK

SEQ ID NO: 181529 - protein, 111 aa, Glycine max
  Coding DNA Sequence Number=SeqID_64751
  Gene Ontology: Mol. function=O-methyltransferase activity; Biological process=lignin biosynthetic process
  Homolog annotation: Hit_ID=Q1SIU5; Match level="QueryCoverage=91%, HitCoverage=40%, E-value=8e-13, Identity=29%"; Hit description=O -methyltransferase, family 2
  Pfam annotation: Domain name=Methyltransf_2; Domain location=1-111; Score=-89.9; E_value=0.0015; Accession=PF00891.8; Description=O -methyltransferase
MQFLEADIPFNMVHGKHVFEYSDMTSSFNQLFKAAMTKRATLIMKKIVECYKGFKHINRLVDVGGGLGVTLNIITSKLEVLKNCYASIPSDGKVIVVDGVLPYEPKTTDAI

SEQ ID NO: 181530 - protein, 149 aa, Glycine max
  Coding DNA Sequence Number=SeqID_64752
  Gene Ontology: Mol. function=O-methyltransferase activity; Biological process=lignin biosynthetic process
  Homolog annotation: Hit_ID=Q2HTB3; Match level="QueryCoverage=68%, HitCoverage=28%, E-value=3e-26, Identity=52%"; Hit description=O -methyltransferase, family 2
  Pfam annotation: Domain name=Methyltransf_2; Domain location=21-149; Score=-22.4; E_value=1.4e-07; Accession=PF00891.8; Description=O -methyltransferase
MAFRWAIKTSSQMCFLNIINFEGIFTNFGFGHETNSQFDMYQLKDAILEGGSPFNRIHGKHVFEDFNMNSSFNQLFMATMTNHATLIMNKIVESYKGFENINKLVDVGGGLGVTLNIITSKYPHIKGINFDLPHAIEHASPSPRTISNS

SEQ ID NO: 181531 - protein, 885 aa, Glycine max
  Coding DNA Sequence Number=SeqID_64753
  Gene Ontology: Mol. function=protein serine/threonine kinase activity; Cellular component=integral to membrane; Biological process=protein amino acid phosphorylation
  Homolog annotation: Hit_ID=Q1SB06; Match level="QueryCoverage=99%, HitCoverage=99%, E-value=0.0, Identity=55%"; Hit description=Protein kinase
  Pfam annotation: Domain name=LRR_1; Domain location=408-430; Score =6.6; E_value=17; Accession=PF00560.23; Description=Leucine Rich Repeat
  Pfam annotation: Domain name=LRR_1; Domain location=432-454; Score =16.9; E_value=0.075; Accession=PF00560.23; Description=Leucine Rich Repeat
  Pfam annotation: Domain name=LRR_1; Domain location=456-475; Score =11.9; E_value=1.7; Accession=PF00560.23; Description=Leucine Rich Repeat
  Pfam annotation: Domain name=Pkinase; Domain location=587-869; Score =118.9; E_value=1.4e-32; Accession=PF00069.15; Description=Protein kinase domain
  Pfam annotation: Domain name=Pkinase_Tyr; Domain location=588-846; Score=106.7; E_value=6.7e-29; Accession=PF07714.7; Description =Protein tyrosine kinase
  Pfam module annotation: Pfam domain module=LRR_1::LRR_1::LRR _1::Pkinase::Pkinase_Tyr; Domain location=408-430::432-454::456 -475::587-869::588-846
MMGMLLQFLYVLFGVLISVVLVQAQDQSGFISIDCGLPESSSYTEKTTSIFYISDAKFIDAGVSKSISPAEKSTHLQQLAYVRSFPSGERNCYRINVTSGTKYLIRATFFYGNYDGLNQPPQFDLHLGPNLWDTVSFPNASLSEISEIIYTPSLDYIHPCLVNKGQGAPFISTIELRTLKNASYVTASAESLAYYRRYDLGSITNLVYRYNYDVYDRIWVPHGFNQWTQLSSTLNHDIFQNDYKLPEVVMSTAATPINASAPFQFYWDPDNVNEKFYIYMHFNEVKILAENETRTFNIFMNGKLFYGPLTPGYLTKNIIYSTSALTGATRYLFSLAKTGTSTLPPIMNAMEIYKVIDFAQSETEQDDVDAITNIKNAYGVDRNWQGDPCGPVAYIWEGLNCSYDNTPRITSLNLSSSGLTGQILSFISELTMLQYLDLSNNSLSGSVPDFLTQLQSLKVLNLAKNNLTGPVPGGLVERSKQGSLSLSLDQNPNLCESDPCIQQTNNKQPDGDQQKNKNNIVIPVVASVAGVLVLLIIVAAAIICGLKRKKPQASDVNIYVETNTPNGSQFASKQRQYTFNELVKITNNFTRILGRGGFGKVYHGFIDDTQVAVKMLSPSAVKLLMRVHHRNLTSLVGYCNEENNIGLIYEYMANGNLDEIVSGKSSRAKFLTWEDRLQIALDAAQGLEYLHNGCKPPIIHRDVKCANILLNENFQAKLADFGLSKSFPTDGGSYMSTVVAGTPGYLDPEYSISSRLTEKSDVYSFGVVLLEMVTGQPAIAKTPDKTHISQWVKSMLSNGDIKNIADSRFKEDFDTSSVWRIVEIGMASVSISPFKRPSMSYIVNELKECLTTELARKYSGRDTENSDSIELVTLNFTTELGPPAR

SEQ ID NO: 181532 - protein, 230 aa, Glycine max
  Coding DNA Sequence Number=SeqID_64754
  Gene Ontology: Mol. function=nucleic acid binding; Biological process= DNA integration
MRFSVVHKKKTADKKGTDGKKNEVRGESNQEKEEQIMVKNKELKAQEKEKEIENEKNEKEEKNNKNAKKSRSEKAVDEGVEVPYPVVPSKKEKARHLVSFLDIFRKLEITMPFGEVLQQMPLYSKFFKDMLTRKHKYIHQENIIVEGNYSVVIQKILPPKHKDPGSVTITCSIGEVNMGKALIDLGASINLIPLSMCRRLGELEIMPTRMTLQLADGSITRPYGVIKDVL

SEQ ID NO: 181533 - protein, 384 aa, Glycine max
  Coding DNA Sequence Number=SeqID_64755
  Gene Ontology: Mol. function=glutamate-ammonia ligase activity; Cellular component=cytoplasm; Biological process=nitrogen compound metabolic process
  Homolog annotation: Hit_ID=P78061; Match level="QueryCoverage=58%, HitCoverage=47%, E-value=1e-92, Identity=79%"; Hit description=Gamma- glutamylputrescine synthetase
MTTPPENRRAAGGRKLAHQFAVADGGEQHAGQRQQIGGRHMAVGKAGDDAEGIEHRHRRQIGQAHHHHLPQLEGFAQLRFARRAAVGGFNRHGISPLGPLLSTVQRHSERPRGNCCSGGGKNGLRSLSGGRRPARRHCGTGKRLRMGMTESWLFPRRRPALELHQLIGFAGQIDVAETFAQQCIEHRLMFELVQRVTLADRERQPVLLQPVAGHRLRQRQRGFQPVDDAGQNGRHHQIRVGVGARHAILHAVVVAIAAGNAQRHGAIVMPPGGLGRHIHAGLEAAVGVDVRRQQRHRRRHQGDHARQRLFQQRRIFAVVVGEHVVALRVQHADVHVHAAAGVFLIRLGHKGRLHIVVLGHHAHQPLQRPARDRRPAARRRYGAG

SEQ ID NO: 181534 - protein, 297 aa, Glycine max
  Coding DNA Sequence Number=SeqID_64756
  Gene Ontology: Cellular component=membrane
  Homolog annotation: Hit_ID=Q0K4H1; Match level="QueryCoverage=98%, HitCoverage=93%, E-value=6e-98, Identity=59%"; Hit description =Permease of drug/metabolite transporter
  Pfam annotation: Domain name=DUF6; Domain location=171-292; Score =27.8; E_value=3.8e-05; Accession=PF00892.11; Description=Integral membrane protein DUF6
  Pfam annotation: Domain name=DUF6; Domain location=19-142; Score =15.0; E_value=0.0092; Accession=PF00892.11; Description=Integral membrane protein DUF6
  Pfam module annotation: Pfam domain module=DUF6::DUF6; Domain location=171-292::19-142
MPALPSRTRATLFGLLAIVLWSSVVGLIRSVSEGLGPIGGAAMIYSVSAAFLLVALGVPKWRSFPRPYLIVGSLLFVSYEICLSLSLGYANTRLQAIEVGMINYLWPCFTVLMALALNGQKAKWWLLPGLLPSLFGIGWIMSGEGGWSPAQMLANVRSNPLSYGLAFSGAVIWALYCNLTKKIAQGSNGVVLFIVLTAQALWLKYAFSAESGMQFSAGVIVTLLCAGVAMGAGYAAWNVGILHGNMTLLATVSYFTPVLSAVFAALVLHTSLTVNFWQGVAMVTLGSLICWRATRGN

SEQ ID NO: 181535 - protein, 118 aa, Glycine max
  Coding DNA Sequence Number=SeqID_64757
  Gene Ontology: Mol. function=nucleic acid binding; Biological process= DNA integration
  Homolog annotation: Hit_ID=Q1T2A4; Match level="QueryCoverage=89%, HitCoverage=28%, E-value=1e-26, Identity=46%"; Hit description=Zinc finger, CCHC-type
MNETFNQTLDVHNPYYLHPSENPTTALVSPVLDPTNYNSWNRSMLIALSAKNKLEFVDGTIFEPQQNNSLHSAWHRCNNMVVSWIVHSVSTSIRQSILWMDRAVDGWKDLKSQYSKEI

SEQ ID NO: 181536 - protein, 207 aa, Glycine max
  Coding DNA Sequence Number=SeqID_64758
  Gene Ontology: Mol. function=RNA-directed DNA polymerase activity; Cellular component=nucleus; Biological process=RNA-dependent DNA replication
MDEQDNAMLISRFSKEEEDILKVMEEFCSHGVLPKGTNATFLSLTLKNDNPQSLREYRPISLVSSLYKIIAKVYLSVMPKPEKKPYIVFKADFEKAYDSVRCPTEEFKNQKAFRQGDPLAPFLFLLVVEELGGLMREATSKGLFQGYHVGNSDLHVSSLHFIDDALFFGVPNRQHLLTLKAILRFFEMVSGLKVNFHGSKVARVATT

SEQ ID NO: 181537 - protein, 578 aa, Glycine max
  Coding DNA Sequence Number=SeqID_64759
  Gene Ontology: Mol. function=oxidoreductase activity, acting on the CH-OH group of donors, oxygen as acceptor; Cellular component =mitochondrion; Biological process=electron transport
  Homolog annotation: Hit_ID=Q9FM82; Match level="QueryCoverage=98%, HitCoverage=99%, E-value=0.0, Identity=64%"; Hit description =Arabidopsis thaliana genomic DNA, chromosome 5, P1 clone:MCD7
  Pfam annotation: Domain name=FAD_binding_4; Domain location=55-195; Score=88.1; E_value=2.7e-23; Accession=PF01565.13; Description=FAD binding domain
MMSNIAFRSTIVFLLFSAVLSTPPEDPIKCATSENTTCTITNSYGAFPDRSICKAAQVLYPTTEQELVSVVASATRNKTKMKVATRFSHSIPKLVCPEGENGLLISTKYLNKILKVDVETRTMTVESGVTLQQLINEAAKVGLALPYAPYWWGLTIGGLMGTGAHGSTLRGKGSAVHDYVVELRIVRPAGPEDGYAMVENLNEQHEDLNAAKVSLGVLGVISQITLKLEPLFKRSITYVAKDDSDLGGQVVAFGDAHEFADITWYPSQHKAIYRVDDRVPINTSGNGLYDFIPFRPTPSLASVFIRTTEEIQESTNDANGKCIVASTASNTLITAAYGLTNNGIIFAGYPIIGFQNRLQSSGSCLDSLQDALITTCAWDPRMKGLFFHQTTFSIRLSFVKSFIEDVQKLVELEPKGLCVLGLYNGMLMRYVTASSAYLGHQENALDIDITYYRSKDPMTPRLYEDILEEVEQLGIFKYGGLPHWGKNRNLAFEGAIKKYKSAEYFLKVKEKYDLDGLFSSTWTDQVLGLKDGVTILKDGCALEGLCICLQDSHCNPSKGYYCRPGKVYKEARVCTNLK

SEQ ID NO: 181538 - protein, 127 aa, Glycine max
  Coding DNA Sequence Number=SeqID_64760
  Subcellular localization annotation: CTP_CleavageSite=30; ConfidenceScore=5.54e-01
MQFILKTVNDTSYSRMSFQVKANINNFNPRCFMKTSSKSFFFSFILSTIYGLINTEAQGLVLGIKGGTAGDKGLATSCILGKKALLIEGKTDPGSVRISGSIQVMNSQWVETLCILIKLTSSHLTSI

SEQ ID NO: 181539 - protein, 580 aa, Glycine max
  Coding DNA Sequence Number=SeqID_64761
  Gene Ontology: Mol. function=D-arabinono-1,4-lactone oxidase activity; Cellular component=membrane; Biological process=electron transport
  Homolog annotation: Hit_ID=Q9FM82; Match level="QueryCoverage=98%, HitCoverage=99%, E-value=0.0, Identity=63%"; Hit description =Arabidopsis thaliana genomic DNA, chromosome 5, P1 clone:MCD7
  Pfam annotation: Domain name=FAD_binding_4; Domain location=55-195; Score=76.3; E_value=9.5e-20; Accession=PF01565.13; Description=FAD binding domain
  Subcellular localization annotation: CTP_CleavageSite=29; ConfidenceScore=5.39e-01
MMSNKALTSTLVFLFFSVVLSTPPEDPIKCSNSKNTSCTITNSYGMFPDRSICKASQVLYPTSEQELVSVVASATRNKTKMKVATRYSHSIPKLVCPEGENGLLISTKYLNKIAKVDVEARTMTVESGVTMKQLINEAAKVGLALPYAPYWWGLTIGGLMGTGAHGSTLWGKGSSVHDYVVELRIVRAAGPEEGYAKAESLNEQHEDLNAAKVSLGVLGVISQVTLKLEPLFKRSITYVAKNDSDLGDQVAAFGHAHEFADITWYPSQRKAVYRVDDRVPFNTSGNGLYDFIPFRPTPSLELAILRTTEDLQESTGDADGKCIGSKTTTNTLITAAYGLTNNGIIFTVYPVIGFQNRLQASGSCLDSLQDAKITACAWDSRVKGEFFHQTTFSISLSVAKKFIEDVQKLVQLEPKGFCGIELYNGILMRYVKASSAYLGKQEDALDIDITYYRSKDPMTPRLYEDILEEVEQLGIFKYGGLPHWGKNRNLAFEGAIKKYKNAGRFLRVKEKYDLQGLFSSTWTDQMLGLKDGVTILKDGCALEGLCICSQDSHCNPSKDYYCKPGKVYKEARVCTHLKSK

SEQ ID NO: 181540 - protein, 58 aa, Glycine max
  Coding DNA Sequence Number=SeqID_64762
MSEDAESEDSKETLPAAESPRTMLRATHSFPLGTGCPLVSAIGVGEAMSYEAVLRAYE

SEQ ID NO: 181541 - protein, 71 aa, Glycine max
  Coding DNA Sequence Number=SeqID_64763
MSHLGTCMSLTPEHHHRYYIPQCVWLKNEEVALHAAVEGDYSELLLGHGRWRDHWLLYSLSAPWLLLESSA

SEQ ID NO: 181542 - protein, 329 aa, Glycine max
  Coding DNA Sequence Number=SeqID_64764
  Gene Ontology: Mol. function=RNA-directed DNA polymerase activity; Cellular component=intracellular; Biological process=RNA-dependent DNA replication
MKEEVRKEVLKLLEVGLIYHISYSAWNDLIPTLTVTGWRMCIDYRKLNEATRKYHFLLPFMDKMLEWLMGQSFYCFLDRYSRMSFGLCNDPTTFQWCMLAIFADMVDKCIEVFMDDFSVFGPSFDYCLTNLELVLQRCVEANLVLNWEKFHFMVDKEKIDVIEKLPPPVNAKGIRSFLGHVGFYRSFVSTTIMVAPDRSKEFELMCDASNYVEMLAIIYALEKFQSYLVGSKVVIFIDHAAIKYLITKADSKPRLIRWVLLIQEFGIVIKDKKGFKNVVANHLSQLVNEEVTHEEQEVRGEFLDESLLSVAERPWFIDIANYKFTGVIP

SEQ ID NO: 181543 - protein, 115 aa, Glycine max
  Coding DNA Sequence Number=SeqID_64765
  Homolog annotation: Hit_ID=Q1SMF0; Match level="QueryCoverage=81%, HitCoverage=18%, E-value=8e-08, Identity=33%"; Hit description =Tetratricopeptide-like helical
MYDSIKYEEVDMDDENEHEPGVNEEQHVDCSDAFNTYEWAQSIAYENGFLAVIMRSDAGMRGRTSFVLIGCERSGQYRSGKKDFVRRDTGSRKHRRPFKLYGKPVVEGQGWMMKL

SEQ ID NO: 181544 - protein, 88 aa, Glycine max
  Coding DNA Sequence Number=SeqID_64766
MALAKATKEGIPINGLINNLEFPEDKAIIFYDSVNEIYLAKDQVEIVGQKRCLADTAWTVKSNALLYGHPMSNGGAHPINCRKSIQSS

SEQ ID NO: 181545 - protein, 140 aa, Glycine max
  Coding DNA Sequence Number=SeqID_64767
  Gene Ontology: Mol. function=nucleic acid binding
  Homolog annotation: Hit_ID=Q1T6D0; Match level="QueryCoverage=63%, HitCoverage=18%, E-value=2e-12, Identity=40%"; Hit description=Zinc finger, CCHC-type; Lipocalin
MGRWHLRVIWKGSRGTCTHGATGLHNEPLNSGVSPPATKTPFIPFIDKVMGNKSCLQPPPLRDLFNEKLVHIEYEGGNTIKPMVQIDNSVFEGRLCAPWENALFIKLLSKRVGYQTMIDRLRANIRLVEEKAIIEVELQR

SEQ ID NO: 181546 - protein, 153 aa, Glycine max
  Coding DNA Sequence Number=SeqID_64768
  Gene Ontology: Mol. function=catalytic activity; Biological process =metabolic process
  Homolog annotation: Hit_ID=Q10BT3; Match level="QueryCoverage=85%, HitCoverage=17%, E-value=8e-31, Identity=52%"; Hit description=Acyl -activating enzyme 18, putative, expressed
MAVVIPTKGSEFSMKLRIGDLSWHDFLEKINSLKGKELIATEQPIGTFTNILFSSGTTGDPKAIPWTNITPLKVAADAWCHMDVRKGDVVCWPTNLGWMMGPWLVYASLLNGASMVCILDPLLGLALPSLYRNKLILLFKFSVLFIAFVSCEV

SEQ ID NO: 181547 - protein, 268 aa, Glycine max
  Coding DNA Sequence Number=SeqID_64769
  Gene Ontology: Mol. function=protein serine/threonine kinase activity; Cellular component=cytoplasm; Biological process=protein amino acid phosphorylation
  Homolog annotation: Hit_ID=Q8S5V9; Match level="QueryCoverage=100%, HitCoverage=57%, E-value=1e-106, Identity=65%"; Hit description =Putative serine/threonine kinase
  Pfam annotation: Domain name=NAF; Domain location=184-245; Score =127.4; E_value=4.1e-35; Accession=PF03822.5; Description=NAF domain
  Pfam annotation: Domain name=Pkinase; Domain location=1-187; Score =130.1; E_value=6.2e-36; Accession=PF00069.15; Description=Protein kinase domain
  Pfam annotation: Domain name=Pkinase_Tyr; Domain location=1-177; Score=-80.2; E_value=1.5e-07; Accession=PF07714.7; Description =Protein tyrosine kinase
  Pfam module annotation: Pfam domain module=NAF::Pkinase::Pkinase_Tyr; Domain location=184-245::1-187::1-177
MASKTKIYIVLELVNGGELFNKIAKNGKLKEDEARRYFHQLINAVDYCHSRGVYHRDLKPENLLLDSNGVLKVTDFGLSTYAQQEDELLRTACGTPNYVAPEVLNDRGYVGSTSDIWSCGVILFVLMAGYLPFDEPNHAALYKKIGRAQFTCPSWFSPEAKKLLKLILDPNPLTENLVTERKEKPVSMNAFELISRSQSFNLENLFEKQQGSVKRETHFTSQRPANEIMSKIEEAAKPLGFNVHKRNYKMKLQGDKSGRKGHLSVATE

SEQ ID NO: 181548 - protein, 101 aa, Glycine max
  Coding DNA Sequence Number=SeqID_64770
  Gene Ontology: Mol. function=protein serine/threonine kinase activity; Cellular component=cytoplasm; Biological process=protein amino acid phosphorylation
  Homolog annotation: Hit_ID=Q8S5V9; Match level="QueryCoverage=80%, HitCoverage=14%, E-value=4e-21, Identity=65%"; Hit description =Putative serine/threonine kinase
MSGKQAARPRTRVGKYELGKTIGEGSFAKVKFAKNVENGNHVAIKILDRNHVLRHKMMEQAPEERNFCDEDDQSSKRCQNLRGMTQFSDFSLSEKRLEIFL

SEQ ID NO: 181549 - protein, 192 aa, Glycine max
  Coding DNA Sequence Number=SeqID_64771
SEDHPPKQSRVRGHLVKIDADSLNTFLETPVVLAKGETLLAYSRYCRLPTDYREIEAALCIPNQGFILNSQGHPGKILKKDLTTLVQPDDLYSQSNTSRHRFPTLITILCRARGVVSDSLTFECLSLVINLAYIRKNCWNPEDLTVSIRGARRARARPAELPSTSAAPTPASTSAAPSVPAQTDSQCFEAML

SEQ ID NO: 181550 - protein, 88 aa, Glycine max
  Coding DNA Sequence Number=SeqID_64772
  Subcellular localization annotation: CTP_CleavageSite=45; ConfidenceScore=5.64e-01
MAISSSTQQLAPVSPSSMACCTKLGLASLTGELRVGVCSSQATCSSSAGGGTAFWWKTPVLLAICAAGSRYSFKINYLYARLIEILYK

SEQ ID NO: 181551 - protein, 54 aa, Glycine max
  Coding DNA Sequence Number=SeqID_64773
EGEGAEVGPREELEEDVIVKDVDKGSQGEVVAGEVIIRDKISVGEDENEEDGVV

SEQ ID NO: 181552 - protein, 153 aa, Glycine max
  Coding DNA Sequence Number=SeqID_64774
MLYFNGRVYEDNDGVIFEGSKKAIQIKRGISFNALKKKIGDKVKLQNNEIISAISCRFLVSGKYTSLQICDDEDVETMLESFKQQQEMSVLELYIEKDVAGGSMFHSANSLTSCGNYVSNDDTQPPTNMSNLNLDEDDDDDDYLVSNSYVEES

SEQ ID NO: 181553 - protein, 154 aa, Glycine max
  Coding DNA Sequence Number=SeqID_64775
  Gene Ontology: Mol. function=transition metal ion binding; Cellular component=cytoplasm; Biological process=fucose metabolic process
MADRLEDMIRDLGQESFQQAHTPVYEGLQSDSKKPFYAGCNNSLTLLSVVLSLVNVKARYGWSDKIFTSLLEVVHNLLLEDNTLPKSNYKAKKILCPMGMEYQKIHACPNDCILYRHEFQEMSKCPICGTSRYKVKDEEESSSDENSNTGPPVK

SEQ ID NO: 181554 - protein, 169 aa, Glycine max
  Coding DNA Sequence Number=SeqID_64776
MVTQNNESRKFLLWDRECVELIGETADDVNRVKIEDGDLYLNASPQALDKLLGHVLAFKVRIQSKFKNAVVRRYSKDLDLINVVLEMLPDSEACSKIDSSNVDCNDATQAERQSLSVIDDHDPVAGLPLIPKKRMSSGEADDKLGSSQISPAQLSSNKLTRHSHKSKFS

SEQ ID NO: 181555 - protein, 398 aa, Glycine max
  Coding DNA Sequence Number=SeqID_64777
  Gene Ontology: Mol. function=transcription regulator activity; Cellular component=nucleus; Biological process=regulation of transcription
  Homolog annotation: Hit_ID=Q1RUX8; Match level="QueryCoverage=52%, HitCoverage=58%, E-value=2e-40, Identity=46%"; Hit description=Helix- loop-helix DNA-binding domain, putative
  Pfam annotation: Domain name=HLH; Domain location=184-235; Score =61.2; E_value=3.4e-15; Accession=PF00010.16; Description=Helix-loop -helix DNA-binding domain
MERLQGPLNSCFFGDPLGVNCLDHVLVDEESLRLEEEEHLLISSLEDNMPFLQMLQSVESPQFFPLKETNFQTLLRLQHKKNPWEGIAYFPRMEAQQVQAALELESCVTHDMSEMQYSPVKSESNELQHPLSVSCFEKKVNYECNQEPQKVSQTCPKSQPTATKERRKRKRTRPSKNKEDVENQRMTHIAVERNRRRQMNDHLSVLRSLMPPSYIQRGDQASIIGGAIDFVKELEQLLQSLEAQKRTRKNEEGGGGGGSSSSSSSTMLCKPPPPPLLLLSSPHGYGMRSSPSDEVNCGDEVKAENKSEAADIKVTLIQTHVNLKIECQRKPGQLLKVIVALEDLRLTILHLNITSSETSVLYSLNLKIEEDCKLCSASDIAETVHQIFSFINGVARDH

SEQ ID NO: 181556 - protein, 179 aa, Glycine max
  Coding DNA Sequence Number=SeqID_64778
  Gene Ontology: Cellular component=chloroplast
  Homolog annotation: Hit_ID=Q2HTB6; Match level="QueryCoverage=82%, HitCoverage=89%, E-value=9e-20, Identity=43%"; Hit description =Thylakoid membrane phosphoprotein 14 kDa, chloroplast
  Subcellular localization annotation: CTP_CleavageSite=61; ConfidenceScore=5.77e-01
MASTSSALTISSSSTLHDCKAPRQSPAASPQCVSLPSPLLHSQNCSWKTTAYCRSIARNVMAMATGEAPAEAAPTEVPEIVKTLQETWDKVDDKYAVSSLALVGVVALWGSVGLISIVLSSYYITLKQAIDRLPLIPGILEIVGIGYTGGSFGTESKRNIQRNTGEQLKVLGSAEMLLT

SEQ ID NO: 181557 - protein, 91 aa, Glycine max
  Coding DNA Sequence Number=SeqID_64779
MWMDQFALTLNRSQELPRLLAKAKAMADTYSAPEEIHGLLSYLRIKSLPHFISSMHCMLVSSFVTGSRKVHITFLTVHIGHYAPKCASKKR

SEQ ID NO: 181558 - protein, 92 aa, Glycine max
  Coding DNA Sequence Number=SeqID_64780
MEKGTNGASLFQNRNHHWRLPAAGQSATLQPRATHLTEPGITKSPLLLALPKPPQQKGTRCWEWRFHAWPDTYETAPHGKYFQNSPSLGNSL

SEQ ID NO: 181559 - protein, 92 aa, Glycine max
  Coding DNA Sequence Number=SeqID_64781
  Subcellular localization annotation: CTP_CleavageSite=50; ConfidenceScore=5.02e-01
MTTIMLVEVVTLMVMKVFSQESYSNVLRAMTTMKVMVATIMAATTIMIVVAMVVTAATMKIMSVDDGGNVGDNYDNDCNGAHGGGNNNHDDN

SEQ ID NO: 181560 - protein, 107 aa, Glycine max
  Coding DNA Sequence Number=SeqID_64782
MEETHEIPHHNLADFEPCLGYATEGQAVGGIPLQNTLEGPQCHPQPQPSHSTTVKNPHAMAEMGKRKGSGPLKEVLDFDKYKGTTCPKNHPKMYCRKIRAYAKMRNC

SEQ ID NO: 181561 - protein, 94 aa, Glycine max
  Coding DNA Sequence Number=SeqID_64783
MSKLLKNKRAEQTNWVFLCHTHTDAVLVHHQADAWLTAGGEPIKHMLVEWKDLSNGSTSVPSATSLFSMLNFWYKASETPQLRTLEDVVALQAA

SEQ ID NO: 181562 - protein, 466 aa, Glycine max
  Coding DNA Sequence Number=SeqID_64784
  Gene Ontology: Mol. function=transcription regulator activity; Cellular component=nucleus; Biological process=regulation of transcription
  Homolog annotation: Hit_ID=Q9LUK7; Match level="QueryCoverage=90%, HitCoverage=90%, E-value=3e-53, Identity=31%"; Hit description=BHLH transcription factor
  Pfam annotation: Domain name=HLH; Domain location=285-334; Score =46.9; E_value=6.6e-11; Accession=PF00010.16; Description=Helix-loop -helix DNA-binding domain
MEELIISPSSSSSLVSLSQENPTPTLQQKLQFLLQSQPDWWVYAIFWQASHDDNGNLYLSFGEGHFQGTKETSPKSLTIPTKNKFLMKTPTNDNINDAEWFYVMSLTRSFAVNNNSSSNSTSCSSSSSSLPGKSFALGSVLWQNNRHELQFYNCERSNEAHMHGIETLICIPTQNGVVEMGSYDTIKQNWNLVQHVKSLFHTSPDPVTVQILDDHIISFADIGIVAGIQETKKRKQITQTAPSKNDNYVDSEHSDSDCPTLPTATTPTASEPKKRGRKPVLGRETPINHVEAERQRREKLNHRFYALRAVVPNVSRMDKASLLSDAVAYINELKAKIEDLESQQPRDSNKKMKTEMTDTLDNQSATTTSTVVDQSGSGSRLGLGPLGLEVDVRIVGPDAMVRVQSENVNHPGARLMGALRDLEFQVHHASMSCVNDLMLQDVVVKLPNGMRSEESLKSAIIMRLDQ

SEQ ID NO: 181563 - protein, 62 aa, Glycine max
  Coding DNA Sequence Number=SeqID_64785
MALTFSSNNKKLNELIINLMWELGQFCLTKNKKGEYMYMFNKESVYEMNATVSDVLFLTLNV

SEQ ID NO: 181564 - protein, 204 aa, Glycine max
  Coding DNA Sequence Number=SeqID_64786
  Homolog annotation: Hit_ID=Q1SWU2; Match level="QueryCoverage=69%, HitCoverage=50%, E-value=5e-52, Identity=62%"; Hit description =Cytosolic fatty-acid binding; Actin-crosslinking proteins
  Pfam annotation: Domain name=DUF569; Domain location=1-131; Score =284.3; E_value=2.4e-82; Accession=PF04601.4; Description=Protein of unknown function (DUF569)
MEFFQKAKVVRLRSHHDKYMLADDDQENVFQDRNGCYRNAKWTVEIVENSNIIRLKSCYGKYLTASNMPFILRGTGKKVLQTLPTRLNSSVEWEPIREGVQVRLRTRLPPWRNTITHDVPHRTATANWILWDVDIVELRPQTQAPKPRPRPIPITPPNQSMNPTPTNLSPCSSPSSSPLISKMDSLVKIDLRSHTTSEVRHMKF

SEQ ID NO: 181565 - protein, 262 aa, Glycine max
  Coding DNA Sequence Number=SeqID_64787
  Gene Ontology: Mol. function=RNA-directed DNA polymerase activity; Cellular component=exocyst; Biological process=exocytosis
  Homolog annotation: Hit_ID=UPI000034F2F4; Match level="QueryCoverage =99%, HitCoverage=38%, E-value=1e-121, Identity=80%"; Hit description= protein binding
  Pfam annotation: Domain name=Exo70; Domain location=1-253; Score= -171.1; E_value=0.00011; Accession=PF03081.6; Description=Exo70 exocyst complex subunit
MNLTKRLAQTAQETFIDFEEAVEKDATKTTVMDGTVHPLTSYVINYVKFLYDYQSTLKQLFHEFDPNDPEGQLAIVTTRIMQALQSNLDGKSKQYKDPALTQLFLMNNIHYIVRSVRRSEAKDMLGDDWVQIHRRIVQQHANQYKRISWAKILQCLTIPGGDNNGGVSRTMVKDRFKTFNDQIEEIHQRQSQWTVPDSELRESLRLAVAEVLLPAYRSFLKRFGPMIENGKNPHKYIVYSPEHLEQMLGEFFESKIWGEQKR

SEQ ID NO: 181566 - protein, 88 aa, Glycine max
  Coding DNA Sequence Number=SeqID_64788
  Homolog annotation: Hit_ID=Q1SMF0; Match level="QueryCoverage=97%, HitCoverage=16%, E-value=2e-11, Identity=40%"; Hit description =Tetratricopeptide-like helical
MKTKLVFATRDEILHWARSVAYEIGFVTVIMRLDTNTGMRGRTSFVLIGCERSGQYRSRKKDFVRKDTDSMKCECPFKFRAKPVVGGQ

SEQ ID NO: 181567 - protein, 74 aa, Glycine max
  Coding DNA Sequence Number=SeqID_64789
MTPPPPPQTRPPRDAVTCEGHAEEVFPAAVPAAVSREAHKGVAGEAARAREGGAEGGADPGGGSGGGRGRAVAG

SEQ ID NO: 181568 - protein, 136 aa, Glycine max
  Coding DNA Sequence Number=SeqID_64790
  Gene Ontology: Biological process=auxin mediated signaling pathway
  Homolog annotation: Hit_ID=Q1SFP1; Match level="QueryCoverage=75%, HitCoverage=90%, E-value=3e-39, Identity=78%"; Hit description=Auxin responsive SAUR protein
  Pfam annotation: Domain name=Auxin_inducible; Domain location=3-98; Score=140.1; E_value=6e-39; Accession=PF02519.5; Description=Auxin responsive protein
MGIGEKSPSKSFNLHHHHHREGKNKQQEFRGVPKGCMAIKVGQGEEQQRFVVPVIYINHPLFMQLLKEAEEEYGFDQKGTITIPCHVEEFRNVRGLIDRDKSLHHHHHHHNFSRAGIIGTPLFRKREEELEKNELT

SEQ ID NO: 181569 - protein, 205 aa, Glycine max
  Coding DNA Sequence Number=SeqID_64791
MLRNLADYIIIPFLTYGMLQNLTNYATMLPFDFRMSRNFTNCLMMGAKHLTRTKQRSHVIEQRSPDKIRRSKRSVVKATKKRKGKEKIIPDANVGGWLLNEKGTLQHLLECSMVASSWNKNPSHGLMEHYEMDFINEKYDILSSSNKVHESVLHHMCLVEKDGHWFLMMVWQVYQVFRVDNHKWVVISTGIGRYYNNFYYFNENS

SEQ ID NO: 181570 - protein, 63 aa, Glycine max
  Coding DNA Sequence Number=SeqID_64792
MEIFIQSIDPGAWNAIIKGPFIPTKEVNGIVAPCRACRPWISFINELIRFLKINGSGMEKEER

SEQ ID NO: 181571 - protein, 170 aa, Glycine max
  Coding DNA Sequence Number=SeqID_64793
  Gene Ontology: Mol. function=nucleic acid binding; Cellular component= endoplasmic reticulum membrane; Biological process=DNA integration
MDFVSQVEQRNIDEALWDEHWLMETLEELNQFKRNDVCDLIPKPIFHKSIGTQWVFQNKLDKSEIIVWNKARLVAKGYNQEEGIDYDETYAPIARLFWMDVKSTFLNAALKKKCFIWFEASTKVMKEFEITMIGQLNFFLGLQVKKMKHRTFLSQTKYCIELIKELGMEK

SEQ ID NO: 181572 - protein, 127 aa, Glycine max
  Coding DNA Sequence Number=SeqID_64794
MASNPARTQKKAKSLKRKQGECSQAALNRLDTWFMDESKKGFNFTNLLEAQTDMEGNLYSTVKGVEMVIDAEVCKAVAGIDMGGVHKILRNGLGVGGLTAKDRMLVYTITYILAPMSSNHAQVTNDD

SEQ ID NO: 181573 - protein, 49 aa, Glycine max
  Coding DNA Sequence Number=SeqID_64795
MDEGGKEDMWRVSGAREDTWMGVRAVGVTARWMGKIGRHNTTNSNSSDI

SEQ ID NO: 181574 - protein, 183 aa, Glycine max
  Coding DNA Sequence Number=SeqID_64796
  Gene Ontology: Mol. function=calcium ion binding; Cellular component =intracellular; Biological process=protein amino acid phosphorylation
  Homolog annotation: Hit_ID=Q6AUZ9; Match level="QueryCoverage=97%, HitCoverage=72%, E-value=8e-32, Identity=30%"; Hit description =Putative pentatricopeptide repeat-containing protein
  Pfam annotation: Domain name=PPR; Domain location=17-51; Score=23.8; E_value=0.00059; Accession=PF01535.11; Description=PPR repeat
  Pfam annotation: Domain name=PPR; Domain location=52-86; Score=29.3; E_value=1.3e-05; Accession=PF01535.11; Description=PPR repeat
  Pfam annotation: Domain name=PPR; Domain location=87-121; Score=49.0; E_value=1.6e-11; Accession=PF01535.11; Description=PPR repeat
  Pfam module annotation: Pfam domain module=PPR::PPR::PPR; Domain location=17-51::52-86::87-121
MKLQDEMKTLGISSHNVAMSAIVRGLANSKKIENAIWVLDLMLEMQIIPTVATFTTLMHVYCKEANVAKALELRSIMEHCHVKLDVVAYNVLISGLCANGDIEAAFKLYEEMKQRDLWPNTSIYIVLIDSFCAGNYQIESEKLLRDIQDRELVSLNSYGGTKRLNELLIISRKELIHLRLCFI

SEQ ID NO: 181575 - protein, 142 aa, Glycine max
  Coding DNA Sequence Number=SeqID_64797
  Gene Ontology: Mol. function=RNA-directed DNA polymerase activity; Biological process=RNA-dependent DNA replication
MDKSDFEVCDFCVFLCANKWCPNGGIQVLKGDPLSPCLFILCAKAFSALLCKAMENQALHELKVCPRALLIISHLPFTDDNLIFARFTNEEALQLVSLLDTYEKASGQKINLKKSEVSFSQNVLSPKIHELEMLAKASLVEF

SEQ ID NO: 181576 - protein, 63 aa, Glycine max
  Coding DNA Sequence Number=SeqID_64798
MWVHECDERINDEYMMLQPLMMLGLVNEFVMTYNIDLSDHNIYALMNDIAYYDIAFEENVTHG

SEQ ID NO: 181577 - protein, 117 aa, Glycine max
  Coding DNA Sequence Number=SeqID_64799
MIHIEHQFNINMLEDIRIALKNNFVLYDIVNFFNKDKVIEDIFTVASATWCLNIGERVRIGWDKDLDVHLIKDTFYKLDASINRIADWKEYPEDLFISEYLVYWKQEVLVPPTSTRI

SEQ ID NO: 181578 - protein, 802 aa, Glycine max
  Coding DNA Sequence Number=SeqID_64800
  Gene Ontology: Mol. function=structural constituent of ribosome; Cellular component=mitochondrion; Biological process=translation
  Homolog annotation: Hit_ID=Q9LVQ5; Match level="QueryCoverage=99%, HitCoverage=82%, E-value=0.0, Identity=41%"; Hit description =Similarity to salt-inducible protein
  Pfam annotation: Domain name=PPR; Domain location=106-140; Score =17.5; E_value=0.05; Accession=PF01535.11; Description=PPR repeat
  Pfam annotation: Domain name=PPR; Domain location=141-175; Score =25.4; E_value=0.0002; Accession=PF01535.11; Description=PPR repeat
  Pfam annotation: Domain name=PPR; Domain location=176-210; Score =33.5; E_value=7.2e-07; Accession=PF01535.11; Description=PPR repeat
  Pfam annotation: Domain name=PPR; Domain location=211-245; Score =40.7; E_value=5.1e-09; Accession=PF01535.11; Description=PPR repeat
  Pfam annotation: Domain name=PPR; Domain location=246-280; Score =23.2; E_value=0.00093; Accession=PF01535.11; Description=PPR repeat
  Pfam annotation: Domain name=PPR; Domain location=281-315; Score =44.1; E_value=4.9e-10; Accession=PF01535.11; Description=PPR repeat
  Pfam annotation: Domain name=PPR; Domain location=316-350; Score =43.2; E_value=9e-10; Accession=PF01535.11; Description=PPR repeat
  Pfam annotation: Domain name=PPR; Domain location=351-385; Score =22.4; E_value=0.0016; Accession=PF01535.11; Description=PPR repeat
  Pfam annotation: Domain name=PPR; Domain location=386-420; Score =52.1; E_value=1.8e-12; Accession=PF01535.11; Description=PPR repeat
  Pfam annotation: Domain name=PPR; Domain location=421-455; Score =33.8; E_value=6.1e-07; Accession=PF01535.11; Description=PPR repeat
  Pfam annotation: Domain name=PPR; Domain location=456-490; Score =25.1; E_value=0.00024; Accession=PF01535.11; Description=PPR repeat
  Pfam annotation: Domain name=PPR; Domain location=491-525; Score =31.6; E_value=2.7e-06; Accession=PF01535.11; Description=PPR repeat
  Pfam annotation: Domain name=PPR; Domain location=526-560; Score =35.6; E_value=1.7e-07; Accession=PF01535.11; Description=PPR repeat
  Pfam annotation: Domain name=PPR; Domain location=561-595; Score =18.7; E_value=0.021; Accession=PF01535.11; Description=PPR repeat
  Pfam annotation: Domain name=PPR; Domain location=596-630; Score =23.4; E_value=0.00082; Accession=PF01535.11; Description=PPR repeat
  Pfam annotation: Domain name=PPR; Domain location=631-665; Score =19.7; E_value=0.01; Accession=PF01535.11; Description=PPR repeat
  Pfam annotation: Domain name=PPR; Domain location=667-701; Score =36.9; E_value=6.9e-08; Accession=PF01535.11; Description=PPR repeat
  Pfam annotation: Domain name=PPR; Domain location=702-736; Score =26.2; E_value=0.00011; Accession=PF01535.11; Description=PPR repeat
  Pfam annotation: Domain name=PPR; Domain location=737-771; Score =34.6; E_value=3.5e-07; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR; Domain location=106-140::141-175::176-210::211-245::246-280::281 -315::316-350::...
  Pfam module annotation: Domain location=351-385::386-420::421 -455::456-490::491-525::526-560::561-595::596-630::631-665::667 -701::702-736::737-771
MEKSIYTFLTVHRWESLNCMKYRLASLRPVHGRLALKFLNWVIKQPNLELNHVTHIICTTTHILVRARMYNFAKTTLKHLLQLPIGLNSVFGALMETYPICNSNPAVFDLLIRVCLRNRMVGDAVQTFYLMGFRGLNPSVYTCNMVLGSLVKEQKVDMFWSFFKGMLAKGICPDVATFNILLNALCERGKFKNAGFLLRKMEESGVYPTAVTYNTLLNWYCKKGRYKAASQLIDCMASKGIGVDVCTYNVFIDNLCRDSRSAKGYLLLKRMRRNMVYPNEITYNTLISGFVREGKIEVATKVFDEMSLFNLLPNSITYNTLIAGHCTTGNIGEALRLMDVMVSHGLRPNEVTYGALLNGLYKNAEFGMVSSILERMRMGGVRVSHISYTAMIDGLCKNGMLEEAVQLLDDMLKVSVNPDVVTFSVLINGFFRVGKINNAKEIMCKMYKTGLVPNGILYSTLIYNYCKMGYLKEALNAYAVMNHSGHVADHFTCNVLVATFCRYGKLEEAEYFMNHMSRMGLDPNSVTFDCIINGYGNSGDALKAFSVFDKMNSFGHFPSLFTYGGLLKGLCIGGHINEALKFFHRLRCIPNAVDNVIFNTKLTSTCRSGNLSDAIALINEMVTNDFLPDNFTYTNLIAGLCKKGKIVAALLLSGKAIEKGLLSPNPAVYTSLVDGLLKHGHARAALYIFEEMLNKDVEPDTVAFNVIIDQYSRKGKTSKVNDILSTMKSKNLCFNLATYNILLHGYAKRHAMARCFMLYKDMIRHGFLPDKFSWHSLILGYCQSKSFDVAIKILRWITLEGH

SEQ ID NO: 181579 - protein, 91 aa, Glycine max
  Coding DNA Sequence Number=SeqID_64801
MASSGLKGGIEIVRQSPKVWQGDTSGDSGNYPNKAVHGQKARRGEVKPEDTLWLKEAWVARLRNPALFERVEEELLWETGMDVNPTFMGDD

SEQ ID NO: 181580 - protein, 135 aa, Glycine max
  Coding DNA Sequence Number=SeqID_64802
MGGVNSNWAHSEDSGEKVAFGGSNPTRLGEMDDNHLPCSPTEFSLEISEEKRKKGKSPIRGVSITLPRCFRNQFHGSSFPFFVVLRLFFIVLRSSTNKFLNSKLSIHSMHPQWSILVLYAFILTSFTFSILFFLF

SEQ ID NO: 181581 - protein, 124 aa, Glycine max
  Coding DNA Sequence Number=SeqID_64803
MAVNTELSMAHEEKAHPKSPMDPTRMCQRGLIMLYPTCGQSLLIRSFIRPPIIRGKVISVTLKAVWEFSKHDPAVSLSPSQAYHAWETAKQTPPRASTLCYFTKGQKGSNFPKAILYKTAFTYS

SEQ ID NO: 181582 - protein, 397 aa, Glycine max
  Coding DNA Sequence Number=SeqID_64804
  Gene Ontology: Mol. function=RNA-directed DNA polymerase activity; Cellular component=intracellular; Biological process=RNA-dependent DNA replication
  Pfam annotation: Domain name=G-patch; Domain location=193-240; Score =5.2; E_value=0.042; Accession=PF01585.13; Description=G-patch domain
MGSNQTPLFKKRFYQVKIKSLEVTSLPELGQLMGQPQRQTFRKAYEILGCPLGGRKPYLFSGFYPSMAIVAKVAKALASRQEVRGEIDLLIQIGPYTYRVTFQVMDINPAYSCLLGRPWIHSVGVVPLTLHQKLKFMVKGHLVIVSGEEDVLVSCPSSMPYVEAAEESLEMTFQSFEVVSNAFVESLPMQPRMSGVAMMVPQVMLRHDYEPGMSLGKNNDGMADLVDIKGNHGRFRLGYKPTQADVRKNILERRNKGQCPHPRPQAREVPPCHISRSFMSAGLRHEEQVTAICDEAPQRRSDLVQPCLPVFQLGNWQVDEEDEDIGFFLELERIVTQEDREKKLHSEETEIVNLGVGDGKKEVKMGMGMTTPIREELVALLRTTKMSLLGHTKTCLV

SEQ ID NO: 181583 - protein, 170 aa, Glycine max
  Coding DNA Sequence Number=SeqID_64805
MAPRKLITKRARKATVGEGSSAASQAEIEFYGHHFQSEEHECCFEAIKDWSFLKERRVQLRTRWTQLTEPMAKYDPEIVMEFYANAWPMEEGVMDKRSWVQGQWVPYDEDAINQFLGHPLVLEKGQHCEYTKRRSQVSGFDEEAICQLLCSPGQDFALEHDREAVADHAH

SEQ ID NO: 181584 - protein, 39 aa, Glycine max
  Coding DNA Sequence Number=SeqID_64806
MAEALPNCDRNRLLHRSLFVLHSSSELRRSEFLIAPEDT

SEQ ID NO: 181585 - protein, 83 aa, Glycine max
  Coding DNA Sequence Number=SeqID_64807
MALGVMEAHPSELLLQPKVTLLAQAASSPGYFTPKLFGGPSEPEASLGKPGFRKRLKMILLPSFLETDVEQHLSVSENQNIGE

SEQ ID NO: 181586 - protein, 63 aa, Glycine max
  Coding DNA Sequence Number=SeqID_64808
  Subcellular localization annotation: CTP_CleavageSite=36; ConfidenceScore=5.30e-01
MVLVMATAAALTSIIFFMLIMTSIIMAICSFMASMSASMSASICSYTSSTSPITLALAQERMQ

SEQ ID NO: 181587 - protein, 183 aa, Glycine max
  Coding DNA Sequence Number=SeqID_64809
MELASTLAGIIATIALSSRYGSKLAYDTRIWGVCAKGGVWELGLCNDIVGLMGNLTVPTLILSSAKTKSAKLEEVYHQLLALQWHIRGKARSQLECGGEFHVSPPCEYGSGVIDILTGSVCHIGWCIVGRQAIWWEGKLAIWGVRSTSAMVLVVAIAAALTSIISFMLIMASIIVTIFSFKAS

SEQ ID NO: 181588 - protein, 137 aa, Glycine max
  Coding DNA Sequence Number=SeqID_64810
MKCLEGVWETLEGNERCQFRGIVRITATLLVHPEQPARILQQPVEWILPMPTLYRLVEPVQLIEVSSSEEDPEGDPEESSPEPAMDAADLPEDDEDPLPDVDFPEDIMPKPEADSTEESGPVGMVNKDDSSSQQTTP

SEQ ID NO: 181589 - protein, 150 aa, Glycine max
  Coding DNA Sequence Number=SeqID_64811
MAAQLIRDCVVMECLEGVWETLEGNERCQFRGTVRLTATLLVHPEQPARTLQQPVEWILPTPTPYRLVEPVQLIEVSSSEEDPEGDPEESSPEPAMDAADLPEDDEDPLPDVDSPDTNYYDIMPTPEAYSTEESGPGGMANNDDSSSQRT

SEQ ID NO: 181590 - protein, 690 aa, Glycine max
  Coding DNA Sequence Number=SeqID_64812
  Gene Ontology: Mol. function=hydrolase activity; Cellular component =membrane; Biological process=cell-cell signaling
  Homolog annotation: Hit_ID=Q1SEI2; Match level="QueryCoverage=99%, HitCoverage=99%, E-value=0.0, Identity=64%"; Hit description =Nucleoside phosphatase GDA1/CD39
  Pfam annotation: Domain name=GDA1_CD39; Domain location=73-517; Score= 78.8; E_value=1.8e-20; Accession=PF01150.8; Description=GDA1CD39 (nucleoside phosphatase) family
  Subcellular localization annotation: CTP_CleavageSite=43; ConfidenceScore=5.15e-01
MVFAKIASLVAPNSHSLPHPLSLQDLSSYHRHLEPPLQGGTTSSSRNKCLRLSLYLATFLFLTYLLFLLLYSYWAHASSAKYYVVLDCGSTGTRVYVYRASVRFNRHTTLPIAITSLRNPSHKKPPTGRAYDRIETEPGIDKLVNNVSGLNNALKPLLRWAKKQIPVRAHKSTFLFLYATAGVRRLPVSDSRWLLDNAWSVLKDSPFVCQRDWVKTILGPEEAYFGWIALNYDSGILGVRPRKATYGALDLGGSSLQVTFESDQQLNSETSLYVRIGSVSHHLTAYSLPGYGLNEAFGKSVVYLFRKEFGLGDVDVGSGGNIELKHPCLQEGYREEYLCSRCLSSKKGGNGGFGGTPLVLVGAPNWGECSTLAKVAVNLSEWSDHGAGLDCGAQPCALGDNLPRPYGHFYVISGFYVVYRFFNLTSEATLDDVLVRGKGFCGKRWDVAKRSVAPQPFIEQYCFRAPYIASLLREGLHINDNQITVGSGNITWTLGVALLEAGKAFSTRFGLRDLELFQMKINPLVLVPLLLLSFILLLCALSCIGNWMPRFFRRQYLPISRHNSVSGASVLNIPSPFRFQRWSPMNSGDGRLKMPLSPKIASSQQSPFGLGHGLDNNSGGVELMKSSLYPSASNVSHSYSSNSLGQMQFDSGNMGAFWSPHRSQMRLQSRRSQSREDLNSSLAEVHLVKP

SEQ ID NO: 181591 - protein, 41 aa, Glycine max
  Coding DNA Sequence Number=SeqID_64813
MFSFCALVLAFTLTLLFSLSLTALLSLVLSHQRSTELEGNG

SEQ ID NO: 181592 - protein, 67 aa, Glycine max
  Coding DNA Sequence Number=SeqID_64814
  Gene Ontology: Mol. function=protein serine/threonine kinase activity; Cellular component=chloroplast; Biological process =regulation of photosynthesis, light reaction
  Homolog annotation: Hit_ID=Q9S713; Match level="QueryCoverage=86%, HitCoverage=10%, E-value=1e-20, Identity=81%"; Hit description =Serine/threonine-protein kinase SNT7, chloroplast precursor
MRHILFLFALDGLHSTGIVHRDIKPHYISLFEESHTFKIIDLGAATDLRVGINYIPKEFLLDPRYLL

SEQ ID NO: 181593 - protein, 586 aa, Glycine max
  Coding DNA Sequence Number=SeqID_64815
  Gene Ontology: Mol. function=binding; Cellular component =intracellular; Biological process=metabolic process
  Homolog annotation: Hit_ID=Q9LIC3; Match level="QueryCoverage=99%, HitCoverage=98%, E-value=0.0, Identity=54%"; Hit description =Selenium-binding protein-like
  Pfam annotation: Domain name=PPR; Domain location=11-45; Score=1.6; E_ value=4.8; Accession=PF01535.11; Description=PPR repeat
  Pfam annotation: Domain name=PPR; Domain location=178-212; Score =32.4; E_value=1.6e-06; Accession=PF01535.11; Description=PPR repeat
  Pfam annotation: Domain name=PPR; Domain location=213-246; Score=0.4; E_value=6.7; Accession=PF01535.11; Description=PPR repeat
  Pfam annotation: Domain name=PPR; Domain location=279-313; Score =30.0; E_value=8.5e-06; Accession=PF01535.11; Description=PPR repeat
  Pfam annotation: Domain name=PPR; Domain location=315-349; Score =13.8; E_value=0.17; Accession=PF01535.11; Description=PPR repeat
  Pfam annotation: Domain name=PPR; Domain location=352-386; Score =10.7; E_value=0.41; Accession=PF01535.11; Description=PPR repeat
  Pfam annotation: Domain name=PPR; Domain location=418-452; Score=5.8; E_value=1.5; Accession=PF01535.11; Description=PPR repeat
  Pfam annotation: Domain name=PPR; Domain location=77-111; Score=45.1; E_value=2.3e-10; Accession=PF01535.11; Description=PPR repeat
  Pfam module annotation: Pfam domain module=PPR::PPR::PPR::PPR::PPR::PP R::PPR::PPR; Domain location=11-45::178-212::213-246::279-313::315 -349::352-386::418-452::77-111
MALRGLDTNFQDYNTVLNECLRKRAIREGQRVHAHMIKTHYLPCVYLRTRLIVFYVKCDSLRDARHVFDVMPERNVVSWTAMISAYSQRGYASQALSLFVQMLRSGTEPNEFTFATVLTSCIGSSGFVLGRQIHSHIIKLNYEAHVYVGSSLLDMYAKDGKIHEARGIFQCLPERDVVSCTAIISGYAQLGLDEEALELFRRLQREGMQSNYVTYTSVLTALSGLAALDHGKQVHNHLLRSEVPSYVVLQNSLIDMYSKCGNLTYARRIFDTLHERTVISWNAMLVGYSKHGEGREVLELFNLMIDENKVKPDSVTVLAVLSGCSHGGLEDKGMDIFYDMTSGKISVQPDSKHYGCVVDMLGRAGRVEAAFEFVKKMPFEPSAAIWGCLLGACSVHSNLDIGEFVGHQLLQIEPENAGNYVILSNLYASAGRWEDVRSLRNLMLKKAVTKEPGRSWIELDQVLHTFHASDCSHPRREEVSAKVQELSARFKEAGYVPDLSCVLHDVDEEQKEKILLSHSEKLALTFGLIATPESVPIRVIKNLRICVDCHNFAKYTSKIYGREVSLRDKNRFHRIVGGKCSCGDYW

SEQ ID NO: 181594 - protein, 97 aa, Glycine max
  Coding DNA Sequence Number=SeqID_64816
MTFCLKGIDQEQEPDSSVEQDDFKVLKVVHSHSKKGHRQKTNRMGSAKGKKGREIGDIPAPLEDECYGCRDTEPKPRFARDPLSHRCQRRGRMCGTV

SEQ ID NO: 181595 - protein, 71 aa, Glycine max
  Coding DNA Sequence Number=SeqID_64817
MGVLDAKHKNGIAYRSYGEDVRNGEWRHRKRVGGLGAIGFRSAKNRGGKEGLNEGDASRKNNRDSREPSFR

SEQ ID NO: 181596 - protein, 497 aa, Glycine max
  Coding DNA Sequence Number=SeqID_64818
  Gene Ontology: Mol. function=cation transporter activity; Cellular component=membrane; Biological process=cation transport
  Homolog annotation: Hit_ID=Q1SYW9; Match level="QueryCoverage=80%, HitCoverage=95%, E-value=2e-78, Identity=84%"; Hit description =Cation efflux protein
  Pfam annotation: Domain name=Cation_efflux; Domain location=53-422; Score=218.9; E_value=1.2e-62; Accession=PF01545.11; Description =Cation efflux family
MEAQSSQHTQVIEISGDFPDGGRKICAEAPCGFADAGSISKDSEERSTSMRKLFMAVVLCVIFMTVEVVGGIKANSLAILTDAAHLLSDVAAFAISLFSLWAAGWEATPRQSYGFFRIEILGALVSIQMIWLLAGILVYEAIDRIIAGPKSVDGFLMFLVAAFGLVVNIIMALLLGHDHGHGHDGHGHGHGHGHGHGHDGHGHSHGFTVSTHCDAKHTKDEHHHTHDDHAHHHDENLSKDAHHHTEEDHLHHHAHKDVTEPLLGESKGGTKKKKQWNINVQGAYLHVLGDSIQSIGVMIGGAVIWYNPRWQIVDLICTLIFSIIVLGTTINMLRNILEVLMESTPREIDATKLERGLLDMEDVVAVHELHIWAITVGKVLLACHVKIRREADADVVLDKICKNFIKSLKLLLVQSNTGLPWAPKCINGVNTRGSLPIQISSCIVFWSVLPTSFVLHKHKIVKVLFQQKHYFDESPSYVICPHSLPSVVSLVNNHKIL

SEQ ID NO: 181597 - protein, 82 aa, Glycine max
  Coding DNA Sequence Number=SeqID_64819
  Subcellular localization annotation: CTP_CleavageSite=68; ConfidenceScore=5.09e-01
MGSKWRKLKLALGLDSCVHIPRAFDDSSAAAARFSGGISPTVVSPAGDTSGYRPSTPTPSSSGLWLPKSGTKSPKVIIIITL

SEQ ID NO: 181598 - protein, 295 aa, Glycine max
  Coding DNA Sequence Number=SeqID_64820
  Gene Ontology: Mol. function=sequence-specific DNA binding; Cellular component=nucleus; Biological process=regulation of transcription, DNA-dependent
  Homolog annotation: Hit_ID=Q1SFJ9; Match level="QueryCoverage=79%, HitCoverage=96%, E-value=2e-90, Identity=73%"; Hit description =Leucine zipper, homeobox-associated; Homeodomain-related
  Pfam annotation: Domain name=HALZ; Domain location=141-185; Score =47.0; E_value=6.5e-11; Accession=PF02183.8; Description=Homeobox associated leucine zipper
  Pfam annotation: Domain name=Homeobox; Domain location=86-140; Score =63.2; E_value=8.7e-16; Accession=PF00046.19; Description=Homeobox domain
  Pfam module annotation: Pfam domain module=HALZ::Homeobox; Domain location=141-185::86-140
MSFGYKANNWGLHSDHHDRNSNKQKPIDTCISQKLLLHTKKILYHQTHLYPQTQGPIVQATEGVEAETYTSSCTTPSRSKKRNNNNTRRFSDEQIKSLETMFESETRLEPRKKLQLARELGLQPRQVAIWFQNKRARWKSKQLERDYGILQSNYNTLASRFEALKKEKQTLLIQLQKLNHLMQKPMEPSQRCTQVEAANSMDSESENGGTMKCKAEGKPSPSSLERSEHVLGVLSDDDTSIKVEDFNLEDEHGLLNFVEHADGSLTSPEDWSAFESNDLFGQSTTDDYQWWDFWS

SEQ ID NO: 181599 - protein, 220 aa, Glycine max
  Coding DNA Sequence Number=SeqID_64821
MAKFDPYIVLEFYANAWPTEEGVRDMRCYRPVPGIPFSAGRGLGVQVWPEEEPDFARTAAGRRVRIMHTNMTTLTQIWMTLLLSNIQPSDHNSDLPLPKCQLAADAPPPHQAGPAGSFDTEQYLRHLVRQQAANHRAHVQTHDCLYQMSLSLQSQGFTSFLCPTPDQFRAEVAWPGDWPEARAGEAPAEAPAEAPDEADEAREDEEMTDLLDFLGGSGAT

SEQ ID NO: 181600 - protein, 363 aa, Glycine max
  Coding DNA Sequence Number=SeqID_64822
  Gene Ontology: Mol. function=protein serine/threonine kinase activity; Cellular component=membrane; Biological process=protein amino acid phosphorylation
  Homolog annotation: Hit_ID=Q6Z8Z4; Match level="QueryCoverage=89%, HitCoverage=50%, E-value=3e-91, Identity=56%"; Hit description =Putative receptor protein kinase PERK1
  Pfam annotation: Domain name=Pkinase; Domain location=6-257; Score =76.9; E_value=6.4e-20; Accession=PF00069.15; Description=Protein kinase domain
  Pfam annotation: Domain name=Pkinase_Tyr; Domain location=8-257; Score=22.9; E_value=7.1e-14; Accession=PF07714.7; Description =Protein tyrosine kinase
  Pfam module annotation: Pfam domain module=Pkinase::Pkinase_Tyr; Domain location=6-257::8-257
MDFPKWQLMVVALIALALATALGIELLARLHHCHLVPLLGYCSELKGKHVQRLLVFDYMANGNLRDCLDGVSGKHIDWATRVMIAIGAARGLEYLHEAAAPRILHRDVKSTNILLDENWQAKITDLGMAKNLRSDDLPSCSNSPARMQGTFGYFAPEYAIVGRASLESDVFSFGVVLLELISGRHPIHKSTGKEESLVIWATPRFQDSRRVITELVDPQLKGNFPEEEVQVMAYLAKECLLLDPDTRPTMSEVVQILSSISPGKSRRRRNIPASLFQEPEDAQKQRQAPPSKFPTHSSMPIYNDHNLSVENKNKAEDALSAEYMESLILLTSKSDGSCASEEEIVDLTEPRFESFCITNGNVP

SEQ ID NO: 181601 - protein, 39 aa, Glycine max
  Coding DNA Sequence Number=SeqID_64823
MGGRVFKGFLYNQGPESFYSTSAVAEGSSSGTNLKIYIF

SEQ ID NO: 181602 - protein, 124 aa, Glycine max
  Coding DNA Sequence Number=SeqID_64824
MLLLYSLKRTQNWRLRQRIRLYKKGRGTPSSIQVCGFLMNESRGVGDEHRTRIAKMCICFIHGVAEVVGVEGHGYVDGGRGRGATVLAGGVLPKERELRGKMTDINNLTVLNNFNSRDLLGIKW

SEQ ID NO: 181603 - protein, 343 aa, Glycine max
  Coding DNA Sequence Number=SeqID_64825
  Gene Ontology: Mol. function=cysteine-type endopeptidase activity; Cellular component=endoplasmic reticulum; Biological process =proteolysis
  Homolog annotation: Hit_ID=Q1T4K1; Match level="QueryCoverage=99%, HitCoverage=100%, E-value=1e-120, Identity=61%"; Hit description =Peptidase C1A, papain; Peptidase M14, carboxypeptidase A
  Pfam annotation: Domain name=Inhibitor_I29; Domain location=39-96; Score=91.9; E_value=2e-24; Accession=PF08246.2; Description =Cathepsin propeptide inhibitor domain (
  Pfam annotation: Domain name=Peptidase_C1; Domain location=124-342; Score=413.7; E_value=2.7e-121; Accession=PF00112.13; Description =Papain family cysteine protease
  Pfam module annotation: Pfam domain module=Inhibitor_I29::Peptidase _C1; Domain location=39-96::124-342
MASENLFHCTSLALLLLFGFWAFSANTRTLEDASMHERHEQWMAQHGKVYKDHHEKELRYKIFQQNVKGIEGFNNAGNKSHKLGVNQFADLTEEEFKAINKLKGYMWSKISRTSTFKYEHVTKVPATLDWRQKGAVTPIKSQGLKCGSCWAFAAVAATEGITKLTTGELISLSEQELIDCDTNGDNGGCKWGIIQEAFKFIVQNKGLATEASYPYQAVDGTCNAKVESKHVASIKGYEDVPANNETALLNAVANQPVSVLVDSSDYDFRFYSSGVLSGSCGTTFDHAVTVVGYGVSDDGTKYWLIKNSWGVYWGEQGYIRIKRDVAAKEGMCGIAMQASYPIA

SEQ ID NO: 181604 - protein, 258 aa, Glycine max
  Coding DNA Sequence Number=SeqID_64826
  Gene Ontology: Mol. function=3'-5'-exoribonuclease activity; Cellular component=exosome (RNase complex); Biological process=RNA processing
  Homolog annotation: Hit_ID=Q69UI6; Match level="QueryCoverage=79%, HitCoverage=79%, E-value=2e-84, Identity=74%"; Hit description =Putative ribonuclease PH
  Pfam annotation: Domain name=RNase_PH; Domain location=44-169; Score =62.1; E_value=1.8e-15; Accession=PF01138.11; Description=3' exoribonuclease family, domain 1
MNQDNFHGQLTPGGIAGPNVLMQPFDPQDVCLLEKGIGTEIPDVVHCAVFRTGAVNAASGSAYAEVGNTKVIVSVFGPRESKKAMMYSDIGRLNCNVSFTTFATPIRGQGSDHKEYSSMLHKALEGAIILETFPKTTVDVFALVLESSGSDLPVVISCASLALADAGIMMYDLVASVSVSCFNKNLVIDPVLEEENGQDGSLMITCMPSRYEITQLTVTGEWSTPKINEGMQLCLDACAKLAKIMRSCLKEAVSDSQE

SEQ ID NO: 181605 - protein, 37 aa, Glycine max
  Coding DNA Sequence Number=SeqID_64827
MAELESFAGVDAVKDSHLSTSEDLDSECYHSITWKLN

SEQ ID NO: 181606 - protein, 162 aa, Glycine max
  Coding DNA Sequence Number=SeqID_64828
MVIDSILTSPRLNSPSFRRQFKKDELGSWSTLFQRHRFLLSTLVLITLLCTIYLYFAVTLGASGTCSGLTGAQKTSCHMELVKDSVAKGYLTFNISADVSSDVEITYFYIDAYVSNDVETCNFYIGAYASTDVKTRICYIVYDVSNVVNNDFSKTVVYLGPM

SEQ ID NO: 181607 - protein, 445 aa, Glycine max
  Coding DNA Sequence Number=SeqID_64829
  Gene Ontology: Mol. function=protein serine/threonine kinase activity; Cellular component=integral to membrane; Biological process=protein amino acid phosphorylation
  Homolog annotation: Hit_ID=Q60D16; Match level="QueryCoverage=96%, HitCoverage=57%, E-value=2e-64, Identity=33%"; Hit description =Putative receptor kinase-like protein, identical
  Pfam annotation: Domain name=LRR_1; Domain location=123-145; Score =14.0; E_value=0.54; Accession=PF00560.23; Description=Leucine Rich Repeat
  Pfam annotation: Domain name=LRR_1; Domain location=147-168; Score =3.6; E_value=61; Accession=PF00560.23; Description=Leucine Rich Repeat
  Pfam annotation: Domain name=LRR_1; Domain location=170-192; Score =6.6; E_value=16; Accession=PF00560.23; Description=Leucine Rich Repeat
  Pfam annotation: Domain name=LRR_1; Domain location=231-253; Score =7.9; E_value=9.6; Accession=PF00560.23; Description=Leucine Rich Repeat
  Pfam annotation: Domain name=LRR_1; Domain location=263-285; Score =14.1; E_value=0.51; Accession=PF00560.23; Description=Leucine Rich Repeat
  Pfam annotation: Domain name=LRR_1; Domain location=287-309; Score =12.3; E_value=1.4; Accession=PF00560.23; Description=Leucine Rich Repeat
  Pfam annotation: Domain name=LRR_1; Domain location=30-55; Score=6.1; E_value=21; Accession=PF00560.23; Description=Leucine Rich Repeat
  Pfam annotation: Domain name=LRR_1; Domain location=311-334; Score =0.0; E_value=2.8e+02; Accession=PF00560.23; Description=Leucine Rich Repeat
  Pfam annotation: Domain name=LRR_1; Domain location=6-28; Score=13.6; E_value=0.71; Accession=PF00560.23; Description=Leucine Rich Repeat
  Pfam annotation: Domain name=LRR_1; Domain location=74-93; Score=1.9; E_value=1.3e+02; Accession=PF00560.23; Description=Leucine Rich Repeat
  Pfam annotation: Domain name=LRR_1; Domain location=98-121; Score =6.0; E_value=21; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =123-145::147-168::170-192::231-253::263-285::287-309::30-55::311 -334::6-28::74-93::98-121
MGQLSQLQKLVASHNSLEGKIPTNFTGCTCLKGLYLNGNNLIGKVSVKVGSLGKLQHLINFEGDLPQEICHLKSLTKIALDVNVLTGTFPSCLYNTSSLTVISAAANQFNGPLSPNMFHTLPNLQEIYIADNQVSGPIPPSITNAFILSRLEISINYFTGQVPSLGKLQNLLYLTLEKNNLGDNSTDYLKFLKSLTIRKIPSPTSAKNEVKRNPYSNIGNFSQLFQETVPKITILNLSKNHLTDVSENQLSGDIPGTIRECRMLEYLYMQGNSLQGIIPSSLASLKCLKCLDLSRNCLSGSIPTILQNISFLEYFNVTFNILDGEVPIEGVFGNASRLVVIGNSKLCGGISELHLPPCLVKGKKLAKFRLVAVIVSVVAFLLILSVILAIYWMRKNSKKPSLDPPTIGELARVSYQSLHDRTYGFSTTNLIGSGILALSAKELLS

SEQ ID NO: 181608 - protein, 81 aa, Glycine max
  Coding DNA Sequence Number=SeqID_64830
MRRYGTLQVVPSQVQLCNPLKHGIACYSMPVTKSLLIEEEAHVIPSAAALVLITDIKALLMANKNMPDGGKKTSNELPLLI

SEQ ID NO: 181609 - protein, 423 aa, Glycine max
  Coding DNA Sequence Number=SeqID_64831
  Gene Ontology: Mol. function=binding; Cellular component =intracellular; Biological process=metabolic process
  Homolog annotation: Hit_ID=Q1SEH3; Match level="QueryCoverage=99%, HitCoverage=99%, E-value=1e-147, Identity=64%"; Hit description =Pentatricopeptide repeat
  Pfam annotation: Domain name=PPR; Domain location=133-167; Score=3.3; E_value=3.1; Accession=PF01535.11; Description=PPR repeat
  Pfam annotation: Domain name=PPR; Domain location=267-301; Score=4.4; E_value=2.2; Accession=PF01535.11; Description=PPR repeat
  Pfam annotation: Domain name=PPR; Domain location=370-404; Score =35.1; E_value=2.5e-07; Accession=PF01535.11; Description=PPR repeat
  Pfam annotation: Domain name=PPR; Domain location=98-132; Score=16.0; E_value=0.094; Accession=PF01535.11; Description=PPR repeat
  Pfam module annotation: Pfam domain module=PPR::PPR::PPR::PPR; Domain location=133-167::267-301::370-404::98-132
MVLITAPVTTVPTHHLFFDENVDLKNSKLRTLPSPNHQLEFRLPLRHPIHNFPNHTSPQPLTQTTTFTKKKKKKKRKGATTSDILHLMEALPFPVPIDIYTSLIKECTVSGDPETAIELATHISKSGIKPPLPFLNRILVMFVSCGLLENARHMFDKMRVRDFNTWATLFVAYYDNTDYEEATNVFVNMLTQLGMMEFPPWIWACLLRACACTVNVPLGMQVHGWLLKLGTCDHVLLSSSLINFYGRFTCLEDASVVFDGVSRHNTLTWTAKIVSGCRERHFSEVFDDFKEMGMRGVKKDCFTFSSVLKACGRMLNQERCGEQVHVDAIKLGLVSDHYVQCSLIAMYGRCGLLEDAKRVFEMSQEERKVDCWNAMLMGYIQNGLYIEAVKFLYQMQAAGMQPRESLLKKLRMACGSISYSNMN

SEQ ID NO: 181610 - protein, 311 aa, Glycine max
  Coding DNA Sequence Number=SeqID_64832
  Pfam annotation: Domain name=DUF647; Domain location=1-277; Score =133.9; E_value=4.4e-37; Accession=PF04884.5; Description=Protein of unknown function, DUF647
ASTRSCFFAGFAAQRNFAEVIAKGEVQGMASRFIGIGLGIGLGNCIGSSTPLVLASFTVLTWIHMYCNLKSYQSIQLRTLNPYRASLVFSEYLLSGQAPPVKEVNDEEPLFPAVPILNATFANKYFSVQAGEYQAQSIVLSSEAKDAAAEIEHRLQLGSKLSEIVNSKEDVLALFGLYKNEGYILSEYMGKFCVVLKENCSQQDMLKALFQVNYLYWLEKNAGIGGRGTLNDSKPGGRLHISLDYVEREFNHVKNDGELVGWVTDGLIARPLPNRIRIGDTPPSNSLHEEASWTRDVSEIEGNGLFFAIDC

SEQ ID NO: 181611 - protein, 321 aa, Glycine max
  Coding DNA Sequence Number=SeqID_64833
  Homolog annotation: Hit_ID=UPI00004D5348; Match level="QueryCoverage =35%, HitCoverage=25%, E-value=1e-21, Identity=46%"; Hit description =UPI00004D5348 related cluster
  Pfam annotation: Domain name=DUF647; Domain location=161-321; Score= -75.3; E_value=1.4e-08; Accession=PF04884.5; Description=Protein of unknown function, DUF647
  Subcellular localization annotation: CTP_CleavageSite=53; ConfidenceScore=5.42e-01
MGGTCTPFSASFLTSLPLHHRLQPSPPHFAAAVPLCSKQQTPSHTFRLLALPLLSHGNNNNNNNNNNGGSWGNPFDSSDSNSNSHHTLFLSLLCSSALCFFCHLLHAKLAKAKTLSPSTTADTSLFSEPVYEVKGGKWTKLVPDLTNDVFVSAQQGFLSELSSLKVPSQLATFVWLKCSDIFTRLMLPEGFPESVTSDYLEYSLWRAVQGVACQVSGVLATQSLLYAVGLGKGAIPTAAAINWVLKDGIGYLSKIMLSNFGRHFDVDPKGWRLFADLLENAAFGLEMCTPAFPQFFVLIGAVAGASRSAASLIQVMQVFSV

SEQ ID NO: 181612 - protein, 55 aa, Glycine max
  Coding DNA Sequence Number=SeqID_64834
MIDPNFEVERSQFHRVRIDVSDGIEVDMAFDGGRQFEGKTRKTKSWDGVQLGVQK

SEQ ID NO: 181613 - protein, 339 aa, Glycine max
  Coding DNA Sequence Number=SeqID_64835
  Gene Ontology: Mol. function=DNA binding; Cellular component=nucleus; Biological process=chromosome organization and biogenesis (sensu Eukaryota)
  Homolog annotation: Hit_ID=Q9FIR1; Match level="QueryCoverage=75%, HitCoverage=73%, E-value=5e-46, Identity=41%"; Hit description =Similarity to AT-hook DNA-binding protein
  Pfam annotation: Domain name=AT_hook; Domain location=115-127; Score =8.5; E_value=0.79; Accession=PF02178.9; Description=AT hook motif
  Pfam annotation: Domain name=AT_hook; Domain location=81-93; Score =18.9; E_value=0.013; Accession=PF02178.9; Description=AT hook motif
  Pfam annotation: Domain name=DUF296; Domain location=139-255; Score =148.7; E_value=1.5e-41; Accession=PF03479.5; Description=Domain of unknown function (DUF296)
  Pfam module annotation: Pfam domain module=AT_hook::AT_hook::DUF296; Domain location=115-127::81-93::139-255
  Subcellular localization annotation: CTP_CleavageSite=74; ConfidenceScore=5.75e-01
MNSREQPQPQQPPQPQPPNMTVGPTMYPSMLSPVTARFPFSSSSNNNPPPSEPLNNDTNDNDNSAFEALKPCALAASESSKKKRGRPRKYSPDGNIALGLGPTHAPASSADPPAKKHRGRPPGSGKKQMDALGIPGTGFTPHVITAEVGEDIAAKLVAFCEQGPRTVCTLSANGATRNVTIRAPDMPAGTVAYEGPFEIISLKAATLQSDNNRMAALSVSLAGPDGRVLGGEVVGALTAATAVQIVLGSFIADGKKSSSSYLKSGRSLTPSSQMLAFGASRTPTTPTSQGPSTESSEDNENSHFSQGPGGPGLYDNNASQPIHTMPMYQHQLWAGHTQQ

SEQ ID NO: 181614 - protein, 124 aa, Glycine max
  Coding DNA Sequence Number=SeqID_64836
MEEAREEHRDHALGDFEPYPMFTAEEPACSGMPQPNTTGAPQHCPLQPLHFSVGRLPPTVEGREKLDLIKERIRAIEGIGDYPFVDMAELCLVPNVIIPLKFKVPDFDKYKGTSCPKNHLKMYC

SEQ ID NO: 181615 - protein, 323 aa, Glycine max
  Coding DNA Sequence Number=SeqID_64837
  Gene Ontology: Mol. function=microtubule motor activity; Cellular component=microtubule associated complex; Biological process =microtubule-based movement
  Homolog annotation: Hit_ID=Q1SEG1; Match level="QueryCoverage=99%, HitCoverage=24%, E-value=1e-142, Identity=80%"; Hit description=Band 4.1; Unconventional myosin/plant kinesin-like protein/non-motor protein conserved ...
  Homolog annotation: Hit description=region MyTH4; Kinesin, motor region
  Pfam annotation: Domain name=MyTH4; Domain location=175-289; Score =155.8; E_value=1.1e-43; Accession=PF00784.8; Description=MyTH4 domain
  Subcellular localization annotation: CTP_CleavageSite=58; ConfidenceScore=5.12e-01
MTIDVPPSGAQSVRTNRPSFSSSNGIEATPVHNYASVSNGDGYDSDGSNFAPLTPTTLSMAIPSELAGAVPLIDKFQVEGFLKLMHKQIQSAGKRGFFSKRSVGPQVREKFTFEDMLCFQKILEKLTGKLLQDPIPTSMLKLNGDLASRATKLFQIILKYIGVDLSDRVTPISLEEQVELVGKLYKQSLKRSELRDELFVQLSKQTRNSPEREYLIKAWELMYLCASSMPPSKDIGAYLSEYVHNVAYGVTADPEIRALALNTLNALKHSVKAGPRHIIPGPVEIEALLTGKKLTTIVFFLDETFEEITYDMSTTVADAVEVL

SEQ ID NO: 181616 - protein, 94 aa, Glycine max
  Coding DNA Sequence Number=SeqID_64838
MSQLGLLALKGNENGVVSVLVGHVHCIGWCIVGGKPYGKAFLFYPIATYPSAGGRCGAHGCVFQERKMHGVATNVYLRKMLKKLESCGLRTLSV

SEQ ID NO: 181617 - protein, 138 aa, Glycine max
  Coding DNA Sequence Number=SeqID_64839
  Gene Ontology: Mol. function=protein serine/threonine kinase activity; Cellular component=clathrin vesicle coat; Biological process=intracellular protein transport
  Homolog annotation: Hit_ID=Q6ZGX8; Match level="QueryCoverage=100%, HitCoverage=29%, E-value=3e-49, Identity=74%"; Hit description =Putative Clathrin coat assembly protein AP50
MVDAFRTHIMQTKELGTCPVKQIGGCSFFYMRISNVYIVIVVSSNANVACAFKFVVEAVALFKSYFGGAFDEDAIRNNFVLIYELLDEIMDFGYPQNLSPEILKLYITQEGVRSPFSSKGVEGKQLITDIPVQNVTSQ

SEQ ID NO: 181618 - protein, 831 aa, Glycine max
  Coding DNA Sequence Number=SeqID_64840
  Gene Ontology: Mol. function=microtubule motor activity; Cellular component=microtubule associated complex; Biological process =microtubule-based movement
  Homolog annotation: Hit_ID=Q1SEG1; Match level="QueryCoverage=99%, HitCoverage=68%, E-value=0.0, Identity=74%"; Hit description=Band 4.1; Unconventional myosin/plant kinesin-like protein/non-motor protein conserved ...
  Homolog annotation: Hit description=region MyTH4; Kinesin, motor region
  Pfam annotation: Domain name=Kinesin; Domain location=463-778; Score =508.7; E_value=6.8e-150; Accession=PF00225.13; Description=Kinesin motor domain
LQHDYILGNYPIGRDDAAQLSALQILAEIGFVRRPESCAQIAMTRARREWELDILSCYHSLAHVTKEDARQQFLHILRTLPYGFSVFFNVRKIDDPIGLLPGRIILGINKRGVHFFRPIPKEYMHSAELRDIMQFGSSNTAGEEICVALQTHINDVMLRRYSKARSAAGGPLNEDISNDFKPSNLELYEKRVQELSKLVEESQRNADQLLDNLREKQKQEEEMLQELEGLKRSLTAGKQSLAEVTNDRDKLRSLCDEKDKALQAEILEKRSMEAKMAELSNLVTKNTTKKDCTQTNNQVSQKLEDDLKLCKGELRVTEETIKSLRSDKLILEQKLSELEKKSAEEINSLQWKLEQERKTLNSKVYDLERKLDVFRQELTVAESTLSVKDSELAALKNNLDELEELREMKEDIDRKNEQTAAILKMQAVQLAEMELLYKEEQVLRKRYFNTIEDMKGKIRVYCRLRPLSEKEIASKERDSLTTTDEFTVEHPWKDDKPKQHIYDRVFDGDATQEDIFEDTRAMQSAVDGYNVCIFAYGQTGSGKTFTIYGVENNPGLTPCATAELFRILRRDSNKYSFSLKAYMLELYQDTLVDLLLPKNAKRLKLDIKKDSKGMVAVENVTIVSISTMEELNSIIQRGSEQRHTSGTQMNDESSRSHLILSIVIESTNLQSQSTARGKLSFVDLAGSERVKKSGSSGSQLKEAQSINKSLSALGDVISALSSGGQHIPYRNHKLTMLMSDSLGGNAKTLMFVNVSPVESSLDETHNSLMYASRVRSIVNDPSKNVSSKEIARLKKLIGYWKEQAGRRGEDEDLEEIQEERPTKERTDGRHS

SEQ ID NO: 181619 - protein, 151 aa, Glycine max
  Coding DNA Sequence Number=SeqID_64841
  Gene Ontology: Mol. function=protein serine/threonine kinase activity; Cellular component=clathrin vesicle coat; Biological process=intracellular protein transport
  Homolog annotation: Hit_ID=Q6ZGX8; Match level="QueryCoverage=76%, HitCoverage=26%, E-value=4e-54, Identity=88%"; Hit description =Putative Clathrin coat assembly protein AP50
  Pfam annotation: Domain name=Adap_comp_sub; Domain location=1-117; Score=82.6; E_value=1.2e-21; Accession=PF00928.11; Description =Adaptor complexes medium subunit family
  Subcellular localization annotation: CTP_CleavageSite=27; ConfidenceScore=5.05e-01
MFALGVVVKIPVPKHTAKTSFTVTSGRAKYNASIDCLVWKIRKFPGQTEPTLSAEIELISTMTEKKSSTRPPIQMEFQVPMFTASGLRVRFLKVWEKSGYNTVEWVRYITKAGSYELLPEKDKCGSDSNTIPAHNMPKRIVNKPTYLRDYE

SEQ ID NO: 181620 - protein, 649 aa, Glycine max
  Coding DNA Sequence Number=SeqID_64842
  Gene Ontology: Mol. function=protein phosphatase type 2C activity
  Homolog annotation: Hit_ID=Q1S8C9; Match level="QueryCoverage=99%, HitCoverage=76%, E-value=0.0, Identity=57%"; Hit description=Protein phosphatase 2C, putative
  Pfam annotation: Domain name=PP2C; Domain location=183-613; Score= -12.8; E_value=3.4e-05; Accession=PF00481.12; Description=Protein phosphatase 2C
  Subcellular localization annotation: CTP_CleavageSite=43; ConfidenceScore=5.13e-01
SAPLGGSVYVKKKRKKSIAGLRKAFQRSLSEKKRPVGRKGKTEAKNERETGSNVQWALGKAGEDRVHVVVSEEQGWLFVGIYDGFNGPDAPEFLMGNLYRALHKELQGLFWELEEPEPEPQPQVQAVEHNEAESHNDWEVEQESNSNSLQGSVKRVTFHAEGTESRRRRLWEFLAEDDDDAEDGLDLSGSDRFAFSVDDALSVSKEGSGGSRRWLILSKLKHGLSRHKEGHGRRLFPWSLGVGAEEKEKVEEENPVAEEEEEEEEKGRGGRKKKVGPVDHELVLRALSRALEMTELAYLDMTDKLIDTNPELALMGSCLLVVLMRDEDVYVMNVGDSRAIVAHYECEEVHASKESGGGADVESSGECIVEENLARDEGGVVLRNEGPAQERRFLEFHTGIHLLLMILHFPIKFYYSSLHEVVRIKNEHPDDNQCIVNDRVKGRLKVTRAFGAGFLKQYTELPTLAMEEMFHATSLFLVWHCCTCPFSSTLRKWNPACLSCLLFKASMHKLLKYCMQMYADLMWNDVVLEMFRNEYIGTAPYISCCPSLRHHRLCPRDQFLILSSDGLYQYLSNQEVVSEVESFMEKFPDGDPAQHLIEELLLRAAKKAGMDFHELLDIPQGDRRKYHDDVTVMVVSLEGRIWKSSGKYP

SEQ ID NO: 181621 - protein, 498 aa, Glycine max
  Coding DNA Sequence Number=SeqID_64843
  Gene Ontology: Mol. function=malate transporter activity; Biological process=response to aluminum ion
  Homolog annotation: Hit_ID=Q9LS22; Match level="QueryCoverage=87%, HitCoverage=91%, E-value=1e-140, Identity=55%"; Hit description =Arabidopsis thaliana genomic DNA, chromosome 5, BAC clone:F10E10
  Pfam annotation: Domain name=UPF0005; Domain location=48-462; Score =494.9; E_value=9.2e-146; Accession=PF01027.11; Description =Uncharacterised protein family UPF0005
MVPKVYAGQEMAVVENENCMMNGKWKKRVHVFGERVMRFPNKAWQTTWKVGREDPRRLIHAFKVGATLCKGLNRGLGTLLAGLLAFLVGYIASASGRVCQAIIIGAAVFSIGALATYMRFIPYIKKNYDYGLVIFLLTFNLIAVSSYRAENVLKIAHDRVYTIAIGCAVCLLMSLLVFPNWSGEDLHNSTVYKLEGLAKSIEACVNEYFYGEIEGSGDMKLSEDPIYKGYKAVLDSKSIDETLALHASWEPRHSRYCHRFPWQQYVKVGAVLRQFGYTVVALHGCLRTEIQTPRSVRAMFKDPCIRLAAEVSKVLIELSNSIRNRRHCSPEILSDHLHEALQDLNTAIKSQPRLFLGPKNRHNQATNMLKIAAEQVGQERHGKTSLSSVKTDSSALLEWKTKRVSVEQTKESERKSLRPQLSKIAITSLEFSEALPFAAFASLLVETVAKLDLVIEEVEELGRLACFKDFIPGDDFVVTCQEPRIDVSQNHLPSHGAD

SEQ ID NO: 181622 - protein, 92 aa, Glycine max
  Coding DNA Sequence Number=SeqID_64844
MMSLMLSDLIVFGQQKRFLACHLTGLSLDNKKWLAAYWWRRVISNALTSVDELRRTLEVVAMRLLPTADHPQAAVVPHPTPADITLSPKGIG

SEQ ID NO: 181623 - protein, 102 aa, Glycine max
  Coding DNA Sequence Number=SeqID_64845
MAFLLDEDSNGAIDQEDLKKCTSNDVLMANSCTTFSVSSCVTQDKNNKDKLNEHLTLFQSNSKGHQNSVLHGCYKCVNFCIFNATILAILVHLSLNKLISYR

SEQ ID NO: 181624 - protein, 120 aa, Glycine max
  Coding DNA Sequence Number=SeqID_64846
MEKFGDRLILFFLDLAFDLSLYAFLGDNIYSFGELLAHPIIRNVSVPKLTRQLPLRDLHELLFLLQQKSWARYGHLHVQLPWLDSFWGHKSGPFLEDPRSLYMVLFFLFLSGSPVEGRKD

SEQ ID NO: 181625 - protein, 146 aa, Glycine max
  Coding DNA Sequence Number=SeqID_64847
MQVDSRSHWSWMFNNILDQREKVRLKQEWNNQIQRDKFSMKTMYNLLMDKSDRILEWIEVTHEPRTWDVELKWAIRETGKKGWKAKLLKLAFTETLYEVWLYRNDEVFKNNVNRNIVDNIIDNIVYRGWMLVGSHEIAMYLSDFLN

SEQ ID NO: 181626 - protein, 121 aa, Glycine max
  Coding DNA Sequence Number=SeqID_64848
  Gene Ontology: Mol. function=oxidoreductase activity, acting on the aldehyde or oxo group of donors, disulfide as acceptor; Biological process=metabolic process
  Homolog annotation: Hit_ID=Q8YTK9; Match level="QueryCoverage=57%, HitCoverage=20%, E-value=5e-13, Identity=51%"; Hit description =Pyruvate dehydrogenase E1 component, alpha subunit
MELNLRLHSKPFNSVKLHIFIKKKVLKANAEKEHYAGRDPITALKKYLFENNLANEQELKTIEKKIDEILEDAVEFADKSPLPPRSQLLENVFADPKGFGIGPDGSYRCEDPKFTQGTAHV

SEQ ID NO: 181627 - protein, 372 aa, Glycine max
  Coding DNA Sequence Number=SeqID_64849
  Pfam annotation: Domain name=SURF2; Domain location=4-282; Score =86.1; E_value=1.1e-22; Accession=PF05477.2; Description=Surfeit locus protein 2 (SURF2)
MATTEETRKKEGSNLLGSPNFTELGNGRFKCLETGHEVLSKDIAFYSHSKKCRLGLIDFALSNNKPPLNMFKQDPLCRSKLICKLTGDNVNKSEEHIWKHMSGKRFLNKLEQEEEEKLLCHGLEGGESLHESKSADGGKKDRMMKKKKNKKNKVKEIDEEKSQVSKSADGAKKDRMKKENNKDKGIEEVISEVRKSSNENSDTEEDFWMPPAGDRWDNDDGGDRWGSESESEQGTEEGDVIVDDVFLIDGDAAEDCKESEELSSRTKRMSIEIGPSSFATRKKKIVKEVLFNDARNKWFLFGDDDNVPLGGGGDGGGELLGKIRRRLRGLGDVASEIEEDREDKIDVERVWSQGLNEGMGNKELLFQNNYQA

SEQ ID NO: 181628 - protein, 275 aa, Glycine max
  Coding DNA Sequence Number=SeqID_64850
  Gene Ontology: Mol. function=nucleic acid binding; Cellular component= ribonucleoprotein complex; Biological process=metabolic process
  Homolog annotation: Hit_ID=Q69UI3; Match level="QueryCoverage=67%, HitCoverage=60%, E-value=4e-35, Identity=38%"; Hit description =Putative RNA-binding protein RNP-D
  Pfam annotation: Domain name=RRM_1; Domain location=100-171; Score =67.8; E_value=3.4e-17; Accession=PF00076.12; Description=RNA recognition motif. (a.k.a. RRM, R
  Pfam annotation: Domain name=RRM_1; Domain location=203-266; Score =21.9; E_value=0.0014; Accession=PF00076.12; Description=RNA recognition motif. (a.k.a. RRM, R
  Pfam module annotation: Pfam domain module=RRM_1::RRM_1; Domain location=100-171::203-266
  Subcellular localization annotation: CTP_CleavageSite=65; ConfidenceScore=5.79e-01
MPPNSNTLFHTHAFVVTPSSSYSSVHTLKLQKPQVKRFVLLFAYPRRSRTFLEPSTSSSSFSPVRKTKEVAEEYVYPPENDDVLEDEEEREKRLGKACEVYVCNLPRSCDAAYLLDMFRPYGTILSIEVCRNAENNESKGCSYVTLGSIHSARNAVAALDGSDVGGCELRVRFSIEMNSRRRSFNKMNSSTKRISYYESPHKLYVGNLAKTVRPEQLRDLFCRFGNIVSARVLRDFNKGTAESMPFSPFNQRQKFVTEFYGRTLIVKEGVERSED

SEQ ID NO: 181629 - protein, 692 aa, Glycine max
  Coding DNA Sequence Number=SeqID_64851
  Gene Ontology: Mol. function=two-component response regulator activity; Cellular component=nucleus; Biological process=two -component signal transduction system (phosphorelay)
  Homolog annotation: Hit_ID=Q2HTB9; Match level="QueryCoverage=96%, HitCoverage=98%, E-value=1e-145, Identity=47%"; Hit description =Response regulator receiver; CCT
  Pfam annotation: Domain name=CCT; Domain location=644-682; Score =76.9; E_value=6.3e-20; Accession=PF06203.4; Description=CCT motif
  Pfam annotation: Domain name=Response_reg; Domain location=32-145; Score=83.1; E_value=8.5e-22; Accession=PF00072.14; Description =Response regulator receiver domain
  Pfam module annotation: Pfam domain module=CCT::Response_reg; Domain location=644-682::32-145
MDELNCAMTTTTTENSNAELVQWERFLPRMVLRVLLVEADHSTRQIIAALLRKCSYTVPDGLKAWETLKKKASELDLILTEVELPAISGFALLSLIMEHDICKSIPVIMMSSHDSVNMALKCMLNGAVDFLIKPIRKNELRNLWQHIITPTQNTTFSPKKLKTASEDNSASNKSNGSVASSKKNNECSERLSEAQSTCTSPIMEAASTYMENMQDVSQDVHCQVMQTHVQSTCASPIFEAESTFVENMQDVPQLESSKLNKIDMVDHEKFAKFERKSAKHNDETEEAARCDKSFELTDLMLEQDCGVAEPETENEDEILKSELGRDNSHVSILHGCNAEQVKPSKGAIDLIATFGNLPKHPNENCSLNGGNTTKFDCETQLELSLRSDFPGSSGKQASESTEESQRLNHSNTSAFSWYSNSKLLQPLFSPPSITSPKVNWLNWDSHECLKLSGNCQYDDSNQNLENMISTVIGQYGLLPVSGVISKLKSEGHGHVFTSVFYAQSGIHPMLSPKPVCQNESSPFPTSTSSQSNPESHCSDQPHDCSNDATCLDQNVKDNTDSDHARHESPAADQSAGNNLCHDAANHVNSSAYGSMDSGNDGHATSAIVSKNTSDGFSDSGCHNYDGFRVTDSHRSSQREAALVKFRLKRKERCFEKKVRYQSRKRLAEQRPRVKGQFVRQHNHPFAEAGGDS

SEQ ID NO: 181630 - protein, 76 aa, Glycine max
  Coding DNA Sequence Number=SeqID_64852
MSPKREDAKDEQPEITEGDVARFETFHGRLDKIKTIKFLLAMQRRYLLIQFFSEFGSCIFKSHINLDMVCPTSAHY

SEQ ID NO: 181631 - protein, 252 aa, Glycine max
  Coding DNA Sequence Number=SeqID_64853
  Gene Ontology: Mol. function=oxidoreductase activity, acting on single donors with incorporation of molecular oxygen, incorporation of two atoms of oxygen; Cellular component=cytoplasm; Biological process=flavonoid biosynthetic process
  Homolog annotation: Hit_ID=Q2Z1Y9; Match level="QueryCoverage=95%, HitCoverage=79%, E-value=5e-80, Identity=59%"; Hit description=2 -oxoacid-dependent dioxygenase
  Pfam annotation: Domain name=2OG-FeII_Oxy; Domain location=140-241; Score=72.7; E_value=1.2e-18; Accession=PF03171.10; Description=2OG -Fe(II) oxygenase superfamily
MWRKISCEEGECKKLREACERWGCLRIINHSIPAILMADMKKVVEALHELPMEIKKRNTEDIAGGDYVGPNAFSPLYEALGLYGLCSSQAMHNFCSQLDASPNQRQIVEAYGLSIHDLAVNIGQKMAESLDLVVADFEDWLFEFKFNKYNFTPEAIGSTGVPIHTDSGFLTILKDDENVGGLEVIKSSGSFVSIPPFPGTFLVNLGDIARVWSNGRFCNLTHRVQCKEGSKRLSIATLMLAPKNRNVEAPAE

SEQ ID NO: 181632 - protein, 498 aa, Glycine max
  Coding DNA Sequence Number=SeqID_64854
  Gene Ontology: Mol. function=protein serine/threonine kinase activity; Cellular component=cell surface; Biological process =protein amino acid phosphorylation
  Homolog annotation: Hit_ID=Q9XIS3; Match level="QueryCoverage=91%, HitCoverage=67%, E-value=1e-179, Identity=68%"; Hit description =Lectin-like protein kinase
  Pfam annotation: Domain name=Lectin_legB; Domain location=2-87; Score= -127.4; E_value=0.093; Accession=PF00139.10; Description=Legume lectin domain
  Pfam annotation: Domain name=Pkinase; Domain location=164-402; Score =164.5; E_value=2.6e-46; Accession=PF00069.15; Description=Protein kinase domain
  Pfam annotation: Domain name=Pkinase_Tyr; Domain location=164-438; Score=127.6; E_value=3.4e-35; Accession=PF07714.7; Description =Protein tyrosine kinase
  Pfam module annotation: Pfam domain module=Lectin_legB::Pkinase::Pkina se_Tyr; Domain location=2-87::164-402::164-438
PLGFEIAPNVTRFHVLWVDYDGDRKEIDVYIAEQPDKDVPIVAKPAKPVLSSPLDLKQVLNKVSYFGFSASTGDNVELNCVLRWNITIEVFPKKNGNGKAYKIGLSVGLTLLVLIVAGVVGFRVYWIRKKKRENESQILGTLKSLPGTPREFRYQELKKATNNFDDKHKLGQGGYGVVYRGTLLPKENLQVAVKMFSRDKMKSTDDFLAELTIINRLRHKNLVRLLGWCHRNGVLLLVYDYMPNGSLDNHIFCEEGSSTTPLSWPLRYKIITGVASALNYLHNEYDQKVVHRDLKASNIMLDSNFNARLGDFGLARALENDKTSYAEMEGVHGTMGYIAPECFHTGRATRESDVYGFGAVLLEVVCGQRPWTKNEGYECLVDWVWHLHREQRILDAVNPRLGNDCVVEEAERVLKLGLACSHPIASERPKMQTIVQILSGSVHVPHLPPFKPAFVWPAMDLSSLASDLTTQTTTTEYTPMSSDTHSMHVQFSDSSSLV

SEQ ID NO: 181633 - protein, 180 aa, Glycine max
  Coding DNA Sequence Number=SeqID_64855
  Gene Ontology: Mol. function=lipoic acid binding; Cellular component =glycine cleavage complex; Biological process=glycine catabolic process
  Homolog annotation: Hit_ID=P16048; Match level="QueryCoverage=99%, HitCoverage=100%, E-value=1e-71, Identity=75%"; Hit description =Glycine cleavage system H protein, mitochondrial precursor
  Pfam annotation: Domain name=GCV_H; Domain location=41-176; Score =230.2; E_value=4.6e-66; Accession=PF01597.9; Description=Glycine cleavage H-protein
  Subcellular localization annotation: CTP_CleavageSite=34; ConfidenceScore=5.16e-01
MALRMWASSTANALKLSSVSRPHLLPPFSFSRCLSSVLDGLKYADSHEWVKHEGSVATIGITDHAQDHLGEVVYVELPEPGGTVSKKSGFGAVESVKATSDINSPISGEIVEVNKKLTETPGLFIYSSYLFFYFSHFKVNSSPYEDGWMIKVKPSDPSELDSLMGPKEYTKFCEEEDASH

SEQ ID NO: 181634 - protein, 94 aa, Glycine max
  Coding DNA Sequence Number=SeqID_64856
MDSKSPSNKASEELSRELLIAISDSLPDKILDSDFVPESKDTDGFARPKGDWHDKFRMERINPDCPVTYLPVPRPSDNWSARIIKGTQLNHGIH

SEQ ID NO: 181635 - protein, 351 aa, Glycine max
  Coding DNA Sequence Number=SeqID_64857
  Gene Ontology: Mol. function=identical protein binding; Cellular component=cellulose and pectin-containing cell wall; Biological process=negative regulation of enzyme activity
  Homolog annotation: Hit_ID=Q1RYB7; Match level="QueryCoverage=97%, HitCoverage=47%, E-value=1e-133, Identity=68%"; Hit description =Protease-associated PA; Proteinase inhibitor I9, subtilisin propeptide
  Pfam annotation: Domain name=PA; Domain location=1-77; Score=41.2; E _value=3.4e-09; Accession=PF02225.12; Description=PA domain
YCVDSSLDKTKAKGKVLVCRHTEYSGESKLEKSKIVKEAGGVGMILIDEANQGVSTPFVIPSAVVGTKTGERILSYINRTRMPMTRISRAKTVLGVQPAPCVAAFSSKGPNTLTPEILKPDVTAPGLNILAAWSPASAGMKFNIVSGTSMSCPHVTGIATLVKAVHPSWSPSAIKSAIMTTDTEHHHSKTNRFVNPSRVLDPGLVYDSNPEDFVAFLCSLGYDERSLHLVTKDNSTCDRAFKTPSDLNYPSIAVPNLEDNFSVTRVVTNVGKARSIYKAVVVSPTGVNVTVVPNRLVFTRIGQKIKFTVNFKVAAPSKGYAFGFLSWKNGRTQVTSPLVVKVAPASHGLVR

SEQ ID NO: 181636 - protein, 231 aa, Glycine max
  Coding DNA Sequence Number=SeqID_64858
  Gene Ontology: Mol. function=identical protein binding; Cellular component=cytoplasm; Biological process=negative regulation of enzyme activity
  Homolog annotation: Hit_ID=Q1RYB7; Match level="QueryCoverage=99%, HitCoverage=30%, E-value=1e-102, Identity=76%"; Hit description =Protease-associated PA; Proteinase inhibitor I9, subtilisin propeptide
MPGVVSVFPNSKRKLHTTHSWDFIGLLDNESMEIHGHSTKNQENIIIGFIDTGIWPESPSFSDTDMPPVPRGWKGHCQLGEAFNASSCNRKVIGARYYMSGHEAEEGSDRKVSFRSARDSSGHGSHTASTAVGRYVANMNYKGLGAGGARGGAPKARIAVYKVCWDSGCYDVDLLAAFDDAIRDGVHIMSLSLGPESPQGDYFDDAVSVASFHAAKHGVLVVASVGNQGNP

SEQ ID NO: 181637 - protein, 64 aa, Glycine max
  Coding DNA Sequence Number=SeqID_64859
  Subcellular localization annotation: CTP_CleavageSite=46; ConfidenceScore=5.14e-01
MFRIAILSPIKFNRQYQSIACLNRCFEVGRARTPVRGSSLLALSPTCMNGSNRIPIVPIPPPQI

SEQ ID NO: 181638 - protein, 71 aa, Glycine max
  Coding DNA Sequence Number=SeqID_64860
MHVFKEENENLKNLFPLGLSNPTMFIIWDGHRQGVAFQTWNRKLTQSNGAGIVEGFGRGNLLLFRDRQGWG

SEQ ID NO: 181639 - protein, 137 aa, Glycine max
  Coding DNA Sequence Number=SeqID_64861
  Gene Ontology: Mol. function=ribonuclease H activity; Biological process=DNA integration
  Homolog annotation: Hit_ID=Q1SYR3; Match level="QueryCoverage=57%, HitCoverage=3%, E-value=7e-28, Identity=74%"; Hit description=RNase H, putative
MSHGRLYQRRIKNAFDKKVRPRKFNEWDLVLKKMSHAVKDIRGKWAPNYEGPFVVKRAFSGGALILTHMDGEELPSPVNSDGQGLLRSTVRSQDKLTAEINQGTWGQMQVGIGSRPTGRCPFPAVSSPGRATPAPKL

SEQ ID NO: 181640 - protein, 232 aa, Glycine max
  Coding DNA Sequence Number=SeqID_64862
  Homolog annotation: Hit_ID=Q67UL5; Match level="QueryCoverage=20%, HitCoverage=11%, E-value=8e-15, Identity=80%"; Hit description =Putative fructokinase
MMQSYPGRALDRRLQVDWARDAREDPRVLMCLKVDFGPMAKYEPTYLCTYSIKHNYLRRFTTPDPHPFSEPSCCSSTILSSPHAHSVPQPQLSIKTKLVPQPFLNLTHTLNSVNHTTQQRQYLNLNLSRTTSDSGGVIALVEIGSTKEEEEDATIKQLRKNLIVKAKLVPSFYYEGPPPKIELKKISEDEISFLTKGEDPYDDAVVHKLFHPNLKLLLVTEGAEGCRRVSKF

SEQ ID NO: 181641 - protein, 83 aa, Glycine max
  Coding DNA Sequence Number=SeqID_64863
MREVIAMLIDAREYVSKSPTSPTSESPLDEDDDISSKDEFVNLIDCFADEVIIEACFGVCINWGVVELVEGWGLILPSITATK

SEQ ID NO: 181642 - protein, 94 aa, Glycine max
  Coding DNA Sequence Number=SeqID_64864
MTKVQKTMLVSACQRLVCLWLTKGADDHKDSPSLDDKGAEDDVSLYVSTGSLAPVMQSYPPRALDRRLQEDWAKDAREGPRVLISLRIDFGPMG

SEQ ID NO: 181643 - protein, 82 aa, Glycine max
  Coding DNA Sequence Number=SeqID_64865
  Subcellular localization annotation: CTP_CleavageSite=23; ConfidenceScore=5.20e-01
MKFQHGIKDHHKPSHRPPLAPPVAMPSVTTRAIVSRHHHLPPTLKPHFSPSLSLTLDPEIHLCVVGEEKERMKTKRRDIFVI

SEQ ID NO: 181644 - protein, 110 aa, Glycine max
  Coding DNA Sequence Number=SeqID_64866
MFTGDKIDEAIHHFLVVLLGIISCILGGPAFAELEALFLLCGGGGGGFEGSGQRPFAELEALSLLCGGGGGGFEGSGQRALWIVNLLGASMNTTLKPKALVSSCFDSHNL

SEQ ID NO: 181645 - protein, 265 aa, Glycine max
  Coding DNA Sequence Number=SeqID_64867
  Gene Ontology: Mol. function=acyltransferase activity; Cellular component=endoplasmic reticulum; Biological process=metabolic process
  Homolog annotation: Hit_ID=Q1RYA6; Match level="QueryCoverage=87%, HitCoverage=61%, E-value=9e-88, Identity=62%"; Hit description =Diacylglycerol acyltransferase
  Pfam annotation: Domain name=DAGAT; Domain location=53-264; Score =155.1; E_value=1.8e-43; Accession=PF03982.3; Description =Diacylglycerol acyltransferase
MAAEPVSDGGAAAEKLISGREEFGDSSNLFSAILAMVLWLGAIHFNIALILLAVFFLPLSKSLLVFGFLFGFMVLPINEKSRFGRRLSRFICKHACNYFPITLHVEDMKAFDPNRAYVFGYEPHSVLPIGIVALADHTGFMPLPKVKVLASSTVFYTPFLRHLWTWLGLTPATKKNFISLLASGHSCILIPGGVQEAFHMQHGTEIAFLKARRGFVRVAMVKGKPLVPVFCFGQANQSDFLLWMKFISDALAPIGDPTLSLLLIT

SEQ ID NO: 181646 - protein, 101 aa, Glycine max
  Coding DNA Sequence Number=SeqID_64868
MKNQLIYEQNLPIPHDNLIRSTQGSALNWVAWDRYDMMGGAKVKNPDTKCEPQSQLVRPVTIVEMQQLIACDFGQHFYNTGVKEQLQTMERGIGHGMKALR

SEQ ID NO: 181647 - protein, 85 aa, Glycine max
  Coding DNA Sequence Number=SeqID_64869
MEFEPLSLSNKSNFGREESNFLLYLYKPNFIILQLCPCMALVSPVVMAKPATLHMQARVSPMVMVKSMVDSGMSTCHAWAWCKDA

SEQ ID NO: 181648 - protein, 560 aa, Glycine max
  Coding DNA Sequence Number=SeqID_64870
  Gene Ontology: Mol. function=DNA binding; Cellular component =intracellular; Biological process=regulation of transcription
  Homolog annotation: Hit_ID=Q69XV5; Match level="QueryCoverage=71%, HitCoverage=73%, E-value=1e-32, Identity=47%"; Hit description=DNA -binding protein-like
  Pfam annotation: Domain name=ARID; Domain location=221-312; Score =5.6; E_value=4.3e-05; Accession=PF01388.11; Description=ARIDBRIGHT DNA binding domain
MSDAKENEVASQGMPSVVEENQQLVDAEVQDQPETASAPVPVEETSNHVEITKEEPRAEDKNAELEAVSEGIPQEDVQNTLLYVPVESDAQILDRTESEEASVAKVEADELAQNNKEAENNDDVHQNSNGNVEMALEVKPEACGMADSKACDNGDPVPASHNELATHLPAPADTNTEIMNVLEVENKADEKQATEPADNGKSNSKYMLFLDADHSYDGNESGTEEEQSAFMKELENFFRERSMEFKPPKFYGEGLNCLKLWRAVTRLGGYDKVTSCKLWRQVGESFKPPNFDMRASPGAAVKLCLGDLLVMGSNPETASLHMQGSLSSTYAGHVPLSHGLFGDFMRSLYLCFDDVPLKLTNNDIHAMTLLEKISYHLHSFLVPLNFILTYYLAALLDYERHKIKGGELNVPVASHPEPINIENQASVSGRARRDAAARAMQGWHSQRLLGNGEVSDPIIKDRNSVSVQKREKQLKSINIHKRKKPSSPYMDNAVKAARSKPSKPQLRSGCFIFNIAFLKDCFEVYALVPGLLREEHIIFAISPLPLRGSCNMGDRQKSWQ

SEQ ID NO: 181649 - protein, 1103 aa, Glycine max
  Coding DNA Sequence Number=SeqID_64871
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=79%, E-value=0.0, Identity=43%"; Hit description =Integrase, catalytic region
  Pfam annotation: Domain name=rve; Domain location=540-700; Score =156.7; E_value=6.1e-44; Accession=PF00665.16; Description=Integrase core domain
  Pfam annotation: Domain name=zf-CCHC; Domain location=246-263; Score =12.1; E_value=0.01; Accession=PF00098.13; Description=Zinc knuckle
  Pfam annotation: Domain name=zf-CCHC; Domain location=282-299; Score =14.0; E_value=0.0048; Accession=PF00098.13; Description=Zinc knuckle
  Pfam module annotation: Pfam domain module=RVT_2::Retrotrans _gag::rve::zf-CCHC::zf-CCHC; Domain location=904-1103::77-192::540 -700::246-263::282-299
MNEASINNTESYLYLHPSENPAIALVSPVLDSTNYHSWSRSMVTALSAKNKVEFIDRSAPEPLKTDRTYGAWRRCNNMVVSWIAHSVATSIRHSILWMDKAEEIWRDLKSRYSQGDLLRISDLQQEASTMKQGSLSVTEYFTRLRVIWDEIENFRPDSVCSCNIRCSCAAFTIIAQRKLEDRAMQFLRGLNEQYANIRSHMLLMDPIPAISKIFSYVAQQERQLLGHAGPNINFEPKDISINATKTTCDFCGRIGHVESTCYKKHGVPASYDGRNKNNNGRKTCTHCGKFGHIVDVCYRKHGYPPGYKPYSGRTTVNNMITMEDKAANDQAQQHGSQEVVHFSPEQYKALLALIQQPSAGSTAQSKQVASVSSCTVNTPLNPVKLPNGNLVHATHTGTVHLSPNLILHNVLYIPTFTFNLISISKLVSSNNYELIFSSTSCILQKANNHMKIGIVEARHGLYHLIPNQITTKAIYSTITHPSCSIIPIDLWHFRMGHPSNERLQCMKNYYPLLSNDNNFVCNTCHYAKHKKIPFSSSNSHASHSFDLLHMDIWGPCSKLSMHGHKYFLTIVDDHSRFTWIHLMKSKAETRHIIINFIVFIERQYNGKVKTIRSDNGVEFLMHEYYASKGIVHQTTCIETPEQNGIVERKHQHLLSVTRALLFQANLPPAFWCYALPHAAFLINCIPTPFLNNISPYEKLHKHPCDISNLRVFGCLCYINTIKANRQKFDPRAHPCIFIGFKTHTKGYLVYDLHSHDVTVSRNVTFYENHFPYLPNTQHLNLDNTIPSPSLTSFSGKDHDQPEESHSSQPTKPIHSCDEHSTKPDPSHLRRSTRSRHSPTYLQDYHRVLASSTPEASVIVRYPLSSVLSYSRLSPAHRNFVMTISSATEPSSYAEASRHDCWVKAMKAELQALQMNNTWRLTRLPPHKVAIGCRWIYKIKYRADGSIERYKARLVAKGYTQMEGLDYLDTFSPVAKLTTVRVLLALAAQNHWHLRQLDVNNAFLHGELEEEVYMQIPPGLEVENPKLVCRLQRSLYGLKQASRQWFTKLSSFLVSHGFQQSNSDHSLFLKLTKSATTILLVYVDDIILTGNSMLEIQDITTLLD

SEQ ID NO: 181650 - protein, 251 aa, Glycine max
  Coding DNA Sequence Number=SeqID_64872
  Gene Ontology: Cellular component=integral to membrane
  Homolog annotation: Hit_ID=Q1RYA5; Match level="QueryCoverage=90%, HitCoverage=52%, E-value=8e-54, Identity=51%"; Hit description=Auxin Efflux Carrier
  Pfam annotation: Domain name=Mem_trans; Domain location=9-242; Score =1.4; E_value=1.3e-07; Accession=PF03547.8; Description=Membrane transport protein
MGLVELFGVASMPVIKVLLITAVGLLLALDNVNLLGKDARIQVNHLVHYVFNPALVGGNLADTITFENVVLLWFMPVNILLTFIIGSALGWILIKLTRAPKHLEGLIMGVCSAGNLGNLPIIIIPAICKDKGSPFGDSNVCYQYGMAYASLSMAVGAVYIWTYVYNIMRVSASVVPKDAYRTSSFRLEASGEFLEFLPEEESSEPENPSKDNMDDYTLLLSSIESEENVKVATDNPITPFKRYLVLIKGKS

SEQ ID NO: 181651 - protein, 142 aa, Glycine max
  Coding DNA Sequence Number=SeqID_64873
  Subcellular localization annotation: CTP_CleavageSite=36; ConfidenceScore=5.33e-01
MGHMSYNRVSSGRGSSSCHGKCRGFRLNLRRLYFLRLRKRFTFLLRLFDMWKLSYSQALQLLKKVLRRKSGFKRNYSNSSRSGLVRDERIKGHADCRVSSYGRNNSFYAEAIADCLEFIKRTSISSMDQIQDPVCHIQDRNS

SEQ ID NO: 181652 - protein, 451 aa, Glycine max
  Coding DNA Sequence Number=SeqID_64874
  Gene Ontology: Mol. function=oxidoreductase activity; Cellular component=anchored to membrane; Biological process=electron transport
  Homolog annotation: Hit_ID=O24093; Match level="QueryCoverage=74%, HitCoverage=63%, E-value=1e-138, Identity=67%"; Hit description=L -ascorbate oxidase precursor
  Pfam annotation: Domain name=Cu-oxidase; Domain location=216-383; Score=224.1; E_value=3.1e-64; Accession=PF00394.12; Description =Multicopper oxidase
  Pfam annotation: Domain name=Cu-oxidase_3; Domain location=112-210; Score=99.2; E_value=1.2e-26; Accession=PF07732.5; Description =Multicopper oxidase
  Pfam module annotation: Pfam domain module=Cu-oxidase::Cu-oxidase_3; Domain location=216-383::112-210
  Subcellular localization annotation: CTP_CleavageSite=77; ConfidenceScore=5.50e-01
MVTVLFTTTIGNLNGSAVRGRAVLISTMSLQIHTSSSARDMVSLDKSRASFSSQVFHSLGTQRKITLCLSPTSGVVQLGKVVHESQPGSEIFRSLILTELSLGGRVRHYKFDVEYMIRKPDCLEHVVMGINGQFPGPTIRAEVGDILDIALTNKLFSEGTVVHWHGIRQALVGTPWADGTASISQCAINPGETYHYRFTVDRICQRDKTNRFHYDGEFNLLLSDLWHTSSHEQEVGLSTKPLKWIGEPQTLLINGRGQFNCSLASKFINTTLPQCHLKGDEECAPQILDVEPNKTYRIRIASTTSLAALNLAISNHKLVVVEVDGNYVTPFAVDDMDIYSGESYSVLLHTNQNPNKNYWLSIGVRGRKPNTPQGLAILNYKTISALIFPTSPPPITPLWNDFEHSKAFTKKIIAKMGTPQPPEHSDRTQYSSSTPKIELMGLPNGPLIMYP

SEQ ID NO: 181653 - protein, 84 aa, Glycine max
  Coding DNA Sequence Number=SeqID_64875
MKLNHQPDIGKKFEVEHAWLLLKDELKFDAKFMSKYSKRRKVFAGGNYSSSSNPENPIEGEEYDTSSPMPYPIGQKVAKKKSKG

SEQ ID NO: 181654 - protein, 58 aa, Glycine max
  Coding DNA Sequence Number=SeqID_64876
MGMIIGWWARSSSAVAWRATGCHSGGNWSELRKDGGREEGGFWQEYVLLQDFRVEEGL

SEQ ID NO: 181655 - protein, 543 aa, Glycine max
  Coding DNA Sequence Number=SeqID_64877
  Gene Ontology: Mol. function=hydroxymethylglutaryl-CoA reductase (NADPH) activity; Cellular component=integral to membrane; Biological process=lipid metabolic process
  Homolog annotation: Hit_ID=Q1RY98; Match level="QueryCoverage=93%, HitCoverage=92%, E-value=0.0, Identity=75%"; Hit description =Hydroxymethylglutaryl-coenzyme A reductase, putative
  Pfam annotation: Domain name=HMG-CoA_red; Domain location=140-533; Score=1034.3; E_value=0; Accession=PF00368.9; Description =Hydroxymethylglutaryl-coenzyme A reductase
MEVRRRVLRPAPAGEPLKPKQDPHPHSQQQSYLTNAVFFGLFFSLAYFLLHRWREKIRTSTPLHVVTLSEMAAIVSLIASFFYLMAFFGITFILHPFLNYRSSPEDDLDLHIPKPVPTPSCPAALPHHDEDIILAVVSGSIPSYSLETRLDDTRRAALIRRKAVEHITGRSLEGLPVEGFDYDSILGQCCEMPIGFVQIPVGVAGPLLLDGKEYTVPMATTEGCLVASTNRGCKAIHVSGGASSMLLRDAMTRAPVVRFNSAKRASQLKFYLEDPLNFDSLAVVFNKSSRFARLQDIKAAIAGKNLYIRFSCTTGDAMGMNMVSKGVQNVLTFLQSDFPDMDVIGISGNFCSDKKAAAVNWIEGRGKSVVCEAVIKEEVVKKVLKTSVEALVELNMLKNLTGSAMAGALGGFNAHASNIVSAVYLATGQDPAQNVESSHCITMMEAVNDGKDLHISVTMPSLEVGTVGGGTQLASQSACLNLLGVKGASKESPGANSRLLATIVAGSVLAGELSLMSAIAAGQLVNSHMKYNRSSKDITKIGS

SEQ ID NO: 181656 - protein, 234 aa, Glycine max
  Coding DNA Sequence Number=SeqID_64878
  Homolog annotation: Hit_ID=Q5PHP7; Match level="QueryCoverage=45%, HitCoverage=64%, E-value=3e-48, Identity=88%"; Hit description=Thiol peroxidase
  Pfam annotation: Domain name=MR_MLE_N; Domain location=116-224; Score= 107.7; E_value=3.3e-29; Accession=PF02746.6; Description=Mandelate racemase  muconate lactonizing enzyme, N-terminal domain
GGQGDHIAQALCAAETGLRERQVSGDAQHHGVVQLRSQLVEFANRCRADAGIDAWENIQYFTFTSVLAQRDVREIFGDQRKRLRLRASLRNGALNGHWVTLEMYGLRHGYLPAQGMRNLRVFEESWPLHTPFVISRGSRSEAKVVVVEIEEDGVKGAGECTPYPRYGESIASVMAQIMAIGEQLERGATREQVQQLLPAGAARNAVDCALWDLEARRAGKTLPGSLASICRAKS

SEQ ID NO: 181657 - protein, 308 aa, Glycine max
  Coding DNA Sequence Number=SeqID_64879
  Gene Ontology: Mol. function=chitin binding; Cellular component =extracellular region; Biological process=chitin metabolic process
  Homolog annotation: Hit_ID=UPI000044A8F0; Match level="QueryCoverage =48%, HitCoverage=99%, E-value=2e-26, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LQVLPSDDYTSSPSEGSTPSPSEDYTSSPSEDYTPSPSEDYMSSPSEDYTPSPLEGYTPSPSEDYTSSPSEGCTPSPLEGYTPSPSEDSTSPPLEDCTPSPLEGYTPSPLEDYTSFPLEGYTPSSLKGYMPLPSEGYTSSTLEGYTPSPLEGYTFSPLEVPWPPPDPGGGPTVRAQPKREAIMQLLYMPGEDFAQTATGRRVWIMRTTTTLISPYRIGSHPQDTQWTRRSPIGPWGFRLWSWASVNPTGCLSPPARSCHRDIGKNCARKTPSGPGEFQQGPGVSSSDYGPLLVLWSARRPQQGHQAPY

SEQ ID NO: 181658 - protein, 106 aa, Glycine max
  Coding DNA Sequence Number=SeqID_64880
MKDKRDEEEKLENQNKKKDSKASSSKAKGKEKEEKDSSKKIVKKENHFATKCDIKKALLFKQYFYLLLSREHPLASPYILSLRYYEAPNSYDRWYDECVEWCNPLL

SEQ ID NO: 181659 - protein, 139 aa, Glycine max
  Coding DNA Sequence Number=SeqID_64881
MNSNSENSNVTEFSLSETLALSEQIETAKEEHNCLRQLHFHSYNCISFHLLFALFITLLAFHCPLYSCNSKWPQRRDVLHPLDHRSLMTHLDLCQRQLGSDTRRTYIIGTSSQRGTWSWHTPIMVSSSGSWRDANGTGT

SEQ ID NO: 181660 - protein, 157 aa, Glycine max
  Coding DNA Sequence Number=SeqID_64882
MLRSIHQGKIILLQSLQLIAPPDSIPTVEQFNEWVAWSGTQPPPHRDDEDPAAQVPHQPTDESLESSTPEPLIRKRRVVVTQEAAATPEKSPEAIPEPLAPKADTTSPQQAADPSTLEVQTTPVLSPNTSPVDTHVLHLTNKEEVQTQDTHDQSQDF

SEQ ID NO: 181661 - protein, 124 aa, Glycine max
  Coding DNA Sequence Number=SeqID_64883
MKLASTRPLVKQVELASGIVPSSVIASSAGEKGHPASEVGPIVVVVEVTPSTSSYVLPLAPPTVEAPTADVTHVTPVVTPATLAHSPPPAIVVQEVAPAATEVVAPSTKADSVVVRPPSLRPLC

SEQ ID NO: 181662 - protein, 641 aa, Glycine max
  Coding DNA Sequence Number=SeqID_64884
  Gene Ontology: Mol. function=metal ion binding; Cellular component =intracellular
  Homolog annotation: Hit_ID=Q8S9K3; Match level="QueryCoverage=99%, HitCoverage=73%, E-value=1e-114, Identity=42%"; Hit description=Zinc finger protein VAR3, chloroplast precursor
  Pfam annotation: Domain name=zf-RanBP; Domain location=74-103; Score =36.1; E_value=1.2e-07; Accession=PF00641.9; Description=Zn-finger in Ran binding protein and others
MKFLLSYASNPFFSSEGNSLNKRDLVESSVRNLFGELFKLNYSAPGPNAFDSVQSQMAGRFGLTKPPGQKIEMKRGDWLCPRCNFMNFARNIKCLECEEARPKRQLAGGEWECPQCDCKRPGQISLGATNTMPNMGYENGNNPNTSDIDARLAANEEKAQRWFSKVSQLDSSADINSVMADEDFPEIMPLRKGVNRFVVSTRKTPLERRLANAQYKRNLSNNDIPGIEDSKAGEPIKSHDNLDEMLRRSGGLPQFDNNNFVDEQNASGDSHPSFASNTSHFNNVKGSYTSTVPPIPLSADALSQKSENLLAEESKKVVLDADVGYARLGDCSQLSNNSTSQNITEEDKEKEQGEKSERWFRKVAELNDFPDIPSAISDEDFPEIMPMRKGENRFVVSKKKDRSLTTPAYKRLAAMEQSGKTNFVPFVPFPPDYFAKKDKQQEDGTDSSVADATALTDRADDDTSFISEVVQQPPEMSVDARAQRGQSPNPSEQSSNNNDVGSMYGATTSGNSRQSFNQDQVPNLTGSSSPEPASETQSGRAEWTRKSLEGSAVKEPDPLDMSEEAKAERWFRRIAQIKDISELSQIPDEDFPSIMPMRKGVNRFVVSKRKTPLERRLTSQQYRRNLPTASSDPIKKENEGS

SEQ ID NO: 181663 - protein, 57 aa, Glycine max
  Coding DNA Sequence Number=SeqID_64885
MDFLQAPENQILVGVAVAVVAIGLGAVYLYSSKKRKGIVQQNYMVRTQSPSLITVNV

SEQ ID NO: 181664 - protein, 89 aa, Glycine max
  Coding DNA Sequence Number=SeqID_64886
  Gene Ontology: Mol. function=cytochrome-b5 reductase activity; Cellular component=cellulose and pectin-containing cell wall; Biological process=electron transport
  Homolog annotation: Hit_ID=Q8W2K4; Match level="QueryCoverage=90%, HitCoverage=29%, E-value=2e-38, Identity=87%"; Hit description =Cytochrome b5 reductase isoform II
  Pfam annotation: Domain name=NAD_binding_1; Domain location=1-74; Score=-0.1; E_value=0.0022; Accession=PF00175.11; Description =Oxidoreductase NAD-binding domain
MTLMEGAFEELDGLASNYPDRFKIYYVLNQPPEVWDGGEGFVSKEMIQTHCPAPAQDIKILRCGPPPMNKAMAAHLEALGYAPEMQFQF

SEQ ID NO: 181665 - protein, 379 aa, Glycine max
  Coding DNA Sequence Number=SeqID_64887
  Gene Ontology: Mol. function=transferase activity; Cellular component= membrane
  Homolog annotation: Hit_ID=Q5BM99; Match level="QueryCoverage=92%, HitCoverage=66%, E-value=7e-99, Identity=55%"; Hit description =Secondary cell wall-related glycosyltransferase family 47
  Pfam annotation: Domain name=Exostosin; Domain location=127-379; Score=104.0; E_value=4.4e-28; Accession=PF03016.6; Description =Exostosin family
  Subcellular localization annotation: CTP_CleavageSite=42; ConfidenceScore=5.53e-01
MVERTVSGSAIKVVSKKSLCGFFTMTTLLFMLSWLFVLRSTRSEASPNSNLFSSYSNSDFDHSVQQQKNVEEEVEPSFGNRAILVDNIEAAAAATTTTTTTTHDDKQQVLEEQGVKCKAHDKAVLRVFMYDLPPEFHFGLLDWKPEENVNNVWPDIKTKAPHYPGGLNLQHSIEYWLTLDLLASELPESEAPSNARSVIRVRNSSEADVIFVPFFSSLCYNRLSKTGPHEKRSRNKLLQEKLVKYVTAQEEWKRSGGKDHVILAHHPNSMLDARMKLWPGTFILSDFGRYPTNIANVEKDVIAPYKHVVGSYDNDQSSFDSRTTLLYFQGAIYRKDLHNCKQILDVGTFKEKKVKRQELWFTDKPEIQIVCLVNHLQAL

SEQ ID NO: 181666 - protein, 72 aa, Glycine max
  Coding DNA Sequence Number=SeqID_64888
  Subcellular localization annotation: CTP_CleavageSite=18; ConfidenceScore=5.32e-01
MVPSYRSRLSGFQPRGMSTFMIQSTKRCRQLVCPPLAFSTPTHGVAPSLQCDFGVSGEYQYLAWLLKEELSF

SEQ ID NO: 181667 - protein, 148 aa, Glycine max
  Coding DNA Sequence Number=SeqID_64889
  Gene Ontology: Mol. function=transferase activity; Cellular component= membrane; Biological process=metabolic process
  Homolog annotation: Hit_ID=Q5BM99; Match level="QueryCoverage=99%, HitCoverage=29%, E-value=2e-61, Identity=75%"; Hit description =Secondary cell wall-related glycosyltransferase family 47
  Pfam annotation: Domain name=Exostosin; Domain location=1-84; Score= -85.2; E_value=0.0011; Accession=PF03016.6; Description=Exostosin family
MRSSKFCLNIAGDTPSSNRLFDAIASHCVPVIISDDIELPYEDVLDYSQFCIFVRTRDALKKRYLINFIRSIGKEEWTRMWNRLKEVESFFEFQFPSKEGDAVQMIWKAIARKVPFMKLKTNRSRRFLRSLYGNDMGNKSITTPANFW

SEQ ID NO: 181668 - protein, 725 aa, Glycine max
  Coding DNA Sequence Number=SeqID_64890
  Gene Ontology: Mol. function=DNA binding; Cellular component=beta -galactosidase complex; Biological process=DNA integration
  Homolog annotation: Hit_ID=Q1SDN3; Match level="QueryCoverage=78%, HitCoverage=45%, E-value=1e-127, Identity=42%"; Hit description =Polynucleotidyl transferase, Ribonuclease H fold
MVDTCYKKHGYLPHLHRGGVINQYSMDDQEIEDDLQSLGQKKVSVDASFVAFTPKQHKALISLLQQTSQAPPSHTINQFVSYHKNDNSVSKLIANLHCCLNFHPTGCSIQDNSSLKTIGAAELRASLYILSSPTTQFSYNCNINIIPSNKCNVWHNSHSPPSADSTQPIKPVPPSSPYDFLLDMPHPPDPSPPEIPISNPPLDPHHQSALPQSSPHRSQRQKQPPSYHKDYHYSLTSATTHNSISPVSSTIRYLISNYISYLKLSHHHKHFTLNLTPLPPNKKPIGCKWVFKVKFKADGSIDKHKARLVTKGFTQTAGLDYIETFSPVVKMTTVRLVLSLAASQGWHLHQLDVNTAFLHGDLNEKQANRQWNAKLTSTLLDSRFQQSKVDYSLFTKRSPIGLTIVLVYVDDLVFTGTDLAEIQQLKHSLDAKFSIKDLGMLKYFLGFEVARSNSIIPLYQRKYCLDLLQDIGLLAAKPCSTPMDPTLKLHKSSGVPFSDPTVYRRLVGRLLYLTHTMPDICYAVGRLSQYLQSPVDIHMQAAQHTLKYLKENAGKGLFFSSSSSTSLTGFSDSDWGACPDTRRSITDLCFFLGTSLISWKSKKQSIVSRSSSKAKYRALTQASYEAKCLLFLLKDLHIEYPKPVVLYCDNQAALHIAANPVFHERTKHIEMDCHVVRDKVQSGMIHLLPISTYEQLTDILTKSLHVDLFNHIHSKLGMLDIHIPA

SEQ ID NO: 181669 - protein, 42 aa, Glycine max
  Coding DNA Sequence Number=SeqID_64891
MEKGFKYEFENFVPLLTLNRTYIARYGSVIIQKASAQSARNA

SEQ ID NO: 181670 - protein, 97 aa, Glycine max
  Coding DNA Sequence Number=SeqID_64892
  Gene Ontology: Mol. function=oxidoreductase activity; Biological process=metabolic process
  Homolog annotation: Hit_ID=Q1S070; Match level="QueryCoverage=50%, HitCoverage=19%, E-value=4e-12, Identity=65%"; Hit description=Short- chain dehydrogenase/reductase SDR
MKGGGRTVLITGVGNGWEEPWLSNSPIEVTLTLTLTLTLITAVIALNPGVINADMLASCFGASASLYQPPQAWALKAATMILNLTPAHNGASLTVST

SEQ ID NO: 181671 - protein, 317 aa, Glycine max
  Coding DNA Sequence Number=SeqID_64893
  Pfam annotation: Domain name=F-box; Domain location=1-54; Score=20.3; E_value=0.0067; Accession=PF00646.23; Description=F-box domain
MCWLLLPDELWRRILEIGIESNGFSYKDLCCVSISCRRLHRLSSEEPLWNRLLFSDYPQSQSHPSSSSSSSSSKSLYRLRFERDKERRIAAHRRAVLRKESQVAEHSRRLKDMKTRLAQETTKATQTAQDLSNLRRLRQAFVALNVWQPEVVRGRQKQMVEQSVVPAECRIHALEMEFKLCKQQILGLEKSYVHWVVTYTKLYQKDEKRRLDTAKEELASMKYHPVQEHKPTSGGENEHVKRKKLKICNSCESLTRIPPNITRKMKQNNIYGYASCNHSLVVGANDMEDVALDDEQCSRQMNFAGLSSIETGNLFLP

SEQ ID NO: 181672 - protein, 278 aa, Glycine max
  Coding DNA Sequence Number=SeqID_64894
  Gene Ontology: Mol. function=sequence-specific DNA binding; Cellular component=nucleus; Biological process=regulation of transcription, DNA-dependent
  Homolog annotation: Hit_ID=Q6X7J3; Match level="QueryCoverage=93%, HitCoverage=91%, E-value=9e-47, Identity=41%"; Hit description =WUSCHEL-related homeobox 11
  Pfam annotation: Domain name=Homeobox; Domain location=29-90; Score =47.0; E_value=6.3e-11; Accession=PF00046.19; Description=Homeobox domain
CIGMEDQGQQQQQQEAKSPRQGTERSEAVRSRWTPKPEQILILESIFNSGMVNPPKDETVRIRRLLEKFGAVGDANVFYWFQNRRSRSRRRQRQMMQQAAAAAAATTIDHPQAQAQTLVGGAIPLDHTTQGNLVVASSATSTMGFGCSSSPSYAFLGSSSSSCGGGVIGGHQQGMEGFFSVSSQMGFPDHHTSPASSAFYPPLDPNLTYQAGYGGTNISGFITVFLNGIATELPKGPIDLKTVFGEDVMLVHSSGVPVPTNEFGFLMQNLRHGESYFL

SEQ ID NO: 181673 - protein, 130 aa, Glycine max
  Coding DNA Sequence Number=SeqID_64895
  Homolog annotation: Hit_ID=Q1SUM5; Match level="QueryCoverage=39%, HitCoverage=48%, E-value=2e-11, Identity=55%"; Hit description =Polynucleotidyl transferase, Ribonuclease H fold
MVMRSEFTLVIFTDCGVSNYARVRCCFTGYFKCNVDAALFNHQQCFGIDMCIRDERGQFIKAKTALHNGIPEPREAEAWGLMQLDHFIPSVPNSIPNFLKSQDLKLALEEAIARWMVDDYEVDCMPKLKE

SEQ ID NO: 181674 - protein, 385 aa, Glycine max
  Coding DNA Sequence Number=SeqID_64896
  Gene Ontology: Mol. function=hydrolase activity; Cellular component =integral to membrane; Biological process=intracellular signaling cascade
  Homolog annotation: Hit_ID=O64668; Match level="QueryCoverage=99%, HitCoverage=100%, E-value=3e-81, Identity=49%"; Hit description =Presenilin-like protein At1g08700
  Pfam annotation: Domain name=Presenilin; Domain location=1-382; Score= 56.0; E_value=2.2e-18; Accession=PF01080.8; Description=Presenilin
MESSVLEWLGVEIIGVMSPVSICMFLVVLLVYSLSSPSTTATTIATAANLVYAENPSDTAAQKLEGAVLNAVVFIVFIALATFLLVLLYYYNCTAFLLHYTRFSTFFVLAAMGGSILLSLLERFSVPLDAVTSFLLLFNFAVVGVLSVFAGGGLPILLRQCYTVCLGIIVAAWFTKLPEWTTWTVLVALALYDLVAVLAPGGPLKLLVELESSRNEELPALVYEARPTVNTRNHAAAVGFIVAGVSDSETSRIELQVVSRVNSNNNNNLSSNNDNGENGINDEWERSPLVGGMRFGEVVVDEGMSPLVEMSGVGENEEEGEGVRRKIGERGIKFGLGDFVFYSVLVGSASPSDFDRIGGSVLLFDKAAHGALHCWDCDQFDDVLR

SEQ ID NO: 181675 - protein, 439 aa, Glycine max
  Coding DNA Sequence Number=SeqID_64897
  Gene Ontology: Mol. function=hydrolase activity; Cellular component =integral to membrane; Biological process=intracellular signaling cascade
  Homolog annotation: Hit_ID=O64668; Match level="QueryCoverage=88%, HitCoverage=93%, E-value=1e-109, Identity=53%"; Hit description =Presenilin-like protein At1g08700
MPSTTNFLSTSHICQKVQGRHLIKITIHLVLEFTDSRAKGREEAIPKPYLSKHHQIGRSPNNEGLHEQPCQKVEQNPQCDRNRKGWQSLPAHGQQNERAAKPRNNGEVARIHSHQIIHSRSTHKNTVENKVPKSKLNPSFTNLPPHPFPFLLIFPHTTHLNKWRHSLINNNLTKSHSTNQRRPFPFIVNPILPIIIVTTQIVIIITINPRHYLKLNSGSFGIRNPGDDKPNRRGVVSRIHRRPCLVDQRRELLVAARLQFDEELERAAGSEDGYQVVERERDEDRPRGPLGKLGEPRGNDDAEADRVALAEQDREAAAGKDGEDSDDGEVEEEEKGGDGVEGDGEAFQEGEEDGSAHGGEDEEGGEARVVEEEGGAVVVVEEDEEEGCERDEDDEDDGVEDRALELLRGGVGGVLSVDEVGGGGDGGGGGGRRGEGVHQ

SEQ ID NO: 181676 - protein, 244 aa, Glycine max
  Coding DNA Sequence Number=SeqID_64898
  Gene Ontology: Mol. function=hydrolase activity, acting on glycosyl bonds; Cellular component=cellular_component; Biological process =lipid metabolic process
  Homolog annotation: Hit_ID=Q9FXE5; Match level="QueryCoverage=79%, HitCoverage=52%, E-value=8e-75, Identity=68%"; Hit description=Alpha- L-fucosidase 2 precursor
  Pfam annotation: Domain name=Lipase_GDSL; Domain location=40-238; Score=102.9; E_value=9.7e-28; Accession=PF00657.12; Description=GDSL- like LipaseAcylhydrolase
MNMNMNMNTKSRLITLWVVLYFCSITNSLAASKQCHFPAIFNFGDSNSDTGGLSAAFGQAGPPHGESYFHHPAGRYCDGRLIVDFLAKKLGLPYLSAFLDSVGSNYSHGANFATAGSTIRPQNTTLHQTGGFSPFSLDVQFNQFSDFQRRTQFFHNKGGVYKTLLPKAEDFSQALYTFDIGQNDLASGYFHNMSTDQVKAYVPDVLAQFKNVIKFFLMGRFRDSKLQPLPFYYQANLITPVWYC

SEQ ID NO: 181677 - protein, 288 aa, Glycine max
  Coding DNA Sequence Number=SeqID_64899
  Subcellular localization annotation: CTP_CleavageSite=28; ConfidenceScore=5.12e-01
MLVILFNSMLDHMTIFAHDINQYFFSPRTTSLGSTDSNLSYLRSYSSGGLVDFFSEPFQASGPHQNKVSCTPQPFDLGSTVSSDLSEAPVAPKQFSSFALSIGLFQFPAAPSQASSVDLFQSSALSAIPSFNELQPVKAFQSLSVDFMDLSQQPSAAMPNEKSLELSVPKNEGWATFDTPQHTTSTGQPWNAFKYSATSVPVDALNQGLQMHDLPSTDDQFFDLRASKCQLQFLDVSTLQAALPDSQLSPTFQSGIAEPWLPQNTLNPYVSSAGQGSPSRLILDVQTF

SEQ ID NO: 181678 - protein, 133 aa, Glycine max
  Coding DNA Sequence Number=SeqID_64900
GSQTLEEGEGIEVSFHSLHAMSISPSTDIILQIPTLKMCGANHISKFYNNPTINKSGIVVLLRRFWVSARKEKAMVQKIFLSTPTCFHNSNGENVQKYVPNLVLKFHDDSTVNESKIDIFLIKVWWYASVLIA

SEQ ID NO: 181679 - protein, 94 aa, Glycine max
  Coding DNA Sequence Number=SeqID_64901
  Subcellular localization annotation: CTP_CleavageSite=74; ConfidenceScore=5.99e-01
MATVFRTPTFRPPPPPPPRAAKSPKPSRFTVASFGQSTTCRRKPPSLLSSLRFPTVPSPRFVRFVPFAFDGDTEAPQVQEPEVQVLPFLLEEAH

SEQ ID NO: 181680 - protein, 86 aa, Glycine max
  Coding DNA Sequence Number=SeqID_64902
MAWAFPLEMARSLLLLLLRMGHPHLFFCSLLLMISEINYREANRSVDFLANHGDFQLTVLDSPPPFLRSIIAEEARGVLFKRFVAL

SEQ ID NO: 181681 - protein, 269 aa, Glycine max
  Coding DNA Sequence Number=SeqID_64903
  Gene Ontology: Mol. function=adenyl-nucleotide exchange factor activity; Cellular component=mitochondrion; Biological process =protein folding
  Homolog annotation: Hit_ID=Q9XQC7; Match level="QueryCoverage=80%, HitCoverage=66%, E-value=2e-78, Identity=69%"; Hit description=GrpE protein
  Pfam annotation: Domain name=GrpE; Domain location=66-232; Score =186.9; E_value=4.9e-53; Accession=PF01025.9; Description=GrpE
MESRFSIRSFGSIPPFLDPSDGAVGVNDSASDNEVSDADETFASPFLVILQSYREALANNDEVKIAELESSLKSIEDEKIELEGKIASLSEELSIEKDRILRISADFDNFRKRTERDRLSLVTNAQGEVVESLLPVLDNFERAKTQIKVETEGEEKINNSYQSIYKQFNEILTSLGVEPVETVGTPFDPLLHEAIMREDSDEFEDGIIIQEFRKGFKLGDRLLRPSMVKVSAGPGPAKPEQEAPQEEQVNTEISEDSKENEGSTETESS

SEQ ID NO: 181682 - protein, 126 aa, Glycine max
  Coding DNA Sequence Number=SeqID_64904
  Gene Ontology: Mol. function=drug transporter activity; Cellular component=membrane; Biological process=multidrug transport
  Homolog annotation: Hit_ID=Q1SD92; Match level="QueryCoverage=70%, HitCoverage=18%, E-value=1e-40, Identity=86%"; Hit description=Multi antimicrobial extrusion protein MatE
VSVGAGWQSVVAYVNIGCYYLIGIPVGVLLDNLFHLEVKGIWIGMLFGTFVQTVMLITITFKTDWDKQVEIARNRVNKWAVTTENEESNSKIIDLIGFCMYYNKAKEERYFPKFEANKDTSRNTRE

SEQ ID NO: 181683 - protein, 318 aa, Glycine max
  Coding DNA Sequence Number=SeqID_64905
  Gene Ontology: Mol. function=drug transporter activity; Cellular component=membrane; Biological process=multidrug transport
  Homolog annotation: Hit_ID=Q1SD91; Match level="QueryCoverage=99%, HitCoverage=64%, E-value=1e-150, Identity=83%"; Hit description =Multi antimicrobial extrusion protein MatE
  Pfam annotation: Domain name=MatE; Domain location=45-205; Score =125.8; E_value=1.2e-34; Accession=PF01554.9; Description=MatE
MEGHLKQKLLRNKERRTSSEQEEEELSLVKRVWNESQVMWIVAAPAIFTRFSTFGISVISQAFVGHIGSKELAAYALVFTVLVRFANGVLLGMASALSTLCGQAYGAKEYGMMGVYLQRSWIVLFLTAVCLLPVFIFTSPILMLLGQDESIAQVAGNIALWSIPVMFASIVSFTCQTFLQSQSKNVIIAFLAAFSIVIHVFLSWLLTMKFQFGIPGAMISAGLAYWIPNIGQLIFVTCGWCSDTWEGFSFLAFKDLWPVVKMSLSAGAMLCLELWYNTILVLLTGNMKNAEVEIDALSICLNINGWEMMISLGFMAAA

SEQ ID NO: 181684 - protein, 115 aa, Glycine max
  Coding DNA Sequence Number=SeqID_64906
MMLINVIETVESTMNCNKGLSIVFYFNNKKKRAPSIELDYPSSSTSGMFPTVLKVCPLYEEDDVYENKFEDALSDDDLDNINEEVCLDDIDALLAVGNILHHETTILEKAFFFGQ

SEQ ID NO: 181685 - protein, 378 aa, Glycine max
  Coding DNA Sequence Number=SeqID_64907
  Gene Ontology: Mol. function=DNA binding; Cellular component=nucleus; Biological process=regulation of transcription, DNA-dependent
  Homolog annotation: Hit_ID=Q1SLX7; Match level="QueryCoverage=41%, HitCoverage=39%, E-value=2e-54, Identity=67%"; Hit description =Homeodomain-related
  Pfam annotation: Domain name=Myb_DNA-binding; Domain location=108 -154; Score=50.6; E_value=5.1e-12; Accession=PF00249.21; Description =Myb-like DNA-binding domain
  Pfam annotation: Domain name=Myb_DNA-binding; Domain location=160 -205; Score=56.2; E_value=1.1e-13; Accession=PF00249.21; Description =Myb-like DNA-binding domain
  Pfam module annotation: Pfam domain module=Myb_DNA-binding::Myb_DNA -binding; Domain location=108-154::160-205
  Subcellular localization annotation: CTP_CleavageSite=35; ConfidenceScore=5.24e-01
MSSSQHLNNVGEGSNRDMSFFPPSSLYVGSSQTPPLSMGHENGVEGSKPEMGLQIFGSTVFQPSECRGTKRASDEEGVEIENRNLCLKLADEAQAKSSASGKIKLCARGHWRPAEDERLKELVAQYGPQNWNLIAENLEGRSGKSCRLRWFNQLDPRINRRSFSEEEEERLITAHRMYGNKWAMIARLFPGRTDNAVKNHWHVIMARRQREHSSSVYRRRKLVVNETLPKGLDLTLSNNAGSESTISSTIDESASTCTNLSLTPSSAKVTPPFRRLFDHPGPSQNHQAFGSLIGQARGDVSFNKFCGASWKGVAYKKADQVGKLKGVDQSNFSDANSEVSVSESVATNRSNVSISEESETVGDKINMPFIDFLGVGAT

SEQ ID NO: 181686 - protein, 140 aa, Glycine max
  Coding DNA Sequence Number=SeqID_64908
MECSSVEFDVSEHRFLSSGRNKCSMIGSGLYSLNDNGKDKRGGHGGKRWKKCKEKGYRKKGLQRRHILIMKTQHPLSFLLERRYRDCLATPLGSHEVANGVTRDPLGQNYSEESSQVHMGKGKKIQFSPSRILKGNKDKG

SEQ ID NO: 181687 - protein, 78 aa, Glycine max
  Coding DNA Sequence Number=SeqID_64909
MTWVHVIHFQEKDIYFGFHGGLGGSEVGNGGLKSVKDGIPSVRFHHWSSMKAPNVMNLNRSRNAKCKSREKRVEKLKT

SEQ ID NO: 181688 - protein, 108 aa, Glycine max
  Coding DNA Sequence Number=SeqID_64910
MPISPCGSISWDRAHKTPSGPRGVQQGPGVSSFGYGPLSVLQDACPPQQGITHARHSVDLEKSNRVLGFPALIMGLCQFNGVPVAPSKVIRPPTNQAFIKKYYAPRQA

SEQ ID NO: 181689 - protein, 150 aa, Glycine max
  Coding DNA Sequence Number=SeqID_64911
  Subcellular localization annotation: CTP_CleavageSite=40; ConfidenceScore=5.24e-01
MSISPCGSISWSVPSRHRVGGCAHKTSSGPGEVQQGPGVSSSGYGPLSVLQGARTPRQGIAPAGHPVDSKKSNRVLGFPALITGLCQFYGVPVTPNKVIRPPINRAFLKRYCAPRQAQGETPQQPGDGWQRATNAPPPPLEFISAHSQKG

SEQ ID NO: 181690 - protein, 50 aa, Glycine max
  Coding DNA Sequence Number=SeqID_64912
MTTIEYAKCPLGRHILSSVSQNRHMTETSMQVGNANVYEFLKLQSIQRSG

SEQ ID NO: 181691 - protein, 274 aa, Glycine max
  Coding DNA Sequence Number=SeqID_64913
  Gene Ontology: Mol. function=cysteine-type peptidase activity; Cellular component=cytoplasm; Biological process=proteolysis
  Pfam annotation: Domain name=Transposase_21; Domain location=170-271; Score=16.7; E_value=5e-16; Accession=PF02992.5; Description =Transposase family tnp2
MDRSWMNTSHMSPTYEEGVEQFLQFASERSRPDEDEKYFWRYCKLIQKVIVSWVQQSIYAVVSGVKSVHDMLPEKNTLPTSYYQTKKILCPMGIEYHKIHACPNDFILYIHEFEEMHKFPRCGVSWYKVKDDDECSSDDNLKKGPPAKVVWYLLIIPWFKHLFSNGDDAKDLTWHAKGRNWDGMLHHPADSSQWKKIDRLYPKFNKEARNLRLGLSIDGMNPYGSLSTQHSSWLVLLVIYNLSLWLCMKRKYIMLSMMILGPSQGMRLMIISVP

SEQ ID NO: 181692 - protein, 148 aa, Glycine max
  Coding DNA Sequence Number=SeqID_64914
MAEINSEELCGAATMSSSFGERKETSHGSKRSLAQHLEATEQSMLAIIGQYKEELNQSLTHEQKLVEDFAQAYTEKEARGRVIDALHQEATMWMDRFALTLNGSQDLPRLLAKVKAIAEVCSAPEEIHGLINYCQHMIDLMAHIIRNR

SEQ ID NO: 181693 - protein, 306 aa, Glycine max
  Coding DNA Sequence Number=SeqID_64915
  Gene Ontology: Mol. function=protein binding; Cellular component =integral to membrane; Biological process=xylan catabolic process
  Homolog annotation: Hit_ID=Q1S5Q1; Match level="QueryCoverage=97%, HitCoverage=77%, E-value=3e-58, Identity=37%"; Hit description =Leucine-rich repeat; Leucine-rich repeat, cysteine-containing type
  Pfam annotation: Domain name=LRR_1; Domain location=118-140; Score =2.6; E_value=93; Accession=PF00560.23; Description=Leucine Rich Repeat
  Pfam annotation: Domain name=LRR_1; Domain location=142-164; Score =14.4; E_value=0.43; Accession=PF00560.23; Description=Leucine Rich Repeat
  Pfam annotation: Domain name=LRR_1; Domain location=166-188; Score =14.3; E_value=0.45; Accession=PF00560.23; Description=Leucine Rich Repeat
  Pfam annotation: Domain name=LRR_1; Domain location=190-211; Score =11.6; E_value=1.9; Accession=PF00560.23; Description=Leucine Rich Repeat
  Pfam annotation: Domain name=LRR_1; Domain location=24-46; Score=5.3; E_value=29; Accession=PF00560.23; Description=Leucine Rich Repeat
  Pfam annotation: Domain name=LRR_1; Domain location=48-70; Score =15.3; E_value=0.22; Accession=PF00560.23; Description=Leucine Rich Repeat
  Pfam module annotation: Pfam domain module=LRR_1::LRR_1::LRR_1::LRR _1::LRR_1::LRR_1; Domain location=118-140::142-164::166-188::190 -211::24-46::48-70
MKFIDMGNNQLSDAIPDWMWEMKYLMVLRLRSNNFNGSITEKICQLSSLIVLDLGNNSLSGSIPNCLDDMKTMAGEDDFFANPLSYSYGSDFSYNHYKETLVLVPKGDELEYRDNLILVRMTDLSSNKLSGAIPSEISKLSALRFLNLSRNHLSGGIPNDMGKMKLLESLDLSLNNISGQIPQSLSDLSFLSVLNLSYNNLSGRIPTSTQLQSFEELSYTGNPELCGPPVTKNCTDKEELTESASVGHGDGNFFGTSEFYIGMGVGFAAGFWGFCSVVFFNRTWRRAYFHYLDHLRDLIYVIIVLK

SEQ ID NO: 181694 - protein, 125 aa, Glycine max
  Coding DNA Sequence Number=SeqID_64916
MHEQRKAINSWGSGLNGGGCMNCIQFMWLRIRFEDGGCTNSARQSVPGTPDSMVEDTYGGGCTNSAWQSIRAPDQWWRMLGNQFVGLRIRFDDGGCTNSGRKSIRGAPDSMVEDASITMNSWGFE

SEQ ID NO: 181695 - protein, 173 aa, Glycine max
  Coding DNA Sequence Number=SeqID_64917
  Gene Ontology: Mol. function=ATPase activity, coupled to transmembrane movement of substances; Cellular component=integral to membrane; Biological process=transport
  Homolog annotation: Hit_ID=UPI0000E68D6F; Match level="QueryCoverage =72%, HitCoverage=34%, E-value=2e-24, Identity=48%"; Hit description =ABC-type multidrug transport system, permease component
MRERRTSQCWAVRWPVLTRRPASRRWHRTWKTCSWPPPVVVAGSRRNEPAQAVGDHAQGTAAATARPHHAGDDRRHSGDAAAAVRLCDQSQPASPRRRCRRSGQQCRLARAGAGHGRHRRDHAAQRGVHARPADACAAPWRDQCRHRGAGRLRASPLRRSRSSAGAGRWQRHR

SEQ ID NO: 181696 - protein, 80 aa, Glycine max
  Coding DNA Sequence Number=SeqID_64918
MTTNSWGSGLDGGGCMNDNQLMGLRIRFIGGGCTNSARQSIRCMNDNQFMGLRIRFIGGGCRNCARQSIRGAPDSMVEDA

SEQ ID NO: 181697 - protein, 164 aa, Glycine max
  Coding DNA Sequence Number=SeqID_64919
MTLSSWQNKLDKYFTCKTLVMKRWCVVQQGKTIGVNVEDDDSYMDTYVSPLTTQITPNIVGEEEAGDVHANHNDHDEGELINIVVVYKSKGETKDIELVEEEEARIGADSSSATSNKYENYKEEARNAAQKHKAKRVESVNADAEAFGDHWKVQIALCILKLKH

SEQ ID NO: 181698 - protein, 398 aa, Glycine max
  Coding DNA Sequence Number=SeqID_64920
  Gene Ontology: Mol. function=ribulose-phosphate 3-epimerase activity; Cellular component=chloroplast; Biological process=carbohydrate metabolic process
  Homolog annotation: Hit_ID=P0AG07; Match level="QueryCoverage=52%, HitCoverage=93%, E-value=1e-103, Identity=87%"; Hit description =Ribulose-phosphate 3-epimerase
  Pfam annotation: Domain name=Hydrolase; Domain location=153-370; Score=78.9; E_value=1.6e-20; Accession=PF00702.16; Description =haloacid dehalogenase-like hydrolase
  Pfam annotation: Domain name=Ribul_P_3_epim; Domain location=5-206; Score=463.9; E_value=2e-136; Accession=PF00834.9; Description =Ribulose-phosphate 3 epimerase family
  Pfam module annotation: Pfam domain module=Hydrolase::Ribul_P_3_epim; Domain location=153-370::5-206
MKQFLLAPSILAADFARLGEDTAKALEAGGDVVHFDVMDNHYVPNLTMGPMVLKALRDYGITAPIDVHLMVKPVDALIPEFAKAGASFITFHPEASEHVDRTLQLIKEHGCKAGLVFNPATPLSYLDYVMDKLDIILLMSVNPGFGGQSFIPGTLDKLREARRRIDQSGYQIRLEVDGGVKIDNIGQIAAAGADMFVAGSAIFGHPDYKKLPPAGVERVSTWIGNGADIMMARALSWALGREPQADEQRDARALFDKHYAATVEAGSTLFPQVQETLAALHASGLPLAIVTNKPTPFVAPLLQSLGIADYFSLIIGGDDVVVKKPHPAAIFLVLGRFGVLPGQLLFVGDSRNDILAAQAAGVPNVAMTFGYNYGEPIATSQPDLTLDTFSELLPVLGL

SEQ ID NO: 181699 - protein, 234 aa, Glycine max
  Coding DNA Sequence Number=SeqID_64921
  Gene Ontology: Mol. function=oxidoreductase activity; Biological process=electron transport
  Homolog annotation: Hit_ID=Q6D4Q2; Match level="QueryCoverage=75%, HitCoverage=96%, E-value=3e-60, Identity=64%"; Hit description =Putative nitroreductase
MVSRTFGEILQPQPAPWLVALAEGIDKSRSPISERPAQKPCDFAGFGAFSPRPAGENSEIADERRAVRRRHLGGGLQLRRAQIEETDDLVLLAAAEGFAHQRMLGPGAGAPDAVKALRQRRHLHRLHRATGGNHLFPARHLGLFSAVRNDGDDQRRAERRLGGLFDRRFVQLILFRRRLQQLAEALQTLIFDHHETPRLQRAVIGRTQARVDDILAHFPRRRRFRQARSRAAIQ

SEQ ID NO: 181700 - protein, 234 aa, Glycine max
  Coding DNA Sequence Number=SeqID_64922
  Homolog annotation: Hit_ID=Q1SA76; Match level="QueryCoverage=32%, HitCoverage=15%, E-value=3e-09, Identity=37%"; Hit description =Transposase
  Subcellular localization annotation: CTP_CleavageSite=91; ConfidenceScore=5.14e-01
MAGAQSSNLIWVIRFQVSWATMIYQPPQPRVMLGAPALLLVHPTILINSVNAPVLSSSFLSWFRRFFHLRLHALFFTFSLSCWFFIVERGSASVEVKVLRVGGDCCGGSFVVGGTPNQWMYDNIMSEEIDMDDQNEQECGVNEQHVDCSDAFNNSQDEKTIIADMTKSMVKPRNILLTLKEHNANTCTTIKQIYNARSAYRSSIRGSDNEIQHLMKLLERDQYIHWHRLKDEDV

SEQ ID NO: 181701 - protein, 142 aa, Glycine max
  Coding DNA Sequence Number=SeqID_64923
  Gene Ontology: Mol. function=nucleic acid binding; Cellular component= mitochondrion; Biological process=DNA integration
  Homolog annotation: Hit_ID=Q1RWN2; Match level="QueryCoverage=98%, HitCoverage=16%, E-value=2e-23, Identity=61%"; Hit description =Peptidase S8 and S53, subtilisin, kexin, sedolisin; Integrase, catalytic region; Zinc finger, CCHC-type
MKHEFDMTDLGKMRYFLVLEVMQRIDGIFLCKKNALEMLQRFGMDISNSVQTPIVPSIKLTKDDTGAKVDKTYYKQIVGSLMYLTSTRPDIMFVVNLISSCCFLVIKEITNCELINYRGRVHRCSIVCLSSHMVENGVGKIV

SEQ ID NO: 181702 - protein, 100 aa, Glycine max
  Coding DNA Sequence Number=SeqID_64924
MLGKLGRIDGDPVLRETRIGATWEYVSSVGGGQQGMVEWYLEICRGGQETLGMSGGVLLPKTKLDQSRPNPGIVSLKTRSGSYEGFWVIDYQGGVIDYPA

SEQ ID NO: 181703 - protein, 72 aa, Glycine max
  Coding DNA Sequence Number=SeqID_64925
MENWRTALGNDIRGAPDSKVEWRMENWRTALGNDIRGAPDSKAEDTCTALGNDIHGAPKKVENGELANSAWQ

SEQ ID NO: 181704 - protein, 148 aa, Glycine max
  Coding DNA Sequence Number=SeqID_64926
  Subcellular localization annotation: CTP_CleavageSite=38; ConfidenceScore=5.00e-01
MPISPYRSISWSVPSRHRGRTHKTPSGLREVQQDPGVASSGYGPLSVLQGSHTPQQEIVPTRHPVNPEKSNRVLGFPSLITSLCHFYRVPVTPSKVIRPPTNRAFIKKYCTPRQAEGETPQQPGDGWQRATNAPPPPLEFISAHPQKG

SEQ ID NO: 181705 - protein, 113 aa, Glycine max
  Coding DNA Sequence Number=SeqID_64927
  Gene Ontology: Mol. function=nucleoside-triphosphatase activity; Cellular component=membrane; Biological process=cobalt ion transport
  Homolog annotation: Hit_ID=Q8U838; Match level="QueryCoverage=79%, HitCoverage=32%, E-value=2e-37, Identity=84%"; Hit description=ABC transporter, nucleotide binding/ATPase protein
MPPSQPPNTATTRASWMNLSVLACIALLHFAAQAGPDIAVQVGETVIQLDFGHIARPFQIHIETAHHTAGRAGGQYDHAVTERDRFFKVVGDQDHRAPVFLPQPQQFVLHEVA

SEQ ID NO: 181706 - protein, 344 aa, Glycine max
  Coding DNA Sequence Number=SeqID_64928
  Gene Ontology: Mol. function=hydrolase activity, acting on carbon -nitrogen (but not peptide) bonds, in cyclic amides; Cellular component=mitochondrion; Biological process=pyrimidine base biosynthetic process
  Homolog annotation: Hit_ID=Q1GYZ0; Match level="QueryCoverage=99%, HitCoverage=99%, E-value=1e-144, Identity=73%"; Hit description =Dihydroorotase, homodimeric type
  Pfam annotation: Domain name=Amidohydro_1; Domain location=2-342; Score=63.7; E_value=5.9e-16; Accession=PF01979.10; Description =Amidohydrolase family
  Pfam annotation: Domain name=Amidohydro_2; Domain location=11-298; Score=-26.0; E_value=0.079; Accession=PF04909.4; Description =Amidohydrolase
  Pfam module annotation: Pfam domain module=Amidohydro_1::Amidohydro _2; Domain location=2-342::11-298
MTTELTLIRPDDWHLHLRDGEGLKAVLPDTARQFARAIVMPNLRPPVTTAEAALAYYQRIKQAVPAGLVFEPLMTLYLTDNTPAQEIAAARASGVVQAVKLYPAGATTNSDSGVTSLHKCAAALAEMEKQGMPLLIHGEVTDGDVDVFDREKVFIERHLQPLLKDFPGLKVVFEHITTKDAVEFVAAGPDTLGATITAHHLLMNRNAMFTGGIRPHHYCLPVLKRETHRQALVKAGISDSGKFFLGTDSAPHPKSAKEASCGCAGMYTAHAAIELYAEAFEEAGALDKLENFASVYGSDFYGLPRNTDKITLRKESWLVPDSIPFADDVLVPLRAGQTIAWRLV

SEQ ID NO: 181707 - protein, 97 aa, Glycine max
  Coding DNA Sequence Number=SeqID_64929
  Gene Ontology: Mol. function=RNA-directed DNA polymerase activity; Cellular component=mitochondrion; Biological process=DNA integration
MSGIQQVLEATVDMEFKQLDVKTIFLHGRLEEDILIQQPEGFEVEGKENYVGRLKKSLYGLQQSPRQWYKRFYDSCVYHSKVEDGSHINLLLNVDDM

SEQ ID NO: 181708 - protein, 110 aa, Glycine max
  Coding DNA Sequence Number=SeqID_64930
MVYIGLFMIGVRALVMEHCMGFLNLSVSTMQAVDIKSVKITLEGPLAARCIVPRRQSSGLVLFFAKEVGCCHQGCSKQSHVQTGNYECEYYVMQWIWCIVSGGLKDDWIH

SEQ ID NO: 181709 - protein, 96 aa, Glycine max
  Coding DNA Sequence Number=SeqID_64931
MTKREMITVIVDTIPVFYNEKMFSLIEVGLKRGKFNHPAWMNEKTGANEEGENEGETRAVTAIPIRPSFPPTQQCHYSANNNPSPYHHPVIHKGHP

SEQ ID NO: 181710 - protein, 243 aa, Glycine max
  Coding DNA Sequence Number=SeqID_64932
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=6e-22, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSSKGPRTKLGYDRLHVLAFRGLHVLDFRGLHFLASRGLHTLSFRGLQILVFRGLHLLYFRGLHLLALRGLHILAFRRLQRATRPRLKRAARSPLKRAARPRLKRVAHPRLQRAACPHIQRTSHPRLQSTTWLHALSFRGLHILTFKGLHLLDFRGLHVLALRGLHILAFRGLQVLSFKGLQALAFRGLDVLAFGGVHVLDFRGLHVLALSGLHVLPLRGLHVLALRGLHILAFRGLHILDF

SEQ ID NO: 181711 - protein, 206 aa, Glycine max
  Coding DNA Sequence Number=SeqID_64933
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-28, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTIRGLHVLPFRGLHALAFRGLHALAFRGMHALTFRGLHALAFRGLHVLAFRGLHAFPFRGLHALAFRGLYALAFRGLHVLPFRGLHALAFRGLHALALTTRLHALTFRGLHALPLRGLIVLALRGLYDLTFRGLHALTFRGLHVLAYRGLHVLTFIRLHVLAIRGLHVLTIRGLHVLPFRGLHALAFRGLHALAFRATGIL

SEQ ID NO: 181712 - protein, 65 aa, Glycine max
  Coding DNA Sequence Number=SeqID_64934
MYENDLQNPQLYNNDAETLTTVCYFRKIFMLYVQVEVIIIHRKYDSIPHHLQQPEEKLWDGQCHQ

SEQ ID NO: 181713 - protein, 74 aa, Glycine max
  Coding DNA Sequence Number=SeqID_64935
  Homolog annotation: Hit_ID=Q9AYM4; Match level="QueryCoverage=40%, HitCoverage=3%, E-value=8e-08, Identity=86%"; Hit description=VuP5CS protein
MTMEGLFLLSFLIFKSQPQGELDGKACAAIGQSSLMALYNTMFSQVGTKLIKLHIHYHHNFQGILASKNNLQTR

SEQ ID NO: 181714 - protein, 136 aa, Glycine max
  Coding DNA Sequence Number=SeqID_64936
  Homolog annotation: Hit_ID=Q84N00; Match level="QueryCoverage=48%, HitCoverage=20%, E-value=8e-11, Identity=43%"; Hit description =Putative class 5 chitinase
MDYDEILVFNKENIATVVYDDVAVAFYSYAGTTWIGFDDGPSIKKKGYFFWAVGKDKDWTISRQGEVPLTGGGTCETKDSDAQRGLMEPTFILVEHGCWSLFVGAVVAFVDNFRLVDNSWELIDNVKDKNLLIDKR

SEQ ID NO: 181715 - protein, 318 aa, Glycine max
  Coding DNA Sequence Number=SeqID_64937
MYVNLIGLGPATTGVDDDNLAHRLRCTWGDALTSLPPLPLLTPLKGEGERITITGTSYLTATKGRALPQGQEAPPPARHKALTLSGEEDLLSEAPQQVSLDEEPPIEMTSRSMMGCSIDPPESLPPRLMAELNGKEYIMVDGSTFKNQMKKKGKPKRRKQGSKKTMNSDPKSNSTTRAPQPPVAIDGCNVYLQCLQRSEKGRVIKSDDLPYLTHQRHVHHGQLDRSSPDNTCPGSGAWQTTSTCNFLTLVEVTTLDTRQYSSILRGSTNSSPSTCQEYYPRYQTDSLTTGQSLSTLDNLFRLQAGLELGGLMYCLGPT

SEQ ID NO: 181716 - protein, 247 aa, Glycine max
  Coding DNA Sequence Number=SeqID_64938
MKSLGEATTVSSAAIISELERMRVVKEKLKTGVTRVRKECDDLRDLNMTTVEAGSNNELKLRRAERDESRVESMYKEKVNLAASHGQRLEDEHAKVPALQMEKEAREKVIESLHGEAMKWMGRFALTLNESQELPKLLARAKAMVDVYPAPDEEVQEQMKADMEALKDQMTSMMEAMMSMRWMIEDNVIVVATTSIAAEANPTHLSGINQTSRPTLDMCTCPTRTPTTLFPVLLEGQQPQLGHAPLA

SEQ ID NO: 181717 - protein, 183 aa, Glycine max
  Coding DNA Sequence Number=SeqID_64939
MVSTRSSLRRETPFADSHLHPAAMTNVDTLQLQNRIAKMEKRHEEELTKLKTEHAQLEARVKRPQGDEQSAHTLLECTQGESHPRRTGNTADDLSLSHMHCSVWIVHQHPFVDHIMEANLYTNDDAILCCVFPTCLKGATLTRYSGLAPRSIDSFDTLVEQFSVQYTTSRSRRITSTALAILR

SEQ ID NO: 181718 - protein, 197 aa, Glycine max
  Coding DNA Sequence Number=SeqID_64940
MESPTVTTYPLLGGRCETQGRVVASTRSNLAHPARPSELVTSPLSYLGSPGELEASLGSDTQHLESKQSIDQPVDVGQRVCVFGACLIQISVVGAYLSFAIGLFYHDNVGEPNSKFVADYARIDSRHLQLDKLFDGFQAFVEGVISQIYVKFIALAGLVDGQGSNLRPFIHYHDLSAFSHYGVTPSGLPDGRIRSYL

SEQ ID NO: 181719 - protein, 166 aa, Glycine max
  Coding DNA Sequence Number=SeqID_64941
  Gene Ontology: Mol. function=RNA-directed DNA polymerase activity; Biological process=RNA-dependent DNA replication
MEEDREDPNEDDSLGIDAKDEDWGPKHERMDFKCCQNQICKHERDDNSKFFHSTINWRRRSNGVKGLWKDYSWLDDLKYVKKEINNFFQQKFKEHGDVDMNLDGVHFKSIGDAENEQLTCPFSDEEVKSVVWDCEGKQSSNPYGYKFSFIKAFWHILKEDICFALR

SEQ ID NO: 181720 - protein, 75 aa, Glycine max
  Coding DNA Sequence Number=SeqID_64942
MLNPLKIKQFQESFIVQGFNLIIPTQIMEETSLDENSFKCTRCGRGDLFDDFASTESLEGKDKGSPMSKWDDNVG

SEQ ID NO: 181721 - protein, 651 aa, Glycine max
  Coding DNA Sequence Number=SeqID_64943
  Gene Ontology: Mol. function=two-component response regulator activity; Cellular component=nucleus; Biological process=two -component signal transduction system (phosphorelay)
  Homolog annotation: Hit_ID=P62598; Match level="QueryCoverage=96%, HitCoverage=94%, E-value=1e-111, Identity=42%"; Hit description=Two -component response regulator ARR12
  Pfam annotation: Domain name=Myb_DNA-binding; Domain location=208 -258; Score=49.1; E_value=1.5e-11; Accession=PF00249.21; Description =Myb-like DNA-binding domain
  Pfam annotation: Domain name=Response_reg; Domain location=20-133; Score=103.6; E_value=5.6e-28; Accession=PF00072.14; Description =Response regulator receiver domain
  Pfam module annotation: Pfam domain module=Myb_DNA-binding::Response _reg; Domain location=208-258::20-133
MTVVEDHRMDDLRDQFPIGMRVLAVDDDSTCLMVLETLLRRCQYHVTTTKNAITALKLLRENKTMFDLVISDVHMPDMDGFKLLELVGLEMDLPVIMLSVNDDPKMVMKGITHGACDYLLKPVRIEELQNIWQHVIRRKKIDSKERNKTSDHDKPNADNGNGRVSAGTGNSDQNGKPSKKRKDQDEDDEEENEDGHDNEDSSTLKKPRVVWSVELHRKFVSAVNQLGIDKAVPKKILDLMNVEKLTRENVASHLQKYRLYLKRISCVANRQANLVAALGTADSSYLRMGSLSGVGHMQTLTGPQQFHNNAFRPFPPGGMIGRLNASVGLNMHGISSSEALQLSHAQNLNKSINDPLKFQSAIACGNQNGIQGMPMSIGLDQLQHNKGVSVGPIQNMSSLIDDRPTFGVSKKLSDQTQKVTIGCSPSPVLDISNNDLVLKADSENTQGGGVYENLTSVASQHSQFSLPLLDHGRCSDIWSSPMQSSGTNSYPPSETLQGGNLSGQSSITSLFNQSHDSPTDMHSQGLIFTNNLGQMSNNVPFQGWDDNNHDSNYDANVIGNSIDTLIDPEGHTSINSNYNRNLDFNFCNPLQMKHDGIMGLSEENSLKQQYGYIMNRQKSQNSSATNNLGSLEDFASSMMKQNFLNSCLRID

SEQ ID NO: 181722 - protein, 65 aa, Glycine max
  Coding DNA Sequence Number=SeqID_64944
MHMTQMQFTNTGVQEIVPFLDTTFGQYGTQQGIKTEPMCDAYAKRRNTGNVHSMTILTEYKQKGI

SEQ ID NO: 181723 - protein, 104 aa, Glycine max
  Coding DNA Sequence Number=SeqID_64945
  Gene Ontology: Biological process=transposition, DNA-mediated
  Homolog annotation: Hit_ID=Q47336; Match level="QueryCoverage=41%, HitCoverage=48%, E-value=2e-16, Identity=90%"; Hit description=LacZ -alpha peptide
APVVSVSISCPSCSATDGVVRNGKSTAGHQRWQAAQLLGRAIGAGLFAITPAGERGMCCKAIKLGNARVFPEFDKSSGFQSSSKWLTKVVTSDIAGLAVARCEV

SEQ ID NO: 181724 - protein, 82 aa, Glycine max
  Coding DNA Sequence Number=SeqID_64946
MAFLGETSSQTIVNSRLAFIFPNGSIIHNDTGVYFQTLIPVPIRVPNNYDFASLKIRIHNTLQLSNKQFLDEIHYRKPFTHT

SEQ ID NO: 181725 - protein, 204 aa, Glycine max
  Coding DNA Sequence Number=SeqID_64947
MVDYEYLKIVVRGGVSNGNNSISVDPDDTDATTFEPENRTVGIEEFSYDPNSDTFITPNNYEPAYQPPSPNQPSPPSHPPLDSEVPIEKQNCHKRRRSEYGGSSSAVGINNQGNVLENLSVGIGTIAVNFEKISNMMEKREKDRDRDRELEGIIWDVIKEISNLDDITRFKTAELLNTKAKKDFFLKMSPEERSSWINFKLGNN

SEQ ID NO: 181726 - protein, 151 aa, Glycine max
  Coding DNA Sequence Number=SeqID_64948
  Gene Ontology: Mol. function=monooxygenase activity; Cellular component=membrane; Biological process=electron transport
  Homolog annotation: Hit_ID=Q1S498; Match level="QueryCoverage=85%, HitCoverage=24%, E-value=2e-41, Identity=63%"; Hit description =Cytochrome P450
MEFSSAVAFIFSILPLLLLLKLTFSWWVSPILNHLKLKRCGFGGPLPSFPLGNIQEMKKKNSLSSSLGSSNLTHDIHSTVFPYFSRWQNSHGKVFIYWLGTEPFLYIADPEFLKKMSTEVLAKRWGKPRVFRHDRDPMFGNGLVMVEGNEW

SEQ ID NO: 181727 - protein, 283 aa, Glycine max
  Coding DNA Sequence Number=SeqID_64949
  Gene Ontology: Mol. function=transcription factor activity; Biological process=regulation of transcription, DNA-dependent
  Homolog annotation: Hit_ID=UPI00005FA169; Match level="QueryCoverage =64%, HitCoverage=70%, E-value=1e-37, Identity=49%"; Hit description =COG0583: Transcriptional regulator
MGVAAGRTPRRAGNTARPSAGDGAACLRPGAAAADHARIPRPASAAEPGKASTARCGWARSTNRAWSRCRWPKYRASSCRRPRWWTPQQARAYPIDQPAPAQRQPVRGATGRMCRAGRSGGLGLAGGRGHRTRAAGSAAAGLAGTGTAGTRGISRRAPAAAAAARLHRCDEGRTAAVARNAAGTALGQRPRHPRMAWMPSNPIGSDPFPPGRALTLQHPVQRSAVIHAATQDHAVDLLGGGDVLQRVGGQQHQIGGLALCDTTVAVHLAEPGRTGTGCGRQRL

SEQ ID NO: 181728 - protein, 79 aa, Glycine max
  Coding DNA Sequence Number=SeqID_64950
MALAAQAILGQLQAMGGAQQQAQAELPLQCLQASADRWLGGAQLSGCGRQAAGIDDAQEGAQQIQAIGASGEVGHAYGV

SEQ ID NO: 181729 - protein, 59 aa, Glycine max
  Coding DNA Sequence Number=SeqID_64951
  Homolog annotation: Hit_ID=Q6H6R9; Match level="QueryCoverage=81%, HitCoverage=5%, E-value=2e-12, Identity=75%"; Hit description =Putative cell division protein FtsH3
MTRSLISLQGIEEKTTKLKGSEKALVARHEVSHAVVGTAVANLLAGQPHVEALVIRLLV

SEQ ID NO: 181730 - protein, 132 aa, Glycine max
  Coding DNA Sequence Number=SeqID_64952
MMAHHFAFDVLMMPYDRDDLMSYENALLKFNSRQQSKNTRYNIKKISSILGREFQIEIAKGLAKKFKLKSLFQEIYSLLLNVIVATYPSAGGRRVTRGMRVPRKEYARSRHQRLFEENVGKTGKDAIYELFK

SEQ ID NO: 181731 - protein, 466 aa, Glycine max
  Coding DNA Sequence Number=SeqID_64953
  Gene Ontology: Mol. function=transferase activity; Biological process= paclitaxel biosynthetic process
  Homolog annotation: Hit_ID=Q94CD1; Match level="QueryCoverage=99%, HitCoverage=94%, E-value=7e-39, Identity=25%"; Hit description =Putative N-hydroxycinnamoyl/benzoyltransferase
  Pfam annotation: Domain name=Transferase; Domain location=11-466; Score=162.7; E_value=9.5e-46; Accession=PF02458.6; Description =Transferase family
MAAPHDDDPRNMVSISRIVSVHPKLVQPQRVLTLSNLDRQCPNLMQLVFFYNNLPHQTLKDLSLNSVFSNLKSGLEETFTLWYPSAGRLGPNQSDGKLNLWCNNQGAVLAEAETSVKTSQLGNLSEYNEFFEKLVYKPAFDGNFSNMPLIVAQVTKFGCGGYSIGIGTSHSLFDGAATYDFLYAWASNSEIVKGRSRSDELPKPVHERGILLSGSLQAPRGTMNFPSDSSSNAKQARAMAIDHLYQLIMQTASGQKGFPMQIGGTSNPKKCVLKTYHLSGAMIEDLKRKHFSMQRGSLPFSTFEVLAAHLWKARTKALEMKKEKLVCLQFAVDIRNKMTPPLPKSFSGNAYVLASIMMSVAELEQTSHEFIIEKIREAKNSVNHDYVKAYVDALDGPQQCSSLPPLKELTLVSDWTRMPFHNIEFFRGKATYACPLATPMPQVAYFMQSPSDNKGVDVRIGFEAEN

SEQ ID NO: 181732 - protein, 128 aa, Glycine max
  Coding DNA Sequence Number=SeqID_64954
MLIGFDLRDLSKIERKSFWKTNNNKVLSYKVGESVIERGYGVVSREVAVSRQSMRAFQAQALSCCPSLYIHFPYFQLICKFIFTINMHLKYKEVMLARYTMQCMHEEVRTIQSLHFLYLAYGTCSSTQ

SEQ ID NO: 181733 - protein, 191 aa, Glycine max
  Coding DNA Sequence Number=SeqID_64955
MTNANCPQESLHSVSNGNLRFLQVSSFFEDKGESPAESDEIKVQTWSNQHYRNEHVVVVAAPRLQKYYSFHDQSGEQPLLLPIRSLKSRLFEEDIDVQSLNMLMSSKRFSSNSNRNAEVEADVVDTDVQSLNRSTISQGFSSNSNRKAEVIMLSSNTYVIMLSSNAEDSVRKKGFYKSCPPPPPPPPPTMF

SEQ ID NO: 181734 - protein, 150 aa, Glycine max
  Coding DNA Sequence Number=SeqID_64956
MDALEIYLNEVERQLDRKWSTVPRDVEIKEVRVQVPLACASSSKVIAPLVVVPNNNEEEQHNNESMIHHKPIVEEPQEVALRRSQRERRLAILNDYVVDLLLSVATYPSAEGRHETHGCIFQGRKTRGVATNVYSRKTSEKPEKGMVYEL

SEQ ID NO: 181735 - protein, 149 aa, Glycine max
  Coding DNA Sequence Number=SeqID_64957
MAPRKLASKRSRKDKAAEGTSSAPEYDSHRFRSAVHQQCFEAIKGWAPTVDITGYSHGQWIPFDAYAIGQLLGYPLVLEEGQECEYGHRRNREASANHAHQHDHPDPDMDDVAPQQHPAQQSFRPPPTEVSAGVRHPDADERPCGSVNR

SEQ ID NO: 181736 - protein, 135 aa, Glycine max
  Coding DNA Sequence Number=SeqID_64958
MGTTDIGLVYHGDTSCALAGYLDFDYAVDLDARRTMTRIRGEMRRHLLEDKPWKEKLHHQKSALDKKLTEEASMKEENERDRVMQSYPLRALDRRLQEDWARDAREGPTVLMSLKVDFRPMTWAKYELTYLCILD

SEQ ID NO: 181737 - protein, 60 aa, Glycine max
  Coding DNA Sequence Number=SeqID_64959
MTTRVRQQRPRVAATETSERQRVRVSWAYLLAAWADSGGTMEARRDVASPVTLLLEKSSY

SEQ ID NO: 181738 - protein, 149 aa, Glycine max
  Coding DNA Sequence Number=SeqID_64960
MAESLKKHKGSSSTTTAIGHCHHGTPMTHQHQFLPPFHLPDIEFFDGETFDCYQLSSQGVPFEGTLVDDWKHVYSSHDARKMVCHDHADMTGRLLAGSFTFECHIMHCILCRILLPRSINLAQASEEDLILLWALQTGRQIDWAHLVRH

SEQ ID NO: 181739 - protein, 53 aa, Glycine max
  Coding DNA Sequence Number=SeqID_64961
MNDEVPRSSGSVPRFRRDARDDLRRMPTSEEIYHARSKWFSSSFLSEVLDYGW

SEQ ID NO: 181740 - protein, 96 aa, Glycine max
  Coding DNA Sequence Number=SeqID_64962
  Gene Ontology: Mol. function=cytokinin dehydrogenase activity; Cellular component=endoplasmic reticulum; Biological process =electron transport
  Homolog annotation: Hit_ID=Q9LTS3; Match level="QueryCoverage=98%, HitCoverage=18%, E-value=4e-22, Identity=48%"; Hit description =Cytokinin dehydrogenase 3 precursor
  Pfam annotation: Domain name=Cytokin-bind; Domain location=1-95; Score=-109.6; E_value=1.6e-06; Accession=PF09265.1; Description =Cytokinin dehydrogenase 1, FAD and cyto
WDDRMTPITPDEDVFYVVDFLRVAKTFDVVDKLQVQNKQILRFCNDAGIKITEYLIGNKTHQQWVEHFGPKWKLFADRKTEFDPKKILSPGHGIFQ

SEQ ID NO: 181741 - protein, 134 aa, Glycine max
  Coding DNA Sequence Number=SeqID_64963
MHERKRNSWGSESKARMENCNRGSSLVNHEAWLQTPWWRMHERKRNSWGSEGKARMEDCTRVVNHEAWLQTLWWRMHERKRNSWGPEKKARMEDCTRGSSLVNHEAWLQTLWWRMHERKRNSCGSGKGEDGGLH

SEQ ID NO: 181742 - protein, 961 aa, Glycine max
  Coding DNA Sequence Number=SeqID_64964
  Gene Ontology: Mol. function=importin-alpha export receptor activity; Cellular component=nuclear pore; Biological process=protein import into nucleus, docking
  Homolog annotation: Hit_ID=Q9ZPY7; Match level="QueryCoverage=100%, HitCoverage=99%, E-value=0.0, Identity=69%"; Hit description =Importin-alpha re-exporter
  Pfam annotation: Domain name=CAS_CSE1; Domain location=522-953; Score= 348.4; E_value=1.1e-101; Accession=PF03378.6; Description=CASCSE protein, C-terminus
  Pfam annotation: Domain name=Cse1; Domain location=158-521; Score =700.6; E_value=1.1e-207; Accession=PF08506.1; Description=Cse1
  Pfam annotation: Domain name=IBN_N; Domain location=29-100; Score =58.5; E_value=2.3e-14; Accession=PF03810.9; Description=Importin -beta N-terminal domain
  Pfam module annotation: Pfam domain module=CAS_CSE1::Cse1::IBN_N; Domain location=522-953::158-521::29-100
MEWNPQTLQFLSECFLHTLSPSPEPRRRAESSLAEAADRPNYALAVLRLVAEPSIDDQIRQAAAVNFKNHLRLRWASEDSPVPDPEKDQIKTLIVPLMLSASPKIQSQLSEALALIGHHDFPKSWPSLLPELIANLQKASQSSDYASINGILGTANSIFKKFRFQYKTNDLLLDLKYCLDNFAAPLLEIFLKTASLIDAGAANLRPLFESQRLCCRIFYSLNFQELPEFFEDHMKEWMGEFRKYLTTSYPALESSGADGVALVDELRASVCENINLYMEKNEEEFQGFLNDFALAVWTLLGNVSQSSSRDRLAITAIKFLTTVSTSVHHTLFASDGVIPQICQCIVIPNVRLREDDEELFEMNYIEFIRRDMEGSDLDTRRRIACELLKGIATYYGDAVKSIVSSQIQSLLSLYAANPGANWKDKDCAIYLVVSLATKKAGASVVSTELVDVQSFFESVIVPELQNADVNGYPMLKAGALKFCTMFRTQISKPVALKFFPDLVRFLAAESNVVHSYAASCIEKLLLVKDEGGAARYTSADINPIFPVLMNNLFNSFKLPESEENQYAMKCIMRVLAVADISVDVARVCVEGLGSLLTEVCKNPKNPIFNHYLFESVAILVRRACERDPSLVSVFEASLFPRLEIILTNDVTEFLPYTFQLLAQLVELNRPPIPPIYMQIFELLLSPETWKRSSNVPALVRLLQAFLQKAPNEITQGDRLTKVLGIFDTLIQASSTSEQGFYVLNTVIESLEYNAIKPYISHIWAALFRELQKRRTVKLIKSLLIFMSLFLIKHGAANVVDTMNSVQPDIFVVILNQFWIPNLKLITGAIELKLTAVASTRLVCESPVLLDPAASVSWGKMVDSIVTLLSRPEEDRVQEEPDMPDITENAGYSTTFVLLYNAGKKEEDPLKDIRDPREFFVASLSRLSALSPGRYPKVISENVDPANQAALLQLCNTYNLSI

SEQ ID NO: 181743 - protein, 64 aa, Glycine max
  Coding DNA Sequence Number=SeqID_64965
MEVAYCVYLIDQWDFVNSHLSCIQGNTHGVRRFFFSMNDKLDQSFVEHCKNAAIAEYKLVRGDN

SEQ ID NO: 181744 - protein, 303 aa, Glycine max
  Coding DNA Sequence Number=SeqID_64966
  Gene Ontology: Mol. function=transcription factor activity; Biological process=regulation of transcription, DNA-dependent
  Homolog annotation: Hit_ID=Q1LAQ1; Match level="QueryCoverage=93%, HitCoverage=98%, E-value=2e-48, Identity=38%"; Hit description =Transcriptional regulator, LysR family
  Pfam annotation: Domain name=HTH_1; Domain location=11-70; Score =64.4; E_value=3.7e-16; Accession=PF00126.17; Description=Bacterial regulatory helix-turn-helix protein, lysR family
  Pfam annotation: Domain name=LysR_substrate; Domain location=92-290; Score=76.1; E_value=1.1e-19; Accession=PF03466.10; Description=LysR substrate binding domain
  Pfam module annotation: Pfam domain module=HTH_1::LysR_substrate; Domain location=11-70::92-290
  Subcellular localization annotation: CTP_CleavageSite=22; ConfidenceScore=5.04e-01
GAVRQRRLPNLAVLRAFEATVRYGSVSKAAKSLNVTDGAVSRAVREFEQTLGFALFQRTSRMVHPTPQAQELASEIGRGLDNLQSAIDRACRHHQNRPLVISCEPTFLIRWLIPRLAGLQQAVGKERDLQLVSAGGAVAFSREGIDLAIRRNDFPIADDVVARPFLKERVGPVCRREHAAAGRELRGTLLHTETRPYAWRDWCAHSGFEIGPGNELRFEHFYLSLQAAVAGAGIGIGPLALVADDIVNGALVAPYGFAPDGTDYVLMTQADGQEDAIFSTVLDWLIAMGEETERAVLAGGKKA

SEQ ID NO: 181745 - protein, 120 aa, Glycine max
  Coding DNA Sequence Number=SeqID_64967
  Gene Ontology: Mol. function=RNA-directed DNA polymerase activity; Cellular component=intracellular; Biological process=RNA-dependent DNA replication
MKLEMSLKIKEEVKKQAVTGFLAVARYSEWVANIVSVPKKDGKIASEDMEKMTFVALWGTFCYKVISSGATYQGAMVALFHDMMHKEIKVYVDDMLPSQKLRRNTLSTYKSCSRGCVSTD

SEQ ID NO: 181746 - protein, 50 aa, Glycine max
  Coding DNA Sequence Number=SeqID_64968
METLVAAIAAALFSIIHFILNRAYIMEAKIMGQSVCLQGRKGEESPPTFI

SEQ ID NO: 181747 - protein, 43 aa, Glycine max
  Coding DNA Sequence Number=SeqID_64969
GKVSDPFNQAIEAEALLQSPTLGRSCCRVTIGRGEFHHEAGYK

SEQ ID NO: 181748 - protein, 167 aa, Glycine max
  Coding DNA Sequence Number=SeqID_64970
MKKFIDRGHGKTVLDYYRIQGSIFHATGEDEFGKRWNVVGVIQWVPGRGGQNSRGGAKEEDKVGWAGLSKMDNWNMAEMLYVCAKLLSCWPEKLMGRIRMSTCKDDWNMAKMLCVCANLLSFWAELLMGRIRTSACILDIALRLSCGESLDSGVGGEQRSASLESGT

SEQ ID NO: 181749 - protein, 94 aa, Glycine max
  Coding DNA Sequence Number=SeqID_64971
  Homolog annotation: Hit_ID=Q1SK64; Match level="QueryCoverage=98%, HitCoverage=10%, E-value=3e-08, Identity=36%"; Hit description =Transposase
MVSRYALNEIAGEFECVPYASKNSSRCGCVMRTTYGLPCSYQGLCETEVTITEEMKTISKRFEQLDICGKVHLKTKLREIAYPDLNFMCPPPEK

SEQ ID NO: 181750 - protein, 137 aa, Glycine max
  Coding DNA Sequence Number=SeqID_64972
  Gene Ontology: Mol. function=zinc ion binding
  Homolog annotation: Hit_ID=Q1S5Q3; Match level="QueryCoverage=81%, HitCoverage=77%, E-value=6e-10, Identity=33%"; Hit description=Zinc finger, GRF-type
  Pfam annotation: Domain name=zf-GRF; Domain location=20-65; Score =30.6; E_value=5.7e-06; Accession=PF06839.3; Description=GRF zinc finger
  Subcellular localization annotation: CTP_CleavageSite=45; ConfidenceScore=5.31e-01
MSQRSNASSSRTRVSSQVVLFCGCGRRAVRRIAGTNINRGRASFTCSINKDEVGYCGYFIWVDQLIEALGVDDSLGTFSMEQRRQFGREEDKTMWKAQVNSKLDCMGIEMKMFRTIVYGMFLIQLLSMVVFVCIHKY

SEQ ID NO: 181751 - protein, 99 aa, Glycine max
  Coding DNA Sequence Number=SeqID_64973
  Subcellular localization annotation: CTP_CleavageSite=38; ConfidenceScore=5.03e-01
MVLTSARLKRSAFKDGAYISTVLEGQHSKTVLTSTRLRRSAFKGGAYISTIFKRRFKELLQYLHPGVKGLEVADLAINKIRENIKYVKGLEGRMKTFKA

SEQ ID NO: 181752 - protein, 104 aa, Glycine max
  Coding DNA Sequence Number=SeqID_64974
  Homolog annotation: Hit_ID=Q1S9K1; Match level="QueryCoverage=66%, HitCoverage=9%, E-value=1e-13, Identity=56%"; Hit description =Integrase, catalytic region; Zinc finger, CCHC-type; Peptidase aspartic, catalytic
MTSSSNVSTSIGSIYNNVQVPLFEGENYDIWAVKMETLFTSLDVLELVKEGYEELAATTEATVTQREELKKKKITDVGVLVFLEVIALDLEEAEEEVETPMEEE

SEQ ID NO: 181753 - protein, 232 aa, Glycine max
  Coding DNA Sequence Number=SeqID_64975
  Gene Ontology: Mol. function=transferase activity, transferring hexosyl groups; Biological process=metabolic process
  Homolog annotation: Hit_ID=Q1RXH8; Match level="QueryCoverage=99%, HitCoverage=86%, E-value=2e-45, Identity=38%"; Hit description=UDP -glucuronosyl/UDP-glucosyltransferase
GPKALEGLQDFHFETIPDGLPLTDEDADVTQDIVSLCKSVRENMLIPFHELLARLHDSDTAGLIPPVTCLVSDVGMAFTIHAAEELALPIVLFPSASAGSLLSCLHLRALIDKGLIPLKGSNLWKENTEGHGWLESEEPKSVHSVVYVNFGSITVLSPEQLLEFARERWNSTIGGFLTHCGWNSTIESICAVNKMRIKVMELKKKVEEDTKPSGSSYMNLDKVINEIFLKQN

SEQ ID NO: 181754 - protein, 175 aa, Glycine max
  Coding DNA Sequence Number=SeqID_64976
  Gene Ontology: Mol. function=RNA-directed DNA polymerase activity; Biological process=RNA-dependent DNA replication
MALDRTQLQNMCKKEHESFKEYTQRWRDLATQVAPPMMEREMITMIVDTLPVFYYEKMVGYMPSSFVDLVFAGERIEVGLRRGKFDYVASTSAGNKKTSTGGAKKKEGDAHAITATPTWTKSQQTPHNPTYQYPPPQYNYSTNIGSPPIPMPIQQRMPTQPQRPPPQNPFLAQPR

SEQ ID NO: 181755 - protein, 206 aa, Glycine max
  Coding DNA Sequence Number=SeqID_64977
MEAMKDQMAAMMEAMLSMKKIMEVNAAVVATISVVTEVDPTYLSGINQISLLVPNVVSQGGETLGSTDGPDVVQSKNSFPPYDLPPNYAPPNVVHVPDENADHSALVPLESQQAQLGHAHFAQPMGGILSPAMEEREKFDLIEERLRVIEGIGDYPFANMAELCLVPDVVIPPKFKVPDFDRYKGTTCPKNHLKMYFGKMGVYAKR

SEQ ID NO: 181756 - protein, 108 aa, Glycine max
  Coding DNA Sequence Number=SeqID_64978
MTLSKIKARLDYFNLNKSQAKLQVVLTKKREFQNEGETNWTLHDSEPGRETHTCKLCVVNPTKFMTIVSKGQGLTIILFNLNGMGQEKELGHKHKHDGDMRNDQSALK

SEQ ID NO: 181757 - protein, 72 aa, Glycine max
  Coding DNA Sequence Number=SeqID_64979
LIEDAAARAWRQGEQKADVTRDVLTSWKRLVADRRAWRQGEQKADIPLCLITLIMKVADPTCITARTSSGSV

SEQ ID NO: 181758 - protein, 105 aa, Glycine max
  Coding DNA Sequence Number=SeqID_64980
  Gene Ontology: Mol. function=RNA-directed DNA polymerase activity; Cellular component=mitochondrion; Biological process=RNA-dependent DNA replication
MWPLVVVPVCTFPTWPRLRGAQAIEIVKRDAWNISKFLASFASLGEVEGVNPKRRPTVASMHQFGGKGASPDMKAVDPFMNFPHDIVCLLAIQVFEKGCCRPSFE

SEQ ID NO: 181759 - protein, 47 aa, Glycine max
  Coding DNA Sequence Number=SeqID_64981
  Subcellular localization annotation: CTP_CleavageSite=8; ConfidenceScore=5.24e-01
MVIAPPTRQTQGSSFVSLTSPKAHQTRGPSLVSLASPKAHQTQGSFL

SEQ ID NO: 181760 - protein, 86 aa, Glycine max
  Coding DNA Sequence Number=SeqID_64982
  Gene Ontology: Mol. function=RNA-directed DNA polymerase activity; Biological process=RNA-dependent DNA replication
MEFITEDANFYYRVMPFGLKNIGATYQRFMDRVFKQQIGKNVKVYVNNMVIKSHSIAQHVANLEEGIEANPDKCTIILEMRSPTNV

SEQ ID NO: 181761 - protein, 48 aa, Glycine max
  Coding DNA Sequence Number=SeqID_64983
MEYAAGEVDEKLELPFLLSRGTPSLGRLKTGERLRLFGELGEEPQQGC

SEQ ID NO: 181762 - protein, 152 aa, Glycine max
  Coding DNA Sequence Number=SeqID_64984
  Gene Ontology: Mol. function=RNA-directed DNA polymerase activity; Cellular component=mitochondrion; Biological process=RNA-dependent DNA replication
MVAWFVKISEFDLQYEPRSPMKIQFMVEFLEEFAGNDQTILDCKAGIILEGPGNVTLEQALKLNFKASNNQAENDALIASLKLARDIGSRSYDATLTRSLSRGKESNTRAYLFSKLVSTKKTGHLKTIFLEILQTPTIDTKEVMDGEEEEPD

SEQ ID NO: 181763 - protein, 80 aa, Glycine max
  Coding DNA Sequence Number=SeqID_64985
MVQKEVEKKNMCLVQINFVVVGLKQKCLGLHRMCANNGTEDNIEVHEILVEGLGWEVYWSGFRVYDRGLGLRFEALDSLA

SEQ ID NO: 181764 - protein, 98 aa, Glycine max
  Coding DNA Sequence Number=SeqID_64986
MEKETLPMPPQEVKKAGVAAHDVQRYVKESDWAAQCTRQDKMSNEELKLQDPRCRIQCPGHPARKYWTHKFVISLTDCAGSTMSDTMSRTSCPKILDT

SEQ ID NO: 181765 - protein, 33 aa, Glycine max
  Coding DNA Sequence Number=SeqID_64987
MKQNLENEVKRQIVGILEELSTSESPTNSSAQD

SEQ ID NO: 181766 - protein, 426 aa, Glycine max
  Coding DNA Sequence Number=SeqID_64988
  Gene Ontology: Mol. function=carboxypeptidase activity; Cellular component=nucleus; Biological process=tetrapyrrole biosynthetic process
  Homolog annotation: Hit_ID=Q04219; Match level="QueryCoverage=99%, HitCoverage=67%, E-value=1e-95, Identity=40%"; Hit description=TNP2
  Pfam annotation: Domain name=Transposase_21; Domain location=242-425; Score=254.5; E_value=2.1e-73; Accession=PF02992.5; Description =Transposase family tnp2
MELNKIWMQITDRTTPLYDKGVQEFIDFAFNSFEKGKLLCCPCRKCINDLFCGQKVMYEHLIINGIKRDYVIWEHHGEVISEPDEFDDDQNNCNDGIRDMLHDLGSAMNIENITGAEEINYTTGTDTNSVNEEEDKFSKLFVIAEQELYPGCENFSKLSFIVQLLNIKCLFGLSGKAIDALLSLLAKAFPQGNKVLVSYYEARKFIRELGLDYVKIDACLNDCILYRAPRLQRLYMTSQIATEMRWHKERKIEDGQLRHLADSITWKTLDSKYPSFATDLRNVRLGLASDGPTAPGNDIDVYLQPLIEELKELWEKGVVTYDASTKETFRLYASILWTINDFPPYENLSGWSTKGRYACPCCNMDTWSSWLLNGGKFSYMGSHRFLPHDHSWRNNAKAFDGKKEKQFAPKPLSGDDIIEQYQHFDQ

SEQ ID NO: 181767 - protein, 114 aa, Glycine max
  Coding DNA Sequence Number=SeqID_64989
MLQPYGISIGLKEHSNPVTPKAYTPKSPSGPLPPDSGNLHFLFNTAHLQFSQDNTGQLFPEIPLVIPPTAPIEFPNVRETEKRLKLPLVLSSCDPFFSLDEYYLENLNGGSVRN

SEQ ID NO: 181768 - protein, 137 aa, Glycine max
  Coding DNA Sequence Number=SeqID_64990
  Gene Ontology: Mol. function=actin binding; Biological process =cytoskeleton organization and biogenesis
MDECNDYFLKLELIYYFMEREKEKDREIVLLSGKLDLFEHGKVIDKFEEHQRHEYEEMHKYPKCGISWYKVKDDDECNSDELTMKGPPAKVLSNCDEMLRHPTNSFQWKMINRLYLDFEKEARNLRLGLATDGINPY

SEQ ID NO: 181769 - protein, 79 aa, Glycine max
  Coding DNA Sequence Number=SeqID_64991
MEPATFLQQYTNQGRSFNGRTGEGASMEEGVGLQCQRKRGFKRRSKQKAKISRVHASRKRKSVGFKHKGLGFKARNLES

SEQ ID NO: 181770 - protein, 65 aa, Glycine max
  Coding DNA Sequence Number=SeqID_64992
  Gene Ontology: Mol. function=DNA binding; Cellular component=nucleus; Biological process=regulation of transcription, DNA-dependent
  Homolog annotation: Hit_ID=Q6QAD8; Match level="QueryCoverage=89%, HitCoverage=29%, E-value=3e-16, Identity=81%"; Hit description=MYB transcription factor
MAGNMGWGVIEEEGWRKGPSTSEEDILTEKKWEELQIKMSELPEARPQEGSNNTTRRKHNSTAAC

SEQ ID NO: 181771 - protein, 95 aa, Glycine max
  Coding DNA Sequence Number=SeqID_64993
MQDSLGENSKTMIIANAVVNEDSTAHEELSILKRRQNVFRSLSFSLSSIRDIKQSLKLEDCCLENATDMVDQHEDNMSDYESKGIRMSHKQAGRD

SEQ ID NO: 181772 - protein, 104 aa, Glycine max
  Coding DNA Sequence Number=SeqID_64994
  Gene Ontology: Mol. function=acid phosphatase activity; Cellular component=cellulose and pectin-containing cell wall
  Homolog annotation: Hit_ID=Q9SW12; Match level="QueryCoverage=66%, HitCoverage=26%, E-value=9e-22, Identity=70%"; Hit description=Acid phosphatase-like protein
  Pfam annotation: Domain name=Acid_phosphat_B; Domain location=1-103; Score=-46.9; E_value=0.00012; Accession=PF03767.5; Description=HAD superfamily, subfamily IIIB (Acid
MNDSRQLEVFDHEKFNNWVEKGVALAIEPSLKLYEDVLNRGFKVILLTGRSERHRSLTVDNLINAGFKEWDQLILRRNLANNPLIPASFFRWTTESAYLKSSWR

SEQ ID NO: 181773 - protein, 91 aa, Glycine max
  Coding DNA Sequence Number=SeqID_64995
  Gene Ontology: Mol. function=serine-type endopeptidase activity; Cellular component=mitochondrion; Biological process=proteolysis
  Homolog annotation: Hit_ID=Q9S834; Match level="QueryCoverage=44%, HitCoverage=13%, E-value=7e-15, Identity=95%"; Hit description=ATP -dependent Clp protease subunit ClpP
  Pfam annotation: Domain name=CLP_protease; Domain location=1-80; Score=-62.4; E_value=0.00046; Accession=PF00574.13; Description=Clp protease
MGAILLSAGTKGNRYSLPNSRIMIHQPLGGAQGGQTDIDIQVEVEWSRARVFWPMYSCTSASGFGFARLLDKVSAIGFPHNNNNGNDARQT

SEQ ID NO: 181774 - protein, 140 aa, Glycine max
  Coding DNA Sequence Number=SeqID_64996
  Gene Ontology: Mol. function=serine-type endopeptidase activity; Cellular component=membrane fraction; Biological process=proteolysis
  Homolog annotation: Hit_ID=Q9S834; Match level="QueryCoverage=52%, HitCoverage=24%, E-value=5e-30, Identity=85%"; Hit description=ATP -dependent Clp protease subunit ClpP
  Pfam annotation: Domain name=CLP_protease; Domain location=63-140; Score=2.2; E_value=1.3e-08; Accession=PF00574.13; Description=Clp protease
  Subcellular localization annotation: CTP_CleavageSite=52; ConfidenceScore=5.67e-01
MANAPCLRCSSLALHCSTHTSSSSHSQSLSLSSHTSRLSCTKKSPGKVKAVYANEFWAPERSSREKYKGRIVRCGGAVDDDMSNIIVAQLLYLDAIDPNKDIVMYVNSLGGSVAAAMAIFDTMRHIRPDVSTVCIGLAAS

SEQ ID NO: 181775 - protein, 788 aa, Glycine max
  Coding DNA Sequence Number=SeqID_64997
  Gene Ontology: Mol. function=protein serine/threonine kinase activity; Cellular component=membrane; Biological process=protein amino acid phosphorylation
  Homolog annotation: Hit_ID=Q2N1D8; Match level="QueryCoverage=44%, HitCoverage=59%, E-value=1e-106, Identity=58%"; Hit description=CMV 1a interacting protein 2
  Pfam annotation: Domain name=Pkinase; Domain location=444-719; Score =142.3; E_value=1.3e-39; Accession=PF00069.15; Description=Protein kinase domain
  Pfam annotation: Domain name=Pkinase_Tyr; Domain location=444-719; Score=129.5; E_value=9.4e-36; Accession=PF07714.7; Description =Protein tyrosine kinase
  Pfam module annotation: Pfam domain module=Pkinase::Pkinase_Tyr; Domain location=444-719::444-719
MASLTRRSLSQLGTILSMKKIPVRANHLLIFGSRGMWKGVIQIENLTNPNSKVTRRSEMLEPGQVIFACAGILKKVQGLVQKWMLILSCLVFVIEAGENDKTMEPPSLYDSGSPLPFVVVHDLPLPANLHVSKHVLSHGAPIAALSPVKPPSYGPFTSNGHPPASSHLSILFKKSEMKPPISGFKDIHIAPVHSTAAAGPSALAQPPLSPYASNCCKQDMVLKRGSKDCQCAYPIKLDLFLSNVSQNPNWNDFLDELATQLGLRNTQIELINFYVLSLSTLNISMNITPHKGISFSANEVSKINSSLSMHKVQLNPGLVGGYKLLNLTWFEPPPPSQAPTLAASPVNTPLHHSPTATSSSSSPKRGRHSNLFLILGIAIGIIFIAIISVLIFCLCTFLPKANTPPIDTEKPRTESAISTVGSLPHPTSTRFIAYEELKEATNNFEAASILGEGGFGRVFKGVLNDGTPVAIKRLTSGGQQGDKEFLVEVEMLSRLHHRNLVKLVGYFINRDSSQNLLCYELVPNGSLEAWLHGPLGINCPLDWDTRMKIALDAARGLSYLHEDSQPCVIHRDFKASNILLENNFQAKVADFGLAKQAPEGRSNYLSTRVMGTFGYVAPEYAMTGHLLVKSDVYSYGVVLLELLTGRKPVDMSQPTGQENLVTWARPILRDKERLEEIADPRLGGEYPKEDFVRVCTIAAACVAPEANQRPTMGEVVQSLKMVQRVTEYHDSVLASSNARPNLRQSSSTFEFDGTSSMFSSGPYSGLSAFDNDNISRTVVFSEDLCEGR

SEQ ID NO: 181776 - protein, 146 aa, Glycine max
  Coding DNA Sequence Number=SeqID_64998
  Gene Ontology: Mol. function=transcriptional repressor activity; Cellular component=cytoplasm; Biological process=regulation of nitrogen utilization
  Homolog annotation: Hit_ID=Q1S084; Match level="QueryCoverage=50%, HitCoverage=23%, E-value=3e-28, Identity=78%"; Hit description=NmrA -like
MDFMADKFDKGCIDHLKLVTSTPFIRVTYTEAVEILEDIVKNGKKFENEQKWVIDLAFEHERGIMLCRYLTKRFIPSKFGLDPTRVQVFVLEDGYNFYAPKVEIRRLVEAEGIPYTFISCNFFVRILLPSLAQPSLDAPPRDKVSS

SEQ ID NO: 181777 - protein, 131 aa, Glycine max
  Coding DNA Sequence Number=SeqID_64999
YSFYPKSQDNKSIMQNNGVSLRAESQQFAIVYDDNPHVASMPYFGVIEEIRELNYVKFTFCVFKYPCDERWSMVLHGKIISVNVEDDDSTVDTCLSPFSTQMPLNVNKEEEVDDLLANCNDHDEEELINNV

SEQ ID NO: 181778 - protein, 576 aa, Glycine max
  Coding DNA Sequence Number=SeqID_65000
  Gene Ontology: Mol. function=transcription factor activity; Cellular component=nucleus; Biological process=regulation of transcription, DNA-dependent
  Homolog annotation: Hit_ID=Q1SG54; Match level="QueryCoverage=96%, HitCoverage=93%, E-value=1e-119, Identity=44%"; Hit description=GRAS transcription factor
  Pfam annotation: Domain name=GRAS; Domain location=179-483; Score =188.0; E_value=2.3e-53; Accession=PF03514.5; Description=GRAS family transcription factor
MEIDQFSSTDLNFKGTQMGYGSTQEDVFQGKESLSGMELLGEIDPLPAENGKGVKLFKYQDQKQLQEPKADNLMLEEVNFDPDVQMQPTQLFQETEGLMKHGVASTEPVEYNKQVAPTPSLASLELLRNYGSRFKRLSEQNISTLSNIETSFDRQKMSTEEIIRVAGARYIQYSAHWNDSFYIPMHPYGLDLGGLSEEENRDIELAQFLLAAAERVGCQQFERANGLLLHCEWSSNASANPVQRVIFHFARALRERIYKETGRMTVKGSGKNEERELLQKMDTNIALKCHLKVPFNQVMQFTGIQAIVEHVACETKIHLIDLEIRSGVQYTALMQALAERRDRIVQLLKITAIGLSSLKTMIEETGKRLASFAESLNLPFSYKTVFVTDIAEIREDHFEIGEDEAVAVYSPYFLRSMVSRPDCMENLMRVIRNIKPVIMIVLEVEANHNSPSFVNRFIEALFFYSAYFDCLETCIKHEIECRMTIEAVLSEGIRDIVAMEGRERTVRNVKIDVWRRFFARYRMVETGFSESSLYHAHLVAKGFSFGKFCTIEKNGKCLIVGWKGTPMHSISAWRFL

SEQ ID NO: 181779 - protein, 301 aa, Glycine max
  Coding DNA Sequence Number=SeqID_65001
MVAMGNLQQKAKELFKFKCLTPKEMFYLITFTLLSLLLPLSFLLLAKFSDAQYYLQTLAWYHSPQHFPYVLTLALHINPLILYVLVSIISMASLIHGLTGKIIILSDSLSSSSTFLQPRILTAWIVLCTFQVCVGLGIEGSIEAGLYDSNDESMSFKFGVERILLSRVVFLLGLHETMQVWARMVVRPVVDDTVFGVAAREEKWVERVVVAASLGALWWWRLREDVESLVVMVEAKTEQLMDVRVSDFVGWWLYYLTLTIGIVRVLRGLMWMVTVCLCRRRRRRATGVSTVVEHCQIDDKV

SEQ ID NO: 181780 - protein, 87 aa, Glycine max
  Coding DNA Sequence Number=SeqID_65002
  Gene Ontology: Mol. function=sequence-specific DNA binding; Cellular component=nucleus; Biological process=regulation of transcription
  Homolog annotation: Hit_ID=O64747-2; Match level="QueryCoverage=87%, HitCoverage=20%, E-value=1e-09, Identity=40%"; Hit description =Isoform 2 of O64747
  Pfam annotation: Domain name=WRKY; Domain location=55-87; Score=-0.0; E_value=0.00072; Accession=PF03106.6; Description=WRKY DNA -binding domain
MDNNTCASSQLESEEASFEHKSETQTSKKRKMVEKTVVAVRTGENVGKLKNEGLPSDFWSWRKYGQKPIKGSPYPRCTFFLLQDGGL

SEQ ID NO: 181781 - protein, 142 aa, Glycine max
  Coding DNA Sequence Number=SeqID_65003
MAKDCSEALLELDERFSFPNFEPATNPHLCKSLTTTAYQQTPSNNRPRNRRTQNCNVFVAQPYNSSCVTSLRDQGSKPSSRFTQRDCPKNRRTQNRRTKITMSSSHHHMIATASHHFGIKGRRPPQGSHSAIGATIFANPNT

SEQ ID NO: 181782 - protein, 93 aa, Glycine max
  Coding DNA Sequence Number=SeqID_65004
MYMVNNIFTPSRYKEIIMVQPKPSAGLKGKPHQHALIFMPSCIQKSKAWVPRPKSFFGIYPSPRKLSTPPKMEIIHAQTQSISNIRKLMRKRH

SEQ ID NO: 181783 - protein, 949 aa, Glycine max
  Coding DNA Sequence Number=SeqID_65005
  Gene Ontology: Mol. function=serine-type peptidase activity; Biological process=proteolysis
  Homolog annotation: Hit_ID=Q10MJ1; Match level="QueryCoverage=91%, HitCoverage=91%, E-value=0.0, Identity=75%"; Hit description=Prolyl oligopeptidase family protein, expressed
  Pfam annotation: Domain name=Abhydrolase_3; Domain location=715-871; Score=-76.1; E_value=0.0092; Accession=PF07859.3; Description =alphabeta hydrolase fold
  Pfam annotation: Domain name=Peptidase_S15; Domain location=640-863; Score=-94.5; E_value=0.0043; Accession=PF02129.9; Description=X-Pro dipeptidyl-peptidase (S15 family)
  Pfam annotation: Domain name=Peptidase_S9; Domain location=687-893; Score=32.8; E_value=1e-09; Accession=PF00326.11; Description=Prolyl oligopeptidase family
  Pfam module annotation: Pfam domain module=Abhydrolase_3::Peptidase _S15::Peptidase_S9; Domain location=715-871::640-863::687-893
  Subcellular localization annotation: CTP_CleavageSite=67; ConfidenceScore=5.50e-01
MRLDKLYNRFLLPSNSSLLPLAPPLRLTLRHRTAANFASMASSRLRNLAPLAAAPAQDAAAASISSSANAAASADYDDESTVGVRYHVPPSVISDIVDAPPVPALSFSPLRDKIIFLKRRALPPLAEIARPEEKLAGIRIDGKCNTRSRMSFYTAIGIHQILPDGTLGPETEVSGFPVGAKINFVSWSPDGCHLSFSTRVNEEDHDSSKLTVWIADVKTGIARKLFQSPNVHLNAVFDNYVWVNNCSLLVCTIPSSRGAPPKKPLVPSCPKIQSNEARSTIQVRTFQDLLKDEYDEDLFDYYATSQLVLASLDGTTKEIGPPAVYTSMDPSPDQKYILISSLHRPYSFIVTYGRFPKKVELWSADGKLIRELCNLPLAEDIPIAFNSVRKGMRSINWRADTPSTLYWVETQDGGDAKVEISPRDIIYTQPAEPLEGEQPTILHKLDFRYGGVSWCDDSLALVYESWYKTRKIRTWVVSPGSEDVAPRILFDRSSEDVYSDPGSPMMRRTQAGTYIIARIKKESDEGRYIILNGIGATPEGNIPFLDLFDINTGKKMERIWESNKEKYYETVVALMSDQEEGYLYLDKLKILTSKESKTENTQYYFVSWPDKKVVQVTNFPHPYPQLASLQKEMIKYQRKDGVQLTATLYLPPGYNPSTDGPLPCLVWSYPGEFKSKDAAGQVRGSPNEFAGIGSTSALLWLARRFAILSGPTIPIIGEGNEEANDRYVEQLVASAEAAVEEVIRRGVADPKKIAVGGHSYGAFMAANLLAHAPHLFCCGIARSGAYNRTLTPFGFQNEDRTLWEATNTYVEMSPFMSANKVKKPILLIHGEEDNNPGTLTMQSGRFFNALKGHGALCRLVILPHESHGYTARESIMHVLWETDRWLYKHCVSNSSDAVEDHATGTVKEQVSKGTIDAESKVVATSGGGSGEVSDLEYEEFHSLPRSYLW

SEQ ID NO: 181784 - protein, 531 aa, Glycine max
  Coding DNA Sequence Number=SeqID_65006
  Gene Ontology: Mol. function=protein binding; Cellular component =nucleus; Biological process=regulation of transcription, DNA -dependent
  Homolog annotation: Hit_ID=Q76I94; Match level="QueryCoverage=99%, HitCoverage=82%, E-value=1e-123, Identity=53%"; Hit description =PHCLF3
  Pfam annotation: Domain name=CXC; Domain location=335-375; Score=4.4; E_value=0.0082; Accession=PF03638.5; Description=TesminTSO1-like CXC domain
  Pfam annotation: Domain name=SET; Domain location=386-505; Score =117.4; E_value=4.2e-32; Accession=PF00856.18; Description=SET domain
  Pfam module annotation: Pfam domain module=CXC::SET; Domain location =335-375::386-505
MAEDQSIIGKMQMYYDKNGGEMMICSDNEEEMVNPKDAKHDFTEAEDLILRMTLEECKSSEEALSIIQEFVKTTDSQIQERYKKLKKKNMESLDDHSEDCHCKGCKCHLGICLEKSLSATLESFDNIFCRQCLSEKQQVWSEHEGDKQPCSDQCYLLDKGVMEGQKDIQLSNSTKVQADEMTNNSNWKQLEKNLYLKGVELFGKNSCLVARNLLPGFKTCLEVARYMFASGESMPYESIPSSITDINDKINAEYIDQEMPSRSRLLRKKCKTRKFSYSHKSIALSSRCRRIDHGKDQCDKQYTPCGCKGICIEGCPCLSTGTCEKYCGCSKLCNNRFKGCYCFKSQCRSQLCPCFAANRECDPDVCRNCWVSCGDGSLGEPPRHGDGQCANMNLLLGKKERNPIIKNTCLGEYTGELITHREAEKRGKLYDRINNSYLFNVNDKWVIDARRFGNKLKFANHSSKPNCYAKVMLVGGDHRVGIFAKENIKAGDELFYHYYYNEECAPPWALPPKVEASKTHKYVSQGRAKKH

SEQ ID NO: 181785 - protein, 141 aa, Glycine max
  Coding DNA Sequence Number=SeqID_65007
MTSTSGDATPPSPKTTRIMAEMIKHGNQMRRMIYEDKEMMERMRKKNGESFRRIHKSNEPLIVRVENIKRREDRSSNSSHAKDEGYEEDEGGRRNERYRERRNHRRYGGRQREKGIEGVKVKIPTFKGTYDPKVYLKWEME

SEQ ID NO: 181786 - protein, 93 aa, Glycine max
  Coding DNA Sequence Number=SeqID_65008
MEENMEQFLEKITVQSRSDSVNPSPYKNREHIEKMYQTCNLLFKIQVKNLKTKLLDKLELSLANIHFIPKIMDNASPCTHEILFKCPVCGYCT

SEQ ID NO: 181787 - protein, 119 aa, Glycine max
  Coding DNA Sequence Number=SeqID_65009
MGSQIGSTDQFGWQVIHSDKHSYHLHINLNIELRTNYKSVYWVEVALRSQLKSHWKSLFLKSIVTTLRKPSSMEKKVRKRRKGERARRKEEKKTKRYMVVLMDACSDTLLDKTEKSMRE

SEQ ID NO: 181788 - protein, 87 aa, Glycine max
  Coding DNA Sequence Number=SeqID_65010
MLDKQGAMGLVKPTNRPDHDVDDHLYLILTIPQLFLKPLQHEDLFEIAHGGQCLSISVIQLWILHMTKTSMRVGNADVYGFLEPQSI

SEQ ID NO: 181789 - protein, 116 aa, Glycine max
  Coding DNA Sequence Number=SeqID_65011
MAPPKEIVIVIYHHGHIADDPVQGSVYTYANPILLYTSRSVTLTQLIQNINNCLPTQNNSSESRTIQEFKIRIKKNSRLKKKVQSQESRFKVQDLKNQDSRFKISRIKNQEKAQSR

SEQ ID NO: 181790 - protein, 163 aa, Glycine max
  Coding DNA Sequence Number=SeqID_65012
MRIVENHVNGGKCTPCSTSHIEAKRIVENHVNAVNIRMPPIPLFHPLLLLTFVHCASRFKEKTKLQNSFREKPDRENSTTKMFITLKSRLQRRAMSSSYQMLFSVAMNQRKTTEHGTDFGSLYAMEDENLKILSQCNSHYIKHVLEKFHCGDYVSQCHCWIQQ

SEQ ID NO: 181791 - protein, 50 aa, Glycine max
  Coding DNA Sequence Number=SeqID_65013
MEVDGSHDFPLQTYNINKNVLKIEIERVETAAVVHFNGPTKLWLEIGLAE

SEQ ID NO: 181792 - protein, 95 aa, Glycine max
  Coding DNA Sequence Number=SeqID_65014
  Subcellular localization annotation: CTP_CleavageSite=19; ConfidenceScore=5.31e-01
MKPSTGTPSTSRARTPILSCGLPPRNSRPQLRGWEMSLIFRQGQDPRGPLETRMELRRMMIWLMCWSTSYIRHRSYPAIRGPLEPNVNFLAITLT

SEQ ID NO: 181793 - protein, 62 aa, Glycine max
  Coding DNA Sequence Number=SeqID_65015
MHQGIESENWARNYINKKTTWREKEQLLGLRYAAIGYTCQLQGYVPGYVLREYIGISLLYKK

SEQ ID NO: 181794 - protein, 265 aa, Glycine max
  Coding DNA Sequence Number=SeqID_65016
  Gene Ontology: Mol. function=DNA-dependent ATPase activity; Cellular component=nucleus; Biological process=DNA replication initiation
  Homolog annotation: Hit_ID=Q6UEJ2; Match level="QueryCoverage=92%, HitCoverage=34%, E-value=1e-111, Identity=84%"; Hit description=Mini- chromosome maintenance 7
  Pfam annotation: Domain name=MCM; Domain location=1-205; Score=207.5; E_value=3.2e-59; Accession=PF00493.13; Description=MCM235 family
MGICAIDEFDKMDESDRTAIHEVMEQQTVSIAKAGITTSLNARTAVLAAANPAWGRYDLRRTPAENINLPHALLSRFDLLWLILDRADMDNDLEMARHVVYVHQNKESPALGFTPLEPSVLRAYISAARRLSPSVPRELEEYIATAYSCIRQEEARSNAPHSYTTVRTLLSILRISAALARLRFSETVAQSDVDEALRLMQMSKFSLYSEDRQKSGLDAISDIYSILRDEAAREDDFCVKLENGLDSSLTDETEELNNQKRSWNN

SEQ ID NO: 181795 - protein, 411 aa, Glycine max
  Coding DNA Sequence Number=SeqID_65017
  Gene Ontology: Mol. function=DNA-dependent ATPase activity; Cellular component=nucleus; Biological process=DNA replication initiation
  Homolog annotation: Hit_ID=Q6UEJ2; Match level="QueryCoverage=95%, HitCoverage=60%, E-value=0.0, Identity=77%"; Hit description=Mini -chromosome maintenance 7
  Pfam annotation: Domain name=MCM; Domain location=274-410; Score =17.7; E_value=1.6e-18; Accession=PF00493.13; Description=MCM235 family
MSTKDLNFDADTALAKDFLSNFADANGEAKYMNILQDVANHKTRAVQIDLEDLFNYKDLDEEFLSRVTDNTRRYIGIFSNAIDELMPEPTEDFTDDDHDILMTQRSDEGAEGTDGSDPRQKMPAEIKRYYELYIKASSKGRPSTIREVKALNIGQLVRISGIVTRCSDVKPLMKVAVYTCEDCGFEIYQAKIQELAEHVPKGHIPRTMTVHLRGELTRKVAPGDVVELSGIFLPIPYTGFRAMRAGLVADTYLEAMSVTHFKKKYEEYEFRGDEEEQIARLAEDGDIYNKLSRSLAPEIFGHDDIKKALLLLLVGAPHRTLNDGMKIRGDLHICLMGDPGVAKSQLLKHIINVAPRGVYTTGRGSSGVGLTAAVQKDPVTNEMVLEGGALVMEASFLKYNSSFHPYCAGIC

SEQ ID NO: 181796 - protein, 92 aa, Glycine max
  Coding DNA Sequence Number=SeqID_65018
  Homolog annotation: Hit_ID=Q9FGQ4; Match level="QueryCoverage=69%, HitCoverage=38%, E-value=5e-17, Identity=66%"; Hit description =Arabidopsis thaliana genomic DNA, chromosome 3, TAC clone:K5K13
MTSCIVNYGNIKVELCHSLEGNVGALTNFEVLDFLLAKGASKDPTRVIAKVAQSEHKVYDYLVDTAASVQTRENINEFLTVLNNMTWQKLRF

SEQ ID NO: 181797 - protein, 345 aa, Glycine max
  Coding DNA Sequence Number=SeqID_65019
  Gene Ontology: Mol. function=kinase activity
  Homolog annotation: Hit_ID=Q6UC87; Match level="QueryCoverage=82%, HitCoverage=83%, E-value=3e-95, Identity=62%"; Hit description =Putative calcium-dependent protein kinase CPK1 adapter protein 2
MAADEDMSALKSKLSQSNETWKKEMERSQSQVDVLQARIMEVKAQIQGSEEDAKKELEVLWRRVKTTSTLLTYLKSKARIMAVPHLAHTSCGIKKLDGVGLVDKDGIPLSGWSRNVDLCSFDDPDEESWIGINRQHGSLDQQDAVYIGEILKSVQMVTDVMEALVKRVLLAESETTFEKEKVSLGQEEIMRKSAQLENMSMKLEEMERFALGTNGILNDMRQKVADLVEETTRQRQRAAENEEELSRVKREFESLKSYVSSLITVRETLLSSEKQFQTIEKLFERVRDPPLHIKSTAHPHLELNGTKPPLLRLAIKAALKRPQLRRAIKAALKRPQLRRARAYRN

SEQ ID NO: 181798 - protein, 400 aa, Glycine max
  Coding DNA Sequence Number=SeqID_65020
  Gene Ontology: Mol. function=mismatched DNA binding; Biological process=response to DNA damage stimulus
  Homolog annotation: Hit_ID=O04716; Match level="QueryCoverage=84%, HitCoverage=26%, E-value=2e-80, Identity=46%"; Hit description=DNA mismatch repair protein MSH6-1
  Pfam annotation: Domain name=MutS_I; Domain location=331-400; Score =40.4; E_value=6.3e-09; Accession=PF01624.10; Description=MutS domain I
  Subcellular localization annotation: CTP_CleavageSite=72; ConfidenceScore=5.85e-01
MAPSRRNTNGRSPLVNQQSQITSFFTKSASPSPSPTLSKTNPNPNPNPNPSPTPATPSPLNPKRSKPLLVIGASTSPPSASPSLYFQELIGRRIKVYWPLDKAWYEGSVKSFDSLTSKHVVRYDDGEEESLDLSKEKIEWLQESSSKKLKRLRRGVPAVRKMMIDDDDEEVEEEESHKKDDDDDDDSNDEDWGMKAALEDAGDAEEDTDLEDENDVAERAKGKKVETKKRKLSGTEKQEPAKKSKSGVEVGKGAFKLSVLEPTSNLEIKETSNGTDNVAITEISERFALREAQKLRFLKEDRRDAKRRRPGDENYDSRTIYLPPDFLRSLSDGQKQWWEFKSKHMDKVLFFKMGKFYELFEMDAHVGAKELDLQYMKGDQPHCGFPEKNFSMNVEKLARK

SEQ ID NO: 181799 - protein, 89 aa, Glycine max
  Coding DNA Sequence Number=SeqID_65021
MTTMMEAMMSMKKIMGINTAAIVATSVVDKVDPTPSSSLYHINHPISDMVVQRAKELGILIQDFFKIKPCLTMKGFKSFKAHVIDYQYM

SEQ ID NO: 181800 - protein, 88 aa, Glycine max
  Coding DNA Sequence Number=SeqID_65022
  Homolog annotation: Hit_ID=Q5SML4; Match level="QueryCoverage=66%, HitCoverage=5%, E-value=6e-08, Identity=46%"; Hit description =Putative histidine kinase 1
MPNDHPKSVKSQAMKNPYVDSIMDGYEATRQIREIEKSHGVHIPIFALTANTREETKLSIEAEMDDHLIKPINKEALLKAIKRIYTKE

SEQ ID NO: 181801 - protein, 86 aa, Glycine max
  Coding DNA Sequence Number=SeqID_65023
  Homolog annotation: Hit_ID=O64438; Match level="QueryCoverage=66%, HitCoverage=38%, E-value=8e-08, Identity=47%"; Hit description=ARG10
MVIYYQTVFDKSTSNLFVASDQAGKICLKVLVASHLLLSLKENPKNKITAVPAEEEEIRGAFFKVILELKKLELNIHYVTTIASCN

SEQ ID NO: 181802 - protein, 47 aa, Glycine max
  Coding DNA Sequence Number=SeqID_65024
MERPKVANAIIAFAKAVNSNHQLSSKGEKLLADKVKSIVAEEDAGEE

SEQ ID NO: 181803 - protein, 58 aa, Glycine max
  Coding DNA Sequence Number=SeqID_65025
METRSTNSQVVVSNQERMRKLTSKLGANSSAFVPNWQLVSICVFIVVICMYPWKTADR

SEQ ID NO: 181804 - protein, 277 aa, Glycine max
  Coding DNA Sequence Number=SeqID_65026
MLVEALLTFMGGCSLPLLLRSGNLFDHHNLSPFCSSGQGRVVVGTIGHPPMCGVTTVLGHHRPFTVAGYEWDSCKIAIQACGSDDFPFLRAMLGSPPFFFVYRCFFDVLDKIGWVSLNTLSKKLFEFDLKIFCHFKDHFFKALATDIMVDGLPLMFNRDREPRFPFYRQFDPTRFKYFDEDLLTLVERVDKVILEQLPTLLGVWAILSLPSADDPFAILDGKMPYLVLFCVRGGTVPSSIVAPFVGEEGQPAVEVGPTAKVVGVIANIPSSVLANRK

SEQ ID NO: 181805 - protein, 733 aa, Glycine max
  Coding DNA Sequence Number=SeqID_65027
  Gene Ontology: Mol. function=mismatched DNA binding; Cellular component=MutSalpha complex; Biological process=mismatch repair
  Homolog annotation: Hit_ID=Q6DQL6; Match level="QueryCoverage=98%, HitCoverage=56%, E-value=0.0, Identity=68%"; Hit description=DNA mismatch repair protein
  Pfam annotation: Domain name=MutS_II; Domain location=28-191; Score =16.5; E_value=0.00089; Accession=PF05188.8; Description=MutS domain II
  Pfam annotation: Domain name=MutS_III; Domain location=207-536; Score= 76.1; E_value=1.1e-19; Accession=PF05192.9; Description=MutS domain III
  Pfam annotation: Domain name=MutS_IV; Domain location=400-491; Score =82.0; E_value=1.8e-21; Accession=PF05190.8; Description=MutS family domain IV
  Pfam annotation: Domain name=MutS_V; Domain location=542-730; Score =175.5; E_value=1.4e-49; Accession=PF00488.12; Description=MutS domain V
  Pfam module annotation: Pfam domain module=MutS_II::MutS_III::MutS _IV::MutS_V; Domain location=28-191::207-536::400-491::542-730
LVRREICSVVTKGTLTDGELLSANPEAAYLMALTEHHENHPTEVSEHLYGVCIVDVATSRVILGQFKDDLECSVLCCILSEIRPVEIVKPAKLLSAETERVLLKHTRDPLVNELVPIVEFWDADKTVDQLKRIYGNSNDVSVNNNELDCLPDVLLELVKTGDDSRSALSALGGALYYLRQAFLDERLLRFAKFELLPCSGFGDLASKPYMVLDAAALENLEIFENSRNGDSSGTLYAQLNQCVTAFGKRLLKTWLARPLCHVESVKERQEAVAGLKGVNLPSALEFRKALYKLPDMERLLARIFSSSEASGRNANRVVLYEDASKKQLQEFILALRGCEQMAQACFSLGVILSHVKSRQLHHLLTPGKVLPDVCMDLNHFKDAFDWVEANNSGRIIPREGVDTEYDSACKAVKEIESSLLKHLKEQMKLLGSTSITYVNVGKDTYLLEVPENLSKNIPRDYELRSSRKGFFRYWSPDIKVFLRELSHAESEKESLLKSTLQRLIGRFCEHHAKWKQLVSTTAELDVLISLAIAGDYYEGPTCRPSFVGTLCTKEAPYLHAKSLGHPVLRSDTLGKGDFVPNDITIGGSDHASFILLTGPNMGGKSTLLRQVCLTVILAQVGADVPAESFDLSPVDRIFVRMGAKDNIMAGQSTFLTELSETASMLSSATCNSLVALDELGRGTATSDGQAIAESVLEHLVRKVQCRGLFSTHYHRLAVDYLKDPKVLPVFYPV

SEQ ID NO: 181806 - protein, 500 aa, Glycine max
  Coding DNA Sequence Number=SeqID_65028
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q1SNJ1; Match level="QueryCoverage=96%, HitCoverage=94%, E-value=1e-123, Identity=68%"; Hit description =Glycoside transferase, six-hairpin, subgroup
  Pfam annotation: Domain name=Glyco_hydro_9; Domain location=1-493; Score=335.7; E_value=8e-98; Accession=PF00759.9; Description =Glycosyl hydrolase family 9
MAGKLEKKRVWWRGDSGLRDGSEENLDLSKGMYDAGDHMKFGFPLAFTATMFSWAILEYGDRMDAVKQLHYALDSLKWITDNLVNAHPFPEVLYIQSFLLCLSCRQAAGFTRDLELDHNCWERPEDKKLRTPLSRGSWLCEGMGEGCCTQPYPCICKEVVSGFEPMTNKSPRHNFTAAPGLALWERPEDMKEKRPLTQVNSSFPGTEVAAETAAALASASLVFNEIDFAYSRILLQHAQQPFIFADTYRVSYSVGIPHLVLGMNSYGQNEKAFGNLEILSWDDKHAATQVLLSRVNFFGASNIPDAENLDLQMYRETAEILMCMLLPDSPTATTNRTESGLIWVVPWNSLQLSVASVFLAVLYRDYMLTSQTEILYCSGKLYKPVDLRKFSISQFQADYVLGENPMKMSYLVGYGTQYPKYLHHRGSSIAVNATTGCKDGFKWFESPHPNPNVAFGALVGGPFFNETYNDFRNNSMQSEPTTYNGTSWLLSYLAWLLVPP

SEQ ID NO: 181807 - protein, 72 aa, Glycine max
  Coding DNA Sequence Number=SeqID_65029
MTHKQPSSEGRGIWKHYFDESGHKHRVIRVIPCLDIIIQEQRPLNADSPHHIFCELLSPMTSPPPHQPHYLT

SEQ ID NO: 181808 - protein, 156 aa, Glycine max
  Coding DNA Sequence Number=SeqID_65030
  Gene Ontology: Mol. function=zinc ion binding
  Homolog annotation: Hit_ID=Q1RUT0; Match level="QueryCoverage=85%, HitCoverage=63%, E-value=6e-27, Identity=51%"; Hit description=Zinc finger, RING-type; RINGv
MVQRKRKYNLQYEPGYTAPPPKKSKINDETMSIREEEEPSNARIEIMVEGVEMESDYSECSSAADRSASCCRSLAIAFTLVLLVRHLFAVLTYGTEDYPFTLLTVIILKASGIIIPMYIVIKIIGAIQNSIQHYQDSDYDEDDENDIQHNVNSRHF

SEQ ID NO: 181809 - protein, 643 aa, Glycine max
  Coding DNA Sequence Number=SeqID_65031
  Gene Ontology: Mol. function=nucleoside-triphosphatase activity; Cellular component=membrane; Biological process=protein catabolic process
  Homolog annotation: Hit_ID=Q9ZPW5; Match level="QueryCoverage=83%, HitCoverage=84%, E-value=0.0, Identity=70%"; Hit description =Putative AAA-type ATPase
  Pfam annotation: Domain name=AAA; Domain location=394-598; Score =158.2; E_value=2.1e-44; Accession=PF00004.19; Description=ATPase family associated with various cellular activities (AAA)
  Pfam annotation: Domain name=AAA_3; Domain location=394-516; Score= -17.1; E_value=0.024; Accession=PF07726.2; Description=ATPase family associated with various
  Pfam annotation: Domain name=AAA_5; Domain location=394-522; Score= -8.9; E_value=0.0085; Accession=PF07728.4; Description=ATPase family associated with various
  Pfam annotation: Domain name=Mg_chelatase; Domain location=394-528; Score=-143.6; E_value=0.0075; Accession=PF01078.11; Description =Magnesium chelatase, subunit ChlI
  Pfam annotation: Domain name=Sigma54_activat; Domain location=366 -486; Score=-190.4; E_value=0.1; Accession=PF00158.16; Description =Sigma-54 interaction domain
  Pfam annotation: Domain name=TolA; Domain location=40-348; Score= -152.2; E_value=0.066; Accession=PF06519.2; Description=TolA protein
  Pfam module annotation: Pfam domain module=AAA::AAA_3::AAA_5::Mg _chelatase::Sigma54_activat::TolA; Domain location=394-598::394 -516::394-522::394-528::366-486::40-348
  Subcellular localization annotation: CTP_CleavageSite=42; ConfidenceScore=5.61e-01
MAASRLTSCVAVTSAAVVSMSTFSDRAYADSYFRLPFFSSKSSSEPSPPNQPSDSNSEPPPPDEPNKSGFDPESLERGAKALREINSSPYSKQLFDLMRKQEETRLAELDAEKVHYELIQSQGDIERQRKMAEEQRNLIQDQAQRQAQVLRYEDELARKRLQDGLTVCEYLDAQRQHNVELVKMQDQSSFRMEQARQATEEQIQSQQRQTERERAEIERETIRVKAMAEAEGRAHEAKLTEDHNRRMLIERMQGERDKWLAAINTTFSHIEGGLRALLTDRDKLLMTVGGATALAAGIYMTREGSKVTWGYINRILGQPSLIRESSMAKFPGSKIISQAKNKVLHDSTLAGAEKPIGSKNGLGNVILHPSLQRRIEHLARATSNTKSHQAPFRNMLFYGSPGTGKTMVAREIARRSGLDYAMMTGGDVAPLGAQAVTKIHDIFDWSKKSRKGLLLFIDEADAFLCERNSSHMSEAQRSALNALLFRTGDQSRDIVLVLATNRPGDLDSAVTDRIDEVIEFPLPGEEERLKLLKLYLNKYLCDDNNGSKGGFFLKKQPQKISIKDLSEDVFREAATKTEGFSGREIAKLMASVQAAVYGRPDCILDSQPWGDDVVEDAKAKAEEAKHFAAEAVHDAEEETRSLQ

SEQ ID NO: 181810 - protein, 75 aa, Glycine max
  Coding DNA Sequence Number=SeqID_65032
  Gene Ontology: Mol. function=DNA binding; Cellular component=nucleus; Biological process=regulation of transcription
  Homolog annotation: Hit_ID=Q0PJF9; Match level="QueryCoverage=89%, HitCoverage=74%, E-value=6e-21, Identity=64%"; Hit description=MYB transcription factor MYB164
  Pfam annotation: Domain name=Myb_DNA-binding; Domain location=2-50; Score=28.5; E_value=2.4e-05; Accession=PF00249.21; Description=Myb -like DNA-binding domain
MASSWTPRQNKLFEEALAIHDRETPDRWQNVARVVGKSVEDVKRHYEILKEDIKRIERGQIPLPNYTGGKRREKK

SEQ ID NO: 181811 - protein, 169 aa, Glycine max
  Coding DNA Sequence Number=SeqID_65033
  Gene Ontology: Biological process=response to stress
  Homolog annotation: Hit_ID=Q1RUT7; Match level="QueryCoverage=98%, HitCoverage=100%, E-value=7e-41, Identity=50%"; Hit description =Universal stress protein family
  Pfam annotation: Domain name=Usp; Domain location=5-165; Score=79.7; E_value=8.8e-21; Accession=PF00582.16; Description=Universal stress protein family
MERKERKIMVGVDESEESMFALSWCITNLIADTPNVKLVLLYVKPPPPVHSFNVACMFCFLPTPQYIWYSSHAILAMEQHGKDLANSVMERAEAICKDFKTTNMKKERVVGCGDAKDVICSAVQKLEADTLVLGTHGYGFFKRALIGSVSDYCAKHAECTVVVVKQPCP

SEQ ID NO: 181812 - protein, 206 aa, Glycine max
  Coding DNA Sequence Number=SeqID_65034
  Homolog annotation: Hit_ID=O16527; Match level="QueryCoverage=82%, HitCoverage=63%, E-value=3e-11, Identity=30%"; Hit description=Ce-LEA
SLGAEEDYEKQATQNMKYQAEDAASRATETMKSAASGASDYASQKATDAKVIKMPTHSINNAKDTMGDTYEDAKQKMNTASDKVSSMAHNAKDNMEYGRDRAAMPMTRDKASDVYGEARHKVKGAMGCGEDKAVDDAKDNMGVKMEHGRDKVAETFDQAKREVGEAYVSAKNTMTKEAKAKYEAAKEKASDATGDLGAKMRNTPNL

SEQ ID NO: 181813 - protein, 71 aa, Glycine max
  Coding DNA Sequence Number=SeqID_65035
MKSLSFISPEQFIAFKVAGKKRNRRAIKHIRKEKNRGVSYLRGATEAMACGDKGVWFACEKHEGEEKGAWE

SEQ ID NO: 181814 - protein, 57 aa, Glycine max
  Coding DNA Sequence Number=SeqID_65036
MVSDASKKKAAQKKVVSVAVMAAASFKGPDKVANGIAKIQISDWTCTSLQRYSIELL

SEQ ID NO: 181815 - protein, 317 aa, Glycine max
  Coding DNA Sequence Number=SeqID_65037
  Gene Ontology: Mol. function=DNA binding; Cellular component=nucleus; Biological process=regulation of transcription
  Homolog annotation: Hit_ID=Q9ZPW7; Match level="QueryCoverage=63%, HitCoverage=66%, E-value=4e-46, Identity=50%"; Hit description =Expressed protein
  Pfam annotation: Domain name=ZF-HD_dimer; Domain location=102-161; Score=135.5; E_value=1.5e-37; Accession=PF04770.3; Description=ZF-HD protein dimerisation region
MAMRGQQDKEIEIPTTTTLGYNLLPNRDSSSSSSKLSSPTVGERSSSDHDHQTHTLIFNETPHHNLYPPPPSLAPPQPQRPTLDPDLSTPIAPTSNPPRTSTPSIRYRECLRNHAASMGSHVVDGCGEFMASGEEGTPESLRCAACECHRNFHRKEVEGELQPQSLPQQHVPNYHSYYTNKHNGHFHYPTPSSSSLHHRLVATTTATPSLVPPVMMAFGGPAESSSEDLINNTGAQLSVQQQAPLTHSSNKKRFRTKFSQHQKDRMMEFADKIDWKIQKHNEQEVQHFCTQVGVKRQVFKVWMHNNKQTSSSKKQQM

SEQ ID NO: 181816 - protein, 199 aa, Glycine max
  Coding DNA Sequence Number=SeqID_65038
  Homolog annotation: Hit_ID=Q10MK8; Match level="QueryCoverage=94%, HitCoverage=99%, E-value=6e-17, Identity=33%"; Hit description =Expressed protein
MGNQIARDATGKIVYWDGSVQEFDEPLTVAELMLEHPQQVVLDFHSAVKEKRPTPLPADEKLEMKKTYVMVPVKRGKPVLLSSEDSRRILLIVNSSLHSKYFVSSSGFLPWLSRLFHSEGEVVSVLQRKEEVEVENTVERYGFSEFLPEMIEGSRPEYMSRQLSGKGWKPSLDTIKEKKVKTKLSRWLLFLKGFSAAKI

SEQ ID NO: 181817 - protein, 196 aa, Glycine max
  Coding DNA Sequence Number=SeqID_65039
  Gene Ontology: Mol. function=transcription regulator activity; Cellular component=intracellular; Biological process=regulation of transcription, DNA-dependent
  Homolog annotation: Hit_ID=Q35QX2; Match level="QueryCoverage=71%, HitCoverage=50%, E-value=6e-33, Identity=54%"; Hit description =Regulatory protein GntR, HTH
MHGRNALHPAQAFQANHCVTCCDLQLIGFVGAGAAVLILQQSRLRLQQTARFVMQTKIVKEMAEVMQRRPAGHHRAGFAPAHQHPFRRERRQRLAHRTDRDTELRRQTVFTGQNGARRQFALQDGFTDMALHYFVQRSAFAFVQATELWNVENSSLQRALTHIADDQAQILDDLQRMLRWTPASRPDWVTQHSPTC

SEQ ID NO: 181818 - protein, 210 aa, Glycine max
  Coding DNA Sequence Number=SeqID_65040
  Subcellular localization annotation: CTP_CleavageSite=20; ConfidenceScore=5.47e-01
MDRLTTMMSALLSAQNSQAAAATVEQPLVSTTPLSTVTSPPLFLPPGCTWGMPPPVCGSPQPAVSEVPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALK

SEQ ID NO: 181819 - protein, 114 aa, Glycine max
  Coding DNA Sequence Number=SeqID_65041
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q9T3G4; Match level="QueryCoverage=64%, HitCoverage=14%, E-value=5e-23, Identity=71%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=1-100; Score=-112.4; E_value=0.042; Accession=PF00361.10; Description=NADH -Ubiquinoneplastoquinone (comple
MKRMLAYSSIGQIGYVIIGIIVGDSNGGYASMITYMLFYISMNLGTFACIVSFGLRTGTDNIRDYAGLYTKDPYLALSLALCLLSLGGLPPLSASTIPGISMNPIIEIAQDTLF

SEQ ID NO: 181820 - protein, 89 aa, Glycine max
  Coding DNA Sequence Number=SeqID_65042
MSLVESPTVATYPSAGGRRVTRGMRVPRKEYARSRHQRLFEENVGKTEGKPAKKKILSSGVVFTLEEGDHFKALDLENDPFYLVKREMT

SEQ ID NO: 181821 - protein, 214 aa, Glycine max
  Coding DNA Sequence Number=SeqID_65043
KEGPRQPKPLVLHFTRDTAPQKPRHPSAVSGVRPISFPYKNSHAVPWRYAPPSGKKEEATDISSLSAKVTNITGLSGITRSSRVFAPPDLPTQPVNAKGKARMMEGQNVKVIPTLDEDVPTKDLFEGREGCGKKEVSLEEASEFLHTIQQSEFKCRQRIKLKVLMIPKDYMNHMLLKGIKLKVLMMPKDYMNHMLLKDLLKTKQLEIFKMDNQD

SEQ ID NO: 181822 - protein, 98 aa, Glycine max
  Coding DNA Sequence Number=SeqID_65044
MVVSKTKLSKGDSKIVMDAAHSLDGPHNELMAIVSENLCKDVAIDMLRGSGPNAKLKKAEILEAAKRELSRCLLSYLEAPKSAGSPTMTKGKSKIGNS

SEQ ID NO: 181823 - protein, 43 aa, Glycine max
  Coding DNA Sequence Number=SeqID_65045
MSLEDKNAGGQQFMENGDNHKGLNKYACASVLAANIVSAIFGY

SEQ ID NO: 181824 - protein, 586 aa, Glycine max
  Coding DNA Sequence Number=SeqID_65046
  Gene Ontology: Mol. function=translation initiation factor activity; Cellular component=transcription factor complex; Biological process =regulation of transcription, DNA-dependent
  Homolog annotation: Hit_ID=O23215; Match level="QueryCoverage=85%, HitCoverage=96%, E-value=1e-171, Identity=64%"; Hit description =Transcription initiation factor like protein
  Pfam annotation: Domain name=TFIIB; Domain location=225-295; Score =31.4; E_value=3.1e-06; Accession=PF00382.10; Description =Transcription factor TFIIB repeat
  Pfam annotation: Domain name=TFIIB; Domain location=321-391; Score =49.7; E_value=9.6e-12; Accession=PF00382.10; Description =Transcription factor TFIIB repeat
  Pfam annotation: Domain name=TFIIB_Zn_Ribbon; Domain location=84-129; Score=8.6; E_value=0.038; Accession=PF08271.2; Description=TFIIB zinc- binding
  Pfam module annotation: Pfam domain module=TFIIB::TFIIB::TFIIB_Zn _Ribbon; Domain location=225-295::321-391::84-129
MHRFWPDAFIVYHFRVPENLARALSKPRKEKMQQPKGVLKVLPEDCEERVMDELNSDLDLHVSITGIMINRDKYGAKRVRRRKMKCPYCSAAQGRCATTSSGRSITECTSCGRVVEERQSHPHHVFHVRAQDNPLCLVTSDLALPALNQNNEEEDPFEPTGFITAFSTWALEPSPLYLQSSLSFSGYLAELERTLESSSSSSSSSSSSSLSSTVVVDNLRAYMQIIDVASILGLDCDISDHAFQLFRDCCSATCLRNRSVESLATAALVQAIREAQEPRTLQEISIAANVPQKEIGKYIKILGEALQLSQPINSNSISVHMPRFCTLLQLNKSAQELATHIGEVVINKCFCTRRNPISISAAAIYLACQLEDKRKTQAEICKVTGLTEVTLRKVYKELLENWDDLLPSNYTPAVPPERAFPTTVIASGRSSTAKVDAVEVISSLDSEKLPDIKPSKPSEVSGMVHQSRGMDEAEGKSNAHASHSTLNQQSTFWQSQLRSGTHNHQNVLQGMDIDVLQRNHQRPEHMAEDTNGAANGSSLKSNNQLCSPPASSASSVMRQFSAPPSSGPSNVRLVQSPKIMPGYPEH

SEQ ID NO: 181825 - protein, 40 aa, Glycine max
  Coding DNA Sequence Number=SeqID_65047
MEVWDETTTHFVILEPVTNLCKLSICHDVIFLTVSHYMNY

SEQ ID NO: 181826 - protein, 460 aa, Glycine max
  Coding DNA Sequence Number=SeqID_65048
  Gene Ontology: Mol. function=protein serine/threonine kinase activity; Cellular component=membrane; Biological process=protein amino acid phosphorylation
  Homolog annotation: Hit_ID=Q1S4F8; Match level="QueryCoverage=94%, HitCoverage=64%, E-value=1e-164, Identity=69%"; Hit description =Protein kinase
  Pfam annotation: Domain name=Pkinase; Domain location=106-352; Score =81.0; E_value=3.8e-21; Accession=PF00069.15; Description=Protein kinase domain
  Pfam annotation: Domain name=Pkinase_Tyr; Domain location=106-390; Score=124.7; E_value=2.6e-34; Accession=PF07714.7; Description =Protein tyrosine kinase
  Pfam module annotation: Pfam domain module=Pkinase::Pkinase_Tyr; Domain location=106-352::106-390
MYYYAGEQSMGKGNNNNYYNSGQHPNYYGGPHGDHVVRMQQNGMGPGGGGWGAPPPPPPMMMSSAEFSSNYSTGPAPLPPPSPNLALGLKGGTFTYEELAAATNGFNDANLIGQGGFGYVHKGVLPSGKEVAVKSLKAGSGQGEREFQAEIDIISRVHHRHLVSLVGYSISGGQRMLVYEFIPNNTLEYHLHGKGRPTMDWPTRMRIAIGSAKGLAYLHEDCHPRIIHRDIKAANVLIDDSFEAKLIKYADNAFFQVADFGLAKLTTDNNTHVSTRVMGTFGYLAPEYASSGKLTEKSDVFSFGVMLLELITGKRPVDHTNAMDDSLVDWARPLLTRGLEEDGNFGELVDAFLEGNYDPQELSRMAACAAGSIRHSAKKRPKMSQIVRILEGDVSLDDLKDGIKPGQNVAYNSSSSSDQYDTMQYNADMQKFRKAVFSNSEEFGTSSGSSGEVSQKQQRL

SEQ ID NO: 181827 - protein, 182 aa, Glycine max
  Coding DNA Sequence Number=SeqID_65049
  Subcellular localization annotation: CTP_CleavageSite=5; ConfidenceScore=5.04e-01
MTKIRSTLPMPSTAPTMALLLSSPPPPLLSRLPLSLPLPEFLEDGGESKDLCGGDGDSKEGGERDDPGGEGDCEDPLGDGGLGLFDVGGEGEGGDDEDDGGGDEGGGDDEEDGGGDDGGGDDGGGDDGGGDDGGGDDGGGDCDDGEDELSASSGVELSGVSLSGEELCGEDIVIVIVSQNSH

SEQ ID NO: 181828 - protein, 374 aa, Glycine max
  Coding DNA Sequence Number=SeqID_65050
  Gene Ontology: Mol. function=carbohydrate binding
  Homolog annotation: Hit_ID=Q10NJ9; Match level="QueryCoverage=97%, HitCoverage=87%, E-value=2e-93, Identity=45%"; Hit description =Lipase, putative, expressed
  Pfam annotation: Domain name=DUF620; Domain location=133-370; Score =541.0; E_value=1.3e-159; Accession=PF04788.3; Description=Protein of unknown function (DUF620)
MKQPAAKSSLRRLCPNIGKEDGLETVLEIPIPEEMFSSMGSNVNLRWQNMLAWMKAQTEDKLSTPTVASRLNELRFLLYLVGSPVIPLQVQLGHSVHRPVRDCSIEASTAKYIVQQYIAATGGQPALNAVDSMCVTGQIKISASDFHLNHTNETIEVKKTSEEMGGFVLWQKDPDLWCLELLVSGCKVCCGSNGKVSWRHSSNQQTPVSRNAPRPLRRFLQGLDPRATANLFLDAACIGEKIINDEECFILKLETSPAIRDAQSGPNFEIIHHTIWGYFSQRSGLLVQFEDSRLHTTRTKDDNDIFWQTSLESVIEDYKYVDGINVSHSGKTRVTVSRYGEQSANHKRELEERWKIEEVDFNIWGLNAESFLAP

SEQ ID NO: 181829 - protein, 446 aa, Glycine max
  Coding DNA Sequence Number=SeqID_65051
  Gene Ontology: Mol. function=sugar porter activity; Cellular component=integral to membrane; Biological process=carbohydrate transport
  Homolog annotation: Hit_ID=Q1XF09; Match level="QueryCoverage=99%, HitCoverage=90%, E-value=1e-164, Identity=64%"; Hit description =Putative polyol transporter protein 2
  Pfam annotation: Domain name=MFS_1; Domain location=1-401; Score =87.0; E_value=5.7e-23; Accession=PF07690.6; Description=Major Facilitator Superfamily
  Pfam annotation: Domain name=Sugar_tr; Domain location=1-441; Score =207.6; E_value=3e-59; Accession=PF00083.14; Description=Sugar (and other) transporter
  Pfam module annotation: Pfam domain module=MFS_1::Sugar_tr; Domain location=1-401::1-441
MTGALIFIKEDLQISDLQVQLLAGTLHLCALPGSMVAGRASDYIGRRYTIILASITFLLGTTLMGYGPSYLILMIGNCIVGIGVGFALVVAPVYSAEISPPSYRGFFTSLPELSSNIGVLLAFMSNYFLENLSLRLGWRMMMVLPSIPSFGLVILMLKLVESPRWLVMQGRVGEARKVLLLVSNTKEEAEQRLRDIKGIVGIDENCTLDIVQVPKNTRSGAGALKEMFCNPSPPVRRILIAAIGLHFFMRIDGYGGFLLYIPRVFERTGITDKSTLMLATVGMGITKVVFAFVSMFLSDRVGRRILLLISAGGMVVTLLGLGICLTIVEHSKEKLVWATTLTVIFTYIFMGIACTGVGPVTWVYSSEILPLRFRAQGLGVCVVVNRLTNVVVVSSFISIYKTITMGGIFFVFTGINALALLFYSSLPETKGRSLEDMEIIFGRSSK

SEQ ID NO: 181830 - protein, 237 aa, Glycine max
  Coding DNA Sequence Number=SeqID_65052
  Gene Ontology: Mol. function=nucleic acid binding; Cellular component= ribonucleoprotein complex
  Homolog annotation: Hit_ID=Q42404; Match level="QueryCoverage=99%, HitCoverage=45%, E-value=2e-57, Identity=53%"; Hit description=U1 small nuclear ribonucleoprotein 70 kDa
  Pfam annotation: Domain name=RRM_1; Domain location=172-236; Score =4.0; E_value=0.06; Accession=PF00076.12; Description=RNA recognition motif. (a.k.a. RRM, R
  Subcellular localization annotation: CTP_CleavageSite=20; ConfidenceScore=5.15e-01
MGDNNSNNDAFMRNQNAAVQARTKAQNRSNVLQLKLIGQSHPTGLTANLLKLFEPRPPLEYKPPPEKRKCPPLSGMAQFVSKFAQPGDPEYAPPVPETETPVAQKRARIHKLRLEKGAAKAAEELEKCDESYIVNLLIFHDFVFSGCHSYIGFYADDPHNDPNVSGDPYKTLFVAKLSYETTESRIKREFESYGPIKRVGIFEYPSGDSVRLVADKDTNKPRGYAFIEYLHTRDMKG

SEQ ID NO: 181831 - protein, 241 aa, Glycine max
  Coding DNA Sequence Number=SeqID_65053
  Homolog annotation: Hit_ID=Q1S4F6; Match level="QueryCoverage=42%, HitCoverage=38%, E-value=1e-28, Identity=55%"; Hit description=U1 snRNP-related
MNFHFSGSNSSLVLKNQECGRTDTVIETGKYHVKELGTKTKNGSDHVNILMKGSGIAIRERIGTTETEIGPGTETGKEIEIEIVDVIEIEHVIVSEGGTVTGIENMIDIVRGIEIMKLAKLIEDAHVIGSLIIIVLNLNMGKGIMTMSLRMIVVGKTSMSMDIGMQTLIMTLLSIMTPTIMEMIVVTITISILTLIGWKMTTMQDVQHLNHMKRREVMMWTVNIGAQRDHIPGSMIIRNWA

SEQ ID NO: 181832 - protein, 71 aa, Glycine max
  Coding DNA Sequence Number=SeqID_65054
MAKFDPEIVMEFYANAWTTEEGCEYSQGRSQASGFDEEAITQLLCIPGQDFAQTAAGRRVQIMRTNMTTLT

SEQ ID NO: 181833 - protein, 372 aa, Glycine max
  Coding DNA Sequence Number=SeqID_65055
  Gene Ontology: Mol. function=oxidoreductase activity; Cellular component=proton-transporting two-sector ATPase complex; Biological process=flavonoid biosynthetic process
  Homolog annotation: Hit_ID=Q3T7D5; Match level="QueryCoverage=99%, HitCoverage=100%, E-value=0.0, Identity=85%"; Hit description =Flavanone 3-hydroxylase
  Pfam annotation: Domain name=2OG-FeII_Oxy; Domain location=196-297; Score=145.5; E_value=1.4e-40; Accession=PF03171.10; Description=2OG -Fe(II) oxygenase superfamily
MAPTAKTDLAYLAQEKTLELSFVRDEDERPKVAYNEFSNEVPVISLAGIHEVGGRREEICKKIVEACKNWGIFQVVDHGVDQQLMAEMTRLAKEFFILPLDEKIRFDMSGGKRGGFNVSSHLRGESVQDWREIVIYFSYPMRERDYTRWPDTPKGWRSVTESYSEKLMALACNLLEVLSEAMGLEKEALTKACVDMDQKIVVNYYPKCPQPDLTLGLKRHTDPGTITLLLQDQVGGLQATRDNGKTWITVQPVEGAFVVNLGDHCHYLSNGRFKSADHQAVVNSNHSRLSIATFQNPVPNATVYPLKVREGEKPVMEEPITFAEMYRRKMSKDLEIAGMKKLAKKKDFENEKHFQELEKAKVEAKPLKEILA

SEQ ID NO: 181834 - protein, 108 aa, Glycine max
  Coding DNA Sequence Number=SeqID_65056
MKLKAENENETKGKRRNRNEIAIRRRRVTPGCVFQERNTRGVATNVYLRKTSEKPEKTLSYPNFVRGLLLDDMQPLIDRFGILGILCFRICEVPRHAGNQKEAGLRDP

SEQ ID NO: 181835 - protein, 35 aa, Glycine max
  Coding DNA Sequence Number=SeqID_65057
EESGPTYEGNYEIAPLIKAATPHFHANPSFFEAKF

SEQ ID NO: 181836 - protein, 335 aa, Glycine max
  Coding DNA Sequence Number=SeqID_65058
  Gene Ontology: Cellular component=GPI-anchor transamidase complex
  Homolog annotation: Hit_ID=Q2R4C3; Match level="QueryCoverage=68%, HitCoverage=42%, E-value=2e-45, Identity=41%"; Hit description=Gpi16 subunit, GPI transamidase component family protein, expressed
  Pfam annotation: Domain name=Gpi16; Domain location=2-277; Score= -207.0; E_value=3.1e-06; Accession=PF04113.4; Description=Gpi16 subunit, GPI transamidase component
MSTDHLDGSRSGINLEQTVTVVLQPNDQKAGPEDFRRNAGFELSVTPKRVHAEMETSSSILYEYPIKEYTETEQFDLGLTWKHPIVWYSPHAPLYASRFSMGSGNERGAIAISLKLIQGLVAINNVKERLVDERPQALTDFVERMRVSPSEDKVSPGVMEMGFLHIDEYPPDVNQGFGIPSAIISFPDFHDGLQFSDKSRSKSPLLFTELLLVPLTTPDFGMPYNVITITCTVFALYFGSLLNVLWRGVGEEERLLKNKVFALYFGSLLNVLQRGVGEEERLLKNKAANVFVLLPVDANKAVFLHQVLSKLYLPSLEADHWNQLCPLPCHRPLLV

SEQ ID NO: 181837 - protein, 57 aa, Glycine max
  Coding DNA Sequence Number=SeqID_65059
MVKQGNKGLAKKSVMREQKKSIEALSVFNGQHHDIVEMQITSGEEESNWPNKRGKTL

SEQ ID NO: 181838 - protein, 69 aa, Glycine max
  Coding DNA Sequence Number=SeqID_65060
  Gene Ontology: Mol. function=RNA-directed DNA polymerase activity; Biological process=RNA-dependent DNA replication
MCMDYTNLNKACPKNASLLPNIDRLVNGAYVFKLLSFLDAYSSYNQIKMYPLDQEKTNLIANGANFCYK

SEQ ID NO: 181839 - protein, 50 aa, Glycine max
  Coding DNA Sequence Number=SeqID_65061
MVHSTHQIQLIGEKSSFTDWYKKNLGYSKFFERTCPDMVPSTLSSEDQLV

SEQ ID NO: 181840 - protein, 134 aa, Glycine max
  Coding DNA Sequence Number=SeqID_65062
MIGTHKPEAFTDSLCKKRSANMDELRRHAVSFIQMEELSEFYDKVKGDQKKLDSHKEKLKPPKYATYIPLTESQACILEKAFNSKILALPLPTVIEEKEEVAIETILKEDILVDKATTINKGEQRQQEIPQGIV

SEQ ID NO: 181841 - protein, 80 aa, Glycine max
  Coding DNA Sequence Number=SeqID_65063
MKPEVLKGSKNKSSRRRDQNPRSWFLKTLSIKLGTVNREEVPSSEIDCEKVLLRSLHREICCVLGDPCWCLSGGAVEVVS

SEQ ID NO: 181842 - protein, 235 aa, Glycine max
  Coding DNA Sequence Number=SeqID_65064
  Homolog annotation: Hit_ID=Q69JZ1; Match level="QueryCoverage=24%, HitCoverage=9%, E-value=2e-11, Identity=58%"; Hit description=AP endonuclease 2-like
  Pfam annotation: Domain name=zf-GRF; Domain location=130-164; Score =13.0; E_value=0.0008; Accession=PF06839.3; Description=GRF zinc finger
MAQEDIAMDSTCERKEPVNRAGSSQESVSKSGSENETSTTRQCNKSNKKLKVVNGPSSHFGHFSRKVQILTMETPTVFAHSSSPKKYGLDTDTCDQDLAGPNGSSTKEEMSNVASLEWQRIQQLMQNSIPICKGYKEPCIARVVKKQGPNFGRRFYVCAHAEDFGGGFKARGRFVALKHKKGKHKANGDCQMGVEEDARWLRDLANGANVVGFIITEEDKGKFPKIQVIVEEFVK

SEQ ID NO: 181843 - protein, 135 aa, Glycine max
  Coding DNA Sequence Number=SeqID_65065
  Gene Ontology: Mol. function=nuclease activity; Cellular component =mitochondrial inner membrane; Biological process=DNA repair
  Homolog annotation: Hit_ID=Q69JZ1; Match level="QueryCoverage=54%, HitCoverage=11%, E-value=6e-21, Identity=64%"; Hit description=AP endonuclease 2-like
MRERMKIVSYNVNGLRQRIAQFGSLRNLLNSFDADIVCFQETELRRQEVTADLVMAGGYESFFSCTRTSQKGRTGYSGNPSLSSSKWKCKQIHGIGMKDSSRRHIQGERNKGADTGQRGADSSKGKEDHHKALLP

SEQ ID NO: 181844 - protein, 134 aa, Glycine max
  Coding DNA Sequence Number=SeqID_65066
MGEEGNGNKRNGKRETERVVSIRSKPKVGEVKQQRYEEEEEMMKGFGKSEREKEKERRNRDKMIRKKRREEKRRDEREGKEGVVKEERIIFLHFLLFSSSYVIATHLLSRALLSRLHYPRALFYLTECFGLALY

SEQ ID NO: 181845 - protein, 105 aa, Glycine max
  Coding DNA Sequence Number=SeqID_65067
MPQLQHRIISYEEQGSQLFNTDNIRKHLNNAWKLFYSNFDETDEEESRINNFRIDELRKRNNGGIARFYARKVAKRREIENLQTLTRCKMMKEEARSTKLHLLFF

SEQ ID NO: 181846 - protein, 391 aa, Glycine max
  Coding DNA Sequence Number=SeqID_65068
  Gene Ontology: Mol. function=metal ion binding
MVERLSGSVGFRDAFLRSVDCVGLLSVALTRRQVVDEKYTRPQGLYNHKDVDHKKLRKLILESKLAPCYPGDEETAYDREECPICFLYRGVKSKEEKGLEQIEEQRVIEAKIRMRQQELQDEEERMHKRLEMSSSNVNVAVADVEYSSNAVSSSSVSVVENDEIVSSQDSCATSVVRANATTRTNSATYKENGRRRNLSFVDATSGHYVADGRYVSSVSSVSSVMGPPTGSSSSPSGGLACAIAALAERQQMAGESSMSLTNENMPSFNTLPGSRRFYNRLGRDMANYPPGDNLNEEPLDEAVTMTRSHGEWDMDHGTQLTETATSYTNSVAAEDRGELSSLPRSDDNDGSLQSATEPIVPESFEEQMMLAMAVSLAEARAMSSGQSASWQ

SEQ ID NO: 181847 - protein, 67 aa, Glycine max
  Coding DNA Sequence Number=SeqID_65069
MGIGAAASQDRCFLYCNARGACHAFICRFSSLPVIAECKYLLISTVNLLPYSAIQALPIYFITFTWT

SEQ ID NO: 181848 - protein, 201 aa, Glycine max
  Coding DNA Sequence Number=SeqID_65070
  Gene Ontology: Mol. function=N-acetylmuramoyl-L-alanine amidase activity; Cellular component=outer membrane; Biological process =peptidoglycan catabolic process
  Homolog annotation: Hit_ID=Q6D3S9; Match level="QueryCoverage=94%, HitCoverage=73%, E-value=5e-58, Identity=54%"; Hit description =Putative N-acetylmuramoyl-L-alanine amidase
MAIAPRQQTLHVAFVRPGADAGLGQLPPWEQRAGILFTLRRDVAVPHHVLRLDAIALDNVAAQRDQHGDLLRRIGLPVGEQHAAGEALVDDFDADRGVIEVAAAAPGAGAGMPGAHRFRHQAEHRRFTVFALRMRRQQIMRADVFVVHHQKADALIRALRLMQGFELVSAAIDERVLLRVLASRQQRGGDDPWPNFHLSSL

SEQ ID NO: 181849 - protein, 250 aa, Glycine max
  Coding DNA Sequence Number=SeqID_65071
  Homolog annotation: Hit_ID=UPI00003CD4EC; Match level="QueryCoverage =82%, HitCoverage=76%, E-value=7e-29, Identity=33%"; Hit description =COG5424: Pyrroloquinoline quinone (Coenzyme PQQ) biosynthesis protein C
  Pfam annotation: Domain name=TENA_THI-4; Domain location=24-244; Score=8.1; E_value=8.2e-05; Accession=PF03070.6; Description=TENATHI- 4 family
MTALNQYGMHLEITPHNGWSQQFWDDLLPAKERVSKHPFFSEMANGGLSLDSFRYALLNFYPLVAHFPSYMAGALGKATGFSEPGVTEARDWLIQNIKIEERHLKWYRDWAGGFGLTVDELDHVRPPAAMNAVNHFLWNMSHRGNLAECLAATNLAIEWATGDWSIQVYKGIHTYTDHPEVTIDKRSLAWLRAHAHYDDLHPYEAMELIKRLCNDRPDWQQKAFHAAEEGLRYYELALDDCYKVQLQASA

SEQ ID NO: 181850 - protein, 66 aa, Glycine max
  Coding DNA Sequence Number=SeqID_65072
MELARSMDMGISCIKSLPTGEVHTWRPSSVSSGCGIWRCKESNKEIYTNSDSIQPIELIFDVYNLN

SEQ ID NO: 181851 - protein, 494 aa, Glycine max
  Coding DNA Sequence Number=SeqID_65073
  Homolog annotation: Hit_ID=Q1SND7; Match level="QueryCoverage=51%, HitCoverage=95%, E-value=1e-119, Identity=83%"; Hit description =Probable tumor-related protein T9L24.46 [imported]-Arabidopsis thaliana
  Pfam annotation: Domain name=ADH_N; Domain location=284-381; Score =88.3; E_value=2.3e-23; Accession=PF08240.2; Description=Alcohol dehydrogenase GroES-like domain
MANNNEEEEEAVAPMVKLGSYGGEVRLVVGGEESAAEETMLLWGIQQPTLSKPNAFVSQASLQLSLDSCGHSLSILQSPSSLGTPGVTGAVMWDSGVVLGKFLEHAVDSGMLVLQGKKIVELGSGCGLVGCIATLLGSEVIVTDLPDRLRLLRKNIETNMKHVSLRGSVTATELTWGEDPDPELIDPKPDFVIGSDVVYSEGAVVDLLETLMQLSGPNTTIFLAGELRNDAILEYFLEAAMDNFTIGRVEQTLWHPDYCSNPAVAWGAGEALVIEEVEVSPPQPMEIRIKVVSTSLCRSDLSAWESHAIFPRIFGHEASGIVESVGQGVTEFKEGDHVLTVFIGECISCRQCTSGKSNTCRFGIGKDGEYTVVHSGCAVKLSPLAPLEKICLLSCGVAAAWNVADVSKGSTVVIFGLGTVGLSGWGLTVTLGVPKVKLEMSARYGLLLMGRTLKGSLFWGWKPKSDLPSLVKKYLNKGGIENATSNAYQSYFLA

SEQ ID NO: 181852 - protein, 111 aa, Glycine max
  Coding DNA Sequence Number=SeqID_65074
MFVKFLIFFCKASICSLKSATTIVSLETEDELEIRIAARLPWWHCRMKLPENAQQLPLADMYKSSEQAAGTEPQSRRRRSNSAWEEEATSSFINPNFFGEEEATLHVREIL

SEQ ID NO: 181853 - protein, 208 aa, Glycine max
  Coding DNA Sequence Number=SeqID_65075
  Gene Ontology: Mol. function=protein serine/threonine kinase activity; Cellular component=integral to membrane; Biological process=protein amino acid phosphorylation
  Homolog annotation: Hit_ID=Q0PW22; Match level="QueryCoverage=71%, HitCoverage=23%, E-value=2e-56, Identity=74%"; Hit description =Leucine-rich repeat receptor-like kinase
MSNIRTTKQTEEERKTEVDKDNNNNDMNDNLHKNRNLPRTSEARQQMQAKAQGVADAVSEGQSSEKTDVFGFGILLLELITGQRALEFGKAANQKGAMLDWVRKLHQEKKLELLVDKDLKTNYDRIELEEIVQVALLCTQYLPGHRPKMSDVVRMLEGDGLAEKWEASQSADTTKCKPQELSSSDRYSDLIDDSSLLVQAMELSGPMM

SEQ ID NO: 181854 - protein, 182 aa, Glycine max
  Coding DNA Sequence Number=SeqID_65076
MGTSKLKASSRIVVRLAVRDCPRTCRGLELGTWNATLPRDLLVAYYALNRLTRVSKLSVDLGRSPPYQASRCSSGSVVPSYRLRLSYFHPKVCPVGHCMWERLKSSAVLTMRRGCDSPWPLPFLAPPRGVAPSPRCVFGVVVHYTCLSLIPDEDGNLREGSRVRPNRMLTMDEQERVDKSCA

SEQ ID NO: 181855 - protein, 150 aa, Glycine max
  Coding DNA Sequence Number=SeqID_65077
  Gene Ontology: Mol. function=tyrosine decarboxylase activity; Biological process=amino acid and derivative metabolic process
  Homolog annotation: Hit_ID=Q8RY79; Match level="QueryCoverage=52%, HitCoverage=25%, E-value=7e-14, Identity=42%"; Hit description =Tyrosine decarboxylase 1
MAYASQKMKITLHRLALYQGVCPIYMEFCDDSEATFRRAFNLLQDGCVYATGLNDFGQLRVSERKGGGVIQGTASEAVLVVLLAARDKILRRVGRNALPKLVMYAYDQTHSALLKAWQVGTTSSTAVDPLLALGKIAKTFYIGSKETDVE

SEQ ID NO: 181856 - protein, 257 aa, Glycine max
  Coding DNA Sequence Number=SeqID_65078
MTFEVGAVLEDANWQAPVNCFDENDKEKNIPILGSAVRGGSLGSYDVHFVLKELVRKSISETEVSNVSAMSQQSSALESGSFHSPVDEKLILKFVVEEMLIGHADHISESRSLKDQILGYSGSELSDDEEEDCLEQILYSASFEELASNYVKYDTVIWLAISLLLVLAWGIGLLMLLYLPIRRYVLQKDLSSRRLYVTCTEVVYKALLQSRLSTSVKEVFLHRFTTVVVGGVVKNERFSTTVVEDRLRMLKHSTSVV

SEQ ID NO: 181857 - protein, 75 aa, Glycine max
  Coding DNA Sequence Number=SeqID_65079
  Homolog annotation: Hit_ID=Q153F8; Match level="QueryCoverage=78%, HitCoverage=17%, E-value=2e-21, Identity=78%"; Hit description =Pectin acetylesterase
MAKERKDSTVKMVNGFRNQMLNAIKGFSRSPQNGLFINSCFAHCQSERQDTWFADNSPVIGNKNIHLEKNSRTFT

SEQ ID NO: 181858 - protein, 174 aa, Glycine max
  Coding DNA Sequence Number=SeqID_65080
  Gene Ontology: Mol. function=acyltransferase activity
  Homolog annotation: Hit_ID=Q69FA1; Match level="QueryCoverage=63%, HitCoverage=23%, E-value=2e-25, Identity=52%"; Hit description =Anthocyanin acyltransferase
MMKPGNCLAPRIVSLKRGMLIGENAIIEAVIAIRRKVRDFQLDAMKGFESVISDSEELSQPGTKSVVTIAGSPKIGAYETDFGWGKPKKSEILHIENSGSISLSDSRDQEGGVEVWTTYFRKTFLPDYFRKTAFPKNFRKTLLPKEGGLPEELQKTFWKKCFWEVFRKKGLPEE

SEQ ID NO: 181859 - protein, 102 aa, Glycine max
  Coding DNA Sequence Number=SeqID_65081
MEHQIFTQPYLQNTTVLRQLQKGVLIGFGGAATRRDAGRRDGGAGKRHSYLRATYKDGHPRPTSLNVSRATHVAHKMLTYLRNCHRYSYYDVFGRNDVERAS

SEQ ID NO: 181860 - protein, 42 aa, Glycine max
  Coding DNA Sequence Number=SeqID_65082
MDMELAGFSHHGTQHSKYPHQTCVAKTDRNHVSVSTDFTMVI

SEQ ID NO: 181861 - protein, 124 aa, Glycine max
  Coding DNA Sequence Number=SeqID_65083
  Homolog annotation: Hit_ID=Q9T041; Match level="QueryCoverage=52%, HitCoverage=6%, E-value=2e-09, Identity=54%"; Hit description =Microtubule-associated protein TORTIFOLIA1
MGEQNKGVQAGAAVCMAKMVECGGGGGGGEAVSVATFQKLCPRICKLLNSSVSEPYWSCIEVVSSLRKPYLSRVPAVLEAQEKKSTKEYYEKLKHLLHPLLTAIGSIGQEVAQTPGILYLFDKH

SEQ ID NO: 181862 - protein, 60 aa, Glycine max
  Coding DNA Sequence Number=SeqID_65084
  Homolog annotation: Hit_ID=Q1SND7; Match level="QueryCoverage=81%, HitCoverage=18%, E-value=7e-17, Identity=86%"; Hit description =Probable tumor-related protein T9L24.46 [imported]-Arabidopsis thaliana
MRKQGVVHVKMGTNGVTGAVMWDSGVVLGKFLEHAVDSGMLVLLQGKKIVELGSGCGLVG

SEQ ID NO: 181863 - protein, 247 aa, Glycine max
  Coding DNA Sequence Number=SeqID_65085
  Gene Ontology: Mol. function=transporter activity; Cellular component= integral to membrane; Biological process=transport
  Homolog annotation: Hit_ID=Q010B9; Match level="QueryCoverage=73%, HitCoverage=21%, E-value=2e-61, Identity=63%"; Hit description=[R] KOG0255 Synaptic vesicle transporter SVOP and related transporters
  Pfam annotation: Domain name=DUF572; Domain location=1-244; Score =345.5; E_value=8.8e-101; Accession=PF04502.3; Description=Family of unknown function (DUF572)
MGERKVLNKYYPPDFDPSKLPRARRPKNQQIKVRMMLPMSIRCNTCGNYIYKGTKFNSRKEDVIGETYLGIQIFRFYFKCTKCSAEVTMKTDPQNSDYIVESGATRNFEPWRAEDEETDKMKEKREAEEMGDAMKSLENRTLDSKREMDILAALDEMKSMKSRHATVSVDEMLEALQRTAADKPLCICKGKAAYNIPSPYLRIAKSLWAMGIQTVLSEEFVMKILKQRRNWFSFQMDMAKHPVLILS

SEQ ID NO: 181864 - protein, 105 aa, Glycine max
  Coding DNA Sequence Number=SeqID_65086
MALDGMGWCGSQQGRGGRTTSKCTTVLEDDNGGGTQERHGVGVVWQGDARKKFEGKGRGCRDLESGQKGDFTKLGSLANWTVEIVAPFEKFFFGESFEKGLDFLI

SEQ ID NO: 181865 - protein, 85 aa, Glycine max
  Coding DNA Sequence Number=SeqID_65087
MEIAINFSVTSSKRSWILSKKEAVCDKIHSKLSSQLVERVIQFRAPSLELNGKDGSLRENALCGAYGRGRKVQRESNDKVLDPHA

SEQ ID NO: 181866 - protein, 43 aa, Glycine max
  Coding DNA Sequence Number=SeqID_65088
FECDESSETQDIDNVSESAPAADSASTNNSKQAAPYVTCAVGH

SEQ ID NO: 181867 - protein, 239 aa, Glycine max
  Coding DNA Sequence Number=SeqID_65089
  Gene Ontology: Mol. function=acyltransferase activity
  Homolog annotation: Hit_ID=Q69FA1; Match level="QueryCoverage=64%, HitCoverage=42%, E-value=4e-29, Identity=38%"; Hit description =Anthocyanin acyltransferase
MLLKQNATWHHHLKLYYHFSIGISSKTPKGLSSFCGRSSYIWNTPIESIIKEPSNVVDSNGKVRHGFVLSRDLVEKLKKWVSFKCKRSNQKRPIMLALILIMMKPGNCLAPRIVSLKRGMLIGENAIIEAVIAIRRKVRDFQLDAMKGFESVISDSEELSQPGTKSVVTIAGSPKIGAYETDFGWGKPKKSEILHIENSGSISLSDSRDEEGGVEVWTSTWKGSNEQILYYLGRISQKY

SEQ ID NO: 181868 - protein, 255 aa, Glycine max
  Coding DNA Sequence Number=SeqID_65090
MSCYHRNEGLEVVAIRVWGFTPTIVCTRLVSCLLGVTGFALRVLLTEDQNNTRTNLSLPTCKIRTYRQIIQSGFSTATRPGWVSVRSRVRPHLCQYIPAHAYLSSTPPSFSFPSPSSDLLFFFPHATHVIHTNTSHRRAPNRVTSSKLPPKTKSHLCHTPSLSSKQPLKRSHQINIAPHRPSPNKIGVTPHRPPRPHHIYVVVHQDLGQATYAIKIRLAPHTTCPVEIQHPCFSFWDFIKGFVVIQFMLLSMVLG

SEQ ID NO: 181869 - protein, 812 aa, Glycine max
  Coding DNA Sequence Number=SeqID_65091
  Gene Ontology: Mol. function=nucleic acid binding; Cellular component= nucleus; Biological process=ubiquitin cycle
  Homolog annotation: Hit_ID=Q1RWA4; Match level="QueryCoverage=97%, HitCoverage=93%, E-value=0.0, Identity=79%"; Hit description=DNA -binding SAP; Zinc finger, MIZ-type; Zinc finger, FYVE/PHD- type
  Pfam annotation: Domain name=PHD; Domain location=115-169; Score =38.1; E_value=3.1e-08; Accession=PF00628.19; Description=PHD-finger
  Pfam annotation: Domain name=SAP; Domain location=11-45; Score=38.6; E_value=2.1e-08; Accession=PF02037.17; Description=SAP domain
  Pfam annotation: Domain name=zf-MIZ; Domain location=324-373; Score =87.4; E_value=4.5e-23; Accession=PF02891.10; Description=MIZ zinc finger
  Pfam module annotation: Pfam domain module=PHD::SAP::zf-MIZ; Domain location=115-169::11-45::324-373
MDLVPSVKEKLNYFRIKELKDVLTQLHLSKQGKKQDLVDRILSVLSDEQVSKIWAKKNAGGGKEQVAKLVDDTYRKMQISGATDLASKGQGASDSSSVKVKSEFDDAFQPDVKIRCLCGSRLETENLVKCDDARCHVWQHISCVIIPEKPTEGIPLVPDKFYCELCRLTRADPFWVSVAHPLHPVKLTTTSNPTDGNNPVQSVERTFQLTRADKDLVSKPEFDVEAWCMLLNDKVPFRMQWPQYTDLQVNGVPVRATNRPGSQLLGANGRDDGPIILNSIPKESDGEKFEDALARVCRCVGGGNAVDDADSDSDLEVVSDTFTVNLRCPMSGSRMKIAGRFKPCIHMGCFDLEVFVEMNQRSRKWQCPICLKNYALENIIIDPYFNRITSMMMNCGEEIAEIEVKPDGSWRVKVKSESERLELGNLAQWRLPDGTLCVSTAGDVKRVDTLKQVKQEGVSDCPAGLKLGIRKNRNGVWEVSKPEGTNTSSGNKLKGAFGNPEQVVIPMSSSATGSGRDGDDPSVNQGGGGHIDHSTTNGIEMDSLCLNNVDLAYEYNEPNTSAQVGGAEVIVLSDSEEDNDLLVSPAIAYKNNRNDATDGYSVPPPVIVDSYTEEHNLGGNSCLGLFPNDDEFGMSSLWSLPSGSQAGPGFQLFGSDADVSDALVHLQHGPMNCSSSLNGYALAPNTALGSGSILQESSAGRSDADLNGGLVDNPLAFGGDDPSLQIFLPTRPADSSMHNELRDQASVANGVCTEEDWISLSLGGGTGGNNGDASTQNGLNSRHQIPTREGATNTLDDTGLLLSDLAEMFLIF

SEQ ID NO: 181870 - protein, 269 aa, Glycine max
  Coding DNA Sequence Number=SeqID_65092
  Gene Ontology: Mol. function=transferase activity, transferring hexosyl groups; Cellular component=plastid chromosome; Biological process=metabolic process
  Homolog annotation: Hit_ID=Q1RW97; Match level="QueryCoverage=87%, HitCoverage=62%, E-value=1e-108, Identity=75%"; Hit description =Tetratricopeptide-like helical
  Pfam annotation: Domain name=PPR; Domain location=111-145; Score =39.9; E_value=8.5e-09; Accession=PF01535.11; Description=PPR repeat
  Pfam annotation: Domain name=PPR; Domain location=146-180; Score =20.8; E_value=0.0048; Accession=PF01535.11; Description=PPR repeat
  Pfam annotation: Domain name=PPR; Domain location=18-52; Score=15.4; E_value=0.11; Accession=PF01535.11; Description=PPR repeat
  Pfam annotation: Domain name=PPR; Domain location=181-214; Score=5.9; E_value=1.5; Accession=PF01535.11; Description=PPR repeat
  Pfam annotation: Domain name=PPR; Domain location=75-109; Score=16.1; E_value=0.091; Accession=PF01535.11; Description=PPR repeat
  Pfam module annotation: Pfam domain module=PPR::PPR::PPR::PPR::PPR; Domain location=111-145::146-180::18-52::181-214::75-109
MDDIVNQLLAVPLIGSEALFNMVIYYFTQARKLTRAVNVFKHMKRSNSYINHVYMETIRCLFRQMVKDGIKPDIFSLNSMIKGYVLSLHVNDALRIFHQMGVIYDCPPNALTYDCLIHGLCAQGRTNNAKELYSEMKTKGFVPSSKSYNSLVNSLALGGEIEEAVNYLWEMTDKQRSADFITYKTVLDEICRRGTVQEGTRFLQELQEKDLVDGHAYRKLLYVLEDDYGNSVSRIDSAEHAEANVDNQVLDQIKCLRMESNEIGSNLNG

SEQ ID NO: 181871 - protein, 431 aa, Glycine max
  Coding DNA Sequence Number=SeqID_65093
  Gene Ontology: Mol. function=zinc ion binding; Cellular component =intracellular; Biological process=ubiquitin cycle
  Homolog annotation: Hit_ID=Q1S199; Match level="QueryCoverage=91%, HitCoverage=73%, E-value=1e-171, Identity=72%"; Hit description=Zinc finger, RING-type; Zinc finger, C6HC-type
  Pfam annotation: Domain name=IBR; Domain location=274-347; Score =61.9; E_value=2e-15; Accession=PF01485.11; Description=IBR domain
  Pfam annotation: Domain name=zf-C3HC4; Domain location=207-250; Score= 12.2; E_value=0.0085; Accession=PF00097.15; Description=Zinc finger, C3HC4 type (RING finger)
  Pfam module annotation: Pfam domain module=IBR::zf-C3HC4; Domain location=274-347::207-250
MREELCRRIHDEKVAREISTIPEKDWEQWGDNFEKPFREGSSSSLGSREEGVVRVYFKGLVSEENVRGQNVVLSGIGVAICDLGDNLIFEVSKSLVGNDTSKVAAEIKALIEAFNAAIALDLKRVVYCCDYYPLFQFVSGKWPAKQRKIAMLVDQVDLLQRKFSYCNPRLVARHNVKFAFKLARDAIESQSTRPAESGSRRSLNETCVICLEETDASQIFSVDGCQHRYCFSCMKQHVEVKLLHGMVPKCPHEGCKYELLVNSCQKFLTQKLTETMQQRKLEASIPVAEKIYCPYPRCSALMSKTKVLEYSRNIIDQSEQSGVKKCLKCHGLFCFNCKVPWHSGMTCNTYKRMNPNPPAEDLKLKFLASRSLWRQCLKCNHMIELAEGCYHMTCRWIVANGGSACVCVLSYSHLSKNSLIPMPISKAQVYR

SEQ ID NO: 181872 - protein, 80 aa, Glycine max
  Coding DNA Sequence Number=SeqID_65094
MYEARKKMFNEEEFKQHMTTTTGLLHVIERYAHEDSQLQTKLTSEKRIYSDDESDLDLEDKLLWMNEIQSCQPNLQCFRL

SEQ ID NO: 181873 - protein, 405 aa, Glycine max
  Coding DNA Sequence Number=SeqID_65095
  Gene Ontology: Mol. function=hydrolase activity; Cellular component =cellulose and pectin-containing cell wall; Biological process =aromatic compound metabolic process
  Homolog annotation: Hit_ID=Q1S193; Match level="QueryCoverage=98%, HitCoverage=80%, E-value=1e-174, Identity=76%"; Hit description =Alpha/beta hydrolase fold
  Pfam annotation: Domain name=Abhydrolase_1; Domain location=178-403; Score=13.3; E_value=0.00073; Accession=PF00561.10; Description =alphabeta hydrolase fold
MEWVKMKEYAREFMVGVAEMTVEFGKGCRDIVKQSLVNDDSYIVKNFGRDSYIGKTVREPFAKLFAKLSFFNEYLPEDKDPLHAWSVIFFVSILAFLALYANFECDPYAAAAPVKQVFVHPPSATRVVLPDGRYMAYKEQGVSSHKARFSVIAPHSFLSSRLAGIPGVKDSLLEEFGIRLLTYDLPGFGESDPHPNRNLESSATDMAFLANALDVDKFWVVGYSSGSMHAWAALRYIPDRLAGAAMFAPMVNPYDPIMTKEERRRTWNKWTRKRKFMYFLARRFPRLLAFFYRRSFLSGKHGQIDRWLSLSLGNRDKALMEDPIYGEFWQRDVEESNRQRNVKPFMEEAALQVANWGFSLSDLKLQKRKQSSNLLSWLKSMFTETEEYMGFLGPIHIWQVSTSMF

SEQ ID NO: 181874 - protein, 202 aa, Glycine max
  Coding DNA Sequence Number=SeqID_65096
  Gene Ontology: Mol. function=oxidoreductase activity, acting on the CH-CH group of donors; Cellular component=mitochondrion; Biological process=electron transport
  Homolog annotation: Hit_ID=Q1RWA6; Match level="QueryCoverage=92%, HitCoverage=45%, E-value=1e-102, Identity=96%"; Hit description=Acyl- CoA dehydrogenase
  Pfam annotation: Domain name=Acyl-CoA_dh_1; Domain location=51-200; Score=217.7; E_value=2.5e-62; Accession=PF00441.14; Description=Acyl- CoA dehydrogenase, C-terminal doma
  Pfam annotation: Domain name=Acyl-CoA_dh_2; Domain location=66-189; Score=48.1; E_value=3e-11; Accession=PF08028.2; Description=Acyl-CoA dehydrogenase, C-terminal doma
  Pfam module annotation: Pfam domain module=Acyl-CoA_dh_1::Acyl-CoA_dh_ 2; Domain location=51-200::66-189
MKDENLTLFMFDYRFNTAQKLDKLGMRGSDTCELVFENCFVPDENVLGKEGKGVYVMMSGLDLERLVLAAGPLGIMQACLDVVLPYVRQREQFGRPIGEFQFIQGKIADMYTSLQSSRSYVYSVARDCDNGKIDPKDCAGAILCAAERATQVALQAIQCLGGNGYVNEYPTGRLLRDAKLYEIGAGTSEIRRMIIGRELFKE

SEQ ID NO: 181875 - protein, 622 aa, Glycine max
  Coding DNA Sequence Number=SeqID_65097
  Homolog annotation: Hit_ID=Q10MZ2; Match level="QueryCoverage=95%, HitCoverage=90%, E-value=1e-122, Identity=42%"; Hit description =Expressed protein
  Subcellular localization annotation: CTP_CleavageSite=38; ConfidenceScore=5.81e-01
MVSHPKSKFSVYQNPSFSAVLTSNSLQPSKFTILSFFSASAFAFLAVFFRENGFVHILSFAAFSPVTAYWLAKTLQAIVGFIFIVSALFKVVFLRRVRYAGGGVVAAKSLSDANSVHRNEILLTKHQLGLLGVKPKVDLAQPDSAKKPPKSKLQLPSSDLLVPLHRPIPSPTQGSSSSIDADGSNSNRGGAARSIGSVSPPRGSAGVDSAVSSPWSNRQASSVTKITAEEKLEKFIAEVDERINESAGKMSTPPPIVSGFGIVSPITVTGSTNTSGTARRTSLRLVRMSPGSQKFNTPPKKGEGKFPAPMSMEESVQAFEHLGIYPQIEQWHDQLWQWFSLLLLNPLLNKIETSHIKVSFILHFFSYVQSKVMQAAAKLGISITISQVGSDMLSTGTPSALPTINKNQEWQPAMSLNEDGLLHQLHSTLVQAIDSSKSVSTADSLVPVMQDCVDAITEHQRLQPLVKGEWLKLAERTCLKNYEYLGSGEVYDKKNKKWTLELPSDPYLLLYLFCAFLEHPKWMLHEDAMSYAGAQSGKNRLFLGVLPPKERFPVKYIAVVSTVPSVLHPGACILAVGKQGPPIFALYWDKKSQFSLQRPLQFPAQPFYCTWEYCTLSEMKFG

SEQ ID NO: 181876 - protein, 906 aa, Glycine max
  Coding DNA Sequence Number=SeqID_65098
  Gene Ontology: Mol. function=nucleic acid binding; Cellular component= chromatin; Biological process=DNA integration
  Homolog annotation: Hit_ID=Q1SRN1; Match level="QueryCoverage=64%, HitCoverage=49%, E-value=1e-149, Identity=42%"; Hit description =Integrase, catalytic region
  Pfam annotation: Domain name=rve; Domain location=316-422; Score =16.4; E_value=0.00025; Accession=PF00665.16; Description=Integrase core domain
  Pfam annotation: Domain name=zf-CCHC; Domain location=201-218; Score =10.3; E_value=0.02; Accession=PF00098.13; Description=Zinc knuckle
  Pfam module annotation: Pfam domain module=RVT_2::rve::zf-CCHC; Domain location=592-804::316-422::201-218
  Subcellular localization annotation: CTP_CleavageSite=49; ConfidenceScore=5.00e-01
MTLLVVRHLLILFLCKVSSSPATFSHSIFEKLTTSNYLLWHSVTGVSQLGEARSASSFLVTIDDLWICSSSSCRMHYFMASLGETSLTFPFDCSHKEASISTELRNLSLDNRKITDYLLHVQTLVDALTSIGDSVLQSEKVDVILGGFRQKSLLAHESRLDKLSKKSLGAGNPIPAEVVAYRGSHDGGRSRGGGHGKFADVRCQVCHKLGHEASFCYHSTYPPPPPPFNPYNPYPFFPYPPQYMPPQYQSQPMNPTSSSPSPQAHVASVQPVQSANWYPDSGSSNHVSKEVLLHGLVGHDGLYHFPDLLQSSRQSSSSSPAPFTSHSGFKYYVTFVDAHSRFTWMYLLKNNVIRRLILPHTHHQNGVVERKHRHIVEMALTMLSQASLPLEYWDNVVVSSVYLINRLPSSAIQNEVPYQNLFDKLPDYKCLSSDGRIYISKDVIFKEAKFPYPQLFAEPVTSSTQASNSTLSVLPSVLNPVAPAMSQSTGNNSTHEVSSTSGTNSTNEVSSSSISPEPAATSYLSASTDHLPSPQPEVSSNPVISAPVPPTSVHSPAESPPLLVRADNTHPMCTRAKAGIIKPRLQPTLLLTHAEPKSTKSPIGCKWVFRVKENPDGTVSKYKARLIAKGFHQRLGYDYNETFSPVIKPITVRILLTLAVTNKWKLQQLDANNAFLNGILEEEVYKTQPPGFEDSNKHLSFKSSKCDPSLLVYSDTSTVVYMLVYVDDIIVTGNNHTFIKSLVSKLHSEFSLKDLGDLDYFLGIEVSSQPNGSLLLTQSKYITDLLAKTTMDEANSISSPMVGGCKLTQTGYEYFSDPSLYRSVLGALQYATIARPEISFSVNKGCQFMSKPTDQHWIAVKRILRYLKGTINFGLVCSLISLSLTILFMPIVMLTGHQILMIEGPP

SEQ ID NO: 181877 - protein, 42 aa, Glycine max
  Coding DNA Sequence Number=SeqID_65099
MDEVSAREKGTTSWLNISHEEGERSIVVVAALRGFLSSLKSD

SEQ ID NO: 181878 - protein, 128 aa, Glycine max
  Coding DNA Sequence Number=SeqID_65100
  Subcellular localization annotation: CTP_CleavageSite=62; ConfidenceScore=5.00e-01
MTSRDQVWSFCTLVSSRGGGPDDTRKYPSEADIVFCTFCSSGNNKSFTCGNFMVARDSRQPRGAKLVSYTDFRGPLLDDMRPFFGPCEERQVMVTRDSRQPRGTKLVSYTDFRGPLLDDKRPFFGPCE

SEQ ID NO: 181879 - protein, 85 aa, Glycine max
  Coding DNA Sequence Number=SeqID_65101
  Homolog annotation: Hit_ID=Q1RXT6; Match level="QueryCoverage=39%, HitCoverage=8%, E-value=9e-07, Identity=76%"; Hit description =Prephenate dehydratase with ACT region
YFDYLFYIDIEASMAEPRAQYALGQLQKFSVLTRSNSHAVHFADNISSYYPRGSSSIREVGKKYPLKALPLSPLSKIFSSPKEVL

SEQ ID NO: 181880 - protein, 434 aa, Glycine max
  Coding DNA Sequence Number=SeqID_65102
  Gene Ontology: Mol. function=aminomethyltransferase activity; Cellular component=mitochondrion; Biological process=glycine catabolic process
  Homolog annotation: Hit_ID=P49364; Match level="QueryCoverage=99%, HitCoverage=100%, E-value=0.0, Identity=87%"; Hit description =Aminomethyltransferase, mitochondrial precursor
  Pfam annotation: Domain name=GCV_T; Domain location=80-322; Score =351.8; E_value=1.1e-102; Accession=PF01571.11; Description=Glycine cleavage T-protein (aminomethyl transferase)
  Pfam annotation: Domain name=GCV_T_C; Domain location=331-423; Score =132.8; E_value=9.2e-37; Accession=PF08669.1; Description=Glycine cleavage T-protein C-terminal barrel
  Pfam module annotation: Pfam domain module=GCV_T::GCV_T_C; Domain location=80-322::331-423
MRGGLWQLGQSITRRLAHGDKKAVARRCFASEAELKKTVFHDFHVAHGGKMVPFAGWSMPIQYKDSIMDSTINCRENGSLFDVSHMCGLSLKGKDAAPFLEKLVIADVAGLAPGTGTLTVFTNEKGGAIDDSVITKVTDDHIYLVVNAGCRDKDLAHIEEHMKAFKAKGGDVSWHIHDERSLLALQGPLAAPVLQHLTKEDLSKLYFGEFRVLDINGSECFLTRTGSEFLRDTMPNLIDCTKHNNLFLIGTFRYTGEDGFEISVPSEHGVDLAKAILEKSEGKVRLTGLGARDSLRLEAGLCLYGNDMEQHITPIEAGLTWAIGKRRRAEGGFLGADVILKQLEEGPKIRRVGFFSSGPPPRSHSEIQDEGGNNIGEITSGGFSPCLQKNIAMGYVKSGLHKAATKVKIIIRGKPNEGVVTKMPFVPTKYYKPS

SEQ ID NO: 181881 - protein, 399 aa, Glycine max
  Coding DNA Sequence Number=SeqID_65103
  Gene Ontology: Mol. function=endonuclease activity; Cellular component=intracellular
  Homolog annotation: Hit_ID=Q1RXS9; Match level="QueryCoverage=90%, HitCoverage=99%, E-value=1e-136, Identity=59%"; Hit description=Zinc finger, RanBP2-type; Endonuclease/exonuclease/phosphatase
  Pfam annotation: Domain name=Exo_endo_phos; Domain location=134-362; Score=46.4; E_value=9.3e-11; Accession=PF03372.13; Description =EndonucleaseExonucleasephosphatase family
  Subcellular localization annotation: CTP_CleavageSite=66; ConfidenceScore=5.16e-01
MSCWACKKCTFVNLPSQKGECEICFSPASPLSMGPSCSSSPPKWSCKACTFLNPYNNPSCEVCATRCSVLSLSNLTDLNDATDHDSSVGSVFFPLRTCNKRKAIDDDDSSEVINFKVKPSNITGDENIDTGKAFKILSYNVWFREDLELHKRMKAIGDLVQLHSPDFICFQLSKLPVKSFSNKPFSNSIMGRELCIAEVEAASGKPLVIATSHLESPCPAPPKWDQMYSKERVVQANEAINLLKKQPSVVFGGDMNWNDQQDGQYPLQDGWVDAWSQLRPNESGWTYDTKSNQMLTGNRTLQKRLDRFICQFTDFKITSVDMIGMEAIPGVSYNKEKKVRKEIKQLVLPVLPSDHYGLLLTISNNKRILGRNVKVGPIWGECSHTDDQQAPQPSSFKSQ

SEQ ID NO: 181882 - protein, 291 aa, Glycine max
  Coding DNA Sequence Number=SeqID_65104
MDGGSRKEKRKNDSLDTVHETAVLKCHLHQDSASSQQPYSYPCKINNNVHLVNCNPKPFGTPCTNISFHSSSFSGKCDKLQKSLHLFHHVATHKWLCGLQDSISSDDEYRSSRNIAISLFRRYRNFIDRGGGDNLKEFITAGVNAYALGCTDEGLRKELVDMKNSGIEIDVMQSYGGSTSLKSKIISEEVDECILWLSIIFITILCTPQPTIVRWSSTTPVSDEVRLQWKGFCALIANAYFMKGMAWLPVKTLQLEQTAVMGQAEKPSVVASRMRLVFSTLEVVSPQWPRA

SEQ ID NO: 181883 - protein, 649 aa, Glycine max
  Coding DNA Sequence Number=SeqID_65105
  Gene Ontology: Mol. function=protein binding; Cellular component =intracellular; Biological process=RNA processing
  Homolog annotation: Hit_ID=Q1RXS5; Match level="QueryCoverage=99%, HitCoverage=99%, E-value=0.0, Identity=77%"; Hit description =Ribosomal protein L29
  Pfam annotation: Domain name=U3_assoc_6; Domain location=9-100; Score= 131.4; E_value=2.6e-36; Accession=PF08640.1; Description=U3 small nucleolar RNA-associated protein
MADVVQYRLERMVDELDDLEQRGLFSRREIAEIVKQRRKFEYRLKRPSPLKQDFLAYVEYETQLDALRRLRKKSVARELMKQGNKKLKKSKSDFAGLLRIMDIYELALKRYKGDIDLWFCYLEFCRLRKNGRMKKALANVIRFHPKVPGVWIYAAAWEFDHNLNVAAARALMQEGLRVCPTSEDLWVEYLRMELTYLNKLKARKVALGEDQGTLTRDPRSSDEKHWRDENSELFMPLGKRGDDDGGANVGSDESEKKQELFEEHGMNIFQTVYSGAVEAVPSSLSLRKRLFEILEGTNLSHYEDMCKEILNDMKRDFSTQPEFWDWLARHECDLEISEEGIIPQVEKAVQVYEEALKNVPSGTMFSLYANFLTDIIAPKEGETDINGSSGCAVNYISHLLSIYERAESMGCITEDLACKHVSLHLQLRQLDEAQKLAAKLCSGKLAESVELWGLRITIEIRCITGSSSSPSDADLQSLFELLQQILMKVSVSRSENLWLKALKFYANQRRYFDKLVEISVVTLVRDGGSENGFSLSSAIVSFILQKDGIQKTRDIYKRFLALPLPGLALYRRCIDLETNLASIGDKDGLINARKLYESSLATYDQNVSLWQDYYRLEIKMGTSEKATAIYWRARKVLKDASEFVTAPDM

SEQ ID NO: 181884 - protein, 558 aa, Glycine max
  Coding DNA Sequence Number=SeqID_65106
  Gene Ontology: Mol. function=hydrolase activity, hydrolyzing O -glycosyl compounds; Cellular component=membrane; Biological process =carbohydrate metabolic process
  Homolog annotation: Hit_ID=Q1RXT3; Match level="QueryCoverage=95%, HitCoverage=94%, E-value=0.0, Identity=84%"; Hit description =Glycoside hydrolase, family 17
  Pfam annotation: Domain name=Glyco_hydro_17; Domain location=63-384; Score=315.7; E_value=8.2e-92; Accession=PF00332.9; Description =Glycosyl hydrolases family 17
  Pfam annotation: Domain name=X8; Domain location=399-502; Score =158.7; E_value=1.6e-44; Accession=PF07983.3; Description=X8 domain
  Pfam module annotation: Pfam domain module=Glyco_hydro_17::X8; Domain location=63-384::399-502
LAHVISSTRAEAGMRKLSLGSFSMANSNLVIILYFSFFTFAEAEALHSQLKQQIQDQEKLPFVGVNIGTDVSNLPSASDLVAFLQLQKITHVRIYDANSDILKTLSGTKIRVIISVPNNQLLAIGSSNSTAASWIDRNVVAYYPQTLISGISVGDEVLTTVPSSAPLILPAVESLYNALVASNLHQHIKVSTPHAASIILDPFPPSQAYFNQSLVSVILPLLQFLSRTGSPLTMNLYPYYVFMQNKGVVPLDNALFKPLTPNKEMVDPNTLLHYTNVLDAMVDAAYFSMKNLNITDVAVLVTETGWPAKGDSKEPYATKDNADTYNSNLIRHVFDRTGTPLHPETTSSVFIYELFNEDLRAPPVSEANWGLFYGNTSPAYLLHVSGIGTFLANDTTNQTYCIAMDGFDSKTLQAALDWACGPGRANCSEIQPGETCFQPNNVKNHASYAFDSYYQKEGKAQGTCDFKGLAMITTTDPILLASSSKYFLEIVSVQYGLHGCVFSLSFGLFQVTGAVYFLEAYLSLIDSTFDVMQQESEQQDKGSGQLYYLKQCRREVEV

SEQ ID NO: 181885 - protein, 387 aa, Glycine max
  Coding DNA Sequence Number=SeqID_65107
  Gene Ontology: Mol. function=methyltransferase activity; Biological process=tRNA processing
  Homolog annotation: Hit_ID=Q8H4D4; Match level="QueryCoverage=93%, HitCoverage=45%, E-value=5e-50, Identity=46%"; Hit description=MET -10+related protein-like
  Pfam annotation: Domain name=Kelch_1; Domain location=1-37; Score =1.9; E_value=2.3; Accession=PF01344.15; Description=Kelch motif
  Pfam annotation: Domain name=Kelch_1; Domain location=42-87; Score =34.4; E_value=4e-07; Accession=PF01344.15; Description=Kelch motif
  Pfam annotation: Domain name=Kelch_1; Domain location=92-137; Score =4.8; E_value=1.1; Accession=PF01344.15; Description=Kelch motif
  Pfam annotation: Domain name=Kelch_2; Domain location=1-37; Score =13.5; E_value=0.64; Accession=PF07646.5; Description=Kelch motif
  Pfam annotation: Domain name=Kelch_2; Domain location=42-87; Score =20.2; E_value=0.0075; Accession=PF07646.5; Description=Kelch motif
  Pfam annotation: Domain name=Met_10; Domain location=258-387; Score= -105.7; E_value=0.0044; Accession=PF02475.7; Description=Met-10+ like- protein
  Pfam module annotation: Pfam domain module=Kelch_1::Kelch_1::Kelch _1::Kelch_2::Kelch_2::Met_10; Domain location=1-37::42-87::92-137::1 -37::42-87::258-387
MGSNIYVFGGLDNDIIFSSFRVFDTNNLHWKEIPVSGDWPCARHSHAMVASGCQIFMFGGYNGGKALGNLYSFDVQKGQWMKERTDGWNPHARFSHSIFVYKNYLGVLGGCPVRQHCQELALLDLKLHLWKHVTLNSVGKDSFVCSTANVMGDDVVVVGSGASCYAFGTKNHHMGDAFDGKNEGPFSKPIKRDEFLLNELSCSEVLILLHEYGAIVLGDKVVEERKAAKSPLKVMTEAITSLIEHKGLPVQLLEELPRRWDLLGDIVLLPSTSFKDSMWDSIAEELWSIVAKSLKAHRLARQGPVAATGTRDSTLQILVGNNGWFNHQENGILYSFDATKCMFSWGNLSEKLRMARLDCKNESVADRVCLGLIPSSELSWVTAVRAL

SEQ ID NO: 181886 - protein, 386 aa, Glycine max
  Coding DNA Sequence Number=SeqID_65108
  Gene Ontology: Mol. function=transferase activity, transferring glycosyl groups; Cellular component=phagocytic vesicle; Biological process='de novo' pyrimidine base biosynthetic process
  Homolog annotation: Hit_ID=Q1RU71; Match level="QueryCoverage=97%, HitCoverage=99%, E-value=1e-119, Identity=53%"; Hit description =Phosphoribosyltransferase; Orotidine 5-phosphate decarboxylase (Uridine 5'-monophosphate ...
  Homolog annotation: Hit description=synthase (Ump synthase) [includes: orotatephosphoribosyltransferase (Ec 2.4.2.10) (Oprtase); orotidine 5'-phosphate decarboxylase (Ec 4.1.1.23) (Ompdecase)])
  Pfam annotation: Domain name=OMPdecase; Domain location=163-373; Score=119.0; E_value=1.4e-32; Accession=PF00215.14; Description =Orotidine 5'-phosphate decarboxylase  HUMPS family
  Pfam annotation: Domain name=Pribosyltran; Domain location=38-211; Score=-4.8; E_value=0.015; Accession=PF00156.17; Description =Phosphoribosyl transferase domain
  Pfam module annotation: Pfam domain module=OMPdecase::Pribosyltran; Domain location=163-373::38-211
MSASSLIESPVLQLHEISAVKFGNFKLKSGISSPIYIDLRLIISYPSLLQQISQTLISSVSSTSFDLVSGVPFTALAIATCVSLAQTIPMDLVTSGTSVLETAAPLPASGLKISDAENQKVAALAKVGKPATKVKALSFGERAKLSKNPIGKRLFEIMAEKESNLCLAADVGTAAELLEIAGKVGPEICLLKTHVDIFPDFTPDFGSMLLSDSSRNLLVPDIIDISTLEAILYISGLVVSNICFILLKIAEKHNFLIFEDRKFADIGNTVTMQYEGGLLLLAEMSSAGNLAKGDYTTAALKIAENHSDFVIGFISVNPASWPGAPINPSFIQATPGVQMVTGGDALGQQGSDIIIVGRGIIKAVNPEEAAREYRLQGWNAYLAKCT

SEQ ID NO: 181887 - protein, 80 aa, Glycine max
  Coding DNA Sequence Number=SeqID_65109
MGGRDFIRGGSSCKWQLAKINLSLLLLCFYLKQQPLSPWHQHPCTTTATPLTPWRQRQPRQNAMEQYYHPLLWNGYSKSV

SEQ ID NO: 181888 - protein, 218 aa, Glycine max
  Coding DNA Sequence Number=SeqID_65110
  Pfam annotation: Domain name=DUF584; Domain location=20-173; Score =87.0; E_value=5.9e-23; Accession=PF04520.4; Description=Protein of unknown function, DUF584
MADWGGFLDQNSGFGGGSMRNEDFDEENVWGLTMERERDFLSPKMRVSKESYGSSSAWLVSTSPRKITRTNSVTLHSLESDSDSNVVQRSSAPTSIPGWSKIYGKKGVEEGVNNKKPDCGFGDHYGDDDDEDEDDMIPPHEWIARKLARSQISSFSVCEGIGRTLKGRDLSKGNGKGGVATSEALSGFVLDLGEWSAPSVVTEFNSLQVFTSGWLIIP

SEQ ID NO: 181889 - protein, 147 aa, Glycine max
  Coding DNA Sequence Number=SeqID_65111
  Gene Ontology: Mol. function=microtubule binding; Cellular component =membrane; Biological process=protein transport
  Homolog annotation: Hit_ID=Q7XY24; Match level="QueryCoverage=97%, HitCoverage=89%, E-value=5e-42, Identity=63%"; Hit description =Autophagy
  Pfam annotation: Domain name=MAP1_LC3; Domain location=4-145; Score =212.7; E_value=8.5e-61; Accession=PF02991.6; Description=Microtubule associated protein 1A1B, light chain 3
MSERRQAESARIRDKYPDRIPVIVEKAERSDIPDIDKKKLVILSNSTYTVVFKYSFAVKWAASFFVPKAYTLYARVKYLVPADLTVGQFVYVVRKRIKVSAEKAIFVFIYNTLPPTAALMSSIYEENKDDDGFLYMTYSGENTFGSH

SEQ ID NO: 181890 - protein, 234 aa, Glycine max
  Coding DNA Sequence Number=SeqID_65112
  Gene Ontology: Mol. function=galactosyltransferase activity; Cellular component=membrane; Biological process=protein amino acid glycosylation
  Homolog annotation: Hit_ID=Q6F2F5; Match level="QueryCoverage=84%, HitCoverage=54%, E-value=2e-92, Identity=69%"; Hit description =Putative glycosyltransferase
  Pfam annotation: Domain name=Galactosyl_T; Domain location=10-177; Score=99.8; E_value=8.3e-27; Accession=PF01762.12; Description =Galactosyltransferase
MKSKGGVELSGRNVLHRKWALLLCVASFCAGMFFTNSSTSGGILDKAIEAEERLHADFLRLNHIEGYLELSAKTKIYFSTAVALWDAEFYVKVDDDVHVNLATLGLTLSMHRKKPRVYIGCMKSGPVLAQKGVRYHEPEYWKFGEVGNKGMLHKYANEDVSLGSWFIGLDVDHVDDRRMCCGTPPDCEWKAQAGNICVASFDWKCSGICRSVERMKEVHQRCGEDENALWSGTF

SEQ ID NO: 181891 - protein, 775 aa, Glycine max
  Coding DNA Sequence Number=SeqID_65113
  Subcellular localization annotation: CTP_CleavageSite=47; ConfidenceScore=5.77e-01
MPSNKQSSMPSNPNPRSSEVGNPMRRSFTGNPFSKPSIVPNHGVKTPANSSSADFSRRGSVGIRESGGSLRDSFDDKENGKDQILKPTKVRSPAVSSKGSKNFMSPTISASCKINESPRKKVLIEKNEAVPSPADKKSHVRKVTFAEPLEEKMIDGIIPNFEEGLRSSLSSEDLSGESETSETHYMDVPLISKNDTDLCFESVNDVNVNVPLVLENDIYTEPSFETEPDCVNLDPTFKLSPTATPPISLKATVVAPLDADPLMPPYDPKTNYLSPRPQFLHYKPKSRMELCRERELDDSFISGSFSDTEVTEDSQSEVSQKESEDVSSDETVKEEEGEISELSPARRTLMPGESVEAKQVPKPRFTVRAKAVALILLLAVAFVSISVTDSPVIDRTVFEGFYKVYVSSEFPEFARANFDLFTQFAKTNFNEIARNLQIWFTKLLSSTSEFISDVRGGHNLAKLQYYNLTIQHDYSMVDQYPIFGHGENEIGETHVPVWDADESDAASDIDGDEDIEGDISEEHYEIYEEQVQQDVATITGAENVLDAPESEEVQSEQLAEAGNLEATVAQEAEANLNVENQPSLNLEVAEISIEAYESDTKQAHENDAELNVNEQSDISLDSDVAAAKDDVAEEKSESIDAAIKGNEGRLGAIDIPPHVVLCLLLGAEKSSGPVEMDVLEDSSCPSEASSIQQSSFYCEKEVNEGHRLGPEKKRKNNYRRESLASSASDYSMGSPSYGSLTLYEKIPIKQGHWEDEIITPVRRSSRIRNQATSPS

SEQ ID NO: 181892 - protein, 562 aa, Glycine max
  Coding DNA Sequence Number=SeqID_65114
  Gene Ontology: Mol. function=zinc ion binding; Cellular component =endoplasmic reticulum
  Homolog annotation: Hit_ID=Q6KA74; Match level="QueryCoverage=94%, HitCoverage=92%, E-value=1e-122, Identity=44%"; Hit description =Ankyrin repeat protein-like
  Pfam annotation: Domain name=Ank; Domain location=11-41; Score=4.0; E_ value=8.2; Accession=PF00023.20; Description=Ankyrin repeat
  Pfam annotation: Domain name=Ank; Domain location=71-103; Score=31.9; E_value=2.2e-06; Accession=PF00023.20; Description=Ankyrin repeat
  Pfam module annotation: Pfam domain module=Ank::Ank; Domain location =11-41::71-103
MAKSTAPPDNYGHSPVHYAVALGDHTTLSRIISSLPRLPDPSLIQTESDSLAQEKIADQISLVLDRRDVPYGETPLHLAVRLNDLFSARALATAGADVSLQNSAGWNALQEALCRRASDIALVLLRLHHRNAWSKWRRRLPRVIAALRRMRDFYMEISFHFESSLIPFVGKIAPSDTYKIWKRDGNLRADTSLAGFDGLKIQRADQSFLFLGDGDHTHDVPSGSLLVLNRDDRKIFDAFENAGGPMNESDLAGFCSQTSVYRPGMDVTKAELVGRMNWRRQEKTESVGEWKAKVYEMHNVVFSFRSRKVAGSESDVAGSEQVLPLELDEDDDGFLVAENPNFGFPMPDKRRHSSFVREETEWVPMGRKSLDLTSVTAPQPRSVTMPTQTKEKEYVRSLRPSVWLTEQFPLKTEELLPLLDILANKVKAVRRLRELLTTTFPPGTFPVKVAIPVVPTVRVVITFTKFVELQPLEQFYTPFSSPRHLLSAAGAGRGDEEQSKAENRCSSSSSSTWLRRNNSVSNKQRCMAFDSDPFKIPAGYTWTSVDDKSRKMKKSKSVRKPK

SEQ ID NO: 181893 - protein, 301 aa, Glycine max
  Coding DNA Sequence Number=SeqID_65115
  Gene Ontology: Mol. function=prephenate dehydratase activity; Cellular component=cytoplasm; Biological process=L-phenylalanine biosynthetic process
  Homolog annotation: Hit_ID=Q1RXT6; Match level="QueryCoverage=92%, HitCoverage=66%, E-value=1e-107, Identity=73%"; Hit description =Prephenate dehydratase with ACT region
  Pfam annotation: Domain name=ACT; Domain location=234-293; Score =17.8; E_value=0.019; Accession=PF01842.15; Description=ACT domain
  Pfam annotation: Domain name=PDT; Domain location=32-224; Score =223.2; E_value=5.9e-64; Accession=PF00800.9; Description=Prephenate dehydratase
  Pfam module annotation: Pfam domain module=ACT::PDT; Domain location =234-293::32-224
MGGIYVFMLPVAKPLTAIDISSYPRDGSKVRVAYQGLPGAYSEDAALKAYPKCETVPCDNFEAAFKAVELWLVNKTVLPIENSVGGSVHRNYDLLLRHRLHIVGEVQLRVNHCLLGLPGVRKEELRAVVSHPQAFAQCETTLSDLGAVKIAARDTAAAAQTVASNCARDTGAIASSRAAEVYGLDILAERIQRKYKTDFSDSIIHCADDDENITRFLVLAREPIIPGTDRPHKTSIVFSLEEGPGVLFKALAVFAMRDINLSKIESRPLKQRSLRVVDHLNEGSATRMNGVYNLRARGLLE

SEQ ID NO: 181894 - protein, 581 aa, Glycine max
  Coding DNA Sequence Number=SeqID_65116
MVDDEKNTVKSETAPEYKPDTEGIVPKEIDPAKRLVNWMSMDDGQNLYAEKFKNCNSVADFNETDSDDACDDNFDDDMDNNQRHEEIDDTNETVSAQKGYHADHIDEESNTTCMGNQKTSCILIAPLSENSEVKTHQDQGKEIKETAAFTAPLNVPSSGSVRISQNRKPLKVAFCPKEVQRIIESEALLQKNAQSHTIRKIIVFASLGIRHGCEDMYELEFNHFSILKKGEPYVSPRNPGEHVLYENPGVRRKIFYPNRQNPVLCPVQMLEEERAMRPSDASCPSCLFLCIKYGGRTRNLPQNEYVRQPMGRNKLKSFGPLMCRMATLVHNRSGSFFFKALGITLLFMAGFPGDQVQKETKYRNLDLLQKYYRTDEDAEGEELFLPHPISCDNGTHEPHNLTKKTPPAKSKGRKHTNAVIKSHNSQKTPSQHATPTSSAATQFGLSGYSSAYTYAMAAFHSMPSQISSQDTPHMPNPAFSPSNANHRMLPPPPQPASTFVPVMYWPPPNAFLPGPYPSTYGYHSFPSAANYMSFQTQPYYNNPKLLEGSGKKDLASDETESDTDSSSSGCSEHKQRPAFHK

SEQ ID NO: 181895 - protein, 71 aa, Glycine max
  Coding DNA Sequence Number=SeqID_65117
MASKRNKQQSGSRRRENVEARGRGKKNRSKKKRRQNGPFNKLLGAPAILLGAPSISLQEVEKLLEWARPII

SEQ ID NO: 181896 - protein, 668 aa, Glycine max
  Coding DNA Sequence Number=SeqID_65118
  Gene Ontology: Mol. function=binding
  Homolog annotation: Hit_ID=Q1SPQ2; Match level="QueryCoverage=99%, HitCoverage=100%, E-value=0.0, Identity=73%"; Hit description=IMP dehydrogenase/GMP reductase
  Pfam annotation: Domain name=Arm; Domain location=179-219; Score =27.2; E_value=5.8e-05; Accession=PF00514.13; Description =Armadillobeta-catenin-like repeat
  Pfam annotation: Domain name=Arm; Domain location=220-260; Score =28.5; E_value=2.4e-05; Accession=PF00514.13; Description =Armadillobeta-catenin-like repeat
  Pfam annotation: Domain name=Arm; Domain location=435-475; Score=9.8; E_value=0.73; Accession=PF00514.13; Description=Armadillobeta-catenin- like repeat
  Pfam annotation: Domain name=Arm; Domain location=491-526; Score=8.4; E_value=1.1; Accession=PF00514.13; Description=Armadillobeta-catenin -like repeat
  Pfam annotation: Domain name=Arm; Domain location=569-609; Score =17.0; E_value=0.066; Accession=PF00514.13; Description=Armadillobeta- catenin-like repeat
  Pfam module annotation: Pfam domain module=Arm::Arm::Arm::Arm::Arm; Domain location=179-219::220-260::435-475::491-526::569-609
MADIVKQLLAKPIQLADQVAKAAEEASSSFKQECLELKSKTEKLAGLLRQAARASSDLYERPTRRIIADTELVLDKALSLTLKCRANGLMKRVFSIIPAAAFRKMSSQLENSIGDVSWLLRVSAPAEDRADTEYLGLPPIAANEPILGLIWEQVAILHTGSLDDRSDAAASLVSLARDNDRYGKLIIEEGGVGPLLKLIKEGKKEGQENAARAIGLLGRDPESVELMIHAGVCSVFAKVLKEGPMKVQAVVAWAVSELAAKYPTCQDLFAQHNIVRLLVSHLAFETVQEHSKYAIVSNKPTSIHAVVMASNNSGNNSNGNSSVKKDSEDEEKQMQSRMQHPLGDRSTNQMHRVVTSTMAMHAANKQQQPNQGNEGTLNLQGPKVNGNGKQNHQSHQQSFSYSGINMKGRELEDPENKAYMKAMAARALRQLAKGNVAICRSITESRALLCFAILLEKGSEDVKYNSALAVKEITAVAEKDAELRRSAFKPNSPACKAVVDQVLKIIEKEDTKLLIPCVKAIGNLARTFRATETRIIGPLVRLLDEREAEVSREAAISLTKFASSENYLHLDHSKAIISAGGAKHLVQLVYLGEQTVQISALVLLSYIALHVPDSEELARAEVLGVLEWASKQPNVTQDETLEALLQESKGRLELYQSRGSRGFQKLHQ

SEQ ID NO: 181897 - protein, 119 aa, Glycine max
  Coding DNA Sequence Number=SeqID_65119
MAQNLTNASSRINNVNSVYTRESVRATTSPDDESERLAISPTGEAGGSAVSSAGVSGGAVASYDDASEMIIRGGDKGTTSSLGERGGFTTGVHGSADIGSTRAGAGFEGAASLVLTNGS

SEQ ID NO: 181898 - protein, 60 aa, Glycine max
  Coding DNA Sequence Number=SeqID_65120
MDKAELELKVIELRRNPQLTSDDGSRVSEVLTCQNGIQNLDIKVSLTGQTCSLINFISRI

SEQ ID NO: 181899 - protein, 314 aa, Glycine max
  Coding DNA Sequence Number=SeqID_65121
  Gene Ontology: Mol. function=nucleic acid binding; Cellular component= intracellular; Biological process=DNA integration
  Homolog annotation: Hit_ID=Q1S1X7; Match level="QueryCoverage=97%, HitCoverage=23%, E-value=1e-111, Identity=64%"; Hit description =Integrase, catalytic region; Zinc finger, CCHC-type; Peptidase aspartic, catalytic
HPNEINKVKTQLSGEFEMKDLGPAKRILGMEIIRDRKIGRLCLSQKSYVEKVLERFGMHNAKAVSTPFAAHFKLSANMSPQTKEEEEFMSRVPYSNAVGSLMYAMVCTRPDIAHAVSVVSRYMANPGKSHWQAVKWILRYLRGSTNLGLVFGKATNECNGHVIGYCDSDYAGDLDRRRSLSGYIFTLGGSAISWRATLQSTVALSTTEAEYMAATEAVKEALWLKGLVGDLGVSKKEVVVHCDSQSAIHLTKNQMYHERTKHIDIRMHFIRDVVTQGDVLIEKISTSDNPADMMTKALPTLKFKQCLDSVGIKN

SEQ ID NO: 181900 - protein, 233 aa, Glycine max
  Coding DNA Sequence Number=SeqID_65122
  Homolog annotation: Hit_ID=Q10MZ1; Match level="QueryCoverage=37%, HitCoverage=14%, E-value=1e-16, Identity=50%"; Hit description =Expressed protein
  Subcellular localization annotation: CTP_CleavageSite=66; ConfidenceScore=5.01e-01
MVPGKANDSKPKINQKTNQATKIGTAEAQSFGFRHNRVFGTARNTNIIPGKPVWDKSITKTKIDVSQRKPKSISTTQLPIDTHNKKSTENANLGLNKKSHTFPQQFAEKTSKNSSQEKGSASEPKTPVASSSHVRTKSTTPFYSALNCSKCRFDRLETSSYWVGQIKMAESVGKHFVASEFFRLALESQAEPIRNLRMELKRYLLRHGYLSEQKEWREVAARYGLLKVESNKH

SEQ ID NO: 181901 - protein, 393 aa, Glycine max
  Coding DNA Sequence Number=SeqID_65123
  Gene Ontology: Mol. function=ferredoxin-NADP+ reductase activity; Cellular component=thylakoid membrane; Biological process=electron transport
  Homolog annotation: Hit_ID=Q0WWE2; Match level="QueryCoverage=79%, HitCoverage=88%, E-value=1e-168, Identity=89%"; Hit description =Ferredoxin-NADP+ reductase
  Pfam annotation: Domain name=NAD_binding_1; Domain location=179-296; Score=162.1; E_value=1.4e-45; Accession=PF00175.11; Description =Oxidoreductase NAD-binding domain
ASLQYRDVCSSGRVVSIRAQVTTEAPAKVEKESKKQDEGVVVNKFKPKTPYVGRCLLNTKITGDDAPGETWHMVFSTEGEIPYREGQSIGVIPDGVDKNGKPHKLRLYSIASSAIGDFGDSKTVSLCVKRLVYTNENGEIVKGVCSNFLCDLKPGAEVTITGPVGKEMLMPKDPNATIIMLGTGTGIAPFRSFLWKMFFEKHEDYKFNGLAWLFLGVPTSSSLLYKEEFEKMQEKYPDNFRLDFAVSREQTNENGEKMYIQTRMAQYAEELWELLKKDNTFVYMCGLKGMEKGIDDIMVSLAAKDGIDWTEYKRQLKKSEQWNVEPLHTKQHCTKRLWEENMEQCPSAVHSHEAPMAVTRENRSESKDNINTMEAISYCKEEGKMKKQWEKKN

SEQ ID NO: 181902 - protein, 96 aa, Glycine max
  Coding DNA Sequence Number=SeqID_65124
MEKFDKKNFKDNKAKKAYITWKDKDIDSSGDSENEVVNLSLMAKNYDSEEEKGHSASTCYFRKNSSNIKMIWVPKESLIKTNNQGPKKIWVPKSKT

SEQ ID NO: 181903 - protein, 631 aa, Glycine max
  Coding DNA Sequence Number=SeqID_65125
  Gene Ontology: Mol. function=nucleic acid binding; Cellular component= intracellular; Biological process=DNA integration
  Pfam annotation: Domain name=rve; Domain location=381-539; Score =130.2; E_value=5.8e-36; Accession=PF00665.16; Description=Integrase core domain
  Pfam annotation: Domain name=zf-CCHC; Domain location=168-185; Score =30.6; E_value=5.6e-06; Accession=PF00098.13; Description=Zinc knuckle
  Pfam module annotation: Pfam domain module=rve::zf-CCHC; Domain location=381-539::168-185
MSSTKFDVEKFTGKNNFNLWRVKMLALLTQQECELALEGEEMLPAEMTAAQKKGDEVLGEVSGEKTVDKLSAKLESRYMTKSLHNRLCLKKQLYTMQMHEDTIIFGRSSLSMEEVKTALQSWELKRRITDSYGGTSSGEGLMVRGRMDERKSFQRRRSKSHSKNKNNNKCHNCQKEGHWKRNCPELKEDKVSTSEFGGAAVVSEESDGGNVLFVSSNVNDDDWILDSACTFHMTPNRDWFATFQNVDGGKVLMGNDGACSIAGKGTVQIKMNDGIVRTLTDVRYVPELKKNLISLSTLDSLGCTYRAGGGDLRVSRGSLIVMKGKLKNGLYILQGSTVEGTTAVSSISNTDQSRLWHMRLGHMSECGMDELSKRGLLGGRRIEKLDFCEHCVYGKQSRVKFSTGVHRTRGTLDYIHSDLWQKSDVFLKFKQWKSLVEKQTEKKVKRLRTDNGLEFCNNEFNEFCANEGIARHRTVRHTPQQNGVAERMNRTLLERARCMLSNAGLPKQFWAEAVNTACYLVNRSPSTAIDCKTPEEMWSGSTANYSILRVFGCPAYAHINEGKLEPRAKKCILLGYQDGVKGYRLWDPKESKLLISRDVTFDETAMLNPRPHKDHDNKVEVHGDIKKVEFE

SEQ ID NO: 181904 - protein, 175 aa, Glycine max
  Coding DNA Sequence Number=SeqID_65126
  Gene Ontology: Mol. function=calmodulin binding; Cellular component =integral to membrane; Biological process=cell death
  Homolog annotation: Hit_ID=Q2HSW1; Match level="QueryCoverage=81%, HitCoverage=24%, E-value=8e-39, Identity=60%"; Hit description=Mlo -related protein
  Pfam annotation: Domain name=Mlo; Domain location=5-175; Score= -212.4; E_value=6.7e-09; Accession=PF03094.6; Description=Mlo family
MAGGSGGRNLEETPTWAVSAVCFVLILISITIEHIIHLIGKWLKKKHRRALYESLEKIKSELMLLGFISLLLTVGQGPISRICISEKVAGTWHPCDDSSNHESDSEESENRTNSRRLLAAFYGSDDVNPRRVLAGGGADKCPELHSAFIRHAHADESLIEIECDICECWLSPMIA

SEQ ID NO: 181905 - protein, 81 aa, Glycine max
  Coding DNA Sequence Number=SeqID_65127
  Subcellular localization annotation: CTP_CleavageSite=16; ConfidenceScore=5.10e-01
MGKHKNHASHSLALTSANSAAKERKRERERSRRASESVNPKLLIGKCEVESVTLRSHDFKCSSFERLEEVSVGSDESVDVV

SEQ ID NO: 181906 - protein, 372 aa, Glycine max
  Coding DNA Sequence Number=SeqID_65128
  Gene Ontology: Mol. function=calmodulin binding; Cellular component =integral to membrane; Biological process=cell death
  Homolog annotation: Hit_ID=Q5BMD0; Match level="QueryCoverage=98%, HitCoverage=75%, E-value=4e-97, Identity=46%"; Hit description=MLO1
  Pfam annotation: Domain name=Mlo; Domain location=1-297; Score=256.2; E_value=6.7e-74; Accession=PF03094.6; Description=Mlo family
MGKVPFVSSDGIHQLHIFIFVLAVFHVLYCIFTMALGRAKMKRWKRWEEETKTTEYQFSHDPERFRFARETSFGRRHLSFWTKNPVLIWIVCFFRQFVRSVPNVDYLTLRHGFIMSSILVLRSAVSPLKHSWVIILLVGTKLQVIITEMGLKIQQRGEVLKGVPLVQPGDHLFWFNRPGLILYLINFVLFQNAFQLAFFAWSALQFGIKSCFHSHTEDVVIRITMGYMGSTMKPTIFNERVALGLRNWHQTAKKHIRQNRVGPLSLSGTPTSSRPTTPSHNLSPVHLFRYYRSEIDSFPTSPQRSNLDDNNMDSPSPSYSHHELEMGHLSQQQQQQQQQTTTNDNTTTHHEIVVAVHSKEFSFDKRPTSSNT

SEQ ID NO: 181907 - protein, 75 aa, Glycine max
  Coding DNA Sequence Number=SeqID_65129
MVPHMSSGPPPLDDKSADDHNCLCVPLDTTVSEWRKGEQNDHNLSPRVIGPAASGRQKMQNDHNLSPRAIGHDCV

SEQ ID NO: 181908 - protein, 120 aa, Glycine max
  Coding DNA Sequence Number=SeqID_65130
  Gene Ontology: Mol. function=actin binding; Cellular component =cytoplasm; Biological process=cytoskeleton organization and biogenesis
  Pfam annotation: Domain name=Transposase_21; Domain location=55-120; Score=-93.8; E_value=1.3e-06; Accession=PF02992.5; Description =Transposase family tnp2
MHKCPRCGVSRYKVKDDDECSSDESTMKVPPAKVLWYLPIIPRFKHFFANADDAKDLTWHADGRNCDGMLCHPVDSFQWKKINRLYPNFGKKTRNLRLGLALDGMNPYGSLSTQHSSWLV

SEQ ID NO: 181909 - protein, 89 aa, Glycine max
  Coding DNA Sequence Number=SeqID_65131
MAMVVTVVAAAVEKARALTVGSQGILQGNVLKLQGELYWVGLVTKLVLSVQNLGTLSIFCAFAKSKIQITNLFCALPIPKKQMAKQGYY

SEQ ID NO: 181910 - protein, 96 aa, Glycine max
  Coding DNA Sequence Number=SeqID_65132
  Homolog annotation: Hit_ID=Q1T4J2; Match level="QueryCoverage=77%, HitCoverage=21%, E-value=5e-12, Identity=43%"; Hit description =Tetratricopeptide-like helical
MDQPTLRVHIEQRVLNRSVLINLRFENSAMNFTPFGNNSKLITFAKCLGKLVCLGACLEHKPSLKRVGRVGKGSNHSVANEGVLHGSLLEKGMIIG

SEQ ID NO: 181911 - protein, 123 aa, Glycine max
  Coding DNA Sequence Number=SeqID_65133
  Gene Ontology: Mol. function=heat shock protein binding; Cellular component=integral to membrane
  Homolog annotation: Hit_ID=Q1T1K6; Match level="QueryCoverage=97%, HitCoverage=97%, E-value=7e-33, Identity=54%"; Hit description=Heat shock protein DnaJ, N-terminal
  Pfam annotation: Domain name=DnaJ; Domain location=11-57; Score=18.8; E_value=6.5e-05; Accession=PF00226.21; Description=DnaJ domain
MLLDKNDIQETHYEVLHVKEHANYEEIRAVIKQPERFLKVQKAWEILCNSSSRSFYDNELRSSRKDVLAAYIAEDLSLRKDVLAADVAEDLSLQDMMIEDDGEALELFYQCRCGDYFSVDSWN

SEQ ID NO: 181912 - protein, 299 aa, Glycine max
  Coding DNA Sequence Number=SeqID_65134
  Gene Ontology: Mol. function=molecular_function; Cellular component =anchored to membrane; Biological process=defense response
  Homolog annotation: Hit_ID=Q1S6A8; Match level="QueryCoverage=98%, HitCoverage=100%, E-value=4e-97, Identity=59%"; Hit description =Thaumatin, pathogenesis-related
  Pfam annotation: Domain name=Thaumatin; Domain location=34-248; Score= 284.1; E_value=2.6e-82; Accession=PF00314.8; Description=Thaumatin family
  Subcellular localization annotation: CTP_CleavageSite=23; ConfidenceScore=5.45e-01
MSASTHDQFAATLIFLFFSHFLRGSNSATFSIVNKCSYPVWPGILSGAGTAQLATTGFALQPGQSNAVAVPTAWSGRLWGRTLCSTDSAGKFSCVTGDCGSSAVECGGGGAVPPATLAEFTLNGAGGLDFYDVSVVDGYNLPMLVEARGGGNCTATGCAADLNGGCPAELKVKTVASGEGVACKSACEAFGDPRYCCSGRYATPETCKASSYSQLFKSACPRAYSYAYDDATSTYTCASADYRITFCPSTSKSSIKSGSGKFPVAVDISVGHAYADKSANVMLVAISAVLLTILWQQLN

SEQ ID NO: 181913 - protein, 103 aa, Glycine max
  Coding DNA Sequence Number=SeqID_65135
MDLLCNAYSNASDHEDEEEEPPKRQRVSLSSPNPLKRHLPLSSHPSFNHQTQAPMPGRYISKRQRALMAPPLPLFLTRSCSVSIHAICVINGGWWWQKAKILP

SEQ ID NO: 181914 - protein, 89 aa, Glycine max
  Coding DNA Sequence Number=SeqID_65136
MTSTAVFSMGCENRMKRRSSHGGVVVVLGDDMVVCCNQQRVVCDSIVLSMETRESSDEGEVVVNDKEKKCAKDIKEEGGNQQLGGEFKV

SEQ ID NO: 181915 - protein, 82 aa, Glycine max
  Coding DNA Sequence Number=SeqID_65137
MLKWPTARANLWADCLNAKGVPNATITIANPLLTWVCTLDDEDGGTAILDLGWVFEDDSMVARDRSMARHYGGFAVHGSFGR

SEQ ID NO: 181916 - protein, 173 aa, Glycine max
  Coding DNA Sequence Number=SeqID_65138
IVPLPTSEIQYVRDVVNSFIGWPRHLVKPLSYDSDLNVWKPVEHSSDAKLAGESDPLGELMKILFYVYQNPVEVPWEANQFGLPEIGAKFYITHADLAEIISGDKCLNIAILQLWTIFMNECGRSKADQSLYGLLEPQSIQNAKERRQQCQQYIETWVKESQRQLYLGAYLNQ

SEQ ID NO: 181917 - protein, 166 aa, Glycine max
  Coding DNA Sequence Number=SeqID_65139
MGGETVVNEQVEQTLLDYLTPQVEIANNILLPTLGAEVNFELRHGFLQIIESNQFHEADSEDPTYLRLTGTINVQSVPTEYRDIGNLVQEQESLAEAWESTSLDAACGGNLMLKPPTEATKIIEDMSFDPNNNSGDRRIVRRPVNQVEVEASSSGLLYLTGCYYNE

SEQ ID NO: 181918 - protein, 261 aa, Glycine max
  Coding DNA Sequence Number=SeqID_65140
  Gene Ontology: Mol. function=protein serine/threonine kinase activity; Cellular component=flagellin-based flagellum; Biological process=protein amino acid phosphorylation
  Homolog annotation: Hit_ID=Q7XZK5; Match level="QueryCoverage=77%, HitCoverage=37%, E-value=8e-98, Identity=83%"; Hit description =Calcium-dependent calmodulin-independent protein kinase isoform 1
  Pfam annotation: Domain name=Pkinase; Domain location=90-261; Score =66.0; E_value=1.2e-16; Accession=PF00069.15; Description=Protein kinase domain
  Pfam annotation: Domain name=Pkinase_Tyr; Domain location=90-261; Score=-115.5; E_value=2.2e-05; Accession=PF07714.7; Description =Protein tyrosine kinase
  Pfam module annotation: Pfam domain module=Pkinase::Pkinase_Tyr; Domain location=90-261::90-261
  Subcellular localization annotation: CTP_CleavageSite=57; ConfidenceScore=5.35e-01
MGCQGSKEKKSKTEFTTSYGSAATGSGGGTSYNTVQPPPPPPPPTTTATTTNQVQTSAAPKPQSKASPTVQQKADTRILGKPFDDIKKYYSLGKELGRGQFGITYLCTDNASGGTYACKSILKRKLVSKADREDMKREIQIMQHLSGQPNIVEFKGAYEDRFSVHLVMELCAGGELFDRIIAQGHYSERAASSLCRSIVNVVHICHFMGVMHRDLKPENFLLSSKDDHATLKATDFGLSVFIEQGKVYHDMVGSAYYVAPE

SEQ ID NO: 181919 - protein, 213 aa, Glycine max
  Coding DNA Sequence Number=SeqID_65141
  Homolog annotation: Hit_ID=Q5N7G7; Match level="QueryCoverage=36%, HitCoverage=36%, E-value=5e-14, Identity=54%"; Hit description =Prolyl 4-hydroxylase alpha subunit-like
  Pfam annotation: Domain name=DUF584; Domain location=48-213; Score =127.5; E_value=3.8e-35; Accession=PF04520.4; Description=Protein of unknown function, DUF584
MLTAYAKAKPEEKEEAPMAKGRKFPTTTRTDRFLGMGTYSSQASAATDLSEFREEDVWSTSEDRDRDVNAYPGEWEALAPPRRRSSRELQGHRHVGGLSLAFEDGSGGAGTRIVHHQYRAQHDAVSHQHQMATSAPVNVPDWSKILRVDSLHEMDDVFDDNNNESEMVPPHEYLARSRKMAANSVFEGVGRTLKGRDMRRVRDAVWSQTGFDG

SEQ ID NO: 181920 - protein, 546 aa, Glycine max
  Coding DNA Sequence Number=SeqID_65142
  Gene Ontology: Mol. function=carboxypeptidase activity; Biological process=DNA integration
  Homolog annotation: Hit_ID=Q1S9U8; Match level="QueryCoverage=88%, HitCoverage=97%, E-value=0.0, Identity=69%"; Hit description =Carboxypeptidase regulatory region
  Pfam annotation: Domain name=Rhamnogal_lyase; Domain location=1-109; Score=15.1; E_value=2.9e-10; Accession=PF06045.2; Description =Rhamnogalacturonate lyase family
MKGSSVPMNIDKRWIPNLNFFLQFESKYRISSSTLCDIIFFHAGLPAVEVYQIRIVFKLDEARFHYMAISDTRQRNMPSMRDRLSGQSLAYPEAVLLTHASEPQFKGEVDDKYQYSSENKDNTVHGWITQDDSAPVGFWLITPSNEFRHAGPIKQDLTSHVGPTTLSMFVSTHYAGKEVAMVFGEGETYKKVFGPVFVYLNSVPNKSQFRSLWSDAVEQLSNEVRRWPYDFVGSKDFLPPNQRGTVTGRLLVLDGGKRAQPANNAYVGLALPGDAGSWQRESKGYQFWIQADKDGHFLIQNIVPGDYNLYAWVPGFIGDYRYQTKITIKPGCNINLNSLVYNPPRNGPTLWEIGIPDRSAAEFYIPDPNPKFTNRLFQNDSQDKFRQYGLWERYTELYPNHDLVYTVGVSDYHNDWFYAQVTRSTPEKTFVPTTWQIQFQLKNIIMPGNYTLQVGLASANNARLEVRFNDQNAKLPHFSTGLTGDDNAIARHGIHGLYRLYTIAVGSNHLVKGKNTIYLTQSKGIGPFMGLMYDYVRLESPPIKST

SEQ ID NO: 181921 - protein, 51 aa, Glycine max
  Coding DNA Sequence Number=SeqID_65143
  Homolog annotation: Hit_ID=Q9SIA8; Match level="QueryCoverage=82%, HitCoverage=9%, E-value=1e-13, Identity=81%"; Hit description =Putative disease resistance response protein
MTVFDDELTEGHELGSGLVGKAQGFYIASAVDGTSQLMAFSAVDGETWDWE

SEQ ID NO: 181922 - protein, 240 aa, Glycine max
  Coding DNA Sequence Number=SeqID_65144
  Gene Ontology: Mol. function=transferase activity, transferring nitrogenous groups; Cellular component=intracellular; Biological process=regulation of transcription, DNA-dependent
  Homolog annotation: Hit_ID=Q1H4I0; Match level="QueryCoverage=95%, HitCoverage=48%, E-value=1e-114, Identity=89%"; Hit description =Transcriptional regulator, GntR family
  Pfam annotation: Domain name=Aminotran_1_2; Domain location=10-239; Score=-101.9; E_value=0.028; Accession=PF00155.11; Description =Aminotransferase class I and II
MKKRWLMIREEWGVLSDLPPGNEMLRQQIARRYLANGMDVSPDDIVITHGATEAITLCLQAVAKAGDTIALESPGYYALAHTVERLGMKVAEIRTDPASGIDLDALRAVTDNVHIAAVILTSNFQNPLGFVMPEDKKRALVAFLTEQNIPLIEDDVYSELYFSEEPPLPAKAFDRAGIVLHCSSFSKSLAPGYRVGWTTAGRYRQEVERLMFLNSLSLTSAPQIAIAKFMQRDSFEQHLK

SEQ ID NO: 181923 - protein, 127 aa, Glycine max
  Coding DNA Sequence Number=SeqID_65145
MGNCCKPASSTEWDGEDWSDLTSKKTRSSKVFDEAHGHGHGLSLGKVQKEKLMEALRVVSPDANGKVRIKISRKEFAELLEKQQQVNKKQVGRASAEQVLLRLINARDDDARHRFWRPELESIPELG

SEQ ID NO: 181924 - protein, 222 aa, Glycine max
  Coding DNA Sequence Number=SeqID_65146
  Subcellular localization annotation: CTP_CleavageSite=59; ConfidenceScore=5.84e-01
MNTRKHSIPSPRNFPSANTSPVNFRRSSPKTHLSARKLAARLWHLRFFNLESSPPRVKRSAQEVTRRDSRKLLGETKLIGGESLLLSELLRAQTCINRLNAEKLLWKRRELKKNQSMLEDLKDKLARERTSRERMESMNAKLVLELAQAKLYAKQFMVYYKEEKRKREIIEQVCNELAMQIGEGKAKLEGMEEERNMLHIAGLLREESIQMKLLDAKLSLED

SEQ ID NO: 181925 - protein, 324 aa, Glycine max
  Coding DNA Sequence Number=SeqID_65147
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=100%, E-value=3e-22, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DYTSSPSDDYTSSPSESCMPSPIITFRGLHVLAFRGLHALAFTGLHILPLRGLHVLTIRGLHVLAIRGLQVLAFRGLHVLAFTGLEILTFSGLHALAFRELNTLACLHLQRTTSPRLQRITRPRLQRTARPHLQRTARPHLQRTTRPRLQRTTRPRLQRTTRPRLQRTTRLHSLAFRGLRILTFKGLHILAFKRFHALALRGLHVLVFKGLHRTTCPNLLKATSPRLQRTTRLHALVFRGLHVLAFRGLHVLTLRGLHILSFRGLHVLAFRGLRALTFRGIDVLAFRGLHVLALRALHVLTFRGLHVLAFRELHVFTLRGLHVL

SEQ ID NO: 181926 - protein, 222 aa, Glycine max
  Coding DNA Sequence Number=SeqID_65148
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=94%, HitCoverage=30%, E-value=1e-104, Identity=91%"; Hit description=DNA -directed RNA polymerase beta' chain
  Pfam annotation: Domain name=RNA_pol_Rpb1_1; Domain location=10-207; Score=-60.0; E_value=2.7e-08; Accession=PF04997.3; Description=RNA polymerase Rpb1, domain 1
MNPILETQHTTFFYYPRFDIFRNREISSGAGAIREQLADLDLRILMDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIVV

SEQ ID NO: 181927 - protein, 93 aa, Glycine max
  Coding DNA Sequence Number=SeqID_65149
MGSGRSRRRLHSKRAIMTPSQENWLRQERGLRTIGRIELAYGRIEVKATRFLDLAQFLTKLHKISSTSSNMDNRSKEQLCACKVYVAGHLALG

SEQ ID NO: 181928 - protein, 76 aa, Glycine max
  Coding DNA Sequence Number=SeqID_65150
MAYGSHWWSWVVEKKVLGFGWAFGEEESEKISFSELISLSGSPFFALSVTICAKCDNSRSAQFPLELVLRLVLFSR

SEQ ID NO: 181929 - protein, 60 aa, Glycine max
  Coding DNA Sequence Number=SeqID_65151
LFFITGISTLLALLVSETVIWQKPILIAKAYGQRYLFTAPPSAKTSVPPTHDSTHGIDVV

SEQ ID NO: 181930 - protein, 1376 aa, Glycine max
  Coding DNA Sequence Number=SeqID_65152
  Gene Ontology: Mol. function=phosphopantetheinyltransferase activity; Biological process=macromolecule biosynthetic process
  Homolog annotation: Hit_ID=Q2HU34; Match level="QueryCoverage=99%, HitCoverage=100%, E-value=0.0, Identity=71%"; Hit description=DNA -binding protein-like-Arabidopsis thaliana-related
MAIEKNSFKVSRLDSECSPRSREIMSSDEEVIRRRNSAAESDDDDEFDDADSGAGSDDFDLLELGETRAEFCQIGNQTCSIPLELYDLSGLEDVLSVDVWNDCLSEEERFELAKYLPDMDQETFVQTLKEVFTGCNLHFGSPIKKLFDMLKGGLCEPRVALYREGLSSFQKRQHYHLLRKHQNNMVSNLCQIRDAWLNCRGYSIEERLRVLNIMRSQKSLMHEKEDLEVDSSDEESGEGIWSRKNKDRKISQKTGRYPFHGVGPGLDIHSQGRSVVMEQEKYGKQNPKGILKLAGSKPPSAKDPIGRASSVYHALDVNPGPNGSTSALSHQNKSVGYDSGSMLRMRDQLWNGDNEEMPYGLTVHQDRNLSRSNMMDKSSFRKMGKRQDLLRGDEMDTDNLMGLSLSSKIDLHGYTRNANQSSKRGLYEYSRNSKYPENVQQFVGSDQAKSRLRSSQLPLKGSMVDSADYDELFCSNETPGQEFGMMDSSFKYDDWYRKGKKWKAGRESPDLSYTPYRSSSPQVSDRLLSSDFRAKSLQEKTRGTSMQNGGKDTMPLRGNHMLLRGEETESDSSEQLGDDDDNTPLLQSKYAYLMGTAAGSRTKLLKSHLDPKKAKFVTDLKPHVIAQSKKKGGFAERGQMHGVENYLSKAKQKGEIRNGGPFHKQAGKFIEESYPSGSDMLNDGDDDWRHAYKTGKNGRIRGDPIERLDMPSSNAYTAEQKKKGRTDLDHSILRSKYLHDYVGDQDDSLERRLVVDNNEVGQSRYGRKGQKYAATYKGDQNERSEAPLLGCNSATKKRKTKDEVVDIGGRDEDGNLLSNTLTNDLTYSKRKSKKKIEAGMVSSEMDNSELHLTDMGTADIELEIKPQKKTFTLITPTVHTGFSFSIIHLLSAVRTAMISPHAEDSLEMGKPIEELNKAPEGTANGDLSNSKTDANCESADHPNMPSLTVPEIVNRVRSNPGDPCILETQEPLQDLVRGVLKIFSSKTAPLGAKGWKVLAVYEKSTRSWSWTGPVIHNSPDYDTTEEVTSPEAWGLPHKMLVKLVDSFANWLKCGQETLQQIGSLPAPPLALMQVNLDEKERFRDLRAQKSLNTISPSSEEVRTYFRKEEVLRYSIPDRAFSYTAADGKKSIVAPLRRCGGKPTSKARDHFMLKRDRPPHVTILCLVRDAAARLPGSIGTRADVCTLIRDSQYIVEDVSDAQINQVVSGALDRLHYERDPCVQFDGERKLWVYLHREREEEDFEDDGTSSTKKWKRQKKDAADQSDQGTVTVACPGTGEQSGYDLCSDLNVDPPPCIDDDKGMEPLSTDTRPNAEAHVDVNRASEEGNVCDGNSMAWEALDLNPTRELCQENSTNEDFDEESFGRERPVGLLSASLL

SEQ ID NO: 181931 - protein, 1078 aa, Glycine max
  Coding DNA Sequence Number=SeqID_65153
  Gene Ontology: Mol. function=microtubule motor activity; Cellular component=microtubule associated complex; Biological process =microtubule-based movement
  Homolog annotation: Hit_ID=Q2HU33; Match level="QueryCoverage=99%, HitCoverage=100%, E-value=0.0, Identity=85%"; Hit description =Kinesin, motor region
  Pfam annotation: Domain name=DUF1474; Domain location=418-515; Score=- 8.3; E_value=0.055; Accession=PF07342.2; Description=Protein of unknown function (DUF1474)
  Pfam annotation: Domain name=Kinesin; Domain location=57-404; Score =564.8; E_value=8.8e-167; Accession=PF00225.13; Description=Kinesin motor domain
  Pfam module annotation: Pfam domain module=DUF1474::Kinesin; Domain location=418-515::57-404
  Subcellular localization annotation: CTP_CleavageSite=22; ConfidenceScore=5.13e-01
MEAAQRRLGGGMVPLSPSQTPRSSDKPVRDLRSADSNSNSHSKYDKDKGVNVQVLVRCRPLSEDETRLHTPVVISCNEGRREVLAVQNIANKQIDRTFAFDKVFGPNSQQKELYDQAVSPIVYEVLEGYNCTIFAYGQTGTGKTYTMEGGARKKNGEFPSDAGVIPRAVKQIFDILEAQNAEYNMKVTFLELYNEEITDLLAPEETSKFIDDKSRKPIALMEDGKGGVFVRGLEEEIVCTANEIYKILEKGSAKRRTAETLLNKQSSRSHSIFSITIHIKECTPEGEEMIKCGKLNLVDLAGSENISRSGARESWPISYCSQAGRAREAGEINKSLLTLGRVINALVEHSGHVPYRDSKLTRLLRDSLGGKTKTCIIATISPSIHCLEETLSTLDYAHRAKNIKNKPEINQKMMKSAMIKDLYSEIDRLKQEVYAAREKNGIYVPRDRYLHEEAEKKAMTEKIERMELEAESKDKQLVELQELYNSQQLLTDELSVKLEKTEKSLEETEQSLFDLEERHKQANATIKEKEFLISNLLKSEKALVERAIELRAELENAASDVSNLFSKIEAHPSNITVEIAVSNLLERKDKIEEGNRILIQKFQSQLAQQLEVLHKTVSASVMHQEQQLKDMEDDMQSFVSTKAEATEDLRQRVGKLKNMYGSGIKALDDLAEELKVNNQLTYDDLKSEVAKHSSALEDLFKGIALEADSLLNDLQSSLHKQEANLTAYAHQQRESHARAVETTRAVSKITVNFFETIDRHASSLTEIVEEAQLVNDQKLCELEKKFEECTAYEEKQLLEKVAEMLASSNARKKQLVQIAVNDLRESANCRTSKLRQEALTMQESTSSVKAEWRVHMEKTEFNYHEDTSAVESGKKDLVEALQICLNKAKVGSQQWRKAQESLLSLEKRNAASVDTIVRGGMEANQALRARFSSAVSTTLEDAGIANKDINSSIDHSLQLDHEACGNLNSMIIPCCGDLRELKGGHFHSIVEITENSGKCLLNEYMVDEPSCSTPRKRLFNLPCVSSIEELRTPSFEELLKSFWDARSPKQANGDVKHIGAYEAAQSVRDSRVPLTAIN

SEQ ID NO: 181932 - protein, 95 aa, Glycine max
  Coding DNA Sequence Number=SeqID_65154
MGIPQTREKKRGRMNCGEEEEVEGDMVGEKGCAVRNRTMAFGNPKGVKKLLYTKRPKTPTAPNRDERNTTQRKRPQGRKVRKKGFGFRERETMTE

SEQ ID NO: 181933 - protein, 89 aa, Glycine max
  Coding DNA Sequence Number=SeqID_65155
MEKEKNGERGGVIKRMAKRMAKSDRKNGQENGQEGNKLQIDSMALKCENKIPGNDAKNLLALWQVYQIARSNNFSVIRVSYHRDFVALM

SEQ ID NO: 181934 - protein, 708 aa, Glycine max
  Coding DNA Sequence Number=SeqID_65156
  Gene Ontology: Mol. function=nucleoside-triphosphatase activity; Cellular component=membrane; Biological process=transport
  Homolog annotation: Hit_ID=Q2NVD8; Match level="QueryCoverage=67%, HitCoverage=99%, E-value=0.0, Identity=73%"; Hit description=Sugar ABC transporter ATP-binding component
DNGLTRCTFTRPQTIPIPSATISGSHDGGRGVADSQSAVHRAHGEIDACRDNDEGHADRQNAVDRDLAQDDQGVFIAEKIVAAPGPLSDLIFANQRHDQAQCEKGDDNAVFVHTALIAGENEIPGDKEWALLIFFLSLLNRKFHQCCLGRIGCRKLAGQLPVTKHQYAIAHADNFRKLGGNHNDPFVLQGELRHKSIDLFLGPDVDTARRLVEQQNLRIQQRPTAQHHFLLVAAAQVAHRLFAVVGFNVEALDHVAGSRLLPFLADKPHPADGGKRGDIDVFTDGTAQHQAGFLAIFRHVGNTAVDGLARRVAVQRLVAQANRAAVGMLNAEDKVEKFTAARSHQPIDAQDLTVLQLQADIFYLAAPTQVIDRQQDLSAGLIEFGELAVVLAANNVFDQLFTGNVGDIAFMDIGAVAENGVALLKRLKDFLRILFANRRGGFIHDDDVGIGMRQRLGDLDQLLFGDAQVAHFFSGVDLEIEFFEQAGRALVERCEIDEPQASRLAAQPNVFGHRQIRDRAQLLLHDGDAGIEGFPRMMKFAALAIDKNVAAIGLNKAHQNAEKGGFTRAVAAAQGMDGSAPQAKLRILERHDRAEGFPDAADLQQVALIKRLVLRLPAGVWRRARGLIQRNEALAQFGQQCGGVPARIVGQHRRPHRLNGAAQRRGLFGFQTDHRASHYVRDDLSPGGAAGAAAGEADFARFDALTAK

SEQ ID NO: 181935 - protein, 34 aa, Glycine max
  Coding DNA Sequence Number=SeqID_65157
MAPYSNVFRLSSAGKGRRFVGRDPILHFHPSLST

SEQ ID NO: 181936 - protein, 172 aa, Glycine max
  Coding DNA Sequence Number=SeqID_65158
MGSEIYPEVHENPRAFFSSSSSIFLEPLAHGSSDWSLPREDCINLFLFVLLEEAMKIAKDEDGLNQDGEEILLARDRALLLSGTAEKTLTKVIGVGVVEVLMRVAKARLLELSSGGGQAGGVHVLEGVGTGLEGGRERVAIRRGVEVDFISTYNWRASNDMSLKLRVLIYGL

SEQ ID NO: 181937 - protein, 199 aa, Glycine max
  Coding DNA Sequence Number=SeqID_65159
  Subcellular localization annotation: CTP_CleavageSite=35; ConfidenceScore=5.18e-01
MRTLGPSSAALAQFSYSLLLMALVTGPFLGRIASRGSRKTPYRILDLMNLKKLRRLNILIKGEFVLKDREVESMEEALELEHLKISWGVFETSDNLVGCQELDVELVIETNQYKSLSAYILSPYLFILNSCDGFHVAYLETPTNVRHSCSAPLELVGLGSSSSMDSFASWKMNGSGMKKEEREETPLQGEDESRRSSPP

SEQ ID NO: 181938 - protein, 243 aa, Glycine max
  Coding DNA Sequence Number=SeqID_65160
  Homolog annotation: Hit_ID=Q2HU26; Match level="QueryCoverage=73%, HitCoverage=72%, E-value=2e-58, Identity=64%"; Hit description=CCT
  Pfam annotation: Domain name=CCT; Domain location=154-192; Score =81.5; E_value=2.5e-21; Accession=PF06203.4; Description=CCT motif
  Subcellular localization annotation: CTP_CleavageSite=4; ConfidenceScore=5.19e-01
MYANSSTASPSSFFPKLTELNNSETNYYYYHNNNNNNNNSNCSSGYSSYGGSPSPTPPSVPIPNLMQRSVSSHSFHCNNNATHHPFSALFAQLLDSDDSPVRRVCSTGDLQRINGMQHNHHSDSPLSSESSMIIEGMSRACRYSPEEKKVRIERYRSKRSQRNFNKKIKYACRKTLADSRPRIRGRFARNDEIDKNTTIQWSQIGAGEDEDEEDENWITMLDSIVAANFAQESQGSSSFGLFY

SEQ ID NO: 181939 - protein, 40 aa, Glycine max
  Coding DNA Sequence Number=SeqID_65161
MEHSPGHAWWRRLWQQHKKGEVRYCVQDGMWCHVNRKRKM

SEQ ID NO: 181940 - protein, 308 aa, Glycine max
  Coding DNA Sequence Number=SeqID_65162
  Gene Ontology: Mol. function=protein serine/threonine kinase activity; Cellular component=membrane; Biological process=protein amino acid phosphorylation
  Homolog annotation: Hit_ID=Q1SQN8; Match level="QueryCoverage=98%, HitCoverage=74%, E-value=1e-131, Identity=78%"; Hit description =Protein kinase
  Pfam annotation: Domain name=Pkinase; Domain location=87-306; Score =85.8; E_value=1.4e-22; Accession=PF00069.15; Description=Protein kinase domain
  Pfam annotation: Domain name=Pkinase_Tyr; Domain location=87-306; Score=82.7; E_value=1.2e-21; Accession=PF07714.7; Description =Protein tyrosine kinase
  Pfam module annotation: Pfam domain module=Pkinase::Pkinase_Tyr; Domain location=87-306::87-306
MGCFRCTGKSSKKTNNINHAEKHTPADKVKVNSNLNGKKEDNNPKPDQLSLDVKYLNLKEVSNEGKVNGYRAQTFTFAELAAATGNFRLDCFLGEGGFGKVYKGRIDKINQVVAIKQLDPHGLQGIREFVVEVLTLSLADHPNLVKLIGFCAEGEQRLLVYEYMSLGSLENRLHDLPRGRKPIDWNSRMKIAAGAARGLEYLHNKMKPPVIYRDLKCSNILLGEGYHSKLSDFGLAKVGPSGDKTHVSTRVMGTYGYCAPDYAMTGQLTFKSDIYSFGVVLLEIITGRKAIDNTKPAKEQNLVSWVCK

SEQ ID NO: 181941 - protein, 275 aa, Glycine max
  Coding DNA Sequence Number=SeqID_65163
  Gene Ontology: Mol. function=ion channel activity; Cellular component= integral to membrane; Biological process=ion transport
  Homolog annotation: Hit_ID=O65717; Match level="QueryCoverage=96%, HitCoverage=37%, E-value=2e-94, Identity=64%"; Hit description =Cyclic nucleotide-gated ion channel 1
MSTTPQEKFVRFQDWNSEKGSESNYPAIKITHSERFRTTLSSVSEKFQNGLESGSERMKRFRTSFKSFPYGSVLSRSFSSRKKILDPQGPFLQKWNKIFVLLCVIAVSLDPLFFYVPVIEDAKKCLSLDSKMEITATVLRSFSDALYIIHMIFQFRTGFIAPSSRVFGRGVLVEDSWAIARRYLSSYFIIDILAVLPLPQVVILVIIPEMSGFKSLNTKNLLKFVVFLQYVPRLLRIIPLYNEVTRTSGILTETAWAGAAFNLFLYMLASHIGQD

SEQ ID NO: 181942 - protein, 164 aa, Glycine max
  Coding DNA Sequence Number=SeqID_65164
MWEDWHILSQIWHLLSTINKVVQHKNKSTRETMVRWNLPAPNSYKLNTDKSSLGNPKNAAFGALSLSHSHTDHAGPICLDLAPNHFGSPHVVSGLSRVAVVVQPRRPDRGARLQALNVPRAPPRGHGWRLDALAWLQRKLLQKHVCRVDKFGFSRVAASETVHQ

SEQ ID NO: 181943 - protein, 263 aa, Glycine max
  Coding DNA Sequence Number=SeqID_65165
  Gene Ontology: Mol. function=ion channel activity; Cellular component= integral to membrane; Biological process=ion transport
  Homolog annotation: Hit_ID=Q8H6U1; Match level="QueryCoverage=99%, HitCoverage=51%, E-value=1e-128, Identity=88%"; Hit description =Cyclic nucleotide-gated channel C
  Pfam annotation: Domain name=IQ; Domain location=171-191; Score=16.5; E_value=0.098; Accession=PF00612.17; Description=IQ calmodulin -binding motif
  Pfam annotation: Domain name=cNMP_binding; Domain location=52-152; Score=37.5; E_value=4.5e-08; Accession=PF00027.19; Description =Cyclic nucleotide-binding domain
  Pfam module annotation: Pfam domain module=IQ::cNMP_binding; Domain location=171-191::52-152
MQNSGCLIDCFQMACESESDDMNSTDGKKPEVPMFEKMDEQLLDAMCDLLKPVLYTEESYIVREGDPVDEMLFIMRGKLLTMTTNGGRTGFFNSEYLKAGDFCGEELLTWALDPHSSPNLPTSTRTVQTLSEVEAFALKADDLKFVASQFRRLHSKQLRHTFRFYSQQWRTWAACFIQAAWRRYSKRKLEESLVEEENRLQDALAKAGGSSPSLGATIYASRFAANALRLLRRNGTKKGRVPERLPPMLPQKPAEPDFTADEE

SEQ ID NO: 181944 - protein, 111 aa, Glycine max
  Coding DNA Sequence Number=SeqID_65166
  Gene Ontology: Mol. function=motor activity; Cellular component =myosin complex
  Homolog annotation: Hit_ID=O24517; Match level="QueryCoverage=86%, HitCoverage=8%, E-value=6e-29, Identity=57%"; Hit description =Unconventional myosin
MKKIQGLQALHGATSVAVKDSSVYHKDTEATLCGVDDMTKLAYLHEPSVLDYLRSSHMMAQYKGLGFRELTPHPFAIANATYKFRLMINEGISQSILVSGENGAGKMESTK

SEQ ID NO: 181945 - protein, 257 aa, Glycine max
  Coding DNA Sequence Number=SeqID_65167
MVGTQRSTAMKTVSEDKSIGARTRGAIQRGETGDKVPGFDPAAAPMETDAEAGGSSQPAGKPQPQPAKADDSNASSHASGLRAWSSEGNPQTARGKAPLREGPVYLVWWFIIAMVVIGYFIISWSRTLADARILSALRPGDIGGCAASVPWMEPDRRRIGIAAAGHRDAPRDGFQRAREATSRPIRQKGRNEGRKRRSEMRSIMNKQPTTPLTDDEDVKFLAENSDVSPLQARQLIERFGRDREKLLEEAKKFKAEG

SEQ ID NO: 181946 - protein, 74 aa, Glycine max
  Coding DNA Sequence Number=SeqID_65168
  Homolog annotation: Hit_ID=Q2K6Y4; Match level="QueryCoverage=74%, HitCoverage=42%, E-value=5e-12, Identity=57%"; Hit description =Hypothetical conserved protein
MEAAMKHDPKAGTTDQKPKWEGPPENRPRGYEPAVDDPAKKRDAVGHNLSDPDRKNLSDALSEPKHAGRNDDDG

SEQ ID NO: 181947 - protein, 43 aa, Glycine max
  Coding DNA Sequence Number=SeqID_65169
MVGRRNFYFILENIKNSFISSIGNIAWSRGVQRSCFPGHTCSL

SEQ ID NO: 181948 - protein, 137 aa, Glycine max
  Coding DNA Sequence Number=SeqID_65170
MVKEECKEVSVSSKRQPSHPLLCKKTLVSTATPLGLEVIPQVKELLDEGLDSFHHVFTVRICKIMYVEGEICIARRIMEWRLQFLSLTFGNPNRATRGGALESTKNATIDNGERLNDYIEATEIWMTPLSVKEDKSG

SEQ ID NO: 181949 - protein, 94 aa, Glycine max
  Coding DNA Sequence Number=SeqID_65171
MATARTTFLNEKSTRFGISTDTIDNNETSTNVTTQTIYKRGNIKENMDLGIPLVIVAPHATGLLGHGNKKWGGRQKQGFCSYVSSICDEELRPT

SEQ ID NO: 181950 - protein, 138 aa, Glycine max
  Coding DNA Sequence Number=SeqID_65172
  Pfam annotation: Domain name=zf-GRF; Domain location=15-49; Score =10.1; E_value=0.0018; Accession=PF06839.3; Description=GRF zinc finger
  Subcellular localization annotation: CTP_CleavageSite=45; ConfidenceScore=5.10e-01
MSVNSSTRGNPTSNRLCYCRRRATIRTARMTRNNGILFYACPLPQVSNVNDIDVGAVEIGRIEPIPDFGLSVGSTTLVQHEKIKCSEKQNPYLYWKAPIASINTGGVTKNDNHHHWESDDRRGPSTGTLSFNHRREKM

SEQ ID NO: 181951 - protein, 76 aa, Glycine max
  Coding DNA Sequence Number=SeqID_65173
MTYFLDFVINDCRNLPFCGGVERPRHMGQMHLSLRKKMSGVATNVYSRKPLEKPKGRWSAGFENEGSRVVYAWGRY

SEQ ID NO: 181952 - protein, 290 aa, Glycine max
  Coding DNA Sequence Number=SeqID_65174
  Gene Ontology: Mol. function=protein serine/threonine kinase activity; Cellular component=membrane; Biological process=two -component signal transduction system (phosphorelay)
  Homolog annotation: Hit_ID=Q5DW43; Match level="QueryCoverage=91%, HitCoverage=56%, E-value=1e-104, Identity=66%"; Hit description =Phototropin
  Pfam annotation: Domain name=PAS; Domain location=156-264; Score =16.1; E_value=0.013; Accession=PF00989.14; Description=PAS domain
  Pfam annotation: Domain name=PAS_3; Domain location=181-277; Score =18.3; E_value=0.0016; Accession=PF08447.1; Description=PAS fold
  Pfam module annotation: Pfam domain module=PAS::PAS_3; Domain location=156-264::181-277
  Subcellular localization annotation: CTP_CleavageSite=46; ConfidenceScore=5.47e-01
MEQSEKSPTKISPLRSSFPRDPRGSLEVFNPNTSALASTSTNARVRSQPLWKSWTESEEPRNEIAATSWMAINPAAGESGEAAQRAAEWGLVLRTDTETGKPQGVAVRNSGGEEPNAAKLAAAASSSRKNSQNSARTSGDSSDGGGGGGGIPRISEDVMGALSAFQQTFVVSDATKADYPILYASAGFFKMTGYKSKEVIGRNCRFLQGADTDPEDVAKIREALQAGKIYCGRLLNYKKDGTPFWNLLTISPIKDEDGKVLKFIGWKGWLGPKLTYHQIAHGTRGVCCKF

SEQ ID NO: 181953 - protein, 502 aa, Glycine max
  Coding DNA Sequence Number=SeqID_65175
  Gene Ontology: Mol. function=protein serine/threonine kinase activity; Cellular component=membrane; Biological process=two -component signal transduction system (phosphorelay)
  Homolog annotation: Hit_ID=Q5DW43; Match level="QueryCoverage=95%, HitCoverage=60%, E-value=0.0, Identity=67%"; Hit description =Phototropin
  Pfam annotation: Domain name=PAS; Domain location=158-280; Score =14.7; E_value=0.017; Accession=PF00989.14; Description=PAS domain
  Pfam annotation: Domain name=PAS_3; Domain location=183-283; Score =20.1; E_value=0.0011; Accession=PF08447.1; Description=PAS fold
  Pfam annotation: Domain name=Pkinase; Domain location=381-497; Score=- 112.8; E_value=0.077; Accession=PF00069.15; Description=Protein kinase domain
  Pfam module annotation: Pfam domain module=PAS::PAS_3::Pkinase; Domain location=158-280::183-283::381-497
MHCIAARQKEKATSSVTELLQAMKRPRALSESASRPSIRKSGSRSSDEEKLEQEQEDDKEKAQKTLRRISESGASFGRKSEGSGNRISMERISELPENKHRNSQRRSFMGFRRKSQSNDESMDSEVIEDESSESEDDERPNSFELDDKEKQREKRKGLDLATTLERIEKNFVITDPRLPDNPIIFASDSFLELTEYSREEILGRNCRFLQGPETDPATVNKIREAIDNQTEVTVQLINYTKSGKISLFNPGKKFWNLFHLQPMRDQKGEVQYFIGVQLDGSQHVEPLHNCIAEDTAKEGEQLVKQTAENVDEAVRDLPDANKSIWLQLWHDHPFGALQKPDDLWTNHSKTVHPKPHRKDDPAWKAIQKVLESGEQIGLKHFRPIKPLGSGDTGSVHLVELRGTGQYFAMKAMDKGVMLNRNKVHRACAEREILDKLDHPFLPALYASFQTKTHVCLITDYCPGGELFLLLDRQPTKVLKEDAVRYIIPPLTDPEFLFDGRKK

SEQ ID NO: 181954 - protein, 86 aa, Glycine max
  Coding DNA Sequence Number=SeqID_65176
MKKIQGLQAPHGATSCQAHDIKQALFGRHPMTFSKTICLSVLWSRSIDHDLCIHYQNRVQPWSITMTQAVIINDHNSRGQVHHDCG

SEQ ID NO: 181955 - protein, 92 aa, Glycine max
  Coding DNA Sequence Number=SeqID_65177
  Subcellular localization annotation: CTP_CleavageSite=46; ConfidenceScore=5.34e-01
MEILRKHYGSSGSLESHFLTKRGRWLPPSSPRRARLRNDTCFLSVMSQNFTDYATIPSLTSRMLRNFTDCATMLPFDFWHVAELHGLPNDGC

SEQ ID NO: 181956 - protein, 46 aa, Glycine max
  Coding DNA Sequence Number=SeqID_65178
MGVEHFEVVKQRSHADKQWSPDEIRIVYILAHNHNHLFIPDTYLPK

SEQ ID NO: 181957 - protein, 56 aa, Glycine max
  Coding DNA Sequence Number=SeqID_65179
MLADVGQGKMTDRGRLGFFVRAQPKLFFGRHRHVLIYSARKTLTHLGEKSLFSDTD

SEQ ID NO: 181958 - protein, 119 aa, Glycine max
  Coding DNA Sequence Number=SeqID_65180
  Gene Ontology: Mol. function=transcriptional repressor activity; Biological process=regulation of nitrogen utilization
  Homolog annotation: Hit_ID=Q2KBP3; Match level="QueryCoverage=97%, HitCoverage=37%, E-value=2e-44, Identity=71%"; Hit description =Hypothetical conserved protein
MGDINELGKIVVGAFAHPDNAGKGAYLPLVGDFLSFREIVGTLNQLGHPVTFKQVPREVYAGFFPGAEALADTLAYYEKYTYLGPGSHEAAIAQADKIAEFQPATFKSWARDHFSLNSK

SEQ ID NO: 181959 - protein, 227 aa, Glycine max
  Coding DNA Sequence Number=SeqID_65181
MWVFLTDRQIDWALLVRYPMHKALRSNAPLPYPHLITLFLQHFNVPLDSEPFVKVKRSFSIGANVVSFFGYRKERDGSWVKKDAPVQAAEDHSPSPYSQRDDSSSLMHSILDKLDGLQTFIGEHFDSLDSRIDAMDARFVGMDTRITKLEEDDYYHQKGGDCGSNAFQDYFDDAKESRVKQVSRIKIKIQDSRIIKIKIQDSRIIKIKIQVKNQESRIKRKLNQDKY

SEQ ID NO: 181960 - protein, 115 aa, Glycine max
  Coding DNA Sequence Number=SeqID_65182
MLAQASWLLPPEGTAFFWKPQEGLSGPGCYLHPLFTKYTSLLCFFIDFFPKHCGTLRITQRHLFSFQNVVKLYGLHNDACFEGSEGSKQGSRTNRKYSRTKLGYDSCPSLLIFYW

SEQ ID NO: 181961 - protein, 58 aa, Glycine max
  Coding DNA Sequence Number=SeqID_65183
MPYPYMKEGQKLNIHPFMRYYSHEWLSKDSHRLPQHQDVELTLESVGSSGLRIIKKGG

SEQ ID NO: 181962 - protein, 348 aa, Glycine max
  Coding DNA Sequence Number=SeqID_65184
MSGVMQLQCVIICLLRPSLSAILTAKCAASARCGGPWRNRAILLQVVILVIHNTKEDAQYKENEDPMEIKDIVEDAYHPTVEVSNPRCKMEEEHALNDAKQKSLVIKLECVYTPYPRIIRHKKSLILEEVPTFDEDMTKSKGKDPLEGLEGHMTRARARKAKETLQQVLSILFEYKPKFQGEKSKVGPIGNLGISLLGDQMVADLLAVGEAEGSGLSHEDRDEIPTSGVGQVQHLRFIDATQERPDATTLQINEVLSDLPEEEEAHLRQEASLEEVRHEEPKVTSSEVTLEDPKPQPSVKAQQQVASPISVHRPPPALDVNNIQALIDQSLQAHDATLCAQLESQNVA

SEQ ID NO: 181963 - protein, 68 aa, Glycine max
  Coding DNA Sequence Number=SeqID_65185
MIGRGKKENQQPLSLTSLTNLHLECDCFESETASSVGVVALGDLVTAATLVAVDVVELLIDGGGEDPV

SEQ ID NO: 181964 - protein, 92 aa, Glycine max
  Coding DNA Sequence Number=SeqID_65186
MPKSPYFRFPTEAILSERLSDTKCGNLSTGIRTFVRHVAGTISASPQVPTGAGFDGVDLEEEDEDAGQMGHATKGVCGRCIQAEKQTSEHAP

SEQ ID NO: 181965 - protein, 71 aa, Glycine max
  Coding DNA Sequence Number=SeqID_65187
MMLMFDKCSTFFYNNPSLPFVELFAITCHNNNPPGNQHGSTSNLEDLSDEYETCWVKNHDSDTNSSSGPEG

SEQ ID NO: 181966 - protein, 157 aa, Glycine max
  Coding DNA Sequence Number=SeqID_65188
PKRLSGSVGPKNKDSVRLDVRDSMLNTPSNLPFFIDAIETRWEHDDTLHMDHFYGFLYCRCAPIDVIIPSESHSLPTDDMMSFSRSNSSSKDTKTISPTLMSHRSMLHESQVQLGDEGEELDEDTSFEEDPSMDEEDPVTEPEFMKEDSSHDSSKES

SEQ ID NO: 181967 - protein, 85 aa, Glycine max
  Coding DNA Sequence Number=SeqID_65189
MASTQKLYSLYQAIRAPARIVVRNMAITSSFYVIHHYTNNTKERVPLSCILGICVRISQVQLNDLINYPNKIGYNASMGGNVGDI

SEQ ID NO: 181968 - protein, 198 aa, Glycine max
  Coding DNA Sequence Number=SeqID_65190
  Homolog annotation: Hit_ID=Q1S216; Match level="QueryCoverage=84%, HitCoverage=43%, E-value=2e-16, Identity=36%"; Hit description =Cyclin-like F-box; FBD
  Pfam annotation: Domain name=FBD; Domain location=118-167; Score =62.3; E_value=1.6e-15; Accession=PF08387.1; Description=FBD
MAQAITLLIFQFNKIELNTLRWTDSLSKNNIQAENGEFMFIYLRGNILGKYYVLQVVKCLKHASTSDIPVFDKLIQLEISFGNYSWDLLASLLQRSHKLEVLTIYKEPQKYAKGQEPRWIHPLLVPECLLHLKTFCLREYQGLETELDFVGYIMQNARVLETMTIYISSSLGSEEKLQIRRHLSILQRNFETCQIVFH

SEQ ID NO: 181969 - protein, 288 aa, Glycine max
  Coding DNA Sequence Number=SeqID_65191
  Gene Ontology: Mol. function=zinc ion binding; Biological process =electron transport
  Homolog annotation: Hit_ID=Q1SVM0; Match level="QueryCoverage=64%, HitCoverage=51%, E-value=1e-27, Identity=38%"; Hit description =Cyclin-like F-box
  Pfam annotation: Domain name=F-box; Domain location=20-67; Score =31.6; E_value=2.7e-06; Accession=PF00646.23; Description=F-box domain
  Pfam annotation: Domain name=LRR_2; Domain location=173-199; Score =24.1; E_value=0.00051; Accession=PF07723.3; Description=Leucine Rich Repeat
  Pfam module annotation: Pfam domain module=F-box::LRR_2; Domain location=20-67::173-199
MAESSEPPSHRQKPTTGDDDRISHLPDVLLLQILSLLPTKQAVITGILSKRWRPLWPAVSVLDFDDESSPEFHHPGGLTGFAEFVYSVLLLHDAPAIERFRLRCANPNYSARDIATWLCHVARRRAERVELSLSLSRYVALPRCLFHCDTVSVMKLNGVFLNALASFSVSLPLLKVLHVGDRVLFGCHDYVVKLLAGCPALEDLVLESTYNDACGGVVCAEGNFQLDLKHLSSAKIGFSWKERCLKSMLLIFRALSNVRCLSLSTSTVATEQGQRGVEVMQNRVTVQA

SEQ ID NO: 181970 - protein, 206 aa, Glycine max
  Coding DNA Sequence Number=SeqID_65192
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=9e-38, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHALTLTERHFLTFRGLHFLTFRGPHILAFRGLHVLPFIGLDVLAFRGLHVLAFRGLHVLPFIGLHDLAFRGLHVLDYRGLHVLTFRGLHVPAFIGLHILALRGLHVLAIRGLHVVAFRGLHVLAFKGLHVIAFRGLHVLAFRGLHVLAFRGLHILAVIGVHVLAFRGLHVLAFRGLHVIAFRGLHVLAFRGVTFTG

SEQ ID NO: 181971 - protein, 72 aa, Glycine max
  Coding DNA Sequence Number=SeqID_65193
  Pfam annotation: Domain name=zf-GRF; Domain location=20-59; Score =13.1; E_value=0.00078; Accession=PF06839.3; Description=GRF zinc finger
  Subcellular localization annotation: CTP_CleavageSite=30; ConfidenceScore=5.52e-01
MSQRSNASSSRTRVSSQVVLFCGCGRRAVRRVAGTNINRGRAFFTCSINKGFYLGLFRMKLDIVGTLFGLIN

SEQ ID NO: 181972 - protein, 75 aa, Glycine max
  Coding DNA Sequence Number=SeqID_65194
MAARPSELLLHPELTFSSKLAGYFTPKLFGGPGEPEASLSEPGFRKKLEMTLLPLSFAGVQHCKSTSNDQKINKR

SEQ ID NO: 181973 - protein, 80 aa, Glycine max
  Coding DNA Sequence Number=SeqID_65195
MAHGGHQWSWVVEKVLGFSEIVSLSGSLLFELSMTIRAERNTPCAKHDNSHSAQFSLRNLQPKSEDDPTVIESKIVILLK

SEQ ID NO: 181974 - protein, 269 aa, Glycine max
  Coding DNA Sequence Number=SeqID_65196
  Gene Ontology: Mol. function=protein dimerization activity
  Homolog annotation: Hit_ID=Q2R1C3; Match level="QueryCoverage=53%, HitCoverage=23%, E-value=6e-15, Identity=31%"; Hit description=HAT family dimerisation domain containing protein
  Subcellular localization annotation: CTP_CleavageSite=66; ConfidenceScore=5.19e-01
MGKARLIALCVCTSKGNWSAHPRNSSAKGKGSRQNGSITSGEKLALKARHGGPSPEPVNFQWTAQVASMVRAGCHMPVGGRIGNGPFRASSEGVKQPTRKMSTATNQAAEQKDETKPLWRYVSKFRKTTGGGNFEFKCNICEVSFNGSYTKVRAHLLKNLKNRISNEGKETNIGANPKIKGPLANSFNVQGRDILDCEIARMLYSLGLPFHLTRNPYYRKALNCSSEVKDKDFIDKHMRDVNMEVRPSNVVQIVTDNVVECKAAIFLIE

SEQ ID NO: 181975 - protein, 71 aa, Glycine max
  Coding DNA Sequence Number=SeqID_65197
MAFRFYQPFVLGILFVALVLGSGPVTGLSPPIFSCVGKCKTAADCNNICKPNCTYPDGVSSNSSSFLSNIG

SEQ ID NO: 181976 - protein, 422 aa, Glycine max
  Coding DNA Sequence Number=SeqID_65198
  Gene Ontology: Mol. function=tricarboxylate carrier activity; Cellular component=integral to membrane; Biological process=transport
  Homolog annotation: Hit_ID=P16482; Match level="QueryCoverage=53%, HitCoverage=51%, E-value=3e-85, Identity=76%"; Hit description =Citrate-proton symporter
  Pfam annotation: Domain name=LysR_substrate; Domain location=1-186; Score=5.2; E_value=0.00038; Accession=PF03466.10; Description=LysR substrate binding domain
MPEGIRRFQARYPRVRIILRDSSVGNVMDAVSSGQADFGICFARNLPPELTFTPLVEDVYVAACRHDHPLATRQQLSWQEYFAQDYVALDKCAGASYARPAKYLRNAPCHDAAGDGRSGHRHCCRARDVDAGERASAAAPAGADRSAGHPFGRINSPQRTYAILRRCGAGKADYRTVSARLTRGLQRQRAAAIQRGRHHRREAAKQRGCQAVGQRETGDAHFCRHHFGQRRDHRTVIQAVNKRQPQQHAQHHAEGRRLRQQRQCRVGGRQRQQRHRQQHRFTPKAVRQRTANWQPDKVGDRHQQRHQQAVRGAQHQHFFAEGGRIDGNEVERGGGHRHHQHPGNHHRPVLQQRAKYLTHIQMMTARAELLCLFQTAAQNKDKRHDQAAKQERNTPAPALMALCSSAALSAKPIAAATMMATC

SEQ ID NO: 181977 - protein, 251 aa, Glycine max
  Coding DNA Sequence Number=SeqID_65199
  Homolog annotation: Hit_ID=Q1SKD7; Match level="QueryCoverage=83%, HitCoverage=58%, E-value=2e-12, Identity=25%"; Hit description =Ankyrin
MAPKKLSAKRSRRDAAAEGTSAAPEFDSHRFRSAEHQQRFEAIKGWSFHRERRVQLRDDEYTDFQEEIAHRQWTSLVTPMAKFDPDIVLEFYVNAWPTEEGVWDMRSWGDPLVLEEGQECEFSQRRNRVDRFDEEAIAQLLCILGQDFARIAAEKRVQIMRTIMTTLTQMWMTLLLSNVLPSDHNSNLPLSKCQLVYAILTRMSVHVAQLIADAIYLFAGMPPTRHPLDPDKSNRALGFLALITGLCQSFG

SEQ ID NO: 181978 - protein, 156 aa, Glycine max
  Coding DNA Sequence Number=SeqID_65200
LKGPSGEEAKVPKENEEVQALKVKLERRRMVKKKLKMTVIRGSNNKLKLRRAERDESRVVSMALKDKLKACHRSKRSLTEQSSGTEENMLTIIDQYKEKVNLAASLRQRLEDDHAKVLTLQMEREARERVIESLRWEAVKWMDRFALTLNGSQELP

SEQ ID NO: 181979 - protein, 114 aa, Glycine max
  Coding DNA Sequence Number=SeqID_65201
MVSNDHADMIGRLLAEDEPFVKRKDVDVRKHNLPPPIPEDHMSLGIFGLKHNLPTPSPPPQWDSSSSLLNDVLTELRYLWAFAGDHFNAIDSRITRLEDDMSFIHRFFDPPADP

SEQ ID NO: 181980 - protein, 178 aa, Glycine max
  Coding DNA Sequence Number=SeqID_65202
  Gene Ontology: Mol. function=transporter activity; Cellular component= membrane; Biological process=oligopeptide transport
  Homolog annotation: Hit_ID=Q9CAS0; Match level="QueryCoverage=47%, HitCoverage=13%, E-value=5e-16, Identity=44%"; Hit description =Putative peptide transporter; 37139-33250
MASQMFKSIASMKICIRDNDLNTEDCVKNPWRICNIQQMEEVKCLIKVLPIRALGILCLIPITQHGGPNHHRLAPQSSLFYSTESPDKMKRIGNSLQYLVVAFSIYVGTLAVNVVHQLTRKHDGIDWLNDDINAGRLDYYCFLVARLALINLVYILFCVKHYRYKVNVEEKVVEKLEP

SEQ ID NO: 181981 - protein, 157 aa, Glycine max
  Coding DNA Sequence Number=SeqID_65203
  Gene Ontology: Biological process=lipid metabolic process
  Homolog annotation: Hit_ID=O80959; Match level="QueryCoverage=93%, HitCoverage=23%, E-value=7e-18, Identity=50%"; Hit description =Similar to latex allergen from Hevea brasiliensis
  Subcellular localization annotation: CTP_CleavageSite=25; ConfidenceScore=5.19e-01
PYLAPSTTPSLFTPFHFSSIDGKTSCAAIDGGLVMNNSAAAAVTHVLHNKRDFLSVNNMEDLLVLSIRNGAQAKRMNNAGECSTSMVVDIALDDISETVDQMLGNAFCWNRTDYVRIQDEEILHTIHRWEIALVVEDLRDGSCCRIVHHQAAIDGGA

SEQ ID NO: 181982 - protein, 117 aa, Glycine max
  Coding DNA Sequence Number=SeqID_65204
MVILRLLSSRGGEPDDMRRQIMVILPKGDCVRWRAETNYGHSAPFHPGSIVSDGTQRQIMVILRPFVIQRRSCPMTHRDKLWSSARFCYLSSESSDKHAETNYGHSTPFVIQEQQVE

SEQ ID NO: 181983 - protein, 54 aa, Glycine max
  Coding DNA Sequence Number=SeqID_65205
MGQNTPNKIDDDGSKSHQGEKQGFWKFKFRPFRNILKIGLLKEEATGQQAPPRC

SEQ ID NO: 181984 - protein, 62 aa, Glycine max
  Coding DNA Sequence Number=SeqID_65206
MDELKDLIKQVAPRRTPPYGVDETQMVLIESNYWKKIGPIEILAVFSKPVLQMEDELSLSQN

SEQ ID NO: 181985 - protein, 810 aa, Glycine max
  Coding DNA Sequence Number=SeqID_65207
  Gene Ontology: Mol. function=phosphoenolpyruvate carboxylase activity; Biological process=carbon utilization by fixation of carbon dioxide
  Homolog annotation: Hit_ID=Q6Q2Z8; Match level="QueryCoverage=97%, HitCoverage=80%, E-value=0.0, Identity=88%"; Hit description =Phosphoenolpyruvate carboxylase
  Pfam annotation: Domain name=PEPcase; Domain location=3-810; Score =1908.0; E_value=0; Accession=PF00311.8; Description=Phosphoenolpyruva te carboxylase
GYKVGLVVKGEGKGGGRIRNCLTQLYAKDITPDDKQELDEALQREHCRNAMILLCSSCMKIQAAFRTDEIRRTPPTPQDEMRAGMSYFHETIWKGIPKFLRRVDTALKNIGINERVPYNAPVIQFSSWMGGDRDGNPRVTPEVTRDVCLLARMMAANLYFSQIEDLMFELSMWRCNDELRVRSDELLSSSKRDAKHYIEFWKQIPPNEPYRVILGDVRDKLYNTRERARQLLANGSSEIPEETTFTNVEQFLEPLELCYRSLCACGDQPIADGSLLDFLRQVSTFGLSLVRLDIRQESDRHTDVMDAITNHLEIGSYREWSEERRQEWLLSELSGKRPLFGPDLPKTEEIADVLETFHVIAELPSDSFGAYIISMATAPSDVLSVELLQRECHVKQPLRVVPLFEKLADLEAAPAAVARLFSIDWYRDRINGKQEVMIGYSDSGKDAGRFSAAWALYKAQEELIKVAKEFGVKLTMFHGRGGTVGRGGGPTHLAILSQPPDTIHGSLRVTVQGEVIEQSFGEEHLCFRTLQRFTAATLEHGMHPPVAPKPEWRALMDEMAVIATEEYRSIVFQEPRFVEYFRCATPELEYGRMNIGSRPSKRKPSGGIESLRAIPWIFAWTQTRFHLPVWLGFGAAFSHVIKKDPKNLQMLQDMYNQWPFFRVSLDLVEMVFAKGDPGIAALYDKLLVSEELWPFGERLRSMFEETKSLLLQVAGHKDLLEGDPYLKQRLRLRDSYITTLNVLQAYTLKRIRDPDYHVKLRPHLSKDYMESNKPAAELVKLNPTSDYAPGLEDTLILTMKGIAAGMQNTG

SEQ ID NO: 181986 - protein, 200 aa, Glycine max
  Coding DNA Sequence Number=SeqID_65208
  Gene Ontology: Mol. function=phosphoenolpyruvate carboxylase activity; Biological process=carbon utilization by fixation of carbon dioxide
  Homolog annotation: Hit_ID=Q6Q2Z8; Match level="QueryCoverage=91%, HitCoverage=18%, E-value=2e-89, Identity=91%"; Hit description =Phosphoenolpyruvate carboxylase
MASIDAQLRLLAPSKVSDDDKLVEYDALLLDRFLDILQDLHGDDIRETVQDCYELSAEYEGQNNPQKLEELGNMLTGLDAGDSIVISKSFAHMLNLANLAEEVQIAYRRRIKLLKKGDFADENSAITESDIEETFKRLVNQLKKTPQEIFDALKSQTVDLVLTAHPTQSVRRSLLQKHGSQRSNVSPFVKHLSISCAESQ

SEQ ID NO: 181987 - protein, 301 aa, Glycine max
  Coding DNA Sequence Number=SeqID_65209
  Subcellular localization annotation: CTP_CleavageSite=35; ConfidenceScore=5.68e-01
MAIPLNSPSTPPESATLSSLSSSKKTRKATRLRLLATRPTGVERPVVHVDPVVWVVGKFAKRDWLAKQDTSLTDLLLRFSNMLSELYASLSGFHSLSGSASIVTRDKVDVIYDNWKQVIVAQKDQIWRIFRKFKSNLTSKWALAHNKKGKDDKVYEKYGISKEKMFERRHRPLKNKTLPLTCCLASRGSFIAHRRQDILAAAIGRPEHPSRVCAARATTDTNDHRPVGGVDYTKVTQQLMMSFSQMQSQMQSQGIALPPEVKVGPSASCVNTKKSYVDSSRQDSETWDSNKRGLYADDSPP

SEQ ID NO: 181988 - protein, 88 aa, Glycine max
  Coding DNA Sequence Number=SeqID_65210
  Subcellular localization annotation: CTP_CleavageSite=69; ConfidenceScore=5.06e-01
MGDQATSMQEITSWAREGTNDSLSKLAARWARSSVTGPLLGFPHALSGLSASLSGCHSLSAYASLSETPAASPSSSLSLKLKFIHISS

SEQ ID NO: 181989 - protein, 289 aa, Glycine max
  Coding DNA Sequence Number=SeqID_65211
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=2e-26, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ELHVLSFRGLHILTFRRLHVLTFRGLDVLTFRRLHILTFRGLHVLTFRGLHALTFRGLHVLTFRGFHVLTFRGLHLHALRTTLSHLQRTAHALHVLTFRGLHVLTIRGLHILAIRGLHALTFRGLHVLAFGGLHVLTFRGLRVLTFRGQRVLTFRGLHVLTYRGLQVLIFTRLLTLAFRGLHVLTFRGQLALAFRGLHALTFRGLRTLTIRGLYILTSRGPHVLTIRVPHALTFRGLHVLTFRGRHIFTFTGLHVLTFRGLHVLTFRGLHALTFRGLHVLALRTTCPHL

SEQ ID NO: 181990 - protein, 115 aa, Glycine max
  Coding DNA Sequence Number=SeqID_65212
  Gene Ontology: Mol. function=unspecific monooxygenase activity
  Homolog annotation: Hit_ID=O04892; Match level="QueryCoverage=81%, HitCoverage=17%, E-value=4e-28, Identity=79%"; Hit description =Cytochrome P450 like_TBP
  Subcellular localization annotation: CTP_CleavageSite=58; ConfidenceScore=5.08e-01
MVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 181991 - protein, 266 aa, Glycine max
  Coding DNA Sequence Number=SeqID_65213
MASKKRKSIGARPTAQYDTRRFHSLDAWNRYIDNVLGRSILPERKLEIYQTEFDDFKTELERHNLHKRLTNLADGTIGVALQARVRGHLVKIDADNLNTFLETPVVLEEGETLPTYSRYCRLPSDHREIEVALCIAGIRFILNAEGHPGRILRKDVTTLAQVWTVLYYSNLAPTSHTSDLTVDRARLIFGLVSHMDMNIGALISGQMTSIAQSNSCRLGFPTLITTLCRARGVVSDNLTFECLSPAINLTYIRKNCWNVDDLTVAF

SEQ ID NO: 181992 - protein, 89 aa, Glycine max
  Coding DNA Sequence Number=SeqID_65214
MALEWWSQMKHPIPVGVLGLWDLHLPYQEKLGPQARLPSLRTTLLIGWILEELPSVGFAAIESIPDGYFEVWLQSAKSQHKLELKELQK

SEQ ID NO: 181993 - protein, 138 aa, Glycine max
  Coding DNA Sequence Number=SeqID_65215
MERKIITMIVDTLPVFYYEKMVGYMPSSFVDLVFAGERIEVGLRRGKFDYVASTSAGNKKTSTGGAKKKEGDAHAITATPTWTKSQQTPHNPTYQYPPPQYNYSTNIGSPPIPMPIQQRMPTQPQRPPPQNPFLAQPR

SEQ ID NO: 181994 - protein, 230 aa, Glycine max
  Coding DNA Sequence Number=SeqID_65216
  Gene Ontology: Mol. function=siderophore-iron transporter activity; Cellular component=outer membrane; Biological process=siderophore transport
  Homolog annotation: Hit_ID=Q8ZQ10; Match level="QueryCoverage=98%, HitCoverage=31%, E-value=2e-76, Identity=56%"; Hit description=Outer membrane receptor for Fe(III)-coprogen
EAGYGSWNRQRYVADLSAPLSPEGNVRGRLVAGYEDKNSFIERYGADKKFIYGVVDADVTDATRLSVGYEFSQVNTDSPMWGGAPRWYTDGTQIHSRRGYNTAPEWAYNNKENKKVFVNLQQNFDNGWNITLNGTHNEMFLDSKQLYLDGYFDKTTGAGVSGYAGYPVVGGTGYNTGKRKVDAVDAFASGPYELLGRQHELMVGVNYSRQDNKYYSAWANISSAELGNFN

SEQ ID NO: 181995 - protein, 193 aa, Glycine max
  Coding DNA Sequence Number=SeqID_65217
  Gene Ontology: Mol. function=transcription factor activity; Cellular component=intracellular; Biological process=regulation of transcription, DNA-dependent
  Homolog annotation: Hit_ID=Q92FS3; Match level="QueryCoverage=89%, HitCoverage=49%, E-value=3e-25, Identity=35%"; Hit description =Transcriptional regulator LacI family
MAVVVVGQPHPAGRWPCVMRDQQHCVGLAVNHLLARGLRDIAFIGGSRKVWVTRERVSHFHATLQQAGITPRDSWICLNNFYPEHGYQAIDTLWQQAEQPQALVAINDRVAMGAIRALRDRGIDVPEQVAVISCERFPGSEYFIPRLTSVDHQNPQLGQNIITMMMAQLDGSLSPHARCSTPLKPVLIPGESA

SEQ ID NO: 181996 - protein, 106 aa, Glycine max
  Coding DNA Sequence Number=SeqID_65218
FKFRSQLRQSSVLDVSEELHHIQSLIVTLGLKEQLSKGKGITVEPESSPPIFVPTPSLSQSSDYDPGNSTCLTPTKRISCQQTSSDFDSDEHAQYQLSTNKHIKAE

SEQ ID NO: 181997 - protein, 80 aa, Glycine max
  Coding DNA Sequence Number=SeqID_65219
MAGDASKFLHTSPKNSEHVTYGDNNKGQEMVLMMSKRIHLIMIVIIKKVENVNVKHCFKINSRSSKQDQEKDKASNKLTG

SEQ ID NO: 181998 - protein, 61 aa, Glycine max
  Coding DNA Sequence Number=SeqID_65220
KYDLLIDVGNALACACCVCSWGALFTDLPGSLALAFSHVHTLDVVYDRGGHCALTFQGLWH

SEQ ID NO: 181999 - protein, 87 aa, Glycine max
  Coding DNA Sequence Number=SeqID_65221
MLRNQTSLLLAKRNSPLSESIEKLLKIKHTPSKGLKSARKRAAFSGKRDELAKRACCTKRVHQYSLYVSISLKITLSVLIALSEFIF

SEQ ID NO: 182000 - protein, 158 aa, Glycine max
  Coding DNA Sequence Number=SeqID_65222
MASRKRKSIGTRPTSQYDTRRFSSLDAWTRYVDNVLGRNILPKRKVELYHTELDDFKVELETHNFHKRLTNLADGSIDLALVKEFYANLFNSKDRPPKQSRVRGHLVKIDVDSLNAFLETPVVLAEGEHRSADFWPILSLGCEHRSADFWPDDFYSPV

SEQ ID NO: 182001 - protein, 250 aa, Glycine max
  Coding DNA Sequence Number=SeqID_65223
  Homolog annotation: Hit_ID=Q47522; Match level="QueryCoverage=19%, HitCoverage=59%, E-value=1e-21, Identity=97%"; Hit description=LacZ protein
  Pfam annotation: Domain name=Abhydrolase_3; Domain location=111-248; Score=-74.4; E_value=0.0072; Accession=PF07859.3; Description =alphabeta hydrolase fold
YDGVFEVLQWLLFLSAVPPVQLLTGWCVTAKAPPDISAGKCSGRVPFAIQAAQLLGRAIGAGLFAITPAGERGMCCKAIKLGNARVFPVTTLNSMVLIQRPKGLPNPAPVLVWAHGGAFVHGSPRTVLSRTASIAQRAGVCVVSVDYRLLPEHNYPENLHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 182002 - protein, 74 aa, Glycine max
  Coding DNA Sequence Number=SeqID_65224
MQSSKRDVYLGAYLNGEHWQMVAIVPKEHRVVWFSSLHIRLDSYLKEIINSALKGLDDAPQPKSKVPARWIIVK

SEQ ID NO: 182003 - protein, 70 aa, Glycine max
  Coding DNA Sequence Number=SeqID_65225
  Homolog annotation: Hit_ID=Q53VM3; Match level="QueryCoverage=59%, HitCoverage=9%, E-value=2e-14, Identity=92%"; Hit description =Ser/Thr protein kinase
MHAKGVAETLKLKWPICTIGEGTFAKVKFARNSETGEPVALKILDKEKVLKHKMAEQVEYLSNLGSYSAP

SEQ ID NO: 182004 - protein, 130 aa, Glycine max
  Coding DNA Sequence Number=SeqID_65226
  Gene Ontology: Mol. function=transferase activity, transferring glycosyl groups; Biological process=metabolic process
  Homolog annotation: Hit_ID=Q66PF2; Match level="QueryCoverage=98%, HitCoverage=27%, E-value=6e-41, Identity=60%"; Hit description =Putative UDP-rhamnose:rhamnosyltransferase
MAEHHKKLHIVVFPWLAFGHMGLYFELAKVISQKGHKISFISTPRNIHRLPKVPKNLQPFVYLIELPLPHVDQLPENVEATVDIPQHIVPYLKKAYDGLQEPLTKFLERCKPDWIIFDFAPYGCHQYLLS

SEQ ID NO: 182005 - protein, 195 aa, Glycine max
  Coding DNA Sequence Number=SeqID_65227
  Homolog annotation: Hit_ID=Q6ZQQ8; Match level="QueryCoverage=98%, HitCoverage=36%, E-value=2e-09, Identity=27%"; Hit description=CDNA FLJ46160 fis, clone TESTI4002141
MVIRTRFRHPETIESDGTQRQIMVILHLLSSRGGELDDMWRQIMVIRTRFWHPETIESDGTQRQIMVILHLLSSRGGEPDDMRRQIMVIRTPFRHPETIESDGTQRQIMVILHLLSSRGGEPDDMWRQIMAIRTPFRHPETIESDGTQRQIMVILHTFSSSRGGESGGTQKLMMVILHFLSSRGGEPDDMWRQIM

SEQ ID NO: 182006 - protein, 81 aa, Glycine max
  Coding DNA Sequence Number=SeqID_65228
  Gene Ontology: Mol. function=endonuclease activity; Biological process=DNA catabolic process
  Homolog annotation: Hit_ID=Q8LA68; Match level="QueryCoverage=45%, HitCoverage=12%, E-value=1e-09, Identity=78%"; Hit description =Endonuclease, putative
MYQFGNIVHTTTQPVQIDSQGPSCFAYSNATPGSTLEDEYFLSQLPIVEKRLAQGSVRLAAIKHHNYCSSLNTHLKGIVPW

SEQ ID NO: 182007 - protein, 1118 aa, Glycine max
  Coding DNA Sequence Number=SeqID_65229
  Homolog annotation: Hit_ID=Q7G2F7; Match level="QueryCoverage=99%, HitCoverage=84%, E-value=0.0, Identity=60%"; Hit description =Expressed protein
SPRDSVQFIEWSPSSCPRALLIANFHGRVTIWTQPPQGPANLVHDTSCWQREHEWRQDIAVVTKWLSGVSPWPPTQNGTTPKWFCTSKGLLGCGPSGIMAGDAIITDSGAMHVAGVPIVNPSTIVVWEVAPGPGNGFQVTPKTSTTCGVPPLSPPNWDGFAALAAYLFSWQDYLLSEAKQGRKQTDQNLVDAVPLYCSPVSNFSAYVSPEAAAQSAATTTWGSGVTAVAFDPTRAGSVIAVVIVEGQYMSPYDPDEGPSITGWRVQRWESSLQHVVLHPIFGNPTSSMGGQPPMQTVWQSKVDLSIPPTNDFKNHQSPAIGMSSDVQKVSESVSDKSKRVNFDPFDLPSDVRALARVVYSAHGGEIAIAFLRGGVHVFSGPNFTPVDNYQINVGSAIAAPAFSSTSCCSASVWHDSSKNCTILRIIRVLPPSIPISQAKANSSTWERAIAESVDWWDAVGCTQSAAEDGIVSLNSVIAVLDADFHSLPSVQHRQQYGPSLDRIKCRLLEGSNAQEVRAMVLDMQARLLLDMLGKGIESALINSSALVPELWQASGETLSSIDPESMAVEPALIPSIQREHIQHRLCDARKCYAVGKARALPENALPGGDGEIDGVEDKEEQNGVAYVDSVLDLASHFITRLRRYASFCRTLASHAVTAGSGSNRNMVASPTQSSATPATSQGGQNGTSSSMGSAQLQTWVQGAIAKISNTTDGGSNPTPNPISGPSTFMPISINTGTFPGTPAVRLIGDCHFLHRLCQLLLFCFFFRRTQLPRYINRTSDTNIQKPQSNTPAPGKVEEIAKPVSAVVKSDDGQTGRTGAKGAEEVPSGRSRLGSGNAGQGYTFEEVKVLFMMLMDLCRRTAGLQHPLPVSQVGSNNIQVRLHYIDGNYSVQPEVVEASLGPHMQNMPRPRGADAAGLLLRELELHPPAEEWHRRNMFGAPWSDPEDVDCANDTPKLVNSDPLDFSSLEHCDVYYGTHRLWPRKRRMSERDAAFGLNTSVGLGGYLGIMGSRRDVVTATWKTGLEGVWYKEVATLIIILGNGLHQVYLESINKDDNDMQKNRSNNICDLATDGSIDDVSGRLQHLLHQMLLLLLVRMTGKCGGSAAGYIAAQCVVEHGL

SEQ ID NO: 182008 - protein, 115 aa, Glycine max
  Coding DNA Sequence Number=SeqID_65230
  Gene Ontology: Mol. function=metal ion binding; Cellular component =integral to membrane
  Homolog annotation: Hit_ID=Q8L8R1; Match level="QueryCoverage=68%, HitCoverage=32%, E-value=2e-23, Identity=58%"; Hit description=RNA -binding protein-like protein
MDRLSSCWSPWTVKNPNLQAVIYPSLLQLEKGVTDTEDKKQKVVCMERYRRRDDEEYRQSSDIDIEREDECGICMDMNSKIVLPNCNHAMCLKCYREWCACSIGTMHMKAGVCKA

SEQ ID NO: 182009 - protein, 211 aa, Glycine max
  Coding DNA Sequence Number=SeqID_65231
  Gene Ontology: Mol. function=mismatched DNA binding; Cellular component=cytoplasm; Biological process=maintenance of fidelity during DNA-dependent DNA replication
  Homolog annotation: Hit_ID=Q10ZB7; Match level="QueryCoverage=63%, HitCoverage=15%, E-value=2e-17, Identity=35%"; Hit description=MutS2 family protein
MEFSLETLQPTYRILWGCTGDSNALSIAGSIGFDRNIIDRAQKWVEKFQSEQQQERRGMLYRSLQEERNRLKAQVEKAASIHAEIMSVHNEIQGEAEDLDQREMELMAKETQQVQHELEHAKSQMETVIQKFEKRLRISAHTPADSFPSMKLIVLRILHKLESKSIIAPGDDGTIMVQYGKVLVKVRVKKSNIIAIPSSRKNAVTSSSSTH

SEQ ID NO: 182010 - protein, 639 aa, Glycine max
  Coding DNA Sequence Number=SeqID_65232
  Gene Ontology: Mol. function=RNA polymerase II transcription factor activity; Cellular component=nucleus; Biological process=regulation of transcription, DNA-dependent
  Homolog annotation: Hit_ID=Q680U9; Match level="QueryCoverage=85%, HitCoverage=99%, E-value=1e-166, Identity=67%"; Hit description=MRNA, complete cds, clone: RAFL22-33-O09
  Pfam annotation: Domain name=Tfb2; Domain location=183-554; Score =150.1; E_value=6e-42; Accession=PF03849.5; Description=Transcription factor Tfb2
  Subcellular localization annotation: CTP_CleavageSite=46; ConfidenceScore=5.16e-01
MSLPNAYDRFSNSLKVVTHLFSSHLISCLHHPSPTSRDPFKSKTVRIITAARDPFRTTITETFELFLKTPLIRIRIKDKEKGGGGGVGITMPEVRIIAKNFMDMVASMPAMKLDKLYENGFICEAILSSELSNPKGWCNGIRLHCVYMSEKDPFSGRTRVRFPSRVKFPWPAAAIHSGWGISLDLGPKKSSEISGVEKWSLLPLAKKYVIQMLHIDVSVAAKLLEEWVLPGGVSKHRVAIDRLVQLRVFLEAVDRKNEKTYKVNPTFQRSLQKLLVQGGTLPRESMPSNITVRLPTLENLEAYALEQWECFLLQLISPSQVEKPLNISSSLMKVFQRRILSYRDKEAPKLTESGFQFLLMDTNAQLWYIIREYISNSECSSSSNLMQDRGVDAADLISFMLELSFHDIGEAYSVDTLTSFQRTIINDLADLGLVKIQQGRKGSWFIPTKLATNLSMSLADSSSRKQGFVVVETNFRVYAYSTSKLHCEILRLFSRVEYQLPNLIVGAITKESLYSAFENGITAEQIDGNDLFLAMLLLGIRGLIITFLQQNAHPRVAERIPSVPENVTEQIRLWEADLNRVEMTDAYYYDEFPSRDVFEGACDCAREWNGLLWEDSKKMHMVVKTEVHQYVRDYLRRQK

SEQ ID NO: 182011 - protein, 160 aa, Glycine max
  Coding DNA Sequence Number=SeqID_65233
  Gene Ontology: Mol. function=translation elongation factor activity
  Homolog annotation: Hit_ID=Q2HUF4; Match level="QueryCoverage=96%, HitCoverage=85%, E-value=7e-24, Identity=43%"; Hit description =Rubber elongation factor
  Pfam annotation: Domain name=REF; Domain location=2-159; Score=24.8; E_value=6.5e-12; Accession=PF05755.3; Description=Rubber elongation factor protein (REF)
MVQVTTLKFLMRGAATAAACTKERSGVRAVEEAAKSAIGPVYDKFHLVPDELVRIADRNSDSSVEHRPTPHPSCTAVSGIAGAVYAKCETVAKELYERYEAKAEQCTVAVRRRLFPQVSNASHWTEKYNEKVAAAVEKGRRVSALVATERISKMFSEKRS

SEQ ID NO: 182012 - protein, 576 aa, Glycine max
  Coding DNA Sequence Number=SeqID_65234
  Gene Ontology: Mol. function=galactinol-raffinose galactosyltransferas e activity; Cellular component=cytoplasm; Biological process =oligosaccharide biosynthetic process
  Homolog annotation: Hit_ID=Q9SBZ0; Match level="QueryCoverage=99%, HitCoverage=66%, E-value=0.0, Identity=87%"; Hit description =Galactinol-raffinose galactosyltransferase
  Pfam annotation: Domain name=Raffinose_syn; Domain location=1-560; Score=999.5; E_value=1.2e-297; Accession=PF05691.3; Description =Raffinose synthase or seed imbibition protein Sip1
MTARLHRFEECDKFGSYQKGLLLGPNAPSFNPKTVKELIAKGIEVERLGKLRDEAVSSGVSDLSLTEIESRIVKVKKEIDDLFGGEGKENKELCGGCCCKANECGGIKAFIRDLRTEFKGLDDVYVWHALCGSWGGVRPGATHLNSKITPCKLSPGLDGTMQDLAVVKIVEGSIGLVHPDQANDLYDSMHSYLAQSGVTGVKIDVFHSLEYVCEEYGGRVELAKAYYDGLTNSIVKNFNGSGIIASMQQCNDFFFLGTKQIPMGRVGDDFWFQDPNGDPMGVFWLQGVHMIHCAYNSLWMGQMIQPDWDMFQSDHVCAKFHAGSRAICGGPVYVSDSVGSHDFDLIKMLVFPDGTVPKCIHFALPTRDCLFKNPLFDQKTVLKIWNFNKYGGVIGAFNCQGAGWDPKMKKIKGFSECYRPISCTVHVTEVEWDQKKEAVHMGKAEEYVVYLNQAEELHFMTPKSEPLQFTIQPSTFEIYNFVPVEKLGGSIKFAPIGLTNMFNSGGTIQELECVEKGAKVKVKGDGRFLAYSSESPKKFQLNGSDVAFEWLPDGKLTLNLAWIEENGGVSDLAIFF

SEQ ID NO: 182013 - protein, 564 aa, Glycine max
  Coding DNA Sequence Number=SeqID_65235
  Pfam annotation: Domain name=ubiquitin; Domain location=12-82; Score =51.1; E_value=3.8e-12; Accession=PF00240.13; Description=Ubiquitin family
  Pfam annotation: Domain name=ubiquitin; Domain location=195-267; Score=7.1; E_value=0.05; Accession=PF00240.13; Description=Ubiquitin family
  Pfam annotation: Domain name=ubiquitin; Domain location=306-379; Score=10.5; E_value=0.023; Accession=PF00240.13; Description =Ubiquitin family
  Pfam module annotation: Pfam domain module=ubiquitin::ubiquitin::ubiqu itin; Domain location=12-82::195-267::306-379
MEVILEILGGNSFFIDVGPSFFIEVGPLDTVLDVKEKVQTLHNIPISYQTFLFNGEVLQDDLQVSTSGIDRGSRIGLLVAPPDDANLAPPQPTLRPPWHTRPFGMPEFPPSLHLNIIPHVYDPFGYGMPNIPEFSSLTELRPMPQMPQQLPSSSTEDMLVPSNSNEFEEPLPDMMEASPPSETAGRVTLNVKVHEIQDRIPIEMEFEDTVLKVKEKIVAREDMRGVPLGRIALQSYSAGVELLDHQVLQDCCAILENNEIDVFLKPTLEVAGGSSRNEFEEPLPEMTAASLPSETAVRVTLYVKMPDIQGRIPVEMEFEDTILKVKEKIVAREDMRGVPVDRIALHSHSEGVELLDHQVLQDCCAVLENNEIDAFSKTCPEKRMVNVKLPMSQNRIRIEVEVNDTFQKLKEKIVALEEMQGVPVERILLYPCSPIPESVLNPIFYVYLKSSVPVAGRAGGGSSSASSGKMTVYLKPNGRPKCYPLQVNAVDNVSALGQQLGRLLRNSPHRLPHDEAFFMVHRGEWMNEQESFEWHGVRNGTKIATFVGRLNDSVTPILRPKSPS

SEQ ID NO: 182014 - protein, 71 aa, Glycine max
  Coding DNA Sequence Number=SeqID_65236
MVVIVLSFQNNVVVKGQHGEPKKGQQKHEVHWFDIREKCTNFGACVRNEQRELYCPCERGGDLILKFKTFY

SEQ ID NO: 182015 - protein, 284 aa, Glycine max
  Coding DNA Sequence Number=SeqID_65237
  Gene Ontology: Mol. function=galactinol-raffinose galactosyltransferas e activity; Cellular component=cytoplasm; Biological process =oligosaccharide biosynthetic process
  Homolog annotation: Hit_ID=Q9SBZ0; Match level="QueryCoverage=99%, HitCoverage=33%, E-value=1e-142, Identity=84%"; Hit description =Galactinol-raffinose galactosyltransferase
  Pfam annotation: Domain name=Raffinose_syn; Domain location=21-284; Score=-107.1; E_value=5.3e-17; Accession=PF05691.3; Description =Raffinose synthase or seed imbibition protein Sip1
  Subcellular localization annotation: CTP_CleavageSite=44; ConfidenceScore=5.15e-01
MAPPNNPVNSTLGFKSLEKVFDLCDGKFTVRGVPLLSQVPNNVTFSSFSSICEPRDAPPSILQRVIAVSHKGGFFGFSQVSPSDRLTNSLGSFSGRNFLSIFRFKTWWSTQWVGNSGSDLQMETQWVLIEIPEIKSYVVIIPIIEKSFRSALHPGSDGHVMICAESGSTQVKASSFGAIAYVHVSENPYNVMKEAYSVLRVHLDSFRLLEEKTVPKIADKFGWCTWDAFYLTVNPVGVWHGLKDFAEGGVAPRFVIIDDGWQSVNFDGDDPNVDAKNLVVGRDR

SEQ ID NO: 182016 - protein, 97 aa, Glycine max
  Coding DNA Sequence Number=SeqID_65238
MSPTQSRDPPRILLVQQYDTFVEPDVYQQLMATAAPDKADIDVHHLRHAVDGHVAIANKLERQLNLRIMTEGTEAYTIVEECLSIARSYISQSIVGH

SEQ ID NO: 182017 - protein, 82 aa, Glycine max
  Coding DNA Sequence Number=SeqID_65239
  Homolog annotation: Hit_ID=Q2R4C3; Match level="QueryCoverage=61%, HitCoverage=8%, E-value=6e-16, Identity=66%"; Hit description=Gpi16 subunit, GPI transamidase component family protein, expressed
MSWKEIICGSNILYITIIIHNKNISLLPTIKFVQKYHIKAMKLSFTQGRWNYERWGGFDSISCNNAKPPGVELWAVFDVPLH

SEQ ID NO: 182018 - protein, 169 aa, Glycine max
  Coding DNA Sequence Number=SeqID_65240
GGGGGSGSTGVGGDVGGSIGGGGSVGGGVGGGASVGGGVGGAGGAGIGTGRGVGAGGGAGIGGGAGGSVGVGGGGGGGTRIGGCGGGGGGGAGVGVGGGGNVSAGGSGGVGAEGGGGIGGCGGASGGGGVSVGGGVGGVGGARIGGSGGTGIGSSAGGVGARGSVGVGG

SEQ ID NO: 182019 - protein, 115 aa, Glycine max
  Coding DNA Sequence Number=SeqID_65241
  Gene Ontology: Mol. function=sequence-specific DNA binding; Cellular component=nucleus; Biological process=regulation of transcription, DNA-dependent
  Homolog annotation: Hit_ID=Q9T0D3; Match level="QueryCoverage=69%, HitCoverage=20%, E-value=4e-19, Identity=54%"; Hit description=Heat shock factor protein 7
  Pfam annotation: Domain name=HSF_DNA-bind; Domain location=35-113; Score=-72.2; E_value=0.00072; Accession=PF00447.8; Description=HSF -type DNA-binding
MADNYNVLELNIGLGNNNNSKVGGHAGQSPRQRCPAPFLLKTYELLEELSENEKDSTKIVSWNAEGTGFVVWSPAEFSELTLPRYFKHNNFSSFIRQLNTYFFFYLQIPLYILQN

SEQ ID NO: 182020 - protein, 409 aa, Glycine max
  Coding DNA Sequence Number=SeqID_65242
  Gene Ontology: Mol. function=transferase activity, transferring glycosyl groups; Cellular component=glycosylphosphatidylinositol-N -acetylglucosaminyltransferase (GPI-GnT) complex; Biological process =biosynthetic process
  Homolog annotation: Hit_ID=Q9M1U9; Match level="QueryCoverage=95%, HitCoverage=88%, E-value=1e-172, Identity=75%"; Hit description=N -acetylglucosaminyl-phosphatidylinositol-like protein
  Pfam annotation: Domain name=Glycos_transf_1; Domain location=157 -321; Score=98.8; E_value=1.6e-26; Accession=PF00534.10; Description =Glycosyl transferases group 1
  Pfam annotation: Domain name=PIGA; Domain location=13-102; Score =217.9; E_value=2.4e-62; Accession=PF08288.2; Description=PIGA (GPI anchor biosynthesis)
  Pfam module annotation: Pfam domain module=Glycos_transf_1::PIGA; Domain location=157-321::13-102
MRGKEANVVVVTHAYGNRSGVRYMTGSLKVYYVPWRPFCNQSTFPTLYGILPIIRTILIRERITVVHGHQTFSTLCHDALLHARIMGYKVVFTDHSLHGFGDVGSIHMNKVMQFTLADVSQAICVSHTSKENTVLRSGLAPEKVFVIPNAVDTAMFKPALERPGGLEIVVVVISRLVYRKGADLLVEVIPEVCRLHPNVRFIIGGDGPKRVRLEEMREKHSLFDRVELLGAVPHAQVRSVLISGHIFLTCSLTEAFCMAILEAASCGLLTVSTRVGGVPEVLPDDMIVLAEPDPGDIVQAIQKAIYMLPEIDPQVMHNRMRELYNWRDVAKRTEIVYDRASKCPNQSLLESLSRYLSCGAWAGKLFSLVMILGFLFWHLLELWQPADDIEEVPDVIFSHNCDEEMLQKS

SEQ ID NO: 182021 - protein, 774 aa, Glycine max
  Coding DNA Sequence Number=SeqID_65243
  Gene Ontology: Mol. function=double-stranded RNA binding; Cellular component=intracellular
  Homolog annotation: Hit_ID=Q5YDB6; Match level="QueryCoverage=94%, HitCoverage=76%, E-value=0.0, Identity=64%"; Hit description=C -terminal domain phosphatase-like 1
  Pfam annotation: Domain name=dsrm; Domain location=706-769; Score =47.4; E_value=4.7e-11; Accession=PF00035.15; Description=Double -stranded RNA binding motif
MYKSVVYQGEVVVGEVDVYPEENNNNNNKNYNKNFHVKEIRISHFSQPSERCPPLAVLHTVTSCGVCFKMESKTQQQDGLFQLHSLCIRENKTAVMPLGGEEIHLVAMHSRNDDRPCFWGFIVTLGLYDSCLVMLNLRCLGIVFDLDETLIVANTMRSFEDRIDALQRKINSEVDPQRISGMQAEVKRYLDDKNILKQYAENDQVVDNGRVIKVQSEIVPALSDSHQPIVRPLIRLQDKNIILTRINPQIRDTSVLVRLRPAWEDLRSYLTARGRKRFEVYVCTMAERDYALEMWRLLDPDSNLINSKELLGRIVCVKSGLKKSLFNVFQDGSCDPKMALVIDDRLKVWDERDQPRVHVVPAFAPYYAPQAEASNTIPVLCVARNVACNVRGGFFKDFDDGLLQKIPQIAYEDDIKDVPSPPDVSNYLVSEDDGSISNGNRDPFLFDGMADAEVERKLKDALAAASTFPVTTANLDPRLTSLQYTMVPSGSVPPPTAQASMMPFPHVQFPQPATLVKPMGQAAPSDPSLHSSPAREEGEVPESELDPDTRRRLLILQHGQDTRDHASAEPPFPVRHPVQASAPRVPSSRGVWFPVEEEIGSQPLNRVVPKEFPVDSGPLGIEKPRLHHPSFFNKVESSISSDRILHDSHQRLPKEMYHRDDRPRLNHMLSSYRSFSGDDIPFSRSSSSHRDLDSESGHSVLHADTPVAVLHEIALKCGTKVDFMSSLVASTELKFSLEAWFSGKKIGHGFGRTRKEAQNKAAKDSIEHLAGRIF

SEQ ID NO: 182022 - protein, 96 aa, Glycine max
  Coding DNA Sequence Number=SeqID_65244
MAVFRWANGDRISAIKNYKPVGIQTTDTALLGRTKMRVCYNIFDQYGNPTSMRNSYWYKKWELVEHSWDIELMRASAALFEGILALNAYLKIPDGA

SEQ ID NO: 182023 - protein, 352 aa, Glycine max
  Coding DNA Sequence Number=SeqID_65245
  Gene Ontology: Mol. function=transferase activity
  Homolog annotation: Hit_ID=Q1S9Q3; Match level="QueryCoverage=99%, HitCoverage=73%, E-value=2e-94, Identity=52%"; Hit description =Ankyrin
MEFNIESLELILPGIKELYEQKKTHHLVLKILKCLCERISDYKESQLQEASAYDAMLQAATLGITEYIDAMRKANPDLLWAIDKNKRGIFSHAILNRRKDVFRLINRVNGRKEIIKCRADAFGNNLLHLAAYLGPSSDLDRRSGAALQLQRELQWFKAVENIVHPKCKEEKNSDGKKPREIFSESHEEMVKAGEKWAKDTASSFTLVGTLITTIMFAAAFTVPGGNNQDTGVPVFLHDQIFTLFIITDTLSLFTSSTSVLIFIGILTSRYAEKDFLKTLPLKLLCGLVTLFLSVVAMMIAFCASLAMMLKGSQRLIIAAMSLGSIPVIVLVPSQLRLFLEIFNSTIYARYIK

SEQ ID NO: 182024 - protein, 408 aa, Glycine max
  Coding DNA Sequence Number=SeqID_65246
  Homolog annotation: Hit_ID=Q1S9Q0; Match level="QueryCoverage=67%, HitCoverage=91%, E-value=4e-43, Identity=39%"; Hit description =Ankyrin
  Pfam annotation: Domain name=Ank; Domain location=177-209; Score =23.4; E_value=0.0008; Accession=PF00023.20; Description=Ankyrin repeat
  Pfam annotation: Domain name=Ank; Domain location=212-247; Score=2.2; E_value=15; Accession=PF00023.20; Description=Ankyrin repeat
  Pfam module annotation: Pfam domain module=Ank::Ank; Domain location =177-209::212-247
MGEIIPTASRRKALYTVPCKVNGYFLPVQIVEAVEMAATNLAARGIVLESLTRDNYDNWSALVKNYLMGEEISAKPKTDCENWKRENAKALHIIQLACGSEILNQIRHVETAKEAWNRLGALYSSQLKGDPDIEQGFVDDTLHEYKQLHRYVESGDWKNAKSIIYTDDTAIFSTSSTGRTVLHIAVIAGYENIVRELVKKGKEKLVKMQDNCDYTALALAAELTGNHKIAKCMVDPKKGGKDLLTMKTKDAEIPVLLSAAKGHKDMTRYLYSQTSLDQFRNKNSHNGLLLLTRCITAEIFDVALNLIHRIPQLPLIHESDDLRPLYALARMPSAFPSGCGFGRLQQLIYNILILEKQEQQKLCRIVPDIAQVECHAQAEASYVDLEELEKGQHNSNASFAGYFEILQS

SEQ ID NO: 182025 - protein, 186 aa, Glycine max
  Coding DNA Sequence Number=SeqID_65247
MECKWIIEEGTIWQIGNEQTAKIWQHKWVSNVRDNCIHGDILNEVDPNALQKSLQSRRHNGTIKSSKKFSNIRFTRPGIRMIQISSVSANAAIISGTTTLYTIPPRSATNTQCAPPPLPSPFTNSPAQIKPISLVREPHHLVPAGIWRPRSGAAVERDPMAFLETGNIKPLTLGDRRMPRVHQLNA

SEQ ID NO: 182026 - protein, 100 aa, Glycine max
  Coding DNA Sequence Number=SeqID_65248
  Homolog annotation: Hit_ID=Q1S9Q3; Match level="QueryCoverage=82%, HitCoverage=17%, E-value=4e-18, Identity=53%"; Hit description =Ankyrin
MPHRNNPAPLPLVVTLNCVEDCSLEFESLAGVATAVEEVVDPKCKEARNDDDKKPHELFTERHKELVKAGEKWAKETANSFTLVGTLITTIMFAAVFTVP

SEQ ID NO: 182027 - protein, 561 aa, Glycine max
  Coding DNA Sequence Number=SeqID_65249
  Gene Ontology: Mol. function=heat shock protein binding; Cellular component=integral to membrane; Biological process=protein folding
  Homolog annotation: Hit_ID=O82287; Match level="QueryCoverage=99%, HitCoverage=98%, E-value=1e-97, Identity=38%"; Hit description =Putative DnaJ protein
  Pfam annotation: Domain name=DnaJ; Domain location=59-120; Score =92.9; E_value=9.9e-25; Accession=PF00226.21; Description=DnaJ domain
MAEAESEALRLKAMAESKFKASNNAKSALKYANRAHRLCPHLAGVPETVAALSVLAAPDWYRALGAEPFASSSVIRRQYKKLALLLHPDKNPHVASEEAFKLLGEAFRFLSDRNRRREYDAELRRKIEAAESESETFWTACSTCRLLHQFERRYLGQELVCPSCEKGFRAVEAVQSDDDGDVRVRSRRLKLKEMEKREIGVEGKVGNAKEGRLGKRMCSVGEVLERAKPSNSKRVKKNGEEMMTLAEFQSQVKRKLQGEKLKAKGNEKEKEKEDGIEKRRNRAERRQGLRNNGGLEVGEVRGLKKSVKPAIEEKRKGLRIEKHRGGSSGGDLEDMAVLDSDFYDFDKDRVEKSFKKGQVWAVYEDEDGMPRNYALIDETVSVNPFGVRISWLDVQNSGDGRIVSREKIGFHIPCGRFKATRKASVNSVNIFSHVVDCDRAARELYKIYPKKGSVWALYGEGSIDVDEGKGCYDIVVFLTSYNEVNGLSMAHLEKVDGYKTVFKRQEKGSGAIRFLGKDDMWLVSHQIPARKLLCDETPELLKDCWELDPASLPSDLLTIGG

SEQ ID NO: 182028 - protein, 391 aa, Glycine max
  Coding DNA Sequence Number=SeqID_65250
  Gene Ontology: Mol. function=protein dimerization activity; Cellular component=nucleus; Biological process=regulation of transcription, DNA-dependent
  Homolog annotation: Hit_ID=Q0GPJ3; Match level="QueryCoverage=62%, HitCoverage=68%, E-value=4e-56, Identity=96%"; Hit description=BZIP transcription factor bZIP86
  Pfam annotation: Domain name=MFMR; Domain location=88-370; Score =271.6; E_value=1.5e-78; Accession=PF07777.2; Description=G-box binding protein MFMR
MGISQTVQNGKENLTGQRHRTTIHGSGFVFASAPALEDPQFLSEWFGDNIGQHQKLDFGMIGREQGAMYWLVPVGWFNVYFEDTDISMGSSEMDKTPKEKESKTPPPPPTSQEQSSTTSTGTINPEWPGFQAYSPIPPHGFLASNPQAHPYMWGVQARDGAVRHTMTKVGGWLNKARPDLKTGDHRSSNHGSSKNGFMAVLHQWLVSSQLQNIGGPAAIDNHEYDCTRERLLQLQKHMPELMVVAYQLYSGNGTGDAGLQFMPPYGTPPHPYVAMYPPGGIYAHPSMPPGSYPFSPFAMPSPNGIAEASGNTPGSMEADGKPPEVKEKLPIKRSKGSLGSLNMITGKNNEHGKTPGTSANGIHSKRALHNPPPLLRLETDYETFGGVGERG

SEQ ID NO: 182029 - protein, 137 aa, Glycine max
  Coding DNA Sequence Number=SeqID_65251
MVLCFEVASWKVVGAESYMVLASLLDSGLSGAFDRIGGRCKIMFMWKGYFLNNKRNPPRWVVRIESVEGYNSNSHLVNSMWNVTNNLHLSRKERCGAGQRRDNWKRNKSQVLTLHLTAAIGIQQLPRLLEVGNYELL

SEQ ID NO: 182030 - protein, 53 aa, Glycine max
  Coding DNA Sequence Number=SeqID_65252
MVAAMMLFLLISTQMKSVEPDAADCLDGCSTACVQSDYFNPKLMIFFWQYKLF

SEQ ID NO: 182031 - protein, 1147 aa, Glycine max
  Coding DNA Sequence Number=SeqID_65253
  Gene Ontology: Mol. function=cellulose synthase (UDP-forming) activity; Cellular component=membrane; Biological process=cellulose biosynthetic process
  Homolog annotation: Hit_ID=Q8GUZ9; Match level="QueryCoverage=96%, HitCoverage=99%, E-value=0.0, Identity=72%"; Hit description =Cellulose synthase-like protein D4
  Pfam annotation: Domain name=Cellulose_synt; Domain location=276 -1147; Score=2056.4; E_value=0; Accession=PF03552.5; Description =Cellulose synthase
MLAEVEAAFKVAGPALILFLQCGVVHCIAMASKFKSVSSIRKITHLSGDMDQEDANGGRASLDNYSVHIPPTPDNQPMEISLERSNSRRVEDQYASSSLFTGGFNQLTRAHLKDKVTESESSHPQMAGAKGSSCAVPGCDGSLMTNERGLDVVPCECNYKICRDCYMDALRAGEGICPGCKDPYKEPEVQGGVANSQALPLPPPPGANKMDKSLSFLRSKNNEFDHAKWLFETKGSYGYGNAMWPNKEEEVDASSGSGSDWMGGDPNVFKEKQWRPLTRKLSISAAILSPYRLMILVRLVVLVFFLKWRVENPNEDAIWLWGMSVVCEIWFAFSWLLDQLPKLFPVNRVADLDVLKEKFETPNPTNPTGKSDLPGIDMFVSTADPEKEPPLVTANTILSILATDYPVEKLSCYVSDDGGALLTFEAMAEAAAFANMWVPFCRKHNIEPRNPESYFNLKRDPYKNKVRSDFVRDRRRVKREYDEFKVRINGLPDSIRRRSDAYNAREEMNAMKKWRENGNEEPMESLKIPKATWMADKEPSCWPGTWTTAAPEHSRGDHASIIQVMLQPPSDEPLTGKTSDSNALDFSEVDIRLPMLVYVSREKRPGYDHNKKAGAMNALVRASAIMSNGPFILNLDCDHYIYNSQALREGMCFMMDRGGDRLCYVQFPQRFEGIDPNDRYANHNTVFFDVNMRALDGIQGPVYVGTGCLFRRTALYGFDPPRIKEESGWFGRKNKKSSTVASVSEASAEEQSLRNGRIEDEEMTSALVPKKFGNSSLLVDSVRVAEFQGLPLADHSSIKYGRPPGALTLPRDPLDAATVAEAINVISCWYEDKTEWGLRVGWIYGSVTEDVVTGYRMHNRGWKSIYCVTKRDAFRGTAPINLTDRLHQVLRWATGSVEIFFSRNNALLASSRLKFLQRIAYLNVGIYPFTSIFLIVYCFVPALSLFTGQFIVQTLEVTFLVYLLGITLTLVILAALEIKWSGIELEEWWRNEQFWLIGGTSAHLAAVLQGLLKVMAGIEISFTLTSKSGGDDENDEFADLYVIKWTSLMIPPITIMMVNLIAIAVAVSRTIYSEDREWSSLLGGVFFSFWVLSHLYPFAKGLMGRRGRTPTIVFVWSGLISITISLLWVAIDPPSGSSLIGGSFQFP

SEQ ID NO: 182032 - protein, 371 aa, Glycine max
  Coding DNA Sequence Number=SeqID_65254
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-47, Identity=30%"; Hit description= UPI00006A17C9 related cluster
GLLVLAFRGLHVLTFRGLHFLAIRALHALTFRGLHVLTFRGLLALTFRGLHVLAIKGLHALTFRGLHVLAFRGLHALAFRGLHALTFRGLNVLAIKGLHTLTFRELHVLTFRGLRVLAIRGLQVLIFRGLHVLAFRGLHALTFRGLHLLAFRGLHVLAFIGLHVLTFRGLNILIFRGLHVLIFRGLHVLTFRGLHALTFRGLNVLAIRGLHTLTFRELHVLTLRGLRVLAIRGLQALTFRGLHVLAFRGLHVLTFRGLHLLTFRGLHALAFRGLHVLSFKGLNILIFRGLHVLIFRGLHVLTFRGLHALTFRRLHVLAFRGQHVLAFKGLHALTFRRLHILAIRGLHVLAFRGQHILAFRGMHALTFRGQH

SEQ ID NO: 182033 - protein, 69 aa, Glycine max
  Coding DNA Sequence Number=SeqID_65255
MALVTGPFLGRIALEAKRQSWQLSEIPCGNIFRKNDRSHPAQEVAAQIRTLLYKHGGCTGLSTKSGIEE

SEQ ID NO: 182034 - protein, 83 aa, Glycine max
  Coding DNA Sequence Number=SeqID_65256
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q93XQ3; Match level="QueryCoverage=98%, HitCoverage=5%, E-value=1e-29, Identity=84%"; Hit description =Putative beta-1,3-glucan synthase
MKLKKEKAEKYRKFIILYWSKLWTILTNIFTRGGALQAIDMNQDNYLEEALKMSNLLEEFNEDHGMRSPTILGVGEHIFTGRI

SEQ ID NO: 182035 - protein, 103 aa, Glycine max
  Coding DNA Sequence Number=SeqID_65257
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT14; Match level="QueryCoverage=99%, HitCoverage=11%, E-value=1e-37, Identity=67%"; Hit description =Glycosyl transferase, family 48
MLPEEWNIFLERLECKKDSDIWEKEENILQLHHWASLRGQTLCRTEIFDGYKAIAVPSEEEKKSHRSLYARLEAMADLKFTYVATGSNMGIRSALETVVQQIS

SEQ ID NO: 182036 - protein, 316 aa, Glycine max
  Coding DNA Sequence Number=SeqID_65258
  Pfam annotation: Domain name=DUF793; Domain location=1-315; Score =308.5; E_value=1.2e-89; Accession=PF05633.2; Description=Protein of unknown function (DUF793)
MSSTDNHCPSSQISSFVHSIYCLRLELVHSLEENQGSITQDSELEPFQKQVTDRFEDLSRVSDDELLSIDWMRKLMDAFICCHEEFRAILLNNKEQVLNSPMVQSISDFFERLRALSEGQVQRARKALMDLALAMLNENGCKSVFTQRNRSFGRHNTSKDHRHHLIAHTGSNSWTVFRSWSAAKQLHSIASNLVPPRGNEIVSTSGLAIPVYTMNSVLLFVLWTLVAAIPSQDRGLNIELSEINQVESCVRNMTDLVDSIQFPLTDEQKMEADQRLKELSLVCGALRHGLDPLELQVREVFRKIMTCRAEGLDYLG

SEQ ID NO: 182037 - protein, 363 aa, Glycine max
  Coding DNA Sequence Number=SeqID_65259
  Gene Ontology: Mol. function=catalytic activity; Cellular component =intracellular; Biological process=superoxide metabolic process
  Homolog annotation: Hit_ID=Q9SLU9; Match level="QueryCoverage=99%, HitCoverage=51%, E-value=1e-111, Identity=53%"; Hit description=ZW18 protein
  Pfam annotation: Domain name=DUF676; Domain location=121-283; Score =125.5; E_value=1.5e-34; Accession=PF05057.5; Description=Protein of unknown function (DUF676)
  Subcellular localization annotation: CTP_CleavageSite=47; ConfidenceScore=5.13e-01
MVYSKVDMPHQYMSNGVEGTSLYRSLRGRSSSTRRSNDDPVQTATMRAELHRRGIAQMRINNRSLQDMYIFGDPLRVPIIIVERLENMYRSASVKSYFLPLEDKARHILENGSRAIIQLPRNSPQQNEHGHHLDLRLIRNQWLLIDPKIQVLMSETNEDKTSGDFREMGSRLAQEVISFLKKKMDKASRVGNLKDMKLSFVGHSIGNLIIRAALAGLWLLKKIKGTQCIHQLTFTDDHDLENTFIYNLSKKKTLANFKNVILLSSPQDGYVPYHSARIELCPAATMDFSKQGKVFLEMLNNCLDQVRTHSEHRVVMRCDINFETSSYGRRSFNTLIGRAAHIEFLECDIFVKFIMWSFPELFS

SEQ ID NO: 182038 - protein, 99 aa, Glycine max
  Coding DNA Sequence Number=SeqID_65260
  Homolog annotation: Hit_ID=Q47522; Match level="QueryCoverage=47%, HitCoverage=58%, E-value=7e-22, Identity=100%"; Hit description=LacZ protein
MRKEKIPHQAPFAIQAAQLLGRAIGAGLFAITPAGERGMCCKAIKLGNARVFPVTTLNEHGSFIKAKTLWQPGGVPDLMGSTSRLLWIQQLHYHNMVID

SEQ ID NO: 182039 - protein, 500 aa, Glycine max
  Coding DNA Sequence Number=SeqID_65261
  Gene Ontology: Mol. function=transporter activity; Cellular component= integral to membrane; Biological process=transport
  Homolog annotation: Hit_ID=Q1SCJ5; Match level="QueryCoverage=95%, HitCoverage=97%, E-value=1e-171, Identity=60%"; Hit description =Major facilitator superfamily MFS_1
  Pfam annotation: Domain name=MFS_1; Domain location=159-467; Score =45.0; E_value=2.5e-10; Accession=PF07690.6; Description=Major Facilitator Superfamily
MTVAKYEASPKKHEEILANCLLFAGNVYRSGKDISVQRGGISISGVSVAKDPFPRWQHKMYLPLEERVSKQMQTSNNKGEHRSLVSQQSSQCNFKLKASGRSRCSFLCSAPYGTNNVGHGEVYRLGLSKRKHAQTEVGKTNKFRVCYKSEEYDISETKMDPLQSTEGTGEAILLEGRASPWWQQFPKRWVIVLLCFTAFLLCNMDRIIGGIWADKLGGKLVLGFGVVWWSIATVLTPIAAKLGLPCLLIMRAFMGIGEGVAMPAMNNILSKWIPVSERSRSLALVYSGMYLGSVTGLAFSPILIQKFGWPSAYSSPKEDPDLGAEEKKLILGGNVSKEPVGGGYPSNCPHNAGLVLKFNLTESGLFCVLPWLTMAIFANIGGWIADTLVSKGLSITSVRKLSHVKTPAMAVLCMACSQGSDAFSQSGLYSNHQDIGPRYAGVLLGLSNTAGVLAGVFGTAATGYILQRGSWDDVFKVAVALYIIGTLVWNIFSTGEKILD

SEQ ID NO: 182040 - protein, 532 aa, Glycine max
  Coding DNA Sequence Number=SeqID_65262
  Gene Ontology: Mol. function=monooxygenase activity; Cellular component=membrane; Biological process=electron transport
  Homolog annotation: Hit_ID=Q1SCJ4; Match level="QueryCoverage=98%, HitCoverage=97%, E-value=0.0, Identity=86%"; Hit description=E-class P450, group I
  Pfam annotation: Domain name=p450; Domain location=27-505; Score =164.9; E_value=2e-46; Accession=PF00067.12; Description=Cytochrome P450
METCTALLFLTAITAYLIWFTFISRSLKGPRVWALLGSLPGLIDNCDRMHDWICDNLRACGGTYQTCICAIPFLAKKQGLVTVTCDPRNLEHILKTRFDNYPKGPTWHAVFHDLLGDGIFNTDGDTWLFQRKTAALEFTTRTLRQAMARWVSRAINRLCLILKKAKDQAEPVDLQDLMLRLTFDNICGLAFGRDPQTCVLGLSDNRFATAFDRATEATLQRFILPEVLWKVKKWLRLGLEVSLSRSLVHVEDHLSNVIEKRKVELLSQQKDGTLHDDLLTRFMKKKESYTDKFLQHVALNFILAGRDTSSVALSWFFWLVIQNPKVEEKILREICTILMETRGDDMAKWLDEPLDFEEVDRLVYLKAALSETLRLYPSVPEDSKHVVADDVLPDGTFVPAGSSVTYSIYSAGRLKSTWGEDCMEFRPERWLSLDGTKFIMHDSFKFVAFNAGPRICLGKDLAYLQMKSIAAAVLLRHRLVLVPGHQVEQKMSLTLFMKNGLKVNVHERDLRGVITSIKKEREEDVDLRSNES

SEQ ID NO: 182041 - protein, 393 aa, Glycine max
  Coding DNA Sequence Number=SeqID_65263
  Homolog annotation: Hit_ID=Q9SLU9; Match level="QueryCoverage=99%, HitCoverage=45%, E-value=5e-68, Identity=39%"; Hit description=ZW18 protein
MFRRLGWFVGLNQTNLSTKRLLNADQTASARPNHQLPMLDAVHEVAVYIHRFHNLDLFEQGWYRIKITLRWEDGDDSHPGVPARVVQYEAPEVGADNLCGVWMIDDKDNSFSTPSFRIRYARQDGKSSAVILKFELFHTPTPEMRLVNDALSPLLFIKPELQSSVNGCAASFHEYRIPPKALLGLHSYCPVHFDAFHAVLVDTSVHISLLKSGYLTPQLKVPSDSLASKGTYGEECVRSSKAALIKALMAARDILLDDLRRISKGTNQAIDLTGITFEPYDTKSLNSTSTAHEKSTDDEVSLQLSDGTQISAEVLNSGNANASLSVMPFLCFRFISHTTISSYLQQKVTQYINHVTEELSQPFSWDDMLNSFQFIGNQLLYLWNTFLKFHRYT

SEQ ID NO: 182042 - protein, 65 aa, Glycine max
  Coding DNA Sequence Number=SeqID_65264
MACEKKKKRKGSYMFSATEIEAARQLVELSNGSIREVEDILAEIEEDERFRRRNSRGYLLYLNLM

SEQ ID NO: 182043 - protein, 117 aa, Glycine max
  Coding DNA Sequence Number=SeqID_65265
  Homolog annotation: Hit_ID=Q52UN1; Match level="QueryCoverage=31%, HitCoverage=7%, E-value=7e-09, Identity=75%"; Hit description=Cyclin- related protein 1
MAVKSGFVYIKMEYQQVLISDIDALIILTSAVPQTKLGFDPTKGLRPEFYFDEHVAHLAEVAVQCERMGLWAQYVGCVLDELSSTKNQLLQGFSPDDAYPSGPPLFMETSRPCSPLA

SEQ ID NO: 182044 - protein, 293 aa, Glycine max
  Coding DNA Sequence Number=SeqID_65266
  Homolog annotation: Hit_ID=Q5Q0H2; Match level="QueryCoverage=47%, HitCoverage=54%, E-value=4e-16, Identity=38%"; Hit description =Fasciclin-like arabinogalactan protein 19 precursor
  Pfam annotation: Domain name=Fasciclin; Domain location=42-171; Score= 4.6; E_value=0.0015; Accession=PF02469.12; Description=Fasciclin domain
MTCSLVPVWMMVALLMVANGVGVRSIPNREFDSMLNTVRARGYDLFCNAIVTSDLKIDILSDANSSRDAFTFFAPTDASLFALDMTLTASSYTDTLRFHVVPLRLSLAQLRLLPDGYTLPTLLPHRRLHLAHRTSSSPASISVAGVDVAFPGIFYGRNVVVHGLAGILSLRSNNSPSPSPIPSEDRWFFSPRSSPNSPANHPILAPFHVTNRSGSPAPFEAPAPAASPVDAPEGEPDWTVYPPVAESPRYPDSAISLPPEEYSDSAAPAPEGIRKCLNPDEGLEESVMQCYAA

SEQ ID NO: 182045 - protein, 285 aa, Glycine max
  Coding DNA Sequence Number=SeqID_65267
  Gene Ontology: Mol. function=acyltransferase activity; Cellular component=integral to membrane; Biological process=metabolic process
  Homolog annotation: Hit_ID=Q1SCJ7; Match level="QueryCoverage=70%, HitCoverage=40%, E-value=1e-89, Identity=82%"; Hit description =Phospholipid/glycerol acyltransferase
  Pfam annotation: Domain name=Hydrolase; Domain location=81-277; Score= -4.1; E_value=0.1; Accession=PF00702.16; Description=haloacid dehalogenase-like hydrolase
  Subcellular localization annotation: CTP_CleavageSite=80; ConfidenceScore=5.50e-01
MTKVKTAIKRHNHKPQGQIRNSTIQKQHLKPNVSPLSLLALSATATTTTFIHSQLSRRERKMATARRSFPPITECNGTTPCESVAADLDGTLLISRSSFPYFMLVAVEAGSLLRGLILLLSLPFVIIAYLFISESLGIQILIFISFSGLKIRDIELVSRAVLPRFYAADVRKESFEVFDRCKRKVVVTANPTLMVEPFVKDFLGGDKVLGTEIEVNPKTKKATGFVKKPGVLVGKWKRLAVLKEFGDESPDVGLGDRKTDHDFMSICKVKNLFLVKICVSRKRFG

SEQ ID NO: 182046 - protein, 128 aa, Glycine max
  Coding DNA Sequence Number=SeqID_65268
  Gene Ontology: Mol. function=protein binding; Cellular component =signalosome complex; Biological process=red or far red light signaling pathway
  Homolog annotation: Hit_ID=Q41369; Match level="QueryCoverage=97%, HitCoverage=52%, E-value=2e-36, Identity=71%"; Hit description=COP9
MDFSSVRAALDSKSYDKVADVCDNLMLQAPISTYNLFDCVGLYFFIFLRLRALLIRTIGPTQFTSSLTFMFTTSIVRAFFGSQYLPQSKRASLKSPRFGKLVRSSGYVTMPECTRQSVALIGLRNSKP

SEQ ID NO: 182047 - protein, 201 aa, Glycine max
  Coding DNA Sequence Number=SeqID_65269
  Gene Ontology: Mol. function=peptidase activity; Cellular component =nucleus; Biological process=cell division
  Homolog annotation: Hit_ID=Q5IBC5; Match level="QueryCoverage=91%, HitCoverage=8%, E-value=8e-53, Identity=55%"; Hit description =Separase
GKAGLRPTIKELASALESHDLFIYFGHGSGGQYIPRHEIQKLDKCAATLLMGCSSGSLTLPGQYAPQGIPLSYLLAGSPAIVGNLWEVTDKDIDRFGKAMLDAWLKERSDMPTECLQCNLLSEEFEAMNLKGCKGRAKRKAPRKKLLELAESESPKNCGHRRKIGAFMGQAREVCTLPFLTGASPAVGITTVPRKGDNPCH

SEQ ID NO: 182048 - protein, 254 aa, Glycine max
  Coding DNA Sequence Number=SeqID_65270
  Homolog annotation: Hit_ID=Q9SJV8; Match level="QueryCoverage=53%, HitCoverage=60%, E-value=2e-51, Identity=73%"; Hit description =Expressed protein
  Pfam annotation: Domain name=Hin1; Domain location=89-228; Score =89.8; E_value=8.5e-24; Accession=PF07320.4; Description=Harpin -induced protein 1 (Hin1)
MTTPRGNHHPQPNGERRRQWPPPQPPAAAPEAAAAPTAVAANYNGYRQYHPTTPARSSSSASFKGCCCCLFLLFSFLALLVLAVVLVIILAVKPKKPQFDLEQVGVQYMGITPNSPSTASLSLTIRLLFAATNPNKVGIRYGQSSFTVMYRGIPLGKATVPGFFQQPHSTRQVIATIAVDRVNLLQADAADLIRDASLNDRVDLRVLGDVAAKIRVINFDSPAVQMEILDTETSIVLFLPPLTLTLTFTGLLMI

SEQ ID NO: 182049 - protein, 461 aa, Glycine max
  Coding DNA Sequence Number=SeqID_65271
  Homolog annotation: Hit_ID=Q75I82; Match level="QueryCoverage=86%, HitCoverage=86%, E-value=4e-79, Identity=45%"; Hit description =Expressed protein
  Pfam annotation: Domain name=Pinin_SDK_memA; Domain location=158-294; Score=30.4; E_value=1e-07; Accession=PF04696.3; Description =pininSDKmemA protein conserved reg
MAVEKTEQELRNEIDELLRQQREISERLRDPRGLRRGALPGPPALRTNGVRQRPFIRPGDRNDSEDQPPSKRRLSSAVVKVDDGDLPEDADAGQEDGKTKDLTNEAVNGTAALVQNDSNPFNSHQSGWSKRDISNQKTSKASDVPNTDHVPRVLPKNEDPSLVNRNKRMLGQLLGTLEKFRKEDMQLSGTEAYMRRSNSLQRAEQRAREESERLRKEEREQIAEKRRRDLTLRARVAAKTEEKKLELLFLQWSEHRKRLSNFIRTKAEPPIYYLPNKPLDEDPTLLEKRKEEVVKLGNLISFGLHLIASFCSPWTAIPDLPVKSPPILMAFLEWKNARREEVSEYQKQIGEQYLANVEKELERWQNARNARKVNNDQNLQETMDKELDTHRLEHGPKKRKIPDGNNNEDDDDVEDINVGEDDMMDDELDDDSGRRIDDTTKTEAGNASTDPVADGENAEGK

SEQ ID NO: 182050 - protein, 740 aa, Glycine max
  Coding DNA Sequence Number=SeqID_65272
  Gene Ontology: Mol. function=hydrolase activity; Cellular component =nucleus; Biological process=chromosome segregation
  Homolog annotation: Hit_ID=Q5IBC5; Match level="QueryCoverage=99%, HitCoverage=46%, E-value=2e-67, Identity=43%"; Hit description =Separase
  Pfam annotation: Domain name=Peptidase_C50; Domain location=479-740; Score=-80.6; E_value=5.2e-06; Accession=PF03568.7; Description =Peptidase family C50
MAYLQGFMELFNDASRLVIKMFKRKNVPIEKWLPLMWESRSLSHALCVSPGNQSSLIGFQQNFSFLFASSHKNSCSHGSSFQTDITIAEVQKAALDLISNVPVPSHSTFLAGCLFYDLCPRLVANGQLIEALSSAKEAHRLHAKLFQRKFTHSVQQQNEEQNVIADSSKNLMDGIENIGLNLSVAREVLLFDSISWDLEDNYLSAWKVMQCYLESTLQVGIIHEMVGDGAEAETYFKWGKAISCSLNLPFFLIVFSSSLGKLYVKKRLWDLAEKELRSAEQILKESNTLFCCSKCKLKLEVTLYEYLGDLCQSKFDTCDGVMSEETAKNWYTSALDKLNLSEWKNPLSCPEVGSDGTATDIKCPAGKTCTCFIMNEAAKVLPKEPNLVVENTSRLTRSRYRSLQNQDTSIHRKLEVHESLEGNHVSDSSDMLSQNGSVFSNIGCPFPSRLVPDTTVDLAEYVKRFLAGLPSTTIISISLLGRDYTSLLQELLSYPTCVQAWMLVSRLSFKNEPVVMLLPLDSILQASGEGDLSTGSDTFPKCEEHSEKWRCPWGFTVVDDVAPAFKTILEENYLSTISPLEDTTQNRMLWWKRRKNLDHCLDKLLRNLEESCFGSWKCLLLGEWLNCKNFDLVLKNLVNDLRSKCKLDVNEGLLKIILGGSKYVCDGKTLVSQLCSKKDCYIAKVGYCNEARRGILNSADGIGVSSEVAFELLSEALNVLEVDDSMYREPIILVLDYEVQ

SEQ ID NO: 182051 - protein, 145 aa, Glycine max
  Coding DNA Sequence Number=SeqID_65273
  Gene Ontology: Mol. function=DNA binding; Cellular component =mitochondrion; Biological process=DNA integration
  Homolog annotation: Hit_ID=Q1SRN1; Match level="QueryCoverage=75%, HitCoverage=7%, E-value=2e-28, Identity=60%"; Hit description =Integrase, catalytic region
MQNGVTATVRYETAPKKDPSEQHSIAVKRILRYLNGTLNLGLKLQPSSSSNFSVQAYCDAYWALDPDDRRSTSGAAIFLGPNLVSWWSKKKKVVAQSSTEAEYRSLALATAEVTWIQTLLSELQTSSPNLLPPLILLCLGTSSEW

SEQ ID NO: 182052 - protein, 541 aa, Glycine max
  Coding DNA Sequence Number=SeqID_65274
  Homolog annotation: Hit_ID=Q8LF97; Match level="QueryCoverage=82%, HitCoverage=95%, E-value=7e-91, Identity=47%"; Hit description =Putative SKP1-like protein
  Pfam annotation: Domain name=Skp1; Domain location=90-172; Score =42.7; E_value=1.2e-09; Accession=PF01466.9; Description=Skp1 family, dimerisation domain
  Pfam annotation: Domain name=Skp1_POZ; Domain location=16-81; Score =22.0; E_value=0.00047; Accession=PF03931.5; Description=Skp1 family, tetramerisation domain
  Pfam module annotation: Pfam domain module=Skp1::Skp1_POZ; Domain location=90-172::16-81
MSETDLAVIKPEMMKPYVWLQTSDDSIQQVEQEIAMFSPLICQEIIQKGMGSSKNCAICLPQQVSPAMLSLILDYCRFHQVPGRSNKERKSYDEKFVRIDTERLCELTSAADSLQLKPLVDLTSRALARIIEGKTPEEIRDIFHLPDDLTEVSGACENSEEKLEPLRNITADPRIRLLNRLYAKKRKELKERGRLKISVVSGLLHICINFHSFMEDCIVSPFWKQRNNVGENNVEVEEEHVDERSVDDLLSFINGNDGERNCLRAIVLLYFSSVPLLNFLLEAKNFVADPKGVKTSKNKKKNRRKKEQQKNSSLKEASEMNKKEVNGHDIRHQSSEAERISETSYLPYAEDDTFSPKVEFDDGDIDDEIDPALKEKIDRSGTYDFCTLELSLVAMFMTLFTFHVFLPFHFREVEDFARRLNSDWPERMQELLSSGQERKTMLFTTDGFLRRQAWNYLSFSLLCYSQLTKSLFPSSGLDLEWNYGNESLPEASTILRDAGKSKKSFAWTNMSPFEFPLAEHALGYVFLDLVRTSLYMALTLN

SEQ ID NO: 182053 - protein, 278 aa, Glycine max
  Coding DNA Sequence Number=SeqID_65275
MNLAGNDSLIKMRFCFTRRRHRHCRLSVCLHWRWSCKGSSASFSFGVFDVDFEFAREFGFFFLRKENCVSLQRKEKKDLCTILADWTMCFFAKNKLIFLILQPLHGMVKRGWENVDVPKFECEICDAQLDFALPSASSCEAIMEMVIVKKEYTVFLTLPLCKLVTVIYGVFLALPNHWHVFGGGKGKWGQMIEICGLETLNIVLILTPFLVICVQPLARRLNQAKSQTLIFEDDWHVVLPLEVGKMLPQNRLLKEQPQEIQAHQSMVSRVENLKVEEH

SEQ ID NO: 182054 - protein, 843 aa, Glycine max
  Coding DNA Sequence Number=SeqID_65276
  Gene Ontology: Mol. function=ubiquitin-protein ligase activity; Cellular component=ubiquitin ligase complex; Biological process =protein amino acid phosphorylation
  Homolog annotation: Hit_ID=Q2HTK4; Match level="QueryCoverage=99%, HitCoverage=100%, E-value=0.0, Identity=62%"; Hit description =Protein kinase; U box
  Pfam annotation: Domain name=Pkinase; Domain location=484-748; Score =160.5; E_value=4.5e-45; Accession=PF00069.15; Description=Protein kinase domain
  Pfam annotation: Domain name=Pkinase_Tyr; Domain location=484-749; Score=83.7; E_value=5.8e-22; Accession=PF07714.7; Description =Protein tyrosine kinase
  Pfam annotation: Domain name=U-box; Domain location=774-843; Score =72.3; E_value=1.5e-18; Accession=PF04564.6; Description=U-box domain
  Pfam module annotation: Pfam domain module=Pkinase::Pkinase_Tyr::U -box; Domain location=484-748::484-749::774-843
  Subcellular localization annotation: CTP_CleavageSite=100; ConfidenceScore=5.36e-01
MAMVSSMPATPPQVNPVNSLRDIGVPGIMTSRRKIVNKPSPSMVNDTIYVAVGKNVKSSKSNLIWAIQNSGGRRICILHVHVPAPMIPLMGAKFPASALREEEVQDYHETERLKMYKTLDAYLSICQGMGVRAGKLQIEMDCIEKGIVELISQYGIQKLVMGAASDKYHSSLDIGNVEVAFPMAQQMANSEVGGSPKLRSQSIVQGQNHGIKLTNPAQELFRRVRSVNDGHRRSLASVSDESYGQSGRSPSVFSMCSHSISVEPGLTPNLISDGSENELDLTLNGPFLINKNLHHSASPSVLEMDGGMDDALYDQLEQAMAEAVNSKRDAYQETVRRGNAEKNAIDAIRRAKTTENLYKEELKLRKEQEEAVEKANEKLNNMKSQTDKVNEELRLALFQNSSLENQIASTELMIKELEQKIISAENLLQNYKDELDDLQIQRDIAVGEAEEFRRKQWEASSSAHKLQCFSEFSFQEIKEATSNFNPSQKIGEGGYGSIFKGILRHAEVAIKMLNRDSTQGPEEFQQEVEVLSKLRHPNIITLIGACPESWTLVYEYLPNGSLEDRLNCKDNSPPLSWQTRIRIATELCSALIFLHSNKPHSIAHGDLKPANILLDANLVSKLSDFGICRILLSCQDSSSNSTTQFWRTDPKGTFVYLDPEFLASGELTPKSDVYSFGIILLRLMTGKPALGIIKEVQYALDAGKLKSILDPFAGDWPFMLAEELVRLALRCCEMNRKSRPDLYPDVWRILEPMRASSGVTNTFQLGSQGLCQPPPYFICPIFLEVMQDPHVAADGFTYEAEAIREWLESGHDTSPRTNSKLAHRHLVPNHTLRHAIQNWLQSH

SEQ ID NO: 182055 - protein, 95 aa, Glycine max
  Coding DNA Sequence Number=SeqID_65277
  Subcellular localization annotation: CTP_CleavageSite=39; ConfidenceScore=5.06e-01
MMRTRKNMRNRFNGSKGNRWLVQCDIDLVSVRSGCPSLSAMAMPQRKRCKRTQTSWRETTSILVIGGNDANAIPTMCTIEGNQPKERGEEEGMRV

SEQ ID NO: 182056 - protein, 92 aa, Glycine max
  Coding DNA Sequence Number=SeqID_65278
MVYHKKQTSNFVLWNRECIELIGKSAQELNDMMFVGGDKSVNVFLDPLDNLLGCTLAFKIKVQPKYRNSSVKNISDDPELMQAIMDLLPDVE

SEQ ID NO: 182057 - protein, 119 aa, Glycine max
  Coding DNA Sequence Number=SeqID_65279
MTLHDYSSNSANSNTICYLFSQKRKRGTSNNLKVVHSGTKEFKIAIERKDIDLIDEEEAQIGGDRSSATSNKAEIYNEEARKKTQKHKPKRVGSVNADAEAFGDHSKILIALCILKLKH

SEQ ID NO: 182058 - protein, 199 aa, Glycine max
  Coding DNA Sequence Number=SeqID_65280
MLQGCYCLTVGTVDEIIIDAPWSYDSCPNCKTTFDPSKGGSACRSCHTSVVDTVPRLAMIIFCTDYLFTRFAVLANFPEISMDVKDATCIKLFGKTVGECRDELIAAGEDIKVFPTCVDEILLKTWAVRFKFRSQLRQSSVLDVSEELHHIQSLIATLGLKPSLSQSSDYDPGYSTCLTPTKRISCQQTSSDFDFDEHA

SEQ ID NO: 182059 - protein, 659 aa, Glycine max
  Coding DNA Sequence Number=SeqID_65281
  Gene Ontology: Mol. function=DNA binding; Biological process=DNA integration
  Pfam annotation: Domain name=Transposase_23; Domain location=322-381; Score=-2.5; E_value=0.0022; Accession=PF03017.5; Description =TNP1ENSPM transposase
MYNSKAKFDIPEGLTAKKKVMSTAGTRWRQFKSSLTTRYVYAENDDEQNKDPSAKYGIDRNTWEEFAKTRQTPTWKGIRKKAQEIQKFNESPHVLSRGGYNVLEKKLMAEKTKSRLNEGDNSQNADMVVDPPSPIARHEKWKKARTNKFGQMTSAAAQEIADKIDELQEQAKQGAFVPHGRQDILNTAIGRPEHPGHVCVGGHGVTITSYFGHASCGSHSSSPAITAERLVEIIQTIKQEVKKEVEDENKDRMDKMKMELDAIKSELSQIHTQQSAPPRPSNLDVFVACVSTKESCAEAANNVVGNERSTFNTCSMGFYIVCGDSTQLVAGGKVFGVGGMIHTVAYGDDVVRVCVDTVYDGEAIVPLPTSEIQYVRDVVNSFIGWPRHLVKPLSYDSDLNVWKPVEHSSDAKLAGESDPLGELMKILFYVYQNPVEVPWEANQFGLPEIGAKFYITHADLAEIISGDKCLNIAILQLWTIFMNECGRSKADQSLYGLLEPQSIQNAKERRQQCQQYIETWVKESQRQLYLGAYLNQAHWQLFVLHPRENTVVWFCSLRKKPDINIKGTINSAMKTITSSFEGMSNQGAPQWVEPKTNVQSGGFECGYYVMHWMWCIVTAGLKNDWHKWFSDGSSLNVEAITSVRQKWATYFLSFRKSSC

SEQ ID NO: 182060 - protein, 240 aa, Glycine max
  Coding DNA Sequence Number=SeqID_65282
  Homolog annotation: Hit_ID=Q9FIV2; Match level="QueryCoverage=49%, HitCoverage=29%, E-value=1e-48, Identity=65%"; Hit description =Similarity to pre-mRNA splicing factor
  Pfam annotation: Domain name=WD40; Domain location=118-157; Score =26.7; E_value=8.4e-05; Accession=PF00400.22; Description=WD domain, G-beta repeat
  Pfam annotation: Domain name=WD40; Domain location=74-114; Score =16.0; E_value=0.14; Accession=PF00400.22; Description=WD domain, G -beta repeat
  Pfam module annotation: Pfam domain module=WD40::WD40; Domain location=118-157::74-114
MQQRSMICTDNTEQAVQKINFSIFSLPKTFHDLKVYVEAYTCPCVRCHPFDSIFVAQSNGNYDAIFTTTPPYRLNKYKRYEGHVVSGFPIKCNFSLDGKKLASGSSDGSIYLYDYQSSKVVKKIKAHDQACIDVAFHPVIPNVIASCSWDGSILPYKKHCDMPSMEDFDKPAVKLEITLICMSFTLLMLGRAYFILMCICEIKTKTKTWHEAVVQLTSYKKCLDACNHYLPSWKETLNVT

SEQ ID NO: 182061 - protein, 179 aa, Glycine max
  Coding DNA Sequence Number=SeqID_65283
  Homolog annotation: Hit_ID=Q8W4H1; Match level="QueryCoverage=32%, HitCoverage=12%, E-value=3e-09, Identity=44%"; Hit description=GATA transcription factor 28
  Pfam annotation: Domain name=GATA; Domain location=1-28; Score=22.1; E_value=0.00052; Accession=PF00320.17; Description=GATA zinc finger
TPLWPNGPADKPVLCNACGSRYKTRGHLDNYLPKNVHPQPHHKKFKNVNSGGSNLNVEPELESGNQLLNHVSPRSTTNGDSDKLTLDVHHISPQDSFGNCIRGFIGDIGVADNTKAEFLALLFGLHMAWRLIAEINVCADFRAKMGLNSGSALLELECPPNELKHHLLSDARRVQFLRL

SEQ ID NO: 182062 - protein, 86 aa, Glycine max
  Coding DNA Sequence Number=SeqID_65284
MANFGKKIPSKKRSPMVYKRMIPMEKFQKQLVKLYKSERQPEESVLVDNMMNFIPENEIGLGTILLKTNDDDASSTDKCGSSTSAP

SEQ ID NO: 182063 - protein, 106 aa, Glycine max
  Coding DNA Sequence Number=SeqID_65285
MKQCKEFKDESNTVAAGIARERERERGRERLPNVGTAIVVDGIGLGSDDAFAAAGEEKRSEAKKNMDLVLVLANAESMPTHTHSDWIGEKNAQSESKREKKTCQSV

SEQ ID NO: 182064 - protein, 285 aa, Glycine max
  Coding DNA Sequence Number=SeqID_65286
  Homolog annotation: Hit_ID=Q9LXV3; Match level="QueryCoverage=28%, HitCoverage=18%, E-value=2e-23, Identity=64%"; Hit description=2 -oxoglutarate/malate translocator-like protein
MAIREKFRAFMHITEKTNYGSKEGEYAEVKAKHALLELRPMLVISKPRKKPDPNDAPTLIKIKKCRAEKLYEPGRDKASTIQKCSGKEKEQLTSDDDVGVILRRKAATELRLRFHGGGGGAHLTLALHSYRDLRTSHSRPSPCRDLRKLVVDIPQPVLRPVGGVALAHHAQHLHQWQENSPALFDTEGIVSARSASLKTKLPVLIKPLAKKKARAMSQGMGSLKPENEAAKVRYLKFKESRKLDFASFHGEKAMEYIWSGELVVLELDVTLASTISIIMWLLQCA

SEQ ID NO: 182065 - protein, 120 aa, Glycine max
  Coding DNA Sequence Number=SeqID_65287
  Subcellular localization annotation: CTP_CleavageSite=30; ConfidenceScore=5.18e-01
MAFYDTETMTLQCEPFKGSKNLPRRRRGTVASAPSPPFAGVSPQRRRHCCPWLQKEKQLMEIFVELSFSKFKTRSTGPALYFRTLSSTGLAGQLSGDIGSLSELETLDTENKDQESSESM

SEQ ID NO: 182066 - protein, 91 aa, Glycine max
  Coding DNA Sequence Number=SeqID_65288
MSSDDIQIDEPVVFSSPQKIDIDKRDKGKGTDRQKFLEEASTDLKPKARTAEEIKAKYRKTGTGDASAAAALARDKLVERQEKLQWYCPLN

SEQ ID NO: 182067 - protein, 122 aa, Glycine max
  Coding DNA Sequence Number=SeqID_65289
  Gene Ontology: Mol. function=oxidoreductase activity; Cellular component=endoplasmic reticulum; Biological process=metabolic process
  Homolog annotation: Hit_ID=Q6RVV4; Match level="QueryCoverage=81%, HitCoverage=30%, E-value=8e-32, Identity=63%"; Hit description=Short- chain dehydrogenase Tic32
MLHGDHQEEGVNITANSLHPGAIATNIHRYNRILTGIPGVVKRLLNLVIKNVQQGAATTCYVALHPEVRGISGEYFADNKIAKANSLGRDIDLAKKLWDFSMNLIKVEYLVPIVDADGILRE

SEQ ID NO: 182068 - protein, 246 aa, Glycine max
  Coding DNA Sequence Number=SeqID_65290
  Gene Ontology: Mol. function=molecular_function; Cellular component =anchored to membrane; Biological process=defense response
  Homolog annotation: Hit_ID=Q1S6B1; Match level="QueryCoverage=90%, HitCoverage=70%, E-value=8e-94, Identity=66%"; Hit description =Thaumatin, pathogenesis-related
  Pfam annotation: Domain name=Thaumatin; Domain location=35-241; Score= 300.4; E_value=3.2e-87; Accession=PF00314.8; Description=Thaumatin family
MSPYHGHSSQRFFIFLLILAFRGVRVTATTFTFVNKCDHTVWPGVLGKPDIGTTGFELKRGSTRSFDAPPGWSGRFWGRTGCEFDDSGHATCATGDCGSGQVNCNGAGATPPATLAEFTLGEGAPDYYDVSLVDGYNLPMMVDASGGSGSCAATGCGADLNRRCPEELRVDGGDACQSACRAFGKPEFCCSDAFNSPAACAPSMYSQIFKAACPKSYSYAYDDATSTFTCTAADYTVTFCPSSSPR

SEQ ID NO: 182069 - protein, 33 aa, Glycine max
  Coding DNA Sequence Number=SeqID_65291
GGVVRVGRWSLLGYCGEDDEKFLVVRVQLLKLP

SEQ ID NO: 182070 - protein, 156 aa, Glycine max
  Coding DNA Sequence Number=SeqID_65292
MVKPKSGNEKKKPRSEPHREVTFGHFNTIARGFAEGFTTSSTTKRYASVHKVQWEQIEGQLKTITVKYLVVNARSAYNLLLGGPTLNRIGVVISTSHLKVKYPLDDGVLIGTITANQELAHKCHKESLKNQRKWYGDQTGHQVNVLNLNPRKDFEE

SEQ ID NO: 182071 - protein, 80 aa, Glycine max
  Coding DNA Sequence Number=SeqID_65293
MHFIRNTIGACYYMEQEGTMEPLEMAKRFQMKNKKNKNDARNQSIARSLTPYHTTSTGANSGDLDGRKKYRIGNISVVNV

SEQ ID NO: 182072 - protein, 40 aa, Glycine max
  Coding DNA Sequence Number=SeqID_65294
MTLMDHSNKNDLMDHSNATARHTMKNLLQGWRRSSQELSI

SEQ ID NO: 182073 - protein, 181 aa, Glycine max
  Coding DNA Sequence Number=SeqID_65295
  Gene Ontology: Mol. function=oxidoreductase activity; Cellular component=integral to membrane; Biological process=metabolic process
  Homolog annotation: Hit_ID=Q6RVV4; Match level="QueryCoverage=85%, HitCoverage=49%, E-value=1e-59, Identity=76%"; Hit description=Short- chain dehydrogenase Tic32
  Pfam annotation: Domain name=adh_short; Domain location=1-156; Score=- 27.5; E_value=0.00036; Accession=PF00106.15; Description=short chain dehydrogenase
ASSGIGAETTRVLAMRGVHVIMGVRNVVAAKVVMEAILKEIPNAKVDAMELDLSSMISVRKFALEFISSGLPLNILINNAGIFGTPFKLSEDNIELQFATNHMGHFLLTNLLLDTIKRTTHESKKEGRIVNISSSGHQWLNYRGGILFDKINDESSGIYPETAKSTKAYSSRNLSMKEQLL

SEQ ID NO: 182074 - protein, 68 aa, Glycine max
  Coding DNA Sequence Number=SeqID_65296
  Homolog annotation: Hit_ID=Q1S1U2; Match level="QueryCoverage=99%, HitCoverage=11%, E-value=4e-17, Identity=63%"; Hit description =Membrane attack complex component/perforin/complement C9
MARKNKGVAVKDAIRAIGLGYDLTNDLKLKSGKNHSILIAIDDDNLQTIKLPTWISIPNVPKSIKCDK

SEQ ID NO: 182075 - protein, 120 aa, Glycine max
  Coding DNA Sequence Number=SeqID_65297
MDKEEGRVARGRGFPYERLLKLWMYSLESSESQYLSPLLATPFISLSGHSGLSEYSGDQVLNARFALSTPLGFFVRLLCTKLELAAKRGDTLGLSCVLSELSQSSTFSSSFCINFPQKHL

SEQ ID NO: 182076 - protein, 68 aa, Glycine max
  Coding DNA Sequence Number=SeqID_65298
  Homolog annotation: Hit_ID=Q10P78; Match level="QueryCoverage=85%, HitCoverage=16%, E-value=2e-12, Identity=59%"; Hit description =Expressed protein
MSSAGNWPSEDVLALYCLSHEDIFRSKKVIELGSGYGLAGFVIAAATEATEVVISDGNSQVVDCILLV

SEQ ID NO: 182077 - protein, 157 aa, Glycine max
  Coding DNA Sequence Number=SeqID_65299
  Gene Ontology: Mol. function=thiosulfate sulfurtransferase activity; Cellular component=chloroplast
  Homolog annotation: Hit_ID=Q1S3S6; Match level="QueryCoverage=79%, HitCoverage=96%, E-value=2e-58, Identity=87%"; Hit description =Rhodanese-like domain
  Pfam annotation: Domain name=Rhodanese; Domain location=16-121; Score= 43.7; E_value=6.2e-10; Accession=PF00581.10; Description=Rhodanese -like domain
MGSIGIESSGPEVVTVDVHATKDLIQTSHVYLDVRTVEEFQKGHVDAEKIINIPYMFNTPEGRVKNPEFLKEVSSACKKEDHIIVGCQSGVRSLYATADLLTEGFKDVSNMGGGYMDWVKKEFPVKAPLELVKNEVPVKTPLELVKNEFPVNPPIVG

SEQ ID NO: 182078 - protein, 123 aa, Glycine max
  Coding DNA Sequence Number=SeqID_65300
  Gene Ontology: Mol. function=electron carrier activity; Cellular component=membrane; Biological process=electron transport
  Homolog annotation: Hit_ID=Q9ZRV5; Match level="QueryCoverage=99%, HitCoverage=100%, E-value=3e-25, Identity=51%"; Hit description =Basic blue copper protein
  Pfam annotation: Domain name=Cu_bind_like; Domain location=39-116; Score=102.9; E_value=9.2e-28; Accession=PF02298.8; Description =Plastocyanin-like domain
MAQGRGILLLLCMLVLYSVSEMAHAKTYMVGGEFGWNYTVNMTTWPNGKSFRTGDILVFYYITYDNVVIVDEAGYNSCRAPKGSITYRSGNDHIALARGPNYFICTNQDHCSLNGMKIAVNAI

SEQ ID NO: 182079 - protein, 315 aa, Glycine max
  Coding DNA Sequence Number=SeqID_65301
  Gene Ontology: Mol. function=transferase activity
  Homolog annotation: Hit_ID=Q9FT43; Match level="QueryCoverage=82%, HitCoverage=35%, E-value=3e-35, Identity=34%"; Hit description =Sterol glucosyltransferase-like protein
MDSCGCGFSFTNHRNPLTFGSHGGLLNCLASLSTHLAEKHVQYCPVSSPPVLCADQNNDTEGLNNQFGSNYENWTAIVRGEYIFLMGLLISGKAESSFFLQKKKVTRDLRQECYALIERIFGDGPGLDDFLDGLGRVEPCRKFLCPLHCSCSLCCSIQFCKSINDLELLLTFRAQIIEVAIIIKHVKKTELQCSNEKLFAPATFESQFQIELPLLYKYLIDAPSGKVCWKDVIHWMWPLFTENWGSWRNDVLHLSPCPFTDPVTGIPTWHDRPQSPLVMYGFSKEVVECPGTILLNHKIGIMSYSSCGNILRGDE

SEQ ID NO: 182080 - protein, 444 aa, Glycine max
  Coding DNA Sequence Number=SeqID_65302
  Gene Ontology: Mol. function=mono-olein transacylation activity; Cellular component=integral to membrane; Biological process=lipid metabolic process
  Homolog annotation: Hit_ID=Q2R2X0; Match level="QueryCoverage=86%, HitCoverage=94%, E-value=1e-127, Identity=61%"; Hit description =Patatin, putative, expressed
  Pfam annotation: Domain name=Patatin; Domain location=195-359; Score =22.5; E_value=1.3e-07; Accession=PF01734.12; Description=Patatin -like phospholipase
ASVNPNTAMKCLQKFASDICVIFGDEYMRRPNNQDTERLLQTGATLDFPRSRMGPSIFSSHAHSHRLPYAANLNPNSSLLRRRAQFISFASNSSPPQPRPQGGFKDDEATAKKSFAVSTGELFLGLAARLIKSRNRGSSLAEEDSRSVAMFEERIEAAAVVVEDEIDPDVVWEQRVKDVEAERNRYRRVVTTPGFSFSAAGLLFPYHLGVAQFLIQNGYIKETTPLAGSSAGAIVCAVIASGASMEEALNATKILAEDCRNQGTAFRLGAVLRDILDKFLPDDVHIRSNGRVRVAVTQLLWRPRGLLVDQFDSKEDLINAVFTSSFIPGYLAPRPATMFRNRLCIDGGLTLFMPPTSAAQTVRVCAFPASRLGLQGIGISPDCNPENVCSPRQFFNWALEPAEDAILDRLFELGYLDAAVWAKENPVEVIVQDDSPAFGNGNAK

SEQ ID NO: 182081 - protein, 76 aa, Glycine max
  Coding DNA Sequence Number=SeqID_65303
  Gene Ontology: Mol. function=transferase activity
  Homolog annotation: Hit_ID=Q9FT43; Match level="QueryCoverage=76%, HitCoverage=11%, E-value=3e-11, Identity=60%"; Hit description =Sterol glucosyltransferase-like protein
MHWLGVSPEPLSRNHLLPDKNDNTSIHEAARVLSLAIHDALSSTVKARAAEIAERILLEDGVSEAIKYLKEELGLN

SEQ ID NO: 182082 - protein, 162 aa, Glycine max
  Coding DNA Sequence Number=SeqID_65304
  Gene Ontology: Mol. function=oxidoreductase activity; Cellular component=endoplasmic reticulum; Biological process=metabolic process
  Homolog annotation: Hit_ID=Q6RVV4; Match level="QueryCoverage=99%, HitCoverage=51%, E-value=4e-63, Identity=68%"; Hit description=Short- chain dehydrogenase Tic32
MKKTTQESKKQGRIVNISSILHQLTFRGGIPFDKINDPSSYHNWLAYGQSKLANILHANELARRLKQDGVDITANSLHPGAIVTNIFRHTSVLAGIINTLGRFVFKNVQQGAATTCYVALHPQVREISGKYFSDCNIAPTISKGRDIDLAKKLWDFSLNLIE

SEQ ID NO: 182083 - protein, 84 aa, Glycine max
  Coding DNA Sequence Number=SeqID_65305
MGDAVTLLDIPGYFLGDGTTLHLRVEINDNFKPQVEDMRKILGVEATMSKEHDEAIFIFKIILVTIVNVKMSLAQMTFLYMMKR

SEQ ID NO: 182084 - protein, 171 aa, Glycine max
  Coding DNA Sequence Number=SeqID_65306
  Gene Ontology: Mol. function=oxidoreductase activity; Cellular component=endoplasmic reticulum; Biological process=metabolic process
  Homolog annotation: Hit_ID=Q6RVV4; Match level="QueryCoverage=95%, HitCoverage=50%, E-value=4e-59, Identity=64%"; Hit description=Short- chain dehydrogenase Tic32
MKKTASESKKEGRIINVSSDGHQYTYPEGILFDKINDESSYQKWRAYGQSKLANILHANELARLLKEDGIDITANSLHPGAIITNIYKPELSGPVPTDLMNMLGDYLLKSIPQGAATTCYVALHPQVKGISGEYFSDSNLAKASSLATDTDLAKKLWDFSMKIIDYNAHDS

SEQ ID NO: 182085 - protein, 55 aa, Glycine max
  Coding DNA Sequence Number=SeqID_65307
  Gene Ontology: Mol. function=oxidoreductase activity; Biological process=metabolic process
MAPLQDRKRTARTEQNNSMWWPFWRKGGSAFSSSSTADEVTEGIDGTGLTAIVTG

SEQ ID NO: 182086 - protein, 255 aa, Glycine max
  Coding DNA Sequence Number=SeqID_65308
  Gene Ontology: Mol. function=protein binding; Cellular component =protein complex
  Homolog annotation: Hit_ID=Q1S6B8; Match level="QueryCoverage=94%, HitCoverage=61%, E-value=7e-58, Identity=54%"; Hit description=Von Willebrand factor, type A; Ubiquitin interacting motif
  Pfam annotation: Domain name=UIM; Domain location=141-158; Score =17.9; E_value=0.036; Accession=PF02809.10; Description=Ubiquitin interaction motif
  Pfam annotation: Domain name=UIM; Domain location=173-190; Score =18.8; E_value=0.019; Accession=PF02809.10; Description=Ubiquitin interaction motif
  Pfam annotation: Domain name=UIM; Domain location=71-88; Score=14.5; E_value=0.31; Accession=PF02809.10; Description=Ubiquitin interaction motif
  Pfam module annotation: Pfam domain module=UIM::UIM::UIM; Domain location=141-158::173-190::71-88
FGEEDEGKTEKLEALLSAVNNNDTSHIVHVPSGPNALSDVLISTPIFTGDGEGGSGFAAGSVSGFEFGVDPNLDPELALALRVSMEEERARQEAAAKKAAEDAAKQEKDGEQQASPQDTTMTKGVSAAASEAETKRTDLTVNENALLQQALAMSMDDPTINHDMRDTDMSEAAAEDPELALALQLSVEDSSKDSASQSDVSKLLADQSFVSSILASLPGVDPNDPSVKDLLASLQNQSEPQQKNEDKPPNEEEKK

SEQ ID NO: 182087 - protein, 40 aa, Glycine max
  Coding DNA Sequence Number=SeqID_65309
MGSSGFSSSSTAEEVTQGIDGSGLTAIVTDIGAYIPSEKR

SEQ ID NO: 182088 - protein, 253 aa, Glycine max
  Coding DNA Sequence Number=SeqID_65310
MAIMMEAVMSMKKMMEVNATVVAVTSAVAEVDPTRPAGLNQISHPTSDMVGQGGKELGSTSGPHFVQVQNNHAFPPYGLPPNYTPPNMVHTLNENVNNSNPILIESQQPQSDHAHVSQPMREAHEIPHHNLADFETCLGYAIEGQAVGGVPLPNTLEGPQFHPQPQPLHLAAGRVPPAMAEKGKLDQIEERLRAVERGGDNAFADMEDFCLVPDMVIPLKFKESLTGAVVTWYTNLEPSRVHSWKDLMVAFVR

SEQ ID NO: 182089 - protein, 70 aa, Glycine max
  Coding DNA Sequence Number=SeqID_65311
  Gene Ontology: Mol. function=protein serine/threonine kinase activity; Biological process=protein amino acid phosphorylation
  Homolog annotation: Hit_ID=Q8S407; Match level="QueryCoverage=64%, HitCoverage=10%, E-value=3e-12, Identity=69%"; Hit description =Similar to putative receptor protein kinase from
MEFISGNLRTFSYFDFRTLRRATKNFHPRNLLGSGGFGPVYQGKLADGRLKSRHCLLTSLNKEKKNFWQK

SEQ ID NO: 182090 - protein, 105 aa, Glycine max
  Coding DNA Sequence Number=SeqID_65312
MTNIKEGQSSLIVMTTVSLFIIIANSYYFGSLCGYYFHSCNKNHPNTLPQIWDKFVLNRTMLSYNLSIIKWGPVISLPELERARPEVQLGHPELKWVMDPKSPAS

SEQ ID NO: 182091 - protein, 95 aa, Glycine max
  Coding DNA Sequence Number=SeqID_65313
MKIGQDNVVQSHNTCLRKYIPNNTFDDCENQGIRNRMYKRSCDPLTVEKSPSPSRHNPGVFFFLGGIVVLIILRILVFIFWRRIKRPAKVMRTQL

SEQ ID NO: 182092 - protein, 64 aa, Glycine max
  Coding DNA Sequence Number=SeqID_65314
VSSPCRSLDPWDTSASRDGSEASSLVWLAEFEVGAAAGTIEGAGEGTSQSKQGGCSAAAGDIGV

SEQ ID NO: 182093 - protein, 123 aa, Glycine max
  Coding DNA Sequence Number=SeqID_65315
  Subcellular localization annotation: CTP_CleavageSite=58; ConfidenceScore=5.21e-01
MVPAHPPDPCLYSGFLHHPIPSPKSYSKPSFPPDYSPAAAPTSNSASHTSEEASDPSREAEVSHGSKLRQGEETSNKLVSHLLAPSSLSSASGDFRGEMLLMGFCMMLPAEGSWRHARTTTTA

SEQ ID NO: 182094 - protein, 238 aa, Glycine max
  Coding DNA Sequence Number=SeqID_65316
  Gene Ontology: Mol. function=RNA-directed DNA polymerase activity; Cellular component=chromatin; Biological process=chromatin assembly or disassembly
  Pfam annotation: Domain name=Chromo; Domain location=155-209; Score =38.9; E_value=1.8e-08; Accession=PF00385.14; Description='chromo' (CHRromatin Organisation MOdifier
MGRRRLLIAAWKHFFGALFQNNPPNGIHGCHGPNSGGVWAPTPSVPRFLPGETQVDSVASILVDRDEALRQLKFHLHPHRQQSMAHRICPKLSSCYFGPSQFLSHVGEVAYKLKLPDTSRIHPVFHVSQLKRSLKDGSTVNSLPLGLEMTDSDFPVPEAVLATRENKRQGVPILEWLILWKSQPLEEATWESAVSIQEKFPSFCLEDKAASNKGGIDGKTKWDKPYKVYYGRPKTKGA

SEQ ID NO: 182095 - protein, 293 aa, Glycine max
  Coding DNA Sequence Number=SeqID_65317
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q67U25; Match level="QueryCoverage=56%, HitCoverage=40%, E-value=5e-67, Identity=64%"; Hit description =Lustrin A-like
MVSHNKPYTVATLFFLALFLISIFFFFSTRTTLHPAPSIHSDLYIHLQPLSPPPPLQPLSPPPPPFPSPHSSSATTETQPEPVGDIEDVADNATDAESDAQPVTENIAEDVALSLKVCDLFTGTWVKDESYPIYQPGSCPYVDEAYDCKVNGRTDTLYSNWRWKPDACDLPRFNATDFLVRLKGKRLMLVGDSMNRNQFESILCLLREGLHNKSRMYEDYNCTVLFVRSHFLVREGVRLNGQGRSNPTLSIDRIDKTSGRWKKADILVFNTGHWWTHGKTARGIRASIAAQEC

SEQ ID NO: 182096 - protein, 93 aa, Glycine max
  Coding DNA Sequence Number=SeqID_65318
MGRGGNRYGLPTQLPKHILLFIFDEIRGRDRYSNLLPYPTFDYRKKPESIPDQLKYYPSKSKRIERDNHGYEFFLSCMVTTPMRPIFDKARNG

SEQ ID NO: 182097 - protein, 269 aa, Glycine max
  Coding DNA Sequence Number=SeqID_65319
  Gene Ontology: Mol. function=hydrolase activity; Cellular component =integral to membrane
  Homolog annotation: Hit_ID=Q1T0L9; Match level="QueryCoverage=91%, HitCoverage=73%, E-value=2e-91, Identity=65%"; Hit description =Rhomboid-like protein
  Pfam annotation: Domain name=Rhomboid; Domain location=82-237; Score =90.7; E_value=4.3e-24; Accession=PF01694.12; Description=Rhomboid family
FPDSVVPFAEQKLAPLTHIFRLNDKWCQRCFQLNGLNYLQLSTGDLTSSWSTSFSFFNGGGDGGRRYGKAGMSNSKMSGKDPFNGRKWTEILLAANVLFYIAQLATQGKLLLWGAKVNCYSLNSVGPTVESFSGPRRFLAVYFISAIASSATSYWFCRMPAVGASGAIFGLVGSVAVFVLRHKDLVGGGKKDLQHIAQVIALNMVIGLLSTGIDNWGHLGGLVGGVAASWFIGPAWKHESTSSDGRRLFIDTAPMYKLFKIKRVPKQWK

SEQ ID NO: 182098 - protein, 72 aa, Glycine max
  Coding DNA Sequence Number=SeqID_65320
MPMSSEALPTLPPPIMMMGAIVVARAMMVVAMVEALNLKVGIVKLIYSPLHQALPECRAPPGFTCRLCGVPK

SEQ ID NO: 182099 - protein, 295 aa, Glycine max
  Coding DNA Sequence Number=SeqID_65321
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=22%, E-value=1e-46, Identity=33%"; Hit description=Chromo
  Pfam annotation: Domain name=zf-H2C2; Domain location=194-235; Score =15.6; E_value=0.003; Accession=PF09337.1; Description=His(2)-Cys(2) zinc finger
MVQWPPLTLAKELRAFLGLTSFYHKFIKNYTAITTPLTSLLCKDAFEWTSTSQTVFDQLKIAMTSAPVLALPNFSESFIVEIDTTGTAMGTVIQTPKQLYYLSKLLGFDYTIQYKSSASNAMADALSLPQFDFLDDLRRTLHANPEFQALLSKVRANPSNHPDYRIHNELLLFQGHIWLDNTNPYIPTLLLEFHATSLGGHLGVAKTTHRLQSNFYWPNLRQDVKRFVRECKVCQQTKMSTRRLEGLLQPLLIPIGVWEDLSMDFITHLRSPTGSQPFLLSSTGIQGCSLRCTSL

SEQ ID NO: 182100 - protein, 178 aa, Glycine max
  Coding DNA Sequence Number=SeqID_65322
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q67U25; Match level="QueryCoverage=79%, HitCoverage=30%, E-value=2e-58, Identity=69%"; Hit description =Lustrin A-like
  Pfam annotation: Domain name=DUF231; Domain location=5-169; Score =196.8; E_value=5.2e-56; Accession=PF03005.6; Description=Arabidopsis proteins of unknown function
MAESWDSALSKKGLNGGELGLCVIEGLGCHSVEAYRKAIKTWGKWIDDNINPRKQIVYYRGYSNAHFRGGDWDSGGSCYGETEPAFNGSILNNYPLKMKVVEEVIRGMKVPVKLLNVTKLTNFRKDGHPSVFGKNTMGGRKVSTRKQDCSHWCLPGVPDAWNELIYATLVFQQTNSRN

SEQ ID NO: 182101 - protein, 67 aa, Glycine max
  Coding DNA Sequence Number=SeqID_65323
  Gene Ontology: Mol. function=RNA-directed DNA polymerase activity; Cellular component=chromatin; Biological process=chromatin assembly or disassembly
MVHCIRRMESLGIRSALDACETWFSQCQRFAFLSRSSESVDSGMAGRSSEGLRGGGIYGGLWLAAVE

SEQ ID NO: 182102 - protein, 117 aa, Glycine max
  Coding DNA Sequence Number=SeqID_65324
MAQVPPLSEEQYMGFFSGGLREDIRMEVLTFEPPNRHCLIFVARLIERKLDRTPFVYGARKLQPNRRPFPSGAQIGTPFLREGEDLTKDPPTSSEDSPEPDPQELVCQALDLHALDP

SEQ ID NO: 182103 - protein, 130 aa, Glycine max
  Coding DNA Sequence Number=SeqID_65325
MGSDGCRETRGTGTREATCKPRQDFNIQKEKERGSLFKIKSHVLSLFTHSEKFRSSRHLLTLLFFFPSHPPSLPIKAPNFAHHFYSKSQKEVIFGVVKRTSTLWDFKFQVWVDFFSHDFRWYWVFGRYDG

SEQ ID NO: 182104 - protein, 69 aa, Glycine max
  Coding DNA Sequence Number=SeqID_65326
MGFADGEEKEGWWKKAVVGGGRRHDERKRASTLLAIRRNDVTSTAPHLSDTLMMRSFDAMTSMLNEAEY

SEQ ID NO: 182105 - protein, 79 aa, Glycine max
  Coding DNA Sequence Number=SeqID_65327
MAASLAKLLTYKAFHAYSLGELGLGTHQGQGQDRLQVSKSTYKGAYRLPTNKFLTSTAAIEPTSFWNMSVFFTNWTNLC

SEQ ID NO: 182106 - protein, 1103 aa, Glycine max
  Coding DNA Sequence Number=SeqID_65328
  Gene Ontology: Mol. function=protein binding; Cellular component =integral to membrane; Biological process=xylan catabolic process
  Homolog annotation: Hit_ID=Q949G8; Match level="QueryCoverage=96%, HitCoverage=95%, E-value=1e-136, Identity=33%"; Hit description =HcrVf2 protein
  Pfam annotation: Domain name=LRRNT_2; Domain location=38-80; Score =49.5; E_value=1.1e-11; Accession=PF08263.3; Description=Leucine rich repeat N-terminal domain
  Pfam annotation: Domain name=LRR_1; Domain location=113-135; Score =14.6; E_value=0.36; Accession=PF00560.23; Description=Leucine Rich Repeat
  Pfam annotation: Domain name=LRR_1; Domain location=138-160; Score =15.0; E_value=0.28; Accession=PF00560.23; Description=Leucine Rich Repeat
  Pfam annotation: Domain name=LRR_1; Domain location=162-185; Score =11.1; E_value=2.4; Accession=PF00560.23; Description=Leucine Rich Repeat
  Pfam annotation: Domain name=LRR_1; Domain location=187-209; Score =14.9; E_value=0.29; Accession=PF00560.23; Description=Leucine Rich Repeat
  Pfam annotation: Domain name=LRR_1; Domain location=211-233; Score =15.1; E_value=0.26; Accession=PF00560.23; Description=Leucine Rich Repeat
  Pfam annotation: Domain name=LRR_1; Domain location=260-281; Score =0.6; E_value=2.2e+02; Accession=PF00560.23; Description=Leucine Rich Repeat
  Pfam annotation: Domain name=LRR_1; Domain location=288-311; Score =8.5; E_value=7.5; Accession=PF00560.23; Description=Leucine Rich Repeat
  Pfam annotation: Domain name=LRR_1; Domain location=317-339; Score =10.0; E_value=3.8; Accession=PF00560.23; Description=Leucine Rich Repeat
  Pfam annotation: Domain name=LRR_1; Domain location=342-363; Score =10.1; E_value=3.7; Accession=PF00560.23; Description=Leucine Rich Repeat
  Pfam annotation: Domain name=LRR_1; Domain location=365-388; Score =8.0; E_value=9.2; Accession=PF00560.23; Description=Leucine Rich Repeat
  Pfam annotation: Domain name=LRR_1; Domain location=390-415; Score =8.0; E_value=8.9; Accession=PF00560.23; Description=Leucine Rich Repeat
  Pfam annotation: Domain name=LRR_1; Domain location=419-442; Score =7.1; E_value=13; Accession=PF00560.23; Description=Leucine Rich Repeat
  Pfam annotation: Domain name=LRR_1; Domain location=445-467; Score =14.4; E_value=0.4; Accession=PF00560.23; Description=Leucine Rich Repeat
  Pfam annotation: Domain name=LRR_1; Domain location=470-492; Score =21.2; E_value=0.0037; Accession=PF00560.23; Description=Leucine Rich Repeat
  Pfam annotation: Domain name=LRR_1; Domain location=494-516; Score =13.7; E_value=0.68; Accession=PF00560.23; Description=Leucine Rich Repeat
  Pfam annotation: Domain name=LRR_1; Domain location=523-545; Score =5.6; E_value=25; Accession=PF00560.23; Description=Leucine Rich Repeat
  Pfam annotation: Domain name=LRR_1; Domain location=547-570; Score =13.4; E_value=0.81; Accession=PF00560.23; Description=Leucine Rich Repeat
  Pfam annotation: Domain name=LRR_1; Domain location=572-595; Score =8.3; E_value=7.9; Accession=PF00560.23; Description=Leucine Rich Repeat
  Pfam annotation: Domain name=LRR_1; Domain location=596-618; Score =4.6; E_value=40; Accession=PF00560.23; Description=Leucine Rich Repeat
  Pfam annotation: Domain name=LRR_1; Domain location=620-643; Score =14.0; E_value=0.54; Accession=PF00560.23; Description=Leucine Rich Repeat
  Pfam annotation: Domain name=LRR_1; Domain location=645-667; Score =3.6; E_value=60; Accession=PF00560.23; Description=Leucine Rich Repeat
  Pfam annotation: Domain name=LRR_1; Domain location=690-710; Score =2.1; E_value=1.2e+02; Accession=PF00560.23; Description=Leucine Rich Repeat
  Pfam annotation: Domain name=LRR_1; Domain location=716-737; Score =10.7; E_value=2.9; Accession=PF00560.23; Description=Leucine Rich Repeat
  Pfam annotation: Domain name=LRR_1; Domain location=740-762; Score =14.0; E_value=0.53; Accession=PF00560.23; Description=Leucine Rich Repeat
  Pfam annotation: Domain name=LRR_1; Domain location=764-786; Score =11.2; E_value=2.3; Accession=PF00560.23; Description=Leucine Rich Repeat
  Pfam annotation: Domain name=LRR_1; Domain location=788-810; Score =12.8; E_value=1.2; Accession=PF00560.23; Description=Leucine Rich Repeat
  Pfam annotation: Domain name=LRR_1; Domain location=813-835; Score =11.8; E_value=1.7; Accession=PF00560.23; Description=Leucine Rich Repeat
  Pfam annotation: Domain name=LRR_1; Domain location=837-859; Score =13.7; E_value=0.67; Accession=PF00560.23; Description=Leucine Rich Repeat
  Pfam annotation: Domain name=LRR_1; Domain location=915-937; Score =13.0; E_value=1.1; Accession=PF00560.23; Description=Leucine Rich Repeat
  Pfam annotation: Domain name=LRR_1; Domain location=939-961; Score =17.4; E_value=0.053; Accession=PF00560.23; Description=Leucine Rich Repeat
  Pfam annotation: Domain name=LRR_1; Domain location=963-985; Score =18.3; E_value=0.029; Accession=PF00560.23; Description=Leucine Rich Repeat
  Pfam annotation: Domain name=LRR_1; Domain location=987-1008; Score =9.7; E_value=4.4; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1; Domain location=38-80::113-135::138 -160::162-185::187-209::211-233::260-281::288-311::317-339::342 -363::365-388::390-415:...
  Pfam module annotation: Domain location=:419-442::445-467::470 -492::494-516::523-545::547-570::572-595::596-618::620-643::645 -667::690-710::716-737::740-762::764-786::788-810::813-835::837 -859::915-937::939-961::963-985::987-1008
MSCYFLKLFYALLLLLLHAAGSILGFNSLPNSAEIKCIESERQALLNFTHGLIDDSGMLSTWRDDDTNRDCCKWKGIQCNNQTGHVETLHLRGQDTQYLIGEINISSLISLENIEHLDLSYNSFQGSHIPELMGSFTNLRYLNLSDSLFGGSIPSDLGKLTHLLSLDLGNNYLLQGQIPYQLGNLTHLQYLDLSGNYLDGELPYQLGNLSQLRYLDLGWNSFSGALPFQVGNLPLLHTLGLGGNFDVKSKDAEWLTNLSSLTKLKLSLLHNLSSSHHWQQMISKLIPNLRELRLFDCSLSDTNIQSLFYSPSNFSTALTILDLSSNKLTSSTFQLLSNFSLNLQELYLGDNNIVLSSPLCPNFPSLVILDLSYNNMTSSVFQGGFNFSSKLQNLYLGNCSLTDRSFLMSSSFNMSSSSSLVSLDLSSNLLKSSTIFYWLFNSTTNLHNLVLYNNMLEGPIPDGFGKVMNSLEVLDLSGNKLQGEIPSFFGNMCALQSLDLSNNKLKGEISSFFQNSSWCNRYIFKGLDLSYNRLTGMLPKSIGLLSELEDLNLAGNSLEGDVTESHLSNFSKLEMLSLSENSLSLKLVPSWVPPFQLKYLGIRSCKLGPTFPSWLKTQSSLYRLDISDNGINDSVPDWFWNNLQYMRDLNMSFNYLIGSIPNISLKLRNRPSVLLNTNPFEGKIPSFLLQASLLILSENNFSDLFSFLCNQSTAANFETLDVSHNQIKGQLPDCWKSVKQLVFLDLSSNKLSGKIPMSMGALVNMEALVLRNNGLMGELPSSLKNCSSLIMLDLSENMLSGPIPSWIGESMHQLIILNMRGNHVSGNLPIHLCYLNRIQLLDLSRNSLSSGIPSCLKNLTAMSEQTINSSDTMSDIYRNGKTYVVLNGYIFGGYTLDITWMWKGVERGFKDPELELKSIDLSCNNLMGEIPKEVRYLLGLVSLNLSRNNLSGEIPSQIGNLGSLESLDLSRNHISGRIPSSLSEIDDLGRLDLSHNSLSGRIPSGRHFETFEASSFEGNIDLCGEQLNKTCPGDGDQTTEEGQEPPVKVDDSVFYEGLYMSLGIGYFTGFWGLLGPLLLWRPWRIAYIRFLNRLTDYVYVCLW

SEQ ID NO: 182107 - protein, 57 aa, Glycine max
  Coding DNA Sequence Number=SeqID_65329
MVAQLVFLKRGIFQSQVFGSDWRTKFIMIHILQEKVLRLILSPTLEKVLQCAKVSKV

SEQ ID NO: 182108 - protein, 176 aa, Glycine max
  Coding DNA Sequence Number=SeqID_65330
  Gene Ontology: Mol. function=transcriptional activator activity; Cellular component=nucleus; Biological process=regulation of transcription, DNA-dependent
  Homolog annotation: Hit_ID=P46602; Match level="QueryCoverage=94%, HitCoverage=40%, E-value=8e-33, Identity=66%"; Hit description =Homeobox-leucine zipper protein HAT3
  Pfam annotation: Domain name=HALZ; Domain location=111-155; Score =47.9; E_value=3.4e-11; Accession=PF02183.8; Description=Homeobox associated leucine zipper
  Pfam annotation: Domain name=Homeobox; Domain location=65-110; Score =8.6; E_value=0.00063; Accession=PF00046.19; Description=Homeobox domain
  Pfam module annotation: Pfam domain module=HALZ::Homeobox; Domain location=111-155::65-110
MKRALILITATTTTDAESNCGFPRSNHPCLRTASNSIALLIRYIFHRANTNAITIFVMSFCFTPRGKRILYMRWFWFHMQVQKQALADQLNLKTRQVEVWFQNRRARTKLKQTEVDHELLKKHCQNLSDENKRLKKELQELRALKVGPSPLCIQLSKTATLTTMCSSCDRELKLVN

SEQ ID NO: 182109 - protein, 518 aa, Glycine max
  Coding DNA Sequence Number=SeqID_65331
  Gene Ontology: Cellular component=chloroplast inner membrane
  Homolog annotation: Hit_ID=Q2QTT0; Match level="QueryCoverage=80%, HitCoverage=96%, E-value=1e-118, Identity=53%"; Hit description =Expressed protein
  Subcellular localization annotation: CTP_CleavageSite=52; ConfidenceScore=5.63e-01
MLPALSQFKVNHVGVGFNSSPNPIPMLPALRRSRCVVLFRLRSYSSTDFKITAHVETDSTVHLERCFNAPVASHLPSISMKGGQYGAFGAVTLEKSKLDMSQKQTRSSPELDIGGGGGDIGKKINHGGGDGGDDDGDDDDYFDDFDDGDEGDEGGLFRRRILFEELFDRKFVDAVLNEWQKTMMDLPAGLRQAYEMAVKHRVLTEFFAFRGWPTTSRFISRTLPQALSRSFIGRLLADPAFLYRFLLEEAATVGCSLWWEIKTRKDRIKQEWDLALMNVMTAAACNALVVWSLAPCRSYGNTFRFDLQNTLQKLPNNIFEKSYPLREFDLQKRIQCFLFKAAELCMVGLSAGAVQGALSNSLASKKEGRLSVTVPSVSSNALGYGAFLGIYANLRYQLLCGFDRAMMTHFDVIGVALFFSTAFRVLNVQLGETSKRAWLGVEADPLAQSDDLLKVYNRTSENVEKSSSKWFISKNAVVSGLGLLGIKQRNADGSGSESSAPKSRRKRIVRKKVAAGSA

SEQ ID NO: 182110 - protein, 290 aa, Glycine max
  Coding DNA Sequence Number=SeqID_65332
  Gene Ontology: Mol. function=zinc ion binding; Biological process =cell redox homeostasis
  Homolog annotation: Hit_ID=Q1S5W7; Match level="QueryCoverage=99%, HitCoverage=97%, E-value=3e-85, Identity=55%"; Hit description=Zinc finger, RING-type; Thioredoxin-related; RINGv
  Pfam annotation: Domain name=zf-C3HC4; Domain location=186-226; Score= 40.2; E_value=6.9e-09; Accession=PF00097.15; Description=Zinc finger, C3HC4 type (RING finger)
MSLTGRPRVVANGRTVRIPFTNNDDGFTSTCPYCFHQLRYELDISRPRLLMNVPNNLEPSPATQLLHNLALILDPPLRRQNNHLINTIPHWETENYEDGSNSSNPHQAWITLRFPRPTRVPRPISNDTDDHDDTLFENNALLDDFIDGVIQNNNNRPGPPPAASSAIAALPMVKLTQTHLASDPNCPICKDEFLLDMEARELPCKHFYHSDCIIPWLRMHNTCPVCRYELQGVTSANNANYYRLQNDDENAASSLVWIWNQLASFWPIRSVLDWALSYFNFQENHVRGRR

SEQ ID NO: 182111 - protein, 143 aa, Glycine max
  Coding DNA Sequence Number=SeqID_65333
MTTISSTAIGYHQHASTVAQFLYYELDSTIILSSYNFSCHLKIQTHVRGKKRKEEQRKGETLPLCRVRCPTRVRCRVRCLCRCRCFIGGERPGLVKERQRERGKRQQASDNNQYERDPESNMRGREIVQVATTLWVGGGGGGG

SEQ ID NO: 182112 - protein, 146 aa, Glycine max
  Coding DNA Sequence Number=SeqID_65334
MEKDELERDKNDGSPQVPTPKNKDSHVATKNLRCGSTRMVQIDYMMSSSIFLLCCLLIFSLYSLSQHTGYSLDATPTRKLSMPAPVHDHKTQHKMQGAEKAMESTPANEDSMTPDYTSNSYSPHDLVFHIDYHGVTTHPTPKHPKP

SEQ ID NO: 182113 - protein, 384 aa, Glycine max
  Coding DNA Sequence Number=SeqID_65335
  Homolog annotation: Hit_ID=Q67UA7; Match level="QueryCoverage=100%, HitCoverage=89%, E-value=1e-122, Identity=56%"; Hit description=F -box protein-like
MEPLPDAILQYILSHINNARDVAACNCVSKRWKDSMAYIRMLYFPRNSFDNPSLGESTDDIVKRMVSAVVRLEELVVYSPFSTSGLASWLSLVGMSLSQLELRMDYLAESQDSHESPSKLDCIGAARNLESLKLWGVLMMHSPKWDVFQNLRTLEIIGARLEEPVLTVVLQSCPYLRRLLLLGCEGVASISIDLPYLEQCKLDFYGPGNCSLTLSSPKIESLEVQGCSWIRVPETQHLRNLSISNSAGRVYMVDFGKLPALVFLSMRGIQWCWNAICKMLKLASEVKHIYMKVEFTGDYEALQSFPEIDFVDFFNNHPKLRKFDIHGAMFAALCQRNSLKHVDPGFLIPCLEEVVITVRSPLNAEQKMSTLESLLKYGKKLRTM

SEQ ID NO: 182114 - protein, 464 aa, Glycine max
  Coding DNA Sequence Number=SeqID_65336
  Gene Ontology: Mol. function=cytochrome-c oxidase activity; Cellular component=membrane; Biological process=electron transport
  Homolog annotation: Hit_ID=Q33B99; Match level="QueryCoverage=94%, HitCoverage=58%, E-value=3e-40, Identity=30%"; Hit description =Expressed protein
  Pfam annotation: Domain name=DUF639; Domain location=1-461; Score =380.5; E_value=2.5e-111; Accession=PF04842.3; Description=Plant protein of unknown function (DUF639)
MQKIFEALVPESVYNDARNLVEYCCFRFLSRDGSDIHPSLQDPAFQRLIFITMLAWENPYTNDLSSNSEKASLQNKLVTEEAFVRLAPAISGVVDRPTVHNLFKALAGDQEGISVSSWLNYINEFVKVRQKLISYQIPEFPQLSEERILCIGSNSKRPVLKWENNMAWPGKLTLTDKAIYFEAVGILAEKRAMRLDLTHDGLQVEKAKVGPLGSALFDSAVSVSSGSELNRWVLEFIDLGGEMRRDVWHAFINEVIALHRFIREYGPDDSDESLFNVYGARKGKDRATTTAINGIARLQVLQYLRKLLDDPTKLVQFSYLQNAPHGDIVLQTLAVNYWGGPLVTGFVNTRNQPETRPSDEIADSRNHVFDIDGSVYLQKWMKSPSWGSSISTSFWKNISVKGLILSKNLVVADLSLIERAAKTSKHKYHIVEKTQATIDAATLQGIPSNIDLFKVGCLTCSCLL

SEQ ID NO: 182115 - protein, 488 aa, Glycine max
  Coding DNA Sequence Number=SeqID_65337
MDGGLKRIVYNLVYEKEKIWANILNKSVLHKAGGLFDICNATLINKLLWDQELYHVFNKMGEDSEHTMFNVDVGAINKRKQKRLAKVIADEDQGLNNFGISRKIQKIMAEQQKRKKDQKIEHKTRRHEPTASTPERPPVVNSVAQRLKDLSETDEDDEGLVRVAKQKRKVAAPYALTPKKAKKTQLVSEPRAFVILSIILRHIKTRATKANLKIGDKEWAICITRNKEDPTSSSSDNKSTNDTLISPLHKHASSTQLHPPPSPLHLDKFRRVAPREPLTDAQRFPLAFINDNPTPTTPFSEVLFFEPVVREKISVQAPVWMQHDYVHTPFEAFKVWGTPKEKGFELYCKEDMPTRKMKVEIVNFPPSTSGYDGGDIVVHRDVIQVLRPIRKYHFDDTCVCFTKDVDRYSFIQHLLKLPTIQYEGTYNLKKISKEIMMAHVTKLHEAQQKKKVDKDDVVVEKEIVVVLFELAMCDLLDVDVELCGVLLT

SEQ ID NO: 182116 - protein, 550 aa, Glycine max
  Coding DNA Sequence Number=SeqID_65338
  Gene Ontology: Mol. function=diacylglycerol kinase activity; Cellular component=nucleus; Biological process=protein kinase C activation
  Homolog annotation: Hit_ID=Q9FJY7; Match level="QueryCoverage=90%, HitCoverage=79%, E-value=3e-98, Identity=38%"; Hit description =Selenium-binding protein-like
  Pfam annotation: Domain name=PPR; Domain location=170-204; Score=1.3; E_value=5.3; Accession=PF01535.11; Description=PPR repeat
  Pfam annotation: Domain name=PPR; Domain location=232-266; Score =40.8; E_value=4.6e-09; Accession=PF01535.11; Description=PPR repeat
  Pfam annotation: Domain name=PPR; Domain location=333-367; Score =26.7; E_value=8.4e-05; Accession=PF01535.11; Description=PPR repeat
  Pfam annotation: Domain name=PPR; Domain location=368-402; Score =11.1; E_value=0.37; Accession=PF01535.11; Description=PPR repeat
  Pfam annotation: Domain name=PPR; Domain location=404-438; Score=6.3; E_value=1.3; Accession=PF01535.11; Description=PPR repeat
  Pfam annotation: Domain name=PPR; Domain location=439-472; Score=0.6; E_value=6.3; Accession=PF01535.11; Description=PPR repeat
  Pfam annotation: Domain name=PPR; Domain location=96-130; Score=26.9; E_value=7.3e-05; Accession=PF01535.11; Description=PPR repeat
  Pfam module annotation: Pfam domain module=PPR::PPR::PPR::PPR::PPR::PP R::PPR; Domain location=170-204::232-266::333-367::368-402::404 -438::439-472::96-130
MRGVSRMLKIQSEKCPVPPFDVVHMIVKKGFLTTVAQKCNTLTQLKQLHAHILRCRINDTPYALAPLLSVLATSNDASFFSYARSIFRHLTNRNTFMHNTMIRGYLQCRSPLHAVSCYLSMLQNGVAVNNYTFPPLIKACIALLPSSPSNIVGRLVHGHVVKFGLRNDPYVVSAFIEFYSVSREVDTARVLFDETSYKDVVLGTAMVDGYGKMGNVKSAREVFDKMPERNAVSWSAMMAAYSRVSDFKEVLALFTEMQNEGTEPNESILVTVLTACAHLGALTQGLWVHSYARRFHLESNPILATALVDMYSKCGCVESALSVFDCIVDKDAGAWNAMISGEALNGDAGKSLQLFRQMAASRTKPNETTFVAVLTACTHAKMVQQGLWLFEEMSSVYGVVPRMEHYACVIDLLSRAGMVEEAEKFMEEKMGGLTAGDANVWGALLNACRIHKNIHVGNRVWKKLVDMGVTDCGTHVLTYNIYREAGWDVEANKVRSRIEEVGMKKKPGCSIIEVDNEVEEFLAGDHSHPQAQEMCKLLDSILKMGTLEHF

SEQ ID NO: 182117 - protein, 184 aa, Glycine max
  Coding DNA Sequence Number=SeqID_65339
  Gene Ontology: Mol. function=acetylglucosaminyltransferase activity; Cellular component=membrane; Biological process=electron transport
  Homolog annotation: Hit_ID=Q69XJ6; Match level="QueryCoverage=89%, HitCoverage=99%, E-value=8e-66, Identity=68%"; Hit description =Glycosylation enzyme-like protein
MFPLLVGNLTTAFGSAWMMLSRPFIEYCIWGWDNLPRIVLMYYANFLSSPEGYFHTVICNADEFRNTTVNHDLHFISWDNPPKQHPHFLTVDDYQKMVDSNAPFARKFGRNEPVLDKIDTELLGQNAVGYVPGRWFSQANSSITNKYSGIRNITDLRPGPGAERLGRLINGLLSAENFHANQCS

SEQ ID NO: 182118 - protein, 404 aa, Glycine max
  Coding DNA Sequence Number=SeqID_65340
  Gene Ontology: Mol. function=oxidoreductase activity; Cellular component=cytoplasm; Biological process=leukotriene metabolic process
  Homolog annotation: Hit_ID=Q9SLN8; Match level="QueryCoverage=99%, HitCoverage=99%, E-value=2e-49, Identity=44%"; Hit description=Allyl alcohol dehydrogenase
  Pfam annotation: Domain name=ADH_zinc_N; Domain location=130-361; Score=73.2; E_value=8.4e-19; Accession=PF00107.16; Description=Zinc -binding dehydrogenase
MEVTNKYIVIKHHVEDAPKQSNFELKTKAFALSVESGSDDIIVKNLYISIDPYQINRMKSYSSSQGTINFAVPITPGEAIDGAVIGKVVASGNAKFQKDDLVMGVFTWAEYRFNGLSAYAGFFELCKPLKGEKVFVSTASGAVGNLVGQYAKLLGCYVVGCAGSQKKVALLKEKLGFDDAFNYKEETDLNSTLKSGKSQNHNIIPEAPHNRNAKSQKHPIETQKKDENGNRVEKGTSPERKRCRECDLVGESANCGDLAGKHENRERLRERKGFLGAREYFPDGIDVYFDNVGGEMLEAAVANMKAFGRVAICGVISEYTSAGKRASPNMLDVVYKRINIRGFLAADFLNVFEDFSTKTSDYIRTGKLKVIEDLSLGVESIPSAFVGLFKGDNIGKKIISLTEE

SEQ ID NO: 182119 - protein, 90 aa, Glycine max
  Coding DNA Sequence Number=SeqID_65341
MAKEMQQQLIFVFVLIITLMSFMMFSAEARNLHDAFQQQHAMAPSAGGLQLNLQMQSLIQSTLIGFGMLPRGAIPPSGPSTPTHSCYYYC

SEQ ID NO: 182120 - protein, 71 aa, Glycine max
  Coding DNA Sequence Number=SeqID_65342
MAKEMQLLIFVFVLIITLSFMMLCAEARNLHAFQQQAMEYGAAGDWFPHLGVLHQFNSARACIYCNYEVQS

SEQ ID NO: 182121 - protein, 285 aa, Glycine max
  Coding DNA Sequence Number=SeqID_65343
  Gene Ontology: Mol. function=RNA-directed DNA polymerase activity; Biological process=RNA-dependent DNA replication
MASSKLMEKGYVTESLSSYVVLVLLVPKKDGSWRMCNDYRAMNNITMKEPNEYNRKIRSEVSNQMKDMNKDVHKTKEKTSETRGPRGNSSTRKKHLCNVCFVDMVAMGNRMEMLDITFTSANFKRLDSEEDDPMTITTKMANFFVRKTLIDKWSLANILFCKTFKQMDILEFMLQLHDDPLFGFFREKVLIRGFIELMTSAYSGYNRIRMHPRDEEKMAFITELTNCCYQVMSFGQKIVGAMYQCLMDKIFKDKIRRNIESEDFQRDTKTHRTHSLFDKISTLDS

SEQ ID NO: 182122 - protein, 352 aa, Glycine max
  Coding DNA Sequence Number=SeqID_65344
  Gene Ontology: Mol. function=RNA-directed DNA polymerase activity; Cellular component=signal recognition particle, endoplasmic reticulum targeting; Biological process=RNA-dependent DNA replication
MGKKDDRKGPPRDRNRRDERLVIDLYQKLQSLRQGFRSVEEYYQEIEVAMIRADVNEGREATMAMFLNGLNKEIAHIVELQHYVELEDMVHMAVRNWNKEEKVAPKKALKAKKNIPFTKFLGASHIASQCPNKKVMIMCDNEVMIEGENDGESMLSLKDATDNEIKYVVEGEALVSRHVLNSQVKEDNVEKQRENIFHTRCLINNKVCSMIDGGSFANVASTTLVEKLNLSTIKHPRPYKLQWLNDCGEVKVKHQVLVSISIGRYNDEVLYDVVPMHVRQMLLGRPWEFDRRENKDGHTNIYSFVMNNRFITLASLSPKQVYGDQIKMNKDREKKEIALKNKDHKKKSEIGE

SEQ ID NO: 182123 - protein, 137 aa, Glycine max
  Coding DNA Sequence Number=SeqID_65345
MILLVKIAYITYQVSIVSNKRIGRENNVREDGEGCGCHEVEMKEEGRMVGGIGRCLETCRDPDHLPIGGGIHHLLWDTGIAGGAEETEADLLIHPTLTTEMNMTFPGLQSYGILMTKARRLKLNHMVDNASYLWIVI

SEQ ID NO: 182124 - protein, 162 aa, Glycine max
  Coding DNA Sequence Number=SeqID_65346
MLLSGDEDTFIDDGLLGFLIHSLKDVKDMIFPKEFVDKGSIVDVIHSFQILHVPHNVDVDCVWKVEGDLIHHMEEHKFMLKVVLSLLFPICLLEILSLEKLWNMLDAPCDLCNGIHGQHHLISKNLGHNLSILELSVPPEHSNEFWVYQLWIVEVTTDATEL

SEQ ID NO: 182125 - protein, 110 aa, Glycine max
  Coding DNA Sequence Number=SeqID_65347
MGVSLAIIEGIFLKKLLKEVSLVMRGTHLLLEVVSPLSLPFSIPLPFIFQEAKESIDEEDPRPTSSNGACIMWYQSSIDCLHNSLGLTLVDTLGSYACWEMIRHFVLISI

SEQ ID NO: 182126 - protein, 223 aa, Glycine max
  Coding DNA Sequence Number=SeqID_65348
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=5e-31, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GYTPSPIRGRNVLTFRGLHALAIRGLHVLTFVGLHALTFRGPHVLTFRGLHALAIRGPHVLTFVGLHALTFRGPHILTFRGLHALAIRGPHVLTFRGLHALAIRGLHVLTFRGLHALAIKGLHVLTFVGLHALTFRGLHVLANRGLHALTFRGLHVLANRGLHALTLRGLHILAIRGLHALTSRGLHVLANRGLHALTFRGLRVLIFSVLHIHTLREFKVLCP

SEQ ID NO: 182127 - protein, 213 aa, Glycine max
  Coding DNA Sequence Number=SeqID_65349
  Homolog annotation: Hit_ID=Q09JM0; Match level="QueryCoverage=26%, HitCoverage=98%, E-value=1e-10, Identity=63%"; Hit description=10 kDa putative secreted protein
MAARALGVPRHLRAPGVGLWAPHSARLETRTKESDMCASQRASKPVRRKEADWWDPPHTCRDPKDGELCLSGAKPEKLWWRPAAILTIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHVNGTCTW

SEQ ID NO: 182128 - protein, 170 aa, Glycine max
  Coding DNA Sequence Number=SeqID_65350
  Gene Ontology: Mol. function=transferase activity; Cellular component= endoplasmic reticulum membrane; Biological process=DNA integration
MLTYKRSNHLEVIGYSDPNYVGCMNSRKSTFGYIFLLAGGVVSWKSAKQSMIATSTMKAEFVACFKATIQALWLQNFTLGFGIVDNIAKTLRIYCDNSTTIFFSKNDKYLKGAKHVGLKYLSIKEKQKHKVSIEHIGTNLMIADPLTKVYHQRYSLAMLKGWILWISPCL

SEQ ID NO: 182129 - protein, 299 aa, Glycine max
  Coding DNA Sequence Number=SeqID_65351
  Homolog annotation: Hit_ID=Q33A42; Match level="QueryCoverage=49%, HitCoverage=57%, E-value=3e-24, Identity=45%"; Hit description =Expressed protein
  Subcellular localization annotation: CTP_CleavageSite=37; ConfidenceScore=5.82e-01
SKSRSSSPRGHRSPSTTPRRRRSRTPSAKRYRRHRSRSSSLSPTRKSSSPSLGSVEHKSATEKLKKEEEKKSGVFGSLLIPLDVLMLYAFFFQPMNISFEPCREVGAYMVMDLVFIAHPLRKDWPDPLNHLQGGLVIRRQLEAELKLIEEETAKRVEEAIRKRVEESLKSEEVQVEIERRLEEGRKRLNDEVAAQLEKEKEAAIIEAKQKEEQARKEKEDLERMLEENRRKVEEAQRREALEQQRREEERYKELEEMQRQKEEAMRRKKHEEEQERLNQIKLLGKNKSRPKLSFALGSK

SEQ ID NO: 182130 - protein, 462 aa, Glycine max
  Coding DNA Sequence Number=SeqID_65352
  Gene Ontology: Mol. function=1-phosphatidylinositol-4-phosphate 5 -kinase activity; Cellular component=intracellular; Biological process=phosphatidylinositol metabolic process
  Homolog annotation: Hit_ID=Q8RY89; Match level="QueryCoverage=97%, HitCoverage=58%, E-value=1e-145, Identity=55%"; Hit description =Phosphatidylinositol-4-phosphate 5-kinase 8 (EC 2.7.1.68) (AtPIP5K8) ...
  Homolog annotation: Hit description=(1-phosphatidylinositol-4 -phosphate kinase 8) (PtdIns(4)P-5-kinase 8)
  Pfam annotation: Domain name=MORN; Domain location=111-133; Score =29.5; E_value=1.2e-05; Accession=PF02493.10; Description=MORN repeat
  Pfam annotation: Domain name=MORN; Domain location=134-156; Score =38.0; E_value=3.2e-08; Accession=PF02493.10; Description=MORN repeat
  Pfam annotation: Domain name=MORN; Domain location=157-179; Score =30.6; E_value=5.3e-06; Accession=PF02493.10; Description=MORN repeat
  Pfam annotation: Domain name=MORN; Domain location=180-201; Score =25.9; E_value=0.00014; Accession=PF02493.10; Description=MORN repeat
  Pfam annotation: Domain name=MORN; Domain location=19-41; Score=19.1; E_value=0.016; Accession=PF02493.10; Description=MORN repeat
  Pfam annotation: Domain name=MORN; Domain location=42-64; Score=16.5; E_value=0.038; Accession=PF02493.10; Description=MORN repeat
  Pfam annotation: Domain name=MORN; Domain location=65-87; Score=21.9; E_value=0.0023; Accession=PF02493.10; Description=MORN repeat
  Pfam annotation: Domain name=MORN; Domain location=88-110; Score =23.7; E_value=0.00067; Accession=PF02493.10; Description=MORN repeat
  Pfam module annotation: Pfam domain module=MORN::MORN::MORN::MORN::MOR N::MORN::MORN::MORN; Domain location=111-133::134-156::157-179::180 -201::19-41::42-64::65-87::88-110
MEDSTGRFDEKSFSNGDVYIGMIKGILPHDKGKYTWSDGTVFEGNWEGEKMTGKGLIVWSSGAQYEGEISGGYLDGYGTLTTSAGCIYRGGWRMNAQHGIGRKQYSNSDVYEGLWKEGVHEGSGRYTWNNGNMYVGNWKNGKIDGRGVMKWVNGDTFDGLWLNGLMHGSGVYRFGDGGLYIGAWNKGLKDGKGVFYPAGSKHPSLKKLHSPHDSDHNGFLLNVEKQEAPKARVKRSLSENMPVISRFKSFRQISHRTSSLKINLIRNDSAQDCVCHDSSLPLSNAVDDDQSEASSESTLVYEREYVQGVLIMERISECSESSRRKKQQNKFSVKQVKKSSCLDIFEGRQSYYLKLNLQLGIRYTVGKITPVPAREVRSSDFGDRARIRMYFPRAGSKLTPPHCSINFYWKDYCPMVFRNLREMFRLDAAEYMMSICGDSGLRDLSSPGKSGSIFYLSKDDRL

SEQ ID NO: 182131 - protein, 365 aa, Glycine max
  Coding DNA Sequence Number=SeqID_65353
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=26%, E-value=4e-79, Identity=42%"; Hit description=Chromo
MKFITEGKFVELQGEREQVGEPVSPSQLRRLLHTNSSSTFFHIKVEANTQTATIPPNSPEISALLTKYSCLFQPLTNLPPSRTTDHTINLLPNATPVNVKPYKYPYYQKQEIEEQVSAMLAKGFIQPSSSPFSSPVLLGYHQILMNKEDVGKTTFRTHQGHYEFRVMPFGLCNAPSSFQATMNQLFQPYLRKHIIIFFDDILVYSKTIVDHLLHLENAFRTLVACQFSLKISKCTFAQQQLEYLAHIVTALGVKPVPEKVQAIQTWPNPRSPRALRGFLGLAGFYRRFIKGYAILASPLTKLLSQGQFQWLPEVTEAFQKLKDAITEALVLALPDFKAPFVVETDTSNTGMGAVLSQGGHPIAFF

SEQ ID NO: 182132 - protein, 76 aa, Glycine max
  Coding DNA Sequence Number=SeqID_65354
  Homolog annotation: Hit_ID=Q1STK9; Match level="QueryCoverage=99%, HitCoverage=51%, E-value=7e-09, Identity=43%"; Hit description =Gonadotropin, beta chain; Peptidase aspartic, active site
MKFYRERMLVYLYVHILTPFLAPNFISVSHCYLQWCYLLSDEAQCCYNSVMEEIMSTSSIYEYAYMESIDGSFQAQ

SEQ ID NO: 182133 - protein, 86 aa, Glycine max
  Coding DNA Sequence Number=SeqID_65355
MAPIPPGPPLTDHRSLKELMAQAIQTPEQQTYLVRLIGYDYTIQYRAGRVMIIPIVEDRVTMNMFVIQHKGPEFIRLINKRPDMLA

SEQ ID NO: 182134 - protein, 160 aa, Glycine max
  Coding DNA Sequence Number=SeqID_65356
MTHMKKTGQMTFEPAKEITDKIDYLEEQATQGSFVSHGHQNVLTATIRQPEHPGRVCAIGANVTIKHYFGLASKGSRTSSSMAAEDLEQLTRKIRDQLKELALPFVAEVGPSAGHVSTKESCIDSSRVYEGSMTIHNVHLGNGQVKVGVEEVRDVDTPVH

SEQ ID NO: 182135 - protein, 653 aa, Glycine max
  Coding DNA Sequence Number=SeqID_65357
  Gene Ontology: Mol. function=transferase activity, transferring hexosyl groups; Cellular component=plastid chromosome; Biological process=metabolic process
  Homolog annotation: Hit_ID=Q0WVV0; Match level="QueryCoverage=89%, HitCoverage=86%, E-value=0.0, Identity=62%"; Hit description =Membrane-associated salt-inducible protein isolog
  Pfam annotation: Domain name=PPR; Domain location=157-191; Score =27.1; E_value=6.4e-05; Accession=PF01535.11; Description=PPR repeat
  Pfam annotation: Domain name=PPR; Domain location=228-262; Score =33.8; E_value=5.8e-07; Accession=PF01535.11; Description=PPR repeat
  Pfam annotation: Domain name=PPR; Domain location=263-297; Score =40.4; E_value=6.2e-09; Accession=PF01535.11; Description=PPR repeat
  Pfam annotation: Domain name=PPR; Domain location=298-332; Score =21.9; E_value=0.0023; Accession=PF01535.11; Description=PPR repeat
  Pfam annotation: Domain name=PPR; Domain location=333-367; Score =20.5; E_value=0.0062; Accession=PF01535.11; Description=PPR repeat
  Pfam annotation: Domain name=PPR; Domain location=371-405; Score =14.9; E_value=0.13; Accession=PF01535.11; Description=PPR repeat
  Pfam annotation: Domain name=PPR; Domain location=406-440; Score =25.4; E_value=0.0002; Accession=PF01535.11; Description=PPR repeat
  Pfam annotation: Domain name=PPR; Domain location=441-475; Score =19.0; E_value=0.017; Accession=PF01535.11; Description=PPR repeat
  Pfam annotation: Domain name=PPR; Domain location=476-510; Score=4.1; E_value=2.4; Accession=PF01535.11; Description=PPR repeat
  Pfam module annotation: Pfam domain module=PPR::PPR::PPR::PPR::PPR::PP R::PPR::PPR::PPR; Domain location=157-191::228-262::263-297::298 -332::333-367::371-405::406-440::441-475::476-510
  Subcellular localization annotation: CTP_CleavageSite=75; ConfidenceScore=5.66e-01
MEVSSSSSSSALIAFGMAFRHSPIPSSLAISASVSTTEPHTQPYRNSVKLGSSKTFSSARKAATLEVRNASDLASALARVGDALTVKDLNAALYHFKKSNKFNHISQLFSWMQENNKLDALSYSHYIRFMASHNLDAAKMLQLYHSIQNQSAKINVLVCNSVLSCLIKKAKFNSALNLFQQMKLDGLLPDLVTYTTLLAGCIKIENGYAKALELIQELQHNKLQMDGVIYGTIMAVCASNTKWEEAEYYFNQMKDEGHTPNVYHYSSLINAYSACGNYKKADMLIQDMKSEGLVPNKVILTTLLKVYVKGGLFEKSRELLAELKSLGYAEDEMPYCIFMDGLAKAGQIHEAKLIFDEMMKNHIYSPHADGYAHSIMISAFCRAKLFREAKQLAKDFETTSNKYDLVILNSMLCAFCRVGEMERVMETLKKMDELAINPGYNTFHILIKYFCREKMYLLAYRTMKDMHSKGHQPVEELCSSLISHLGQVNAYSEAFSVYNMLKYSKRTMCKSLHEKILHILLAGQLLKDASSDESYPVQDNAKFISRPATKKFASAFMKSGNLNYINDVLKTLHDCGYKLDQDLFAMAVSRYLDQPEKKDLLLHLLQWMAGQGYAVDSSTRNLILKNSHLFGRQLIAEVLSKQQVKLKHKNLTS

SEQ ID NO: 182136 - protein, 175 aa, Glycine max
  Coding DNA Sequence Number=SeqID_65358
  Gene Ontology: Mol. function=acyltransferase activity; Cellular component=integral to membrane
  Homolog annotation: Hit_ID=Q9C992; Match level="QueryCoverage=99%, HitCoverage=48%, E-value=5e-46, Identity=51%"; Hit description=3 -ketoacyl-CoA synthase 7
  Pfam annotation: Domain name=FAE1_CUT1_RppA; Domain location=1-132; Score=-68.1; E_value=7.8e-12; Accession=PF08392.2; Description =FAE1Type III polyketide synthase-lik
MGCSARLLPISLAKDLPRVHKISLALVLSMEAVAPNGYRGNTKSKLIANVLFRMGGAAILLSNRKQHKPVPRYKLEHLVRTHIGSNDKAYQSVYEEPDEDGNILARVNKEMYVPNFRKAFEHFCIDAGGKSVVDAIEESLRLQKKDGLQDGTIQIWQYFIFFCGMSRAIWRQKEE

SEQ ID NO: 182137 - protein, 423 aa, Glycine max
  Coding DNA Sequence Number=SeqID_65359
  Gene Ontology: Mol. function=oxidoreductase activity
  Homolog annotation: Hit_ID=Q5VPG7; Match level="QueryCoverage=90%, HitCoverage=62%, E-value=1e-105, Identity=50%"; Hit description =Oxidoreductase, 2OG-Fe(II) oxygenase family protein-like
  Pfam annotation: Domain name=2OG-FeII_Oxy; Domain location=277-374; Score=39.9; E_value=8.6e-09; Accession=PF03171.10; Description=2OG -Fe(II) oxygenase superfamily
MELLSSLRKEDILELFSHGFCSHCEDILHTRITNLRKRKLDETSSPDEEGFESSGDHVVDKPVNIGNVSNSESLTKNHEKQWDSPRNSSQRRDSTTPMKDDIKNIFYSSPKCLVGCKQSDFKLLLNDGICGDSSFENGGLSEEEKEQIRYSQVHCKKDFTFVERVNRRYVNVLRGLELHTGVFNAVEQRKIVEWIYRLQWRGQQGKLKDRTYSEPRKWMRGKGRVTIQFGCCYNYAVDKNGSPPGIMRDEEVDPLPPVFKQMIKRMVRWNIIPSTCIPDSCIVNIYEEGDCIPPHIDHHDFVRPFYTVSFLNECKILFGSNLQVVCPGEFAGPVSIPLPVGSVFVLNGNGADIAKHCIPSVSSKRISITFRKMDESKLPYKFSPDPDLVGIKPLIISPLNKGQDEVGNLDNKADSVESESDTG

SEQ ID NO: 182138 - protein, 162 aa, Glycine max
  Coding DNA Sequence Number=SeqID_65360
MVSLSDYGVEWFDPSNLGTSSFIRGGLLMVVLGVGVAEDEDGASLAIASSRCSKFDLERVDSAMRVNESTDVGDETILHWLRDCIKTVVVWNALRCLATGGHGIIFSPLRAGSSGSARSCDTTKPALQLVLQGNGVADILAKHGAMDSTSLVTYPSPPLEML

SEQ ID NO: 182139 - protein, 66 aa, Glycine max
  Coding DNA Sequence Number=SeqID_65361
MPNFRVHNATLSSEFIMPNEECLTSSAKRRMPNFKVHNAQRRMPNHNVILHLFKLTSEFIMSFYIT

SEQ ID NO: 182140 - protein, 184 aa, Glycine max
  Coding DNA Sequence Number=SeqID_65362
  Gene Ontology: Mol. function=serine-type endopeptidase inhibitor activity
  Homolog annotation: Hit_ID=P01070; Match level="QueryCoverage=99%, HitCoverage=100%, E-value=2e-38, Identity=46%"; Hit description =Trypsin inhibitor A precursor
  Pfam annotation: Domain name=Kunitz_legume; Domain location=27-168; Score=105.0; E_value=2.1e-28; Accession=PF00197.9; Description =Trypsin and protease inhibitor
  Subcellular localization annotation: CTP_CleavageSite=41; ConfidenceScore=5.01e-01
MKSPTIFILFLLSAFYTSLLPSATAQVVLDTEVVSSYGGIRVAATGKERRPLTVVQSPNPFDKGIGTIISSPYRSYFIGESFPVNMTFGNFAVILPCVPLRSEWTVVNGQPEGPAVKIGAPPNGENGWFGIEKPERSTCQHIGIHVDDENHARLVLTNDDPLEVKFEKDNHFWPQNNLVLPRSE

SEQ ID NO: 182141 - protein, 236 aa, Glycine max
  Coding DNA Sequence Number=SeqID_65363
  Gene Ontology: Mol. function=nucleoside-triphosphatase activity; Cellular component=nucleus; Biological process=protein transport
  Homolog annotation: Hit_ID=Q9SS94; Match level="QueryCoverage=80%, HitCoverage=58%, E-value=4e-77, Identity=57%"; Hit description=Cell division control protein 48 homolog C
  Pfam annotation: Domain name=AAA; Domain location=15-202; Score =278.0; E_value=1.9e-80; Accession=PF00004.19; Description=ATPase family associated with various cellular activities (AAA)
  Pfam annotation: Domain name=AAA_2; Domain location=11-141; Score= -50.2; E_value=0.061; Accession=PF07724.4; Description=ATPase family associated with various
  Pfam annotation: Domain name=AAA_5; Domain location=15-146; Score =0.6; E_value=0.0016; Accession=PF07728.4; Description=ATPase family associated with various
  Pfam module annotation: Pfam domain module=AAA::AAA_2::AAA_5; Domain location=15-202::11-141::15-146
MPFLIFELGVDLETGFLLYGPPGCGKTLIAKAVANEAGATFIHIKGPELLNKYVGESELAVRTMFSRARTCAPCILFFDEIDALTTKRGKEGGWVVERLLNQLLVELDGAEQRKGVFVIGATNRPEVMDRAVLRPGRFGKLLYVPLPSPDERVLILKALARKKAVDASVDLSAIAKMEACENLSGADLAALVCVCPLLMSTRGTTNNRGDISPDIEHKTKNPTKETTPPQPYTITT

SEQ ID NO: 182142 - protein, 100 aa, Glycine max
  Coding DNA Sequence Number=SeqID_65364
  Homolog annotation: Hit_ID=Q2HW59; Match level="QueryCoverage=76%, HitCoverage=30%, E-value=4e-37, Identity=88%"; Hit description =Cellular retinaldehyde-binding/triple function, C-terminal
MIFICGEVASYLVLPQDHRNTNILYWKIKYVSRLQYLWDDIKKGEIEIPDFVKSHDDILENRPLTDYGIEPDPFHLTGIPSTTYSFGKYEERWAGRNYVS

SEQ ID NO: 182143 - protein, 239 aa, Glycine max
  Coding DNA Sequence Number=SeqID_65365
  Homolog annotation: Hit_ID=Q5JMS6; Match level="QueryCoverage=90%, HitCoverage=90%, E-value=2e-72, Identity=53%"; Hit description =Membrane protein-like
MRKRTVYAWLVALLCFLVLMIVTPSIPQSQEYHDFADHRTFLGIPNALNVISNFPFLVIGLVGLVLCYHGNYFRLSLQGELWGWTCFYVGVAAVAVGSSFYHLKPDDARLVWDRLPMTVAFTSIMAIFIIERIDERKGTVSIIPLVLAGSYLLAKVLEATDDVIYEWTRHIVSGHTLKHLVAAMVPVFLTFMLAKRSVEPERQSLLKTWRVSWTKFREGNSNTESYSYSYTNVQAVEPQ

SEQ ID NO: 182144 - protein, 289 aa, Glycine max
  Coding DNA Sequence Number=SeqID_65366
  Homolog annotation: Hit_ID=Q7XAE6; Match level="QueryCoverage=94%, HitCoverage=40%, E-value=4e-70, Identity=50%"; Hit description=S3 self-incompatibility locus-linked pollen 3.15 protein
MEISDVSGDKLTFLASKLWGNWIGSGARRGKLVLKFWKTQTEFLEHQAETSTSNQNTRSVGEDSVIKIDKEDPPKSFTLSAKETLKAAIIHFGKKWYRRISFIWRHTMQIIGSFQKLWNIAGVHLNLDIPKWMHILRLDRLNTNAVQWLNKKGKLFEPTYLYTMEKGYFLLPESAKSHHNIHTVNVSISAWYSCFGNKWQQLLINRFVGYDTILINSLLSSHGQGYLYNYQTKEFYNLSYAQEVPEGPARLPCNKVWCADDVLVCIFYYHNVSIIYIKRNTDSHAEVHG

SEQ ID NO: 182145 - protein, 48 aa, Glycine max
  Coding DNA Sequence Number=SeqID_65367
MSCSTHDGDVLQNVRATGNERCSLTVAQTPNELDKGIGTRNKEYSKVR

SEQ ID NO: 182146 - protein, 1048 aa, Glycine max
  Coding DNA Sequence Number=SeqID_65368
  Gene Ontology: Mol. function=protein transporter activity; Cellular component=nuclear pore; Biological process=protein import into nucleus, docking
  Homolog annotation: Hit_ID=Q00WP4; Match level="QueryCoverage=91%, HitCoverage=96%, E-value=1e-131, Identity=31%"; Hit description=[YU] KOG2171 Karyopherin
  Pfam annotation: Domain name=HEAT; Domain location=113-149; Score =10.8; E_value=2; Accession=PF02985.12; Description=HEAT repeat
  Pfam annotation: Domain name=HEAT; Domain location=154-191; Score =27.3; E_value=5.5e-05; Accession=PF02985.12; Description=HEAT repeat
  Pfam annotation: Domain name=HEAT; Domain location=201-237; Score =4.0; E_value=14; Accession=PF02985.12; Description=HEAT repeat
  Pfam annotation: Domain name=HEAT; Domain location=332-368; Score =10.8; E_value=2.1; Accession=PF02985.12; Description=HEAT repeat
  Pfam annotation: Domain name=HEAT; Domain location=373-409; Score =30.6; E_value=5.7e-06; Accession=PF02985.12; Description=HEAT repeat
  Pfam annotation: Domain name=HEAT; Domain location=414-450; Score =27.4; E_value=4.9e-05; Accession=PF02985.12; Description=HEAT repeat
  Pfam annotation: Domain name=HEAT; Domain location=455-491; Score =14.6; E_value=0.36; Accession=PF02985.12; Description=HEAT repeat
  Pfam annotation: Domain name=HEAT; Domain location=500-535; Score =11.4; E_value=1.7; Accession=PF02985.12; Description=HEAT repeat
  Pfam annotation: Domain name=HEAT; Domain location=664-700; Score =7.8; E_value=4.7; Accession=PF02985.12; Description=HEAT repeat
  Pfam annotation: Domain name=HEAT; Domain location=715-752; Score =15.7; E_value=0.16; Accession=PF02985.12; Description=HEAT repeat
  Pfam annotation: Domain name=HEAT; Domain location=73-110; Score=6.4; E_value=7.1; Accession=PF02985.12; Description=HEAT repeat
  Pfam annotation: Domain name=HEAT; Domain location=860-896; Score =21.3; E_value=0.0036; Accession=PF02985.12; Description=HEAT repeat
  Pfam annotation: Domain name=HEAT; Domain location=901-939; Score =9.9; E_value=2.6; Accession=PF02985.12; Description=HEAT repeat
  Pfam annotation: Domain name=IBN_N; Domain location=23-89; Score =62.3; E_value=1.6e-15; Accession=PF03810.9; Description=Importin -beta N-terminal domain
  Pfam annotation: Domain name=Xpo1; Domain location=92-215; Score= -20.0; E_value=0.09; Accession=PF08389.2; Description=Exportin 1-like protein
  Pfam module annotation: Pfam domain module=HEAT::HEAT::HEAT::HEAT::HEA T::HEAT::HEAT::HEAT::HEAT::HEAT::HEAT::HEAT::HEAT::IBN_N::Xpo1; Domain location=113-149::154-191::201-237::332-368::373-409::414 -450::455-491::...
  Pfam module annotation: Domain location=500-535::664-700::715-752::73- 110::860-896::901-939::23-89::92-215
MAQSLELLLIQFLMPDNDARRQAEDQIKRLAKDPQVVPALVQHMRTAKTPNVRQLAAVLLRKKITGHWAKLSPQLKQLVMQSLIETITMEHSPPVRKASANVVSIVAKYAVPSGEWPDLLPFLFERSQSAQEDHREVALILFSSLTETIGNTFRPYFTRLQDLLLKCLQDETSNRVRVAALKAVGSFLEFTHDEIEVIKFREFIPSILNVSRQCLASGEEDVAILAFEIFDELIESPAPLLGDSVKSIVQFSLEVCSSQNLESNTRHQAIQIISWLAKYKSSTLKKHKLITPILQVLCPLLAESTNETEDDDLAPDRAAAEVIDTMALNIPKHVFQPVFEFASVSCQNANPKFREASVTALGVISEGCLELMKTKLEPVLHIVLGALRDPEQMVRGAASFALGQFAEHLQPEIVSHYESVLPCILNALEDASDEVKEKSYYALAAFCENMGEDILPFLDPLMKRLLTALQNSSRVLQETCMSAIGSIASAAEQAFIPYAERVLELMKIFMVLTNDEDLRSRARATELVGIVAMSVGRVRMEPILPPYIEAAISGFGLEFSELREYTHGFFSNVAEILDDSFAHYLPHVVPLAFSSCNLDDGSAVDIDECDDEITNGFGGVSSDDEAHDEPRVRNISIRTGVLDEKAAATQALGLFAQHTKTSYAPYLEETLRILVKHSSYFHEDVRLQAIISLKHILTAAHGIFQSQNEGAAKAKELLDTVMNIYIKTMVEDDDKEVVAQACTSVADIIRDFGYATLEPYLSQLVDATSLLLQEKSSCQQIESDSEIDDVDSAHDEVLMDAVSDLLPAFAKSIGAQFAPIFAQLFEPLMKFAKSSRPPQDRTMVVACLAEVAQNMGFPIASYVDRVMPLVLKELASSEATNRRNAAFCVGELCKNGHEPALKYYDNILRGLYPLFGESEPDDAVRDNAAGAVARMIMVHPESIPLNQVLPVFLRVLPLKEDREESMAVYSCVSTLVFSSNPQILSLVPELVNLFALVVVSPVETPEVKAVVGRAFSHLISLYGQQIQPLLSNLPPAHANALSAFAQRS

SEQ ID NO: 182147 - protein, 548 aa, Glycine max
  Coding DNA Sequence Number=SeqID_65369
  Gene Ontology: Mol. function=nucleoside-triphosphatase activity; Cellular component=membrane; Biological process=protein transport
  Homolog annotation: Hit_ID=Q5VRN1; Match level="QueryCoverage=98%, HitCoverage=98%, E-value=1e-138, Identity=44%"; Hit description =Putative cell survival CED-4-interacting protein MAC-1
  Pfam annotation: Domain name=AAA; Domain location=249-449; Score =256.7; E_value=4.8e-74; Accession=PF00004.19; Description=ATPase family associated with various cellular activities (AAA)
  Pfam annotation: Domain name=AAA_2; Domain location=245-390; Score= -42.3; E_value=0.015; Accession=PF07724.4; Description=ATPase family associated with various
  Pfam annotation: Domain name=AAA_3; Domain location=249-377; Score= -20.3; E_value=0.054; Accession=PF07726.2; Description=ATPase family associated with various
  Pfam annotation: Domain name=AAA_5; Domain location=249-396; Score= -1.6; E_value=0.0024; Accession=PF07728.4; Description=ATPase family associated with various
  Pfam module annotation: Pfam domain module=AAA::AAA_2::AAA_3::AAA_5; Domain location=249-449::245-390::249-377::249-396
MGRRNGGRSLQETLRRRLESCKSKYSTAEEFANHLRSTYPDYHRTKHQTLIRFVQEALHSTAKLNHTPTPKHCDGDDDDDEEGEAQSASRKRRKKIDGSEERLQRMEALHVRSKVQRSSSSSSASESDDEDEEETVSTSEDAIYGEKVEPEFDLMKTMLRKSYTPKKVAAEEKNVELEVGNSSKDTLVNEERKEVKGSSSGSVSNRKDGPRFKDLGGMKEVLEELKMEVIVPLFHPQLPRQLGVRPMAGILLHGPPGCGKTKLAHAIAHETGLPFYQISATEVVSGVSGASEENIRELFAKAYRSAPAIVFIDEIDAIASKRENLQREMEKRIVTQLMTCMDQSNRLLQPADDVESSGDDHHPGYVLVIGATNRPDAVDPALRRPGRFDREIIIGNPDESAREEILSVLTCDLRLEGLFDLRKIARATSGFVGADLAALVDKAGNLAMKRIIDERKRELSQDLTSEHAEDWWREPWSVEEINKLAIKMSDFEEAANKVQPSLRREGFSSIPNVKWDDVGGLDLLRKEFERYIVRRIKYPEDYEVIFKY

SEQ ID NO: 182148 - protein, 134 aa, Glycine max
  Coding DNA Sequence Number=SeqID_65370
  Gene Ontology: Mol. function=translation elongation factor activity; Biological process=transcription
  Homolog annotation: Hit_ID=Q1RY71; Match level="QueryCoverage=99%, HitCoverage=22%, E-value=2e-40, Identity=57%"; Hit description=Bromo adjacent region; Transcription elongation factor S-II, central region
MENHRRRTQVTTSDDEDEQEKEEVLKRSRPVEDAKPIGEPLKYSGKGKSKKWHYDSFEFNGIQYTIGDHVLFKPEEKGQKPYAGIIKDITQGNNGNVVVTGQWFYRPEEAEKKGGGNWKSCDSRELFYSFHCDD

SEQ ID NO: 182149 - protein, 116 aa, Glycine max
  Coding DNA Sequence Number=SeqID_65371
MAREVIRYSTNGKEVRVEKITWVKMLIPNPSYGYKCLYTCHVVKVNWWNGFYIKLFPRDIPSVMVIIFSDGLVTYQCITQHNSLYHYLGQTIQWVEIVLRYPEKKKSSGSFNGGTL

SEQ ID NO: 182150 - protein, 384 aa, Glycine max
  Coding DNA Sequence Number=SeqID_65372
  Gene Ontology: Mol. function=heat shock protein binding; Cellular component=nucleus; Biological process=protein folding
  Homolog annotation: Hit_ID=O04087; Match level="QueryCoverage=68%, HitCoverage=55%, E-value=4e-69, Identity=50%"; Hit description=DnaJ isolog; 47062-48761
  Pfam annotation: Domain name=DnaJ_C; Domain location=257-377; Score =28.8; E_value=8.2e-09; Accession=PF01556.9; Description=DnaJ C terminal region
MGDHPRSQPLDLHNLFKIPKNKSLKDVSKAYKSLVSKRNHHDKKTPEEPTTPPRFEESDNKRVDQDNWSPKLFSRAASRRSKTPTPKSRPMSRHGSRRCTTPTSLSRSSSSSGRRSATEIAASSLKRIMSKRVSPPSLSSNKLDISEPELTNHVASPTKDADAGAKTTTRKTQHIPAVSLSSNMSCRSTTPIIFSQTTTRRKPPQVERTLYCTLENLCFGCKKNVKVTRDAIKFPGVIIQEEEILKIEVKPGWRKGTKITFEGVGDEKPGYLPADIVFLIDEKKHPLFRREGIDLEIGVEIPLVDALTGCFISIPLLGGENMGLSFENDVIYPGYEKVIKGQGMPDPKNNGIRGDLLVRFLIEFPRELSEERRKEAASILQDCC

SEQ ID NO: 182151 - protein, 183 aa, Glycine max
  Coding DNA Sequence Number=SeqID_65373
  Homolog annotation: Hit_ID=Q9LT45; Match level="QueryCoverage=18%, HitCoverage=16%, E-value=8e-08, Identity=64%"; Hit description =Putative GATA transcription factor 18
  Pfam annotation: Domain name=GATA; Domain location=112-148; Score =43.5; E_value=7e-10; Accession=PF00320.17; Description=GATA zinc finger
MDSGKTNEAPNAKLVRDFDLNISYVEEFDVNAEDKLSSPILMNTQPASQNCIENMNIQDEIANNGDTTIQANSAAKGVTSVSFAPGRISQYRRRRRRRSVECKPSTDPDRLCTNTYCKTRRTPLWRKGPLGPKTLCNACGIQYLKIVKGTGSGLPAAVADDEGDASPGPVPAAEIVEEGDSNL

SEQ ID NO: 182152 - protein, 228 aa, Glycine max
  Coding DNA Sequence Number=SeqID_65374
  Homolog annotation: Hit_ID=Q7XAE6; Match level="QueryCoverage=96%, HitCoverage=31%, E-value=2e-76, Identity=68%"; Hit description=S3 self-incompatibility locus-linked pollen 3.15 protein
MKFFPRFFLLYFLVFHIYFFSYAYGFSYLALSTTAAFMQHLILYFWNRFERLDEGIGKRGLGEVPALQRYMQNRRSQLQQHPDFHITSSTILASTLHITRLNTRNQGLNNTDLPTGAGLRPGFDQSMPQNGPGVADPQGRSENNRDRVANPAQIPGQADIRQAERGLNPGSMNSFSSLLLWILGGASSEGLNSFFSMFRDVREQGQVFNETPGAANENPENQDNIDNR

SEQ ID NO: 182153 - protein, 133 aa, Glycine max
  Coding DNA Sequence Number=SeqID_65375
MESIGLPYEHILAAILHLHFSEVPKSLMLDRWSKHAKEGIVRCYAHGSNYWNLDSMAKYVTLVQISRQTERIDVGQARRLDLEDLVRCRHVAGVVEMDITRSCGSSNQHYTGDGNPDGVIPLVRRAMLFMNLT

SEQ ID NO: 182154 - protein, 112 aa, Glycine max
  Coding DNA Sequence Number=SeqID_65376
MVPPDAAKGSIGSAPMLQRKGKIHDPRPHPFKNQIHVEKMILGSMLPPIDVFFIATPTPCGLIGIFVRKRTIPAIDVVVGEQSSFYLLDLDARLDEGDGHRGCDALVLAKAL

SEQ ID NO: 182155 - protein, 133 aa, Glycine max
  Coding DNA Sequence Number=SeqID_65377
MNAHTLMGRWAFGRRHCQCFGHRDAEGEEKEEVEDADDIQIDVEDGDVRGSTENAGDDGIVIDDVTDILKFDMENLSMDDLRRVGFKQKNGLNPNCRKHRSKNGTRCGCDAMCPLLAAHGKMSATDILQIDNF

SEQ ID NO: 182156 - protein, 194 aa, Glycine max
  Coding DNA Sequence Number=SeqID_65378
  Homolog annotation: Hit_ID=Q1STY0; Match level="QueryCoverage=38%, HitCoverage=85%, E-value=9e-37, Identity=97%"; Hit description=Like -Sm ribonucleoprotein-related, core
  Pfam annotation: Domain name=LSM; Domain location=116-181; Score =95.7; E_value=1.4e-25; Accession=PF01423.12; Description=LSM domain
  Subcellular localization annotation: CTP_CleavageSite=34; ConfidenceScore=5.53e-01
MGSPNKTGIISQTPSSLWVLRYKTLITASSSVIVSSSRFQRFRSRIAFYNGREYLLLALPELNYLPFYFIHLIILAATYKPVYYADISVATYFLCGGGGGGFIYWNYVTIPVNPKPFLNNLTGKPVIVKLKWGMEYKGYLVSVDSYMNLQLANTEEYIEGQFTGNLGEILIRCNNVLYLRGVPEDEEIEDVAED

SEQ ID NO: 182157 - protein, 72 aa, Glycine max
  Coding DNA Sequence Number=SeqID_65379
MVGTNEKEKKKHNLKRCRLWRCQGRGDGLCRCLDDVQQHQGKYNNVKMCREDKRKGETRDGLGQSKGRVRGS

SEQ ID NO: 182158 - protein, 660 aa, Glycine max
  Coding DNA Sequence Number=SeqID_65380
  Gene Ontology: Mol. function=protein serine/threonine kinase activity; Cellular component=integral to membrane; Biological process=protein amino acid phosphorylation
  Homolog annotation: Hit_ID=O04086; Match level="QueryCoverage=84%, HitCoverage=85%, E-value=0.0, Identity=63%"; Hit description=Ser/Thr protein kinase isolog; 46094-44217
  Pfam annotation: Domain name=Pkinase; Domain location=214-511; Score =143.6; E_value=5.5e-40; Accession=PF00069.15; Description=Protein kinase domain
  Pfam annotation: Domain name=Pkinase_Tyr; Domain location=214-511; Score=78.8; E_value=1.7e-20; Accession=PF07714.7; Description =Protein tyrosine kinase
  Pfam module annotation: Pfam domain module=Pkinase::Pkinase_Tyr; Domain location=214-511::214-511
CIKDFQSKLSSLSLPNNLVDTCFDPLQFVISPNICAGIQTIPDWTKKVGQSTPLNTACRSDLTDISLCDVCLQAGLQVKQKLISIDGNASHSIDCFYFAILYAAGIVNEFGPESNGAVSCIFSISVYSQGGSGGKRHQALVFGLTGAGVALLVMSSFLGMYSWYDRKHRRKKLETFNQFDFDPEEQGGSRPRLRPNTGSIWFKIEELEKATDNFSSKNFIGRGGFGMVFKGTLSDGTVVAVKRILESDFQGNAEFCNEVEIISNLKHRNLVPLRGCCVAEEDENCDERGSSQRYLVYDYMPNGNLEDHIFLSSTEDSQKSKGLSLTWPQRKSIILDVAKGLAYLHYGVKPAIFHRDIKATNILLDSDMRARVADFGLAKQSREGQSHLTTRVAGTHGYLAPEYALYGQLTEKSDVYSFGVVVLEIMCGRKALDLSSSGSPRAFLITDWAWSLVKAGKIEEALDGSLVKDKDESFPSSNPKSIMERFLLVGILCSHVMVALRPTIADALKMLEGDIEVPQIPDRPMPLGHPSSFYNNDHGSTFSISPALSGPKLQTGDMLRKQKEVEAVFILKSDKGPVKSCLVTPPLHLSIFNYKPNLPCVTLQINFLPPTALKISRSKLAVTDCRTDLVCVNKVYAVLCCNPNHEENYQGMTITSYQGS

SEQ ID NO: 182159 - protein, 78 aa, Glycine max
  Coding DNA Sequence Number=SeqID_65381
MTDNLPQPSKVATFLKLKIIVDGICGLLAGIRAFDTIQILFYLERFLVSSIDIKEHDLVMPVILVCLDRCPTSKNVII

SEQ ID NO: 182160 - protein, 762 aa, Glycine max
  Coding DNA Sequence Number=SeqID_65382
  Gene Ontology: Mol. function=voltage-gated potassium channel activity; Cellular component=integral to membrane; Biological process=potassium ion transport
  Homolog annotation: Hit_ID=O24538; Match level="QueryCoverage=95%, HitCoverage=94%, E-value=0.0, Identity=70%"; Hit description =Potassium channel
  Pfam annotation: Domain name=Ank; Domain location=509-541; Score=2.5; E_value=13; Accession=PF00023.20; Description=Ankyrin repeat
  Pfam annotation: Domain name=Ank; Domain location=542-574; Score =37.2; E_value=5.7e-08; Accession=PF00023.20; Description=Ankyrin repeat
  Pfam annotation: Domain name=Ank; Domain location=575-609; Score =15.6; E_value=0.17; Accession=PF00023.20; Description=Ankyrin repeat
  Pfam annotation: Domain name=Ank; Domain location=610-638; Score=2.0; E_value=16; Accession=PF00023.20; Description=Ankyrin repeat
  Pfam annotation: Domain name=Ank; Domain location=639-671; Score =20.6; E_value=0.0058; Accession=PF00023.20; Description=Ankyrin repeat
  Pfam annotation: Domain name=Ion_trans; Domain location=115-266; Score=23.7; E_value=0.00062; Accession=PF00520.21; Description=Ion transport protein
  Pfam annotation: Domain name=Ion_trans_2; Domain location=175-272; Score=55.8; E_value=1.4e-13; Accession=PF07885.6; Description=Ion channel
  Pfam annotation: Domain name=cNMP_binding; Domain location=385-474; Score=63.0; E_value=1e-15; Accession=PF00027.19; Description=Cyclic nucleotide-binding domain
  Pfam module annotation: Pfam domain module=Ank::Ank::Ank::Ank::Ank::Io n_trans::Ion_trans_2::cNMP_binding; Domain location=509-541::542 -574::575-609::610-638::639-671::115-266::175-272::385-474
MEGMNFSSYNPQLASSLKKSYSKQEHDHSVERNHLNEEDHMSPSFNLRNISKLILPPLGVSSQNPVNSKGWIISPMDSRYRCWESFMVLLVAYSAWVYPFEVAFMHKSSNKEIYIVDTVVDLFFGIDIVLTFFVAYIDRTTHLLVRDKKKIVVRKWASHTSSWACSDFGESDGSSNTSQVHCAGCLYYMLADRYPHQGKTWIGAVNPNFRETSLRIRYISAMYWSITTMTTVGYGDLHAVNTIEMIFIIFYMLFNLGLTAYLIGNMTNLVVEGTRRTMEFELYAIVTNVSCSFMVLSVQRNSIEAASNFVCRNRLPPRLKEQILAYMCLRFKAESLNQHQLIEQLPKSICKSICQHLFFATVEKVYLFKGVSKEIILSLVAKMKAEYIPPREDVIMQNEAPDDVYIIVSGEVEILDTETEKERILGTLHTGEMFGEFGALCCRPQSLTYRTKTLTQLLRLKTNTLLEAMQIKREDNIQILKNFLQHFKQVKDLSIKDLMVENVEEEDPNMAVNLLTVASTGNAAFLEELLRAGLDPDIGDSKGKTPLHIAASNGHEGCVKVLLKHACNMHIKDMNGNTALWDAIASKHYSIFRILFQLSALSDPNIAGDLMCTAAKRNELTVMTDLLRQGLNVDSKDHRDTTAIQIAMAENHVDMVQLLVMNGADVSDVHNHEFCSSTLNEMLQKREIGHLINVTEVMLSEVVLKGRHQEQEHNGGRSNSGLKFPRVSIYRGHPVVRREKCSMEAGKLIRLPDSIEELKTIA

SEQ ID NO: 182161 - protein, 218 aa, Glycine max
  Coding DNA Sequence Number=SeqID_65383
  Homolog annotation: Hit_ID=Q1S717; Match level="QueryCoverage=98%, HitCoverage=29%, E-value=2e-16, Identity=27%"; Hit description =Ovarian tumour, otubain
MAFAITFAYLDGEDINNVVWALERFRGVFMRHDAIPQVIVTNKDSTLMNAMKIVFLEATNLLCRVESAHWALKKLLHNNLGDPCSVWEAMNNMITLQHTEIKASFETSTHVVEHVFKATLYKRLIGMISRYVLNQIAAEFERVNYVGIDSSRCGCITWSPMCMLSFLDQDLSTLEVCITEEMKSISKWFEDLDICDKVTLKSKLQKIAYPDLNSMCSS

SEQ ID NO: 182162 - protein, 504 aa, Glycine max
  Coding DNA Sequence Number=SeqID_65384
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q1WAB6; Match level="QueryCoverage=99%, HitCoverage=100%, E-value=0.0, Identity=80%"; Hit description =Lycopene beta-cyclase
  Pfam annotation: Domain name=DAO; Domain location=89-376; Score=-9.3; E_value=2e-05; Accession=PF01266.14; Description=FAD dependent oxidoreductase
  Pfam annotation: Domain name=Lycopene_cycl; Domain location=89-482; Score=675.1; E_value=5.3e-200; Accession=PF05834.3; Description =Lycopene cyclase protein
  Pfam annotation: Domain name=Thi4; Domain location=75-287; Score= -132.0; E_value=0.022; Accession=PF01946.7; Description=Thi4 family
  Pfam module annotation: Pfam domain module=DAO::Lycopene_cycl::Thi4; Domain location=89-376::89-482::75-287
MDTLLKTPNKLEFLHPLHGYSEKFSNSCSSRVQNQDFRFGSKKPIVRWGKCGNLRASSSALLELVPEFKKENLDFELPLYDSSKGAVVDLAVVGGGPAGLAVAQQVSEAGLSVCAIDPNPRLIWPNNYGVWVDEFEAMDLLDCLDTTWSGAVVFIDDKTKKDLDRPYGRVNRKLLKSKMLQKCISNGVKFHQAKVIKVIHEETKSLLICNDGVTIQATVVLDATGFSRCLVQYDKLYNPGYQVAYGILAEVDEHPFDVDKMLFMDWRDSHLNNDMELKQRNCRIPTFLYAMPFSSTKIFLEETSLVARPGLRMDDIQERMVARLKHLGIRVKSIEEDEQCVIPMGGPLPVLPQRVVGIGGTAGMVHPSTGYMVARTLAAAPIVANSIVQCLGSDRGFSGGETSAQVWKDLWPIQRRRQREFFCFGMDILLKLDLPGTRRFFDAFFDLEPHYWHGFLSSRLFLPELIFFGLSLFSYASNTSRIEIMAKGTLPLVNMINNLVKDTE

SEQ ID NO: 182163 - protein, 125 aa, Glycine max
  Coding DNA Sequence Number=SeqID_65385
  Homolog annotation: Hit_ID=Q2HVA5; Match level="QueryCoverage=37%, HitCoverage=16%, E-value=3e-09, Identity=66%"; Hit description=HAT dimerisation
MYIVYPMIYLLVKLALILPMEIAIEKCVSAMNFVKNGMWNCMGDEWLNVHVPTPIPIQNLHKSTKGKREEGSTYLRDGGKVAMVVEILLNKSGDDEALDTMDDVIDMKYIDKVDGSLAKGLRGQM

SEQ ID NO: 182164 - protein, 213 aa, Glycine max
  Coding DNA Sequence Number=SeqID_65386
MDQASRGVVSDSLTFELLSLAINLAYIKKNCWNLDDPSVTFPGTRKARARGSEGPSSSAPPASTAPAPSPPSYAQSPDIIVAMLQSLHHGLYLVMQSIHALAQHRPIISMEEFASQEPQPEPEAAQEADTDVDPEADLEIPEPEILETDPATQEDVVEATPDTTPQPSPVTTPVLELTSPQASPVGTPVLELSEDEDDVTTMDFSPSAPQDPP

SEQ ID NO: 182165 - protein, 211 aa, Glycine max
  Coding DNA Sequence Number=SeqID_65387
  Gene Ontology: Mol. function=binding
  Homolog annotation: Hit_ID=Q10L89; Match level="QueryCoverage=99%, HitCoverage=96%, E-value=2e-47, Identity=49%"; Hit description =Tetratricopeptide repeat protein 11, putative, expressed
  Pfam annotation: Domain name=TPR_2; Domain location=120-153; Score =24.4; E_value=0.0004; Accession=PF07719.7; Description =Tetratricopeptide repeat
MDAKFGSLFETIGNFFTGGEQIPWCDRDVIAGCEREVAEAANGDSEERKNESIMRLSWALVHSRQKEDIQRGIAMLEITDSLEMLMLLSSGNWHYDHSLFPSFYCFPSSLGNDKSPLHQREKLYLLAVGYYRSNDYGRSRQLVEQCLEIAPDWRQALSLKKIVEDRIAKALTKELQMFVVSMPDGVIGIGITATAVGLIVGGIATALARRS

SEQ ID NO: 182166 - protein, 188 aa, Glycine max
  Coding DNA Sequence Number=SeqID_65388
  Gene Ontology: Mol. function=DNA-directed RNA polymerase activity; Biological process=transcription
  Homolog annotation: Hit_ID=Q9LKX4; Match level="QueryCoverage=69%, HitCoverage=58%, E-value=7e-36, Identity=53%"; Hit description=RPB5d
  Pfam annotation: Domain name=RNA_pol_Rpb5_N; Domain location=45-135; Score=78.1; E_value=2.8e-20; Accession=PF03871.5; Description=RNA polymerase Rpb5, N-terminal domain
MLVFYNNRSGRAALTAENGLLEWVRVGGEEEEEEEEAKGCLSKFVDDGIVESHRYYLSRTTTLEMLKNRGYSIPSHEIDLSLSDFHDMHGQSPDPDRLRLSLTHATNSSKRILVIFCEPGVVKVTAIQNIAGQIINRDTLTGLMLIVENHITSQALKAVNLFSFKVEIFQVFVSDISWCLSNIQFGYA

SEQ ID NO: 182167 - protein, 625 aa, Glycine max
  Coding DNA Sequence Number=SeqID_65389
  Gene Ontology: Mol. function=glycine hydroxymethyltransferase activity; Cellular component=vacuole; Biological process=L-serine metabolic process
  Homolog annotation: Hit_ID=Q75HP7; Match level="QueryCoverage=86%, HitCoverage=81%, E-value=0.0, Identity=65%"; Hit description =Putative hydroxymethyltransferase
  Pfam annotation: Domain name=SHMT; Domain location=109-573; Score =703.1; E_value=2e-208; Accession=PF00464.10; Description=Serine hydroxymethyltransferase
  Subcellular localization annotation: CTP_CleavageSite=15; ConfidenceScore=5.00e-01
MDLSHPQSNLSLGFSSSHASPPRRSDPPVPLQLMEPQTENGNNLDVESDDDDDDKEVEEFRILGHSMCLKRRRDCDSSSSSAAAAKRVSVEPDLDARKAAVRAWGCQPLSIADPDIHEIMEKEKKRQFCGIELIASENFVCRAVMEALGSHLTNKYSEGMPGSRYYGGNQYIDEIETLCCERALNAFGLDPKCWGVNVQPYSCTSANFSVYTGLLLPGDRIMGLDTPSGGNTSHGYYTPNGKKVSGASIFFESLPYKVNPQTGYIDYDKLEERALDFRPKILICGGSSYPREWDYARFRHIADKCGAVLLCDMAQISGIIAAKECVNPFDYCDIVTSTTHKSLRGPRGGIIFYRKGTKPRNRGILLSQGHESDQYDFEEKINFAVFPSMQGGPHNNHIAALAIALKQVATPEYKAYMQQVKKNAQALACALLRRKCRLVTGGTDNHLILWDLRPLGLTDGHMDFYRKNRGFLGFPPKRPRCDPVAGHVLYRDKTFALSLCLNPIVQAGQSMNFFLVYGKFYEKVCETCHITLNKIAIFGDNGTIIPGGVRVGTPAMTSRGCLEADFETMAEFLIRAAQIASILQREHGKLQKTTLKGLESHRDIVELRARVEAFATQFAMPGFDI

SEQ ID NO: 182168 - protein, 105 aa, Glycine max
  Coding DNA Sequence Number=SeqID_65390
MSMSVLYRWRLQCSLILPQCNRKTCWKLIISRLMSEADVQSWSPPVNGTLKCNCEATIFKEHQSFGVSMCLRDSNDCKTLHDNLQSGTKGSSDFYRILAESKCYF

SEQ ID NO: 182169 - protein, 429 aa, Glycine max
  Coding DNA Sequence Number=SeqID_65391
  Gene Ontology: Mol. function=protein phosphatase type 2C activity; Cellular component=nucleus; Biological process=protein amino acid dephosphorylation
  Homolog annotation: Hit_ID=Q1S458; Match level="QueryCoverage=78%, HitCoverage=68%, E-value=1e-128, Identity=67%"; Hit description =Protein phosphatase 2C-like
  Pfam annotation: Domain name=PP2C; Domain location=70-370; Score =137.8; E_value=2.9e-38; Accession=PF00481.12; Description=Protein phosphatase 2C
MMIVAGGGGAESGIGNGIVHLGGWSWWKSPPLLPFSPESNMDGGKRRRLRGSSSFDFKVPGRMFLNGSSEVASMYCKQGRKGINQDAMLVWENFCSKEDTIFCGVFDGHGPYGHRVAKKVRDSFPLKLNAQWDLHHKNRDGLSDHSSATGSYKSEGNGFRLVDEKTSPTDHELDETDTILTLRESFLKACKIMDKELKHHPDIDCFCSGTTAVTLVKQGLNLVIGNVGDSRAVLGTRDHEDSLIAVQLTVDLKPNLPREEERIKLRRGRVFSLQNEPDVARVWLPNSDFPGLAMARAFGDFCLKDFGLIAVPDISYHRLTEKDEFVVLATDGIWDVLSNEEVVDIVASASQSTAARALVESAVRAWKTKFPFCKVDDCAAVCLFFDSDLDFKSTDTKDKLIPEASIDQSEQLALLGEKGVGNEAEKKQQ

SEQ ID NO: 182170 - protein, 161 aa, Glycine max
  Coding DNA Sequence Number=SeqID_65392
MEKGKEPIVSHEDLLALVVEDSDTEQDSQCYEDLLGMIVEDSLESEHVNSNMLLPKMIESSNAALSSSAAKMVEVSSVASSSSVAKMIEGSSVASSSSVAKMIEGSSVASSSSASSSVSNEVLLFNLNKFPEDECKDDTEEEKEKKLVERALLKIYFPDYY

SEQ ID NO: 182171 - protein, 403 aa, Glycine max
  Coding DNA Sequence Number=SeqID_65393
  Gene Ontology: Mol. function=chromatin binding; Cellular component =chromatin; Biological process=chromatin assembly or disassembly
  Homolog annotation: Hit_ID=Q1SAV4; Match level="QueryCoverage=87%, HitCoverage=92%, E-value=1e-106, Identity=53%"; Hit description =Integrase, catalytic region
  Pfam annotation: Domain name=Chromo; Domain location=306-351; Score =19.7; E_value=0.0046; Accession=PF00385.14; Description='chromo' (CHRromatin Organisation MOdifier
  Pfam annotation: Domain name=rve; Domain location=10-166; Score =102.7; E_value=1.1e-27; Accession=PF00665.16; Description=Integrase core domain
  Pfam module annotation: Pfam domain module=Chromo::rve; Domain location=306-351::10-166
MAGLLCPLPVPSRSWEDLSLDFITGLPVYQGHTVILVVVNRFSKGVHLGMLPTAHTALAVASLFVNIVVKLHGIPRSLVSDRDPLFISRFWQELFRRSGTQLRMSTAYHPQSDGQTEVLNRTIEQYLRSFVHRRPSSWGKYLPWAEWSHNTSWNSATRTTPYELTFGKKPFNFPEYIAGSSTVDVVDNLLQDRDETFQMVRRKLLKAQSRMKEQADRRRSDVNYNSGDWTSAKGSQSSSGKLARRYYGPFRVIEAIGKVAHHLQLPPDTKIHEVFHYSLLKPFRGQLETTSPAPLPDQFHNDQPIITPAAIVDYRRTPSDAWEVLVQWHGLSPDDTSWEDWSTLCHDYHLEDKVISQGPRDDRETTDHRAGVQIEYSAEVQADHTKVQIEEKPKRRIMRPTYL

SEQ ID NO: 182172 - protein, 63 aa, Glycine max
  Coding DNA Sequence Number=SeqID_65394
MEIALSRQHIPLSWGYDENNGKNQMYYVQHCPFKEMRNLREIQPETKGDDPLCQNSGQKRHDN

SEQ ID NO: 182173 - protein, 82 aa, Glycine max
  Coding DNA Sequence Number=SeqID_65395
MGTMLKLEMKGFLREIMDLHVEMFIRLQRLESLECIRGLKGSNLQVEKAHNLEELLKEATEGLLQLGKKNWFKLKKLRIGRY

SEQ ID NO: 182174 - protein, 466 aa, Glycine max
  Coding DNA Sequence Number=SeqID_65396
  Gene Ontology: Mol. function=serine carboxypeptidase activity; Cellular component=cellulose and pectin-containing cell wall; Biological process=proteolysis
  Homolog annotation: Hit_ID=Q93Y09; Match level="QueryCoverage=93%, HitCoverage=93%, E-value=0.0, Identity=76%"; Hit description=Serine carboxypeptidase II, putative
  Pfam annotation: Domain name=Peptidase_S10; Domain location=36-459; Score=593.5; E_value=1.9e-175; Accession=PF00450.12; Description =Serine carboxypeptidase
MCSLLWSSIALCVALLLLQLGIVHPSPSHHRITRLPGQPHVQFHQFSGYVTVDDKNQRALFFYFAEAEKDALSKPLVLWLNGGAPQSLLVSFHTWPGCSSLGVGAFSENGPFRPKGEGLVRNQFSWNKEANMLYLETPIGVGFSYSTDTSSYEAGDNLVFLQNWFMKFPEYRNRSLFIVGESYAGHYVPQLAELMLRFNRKEKLFNLKGIALGNPVLEFATDFNSRAEFFWSHGLISDTTYKMFTSVCNYSTYVREYYNGAVSPICSSVMSQVSTETSRFVDKYDVTLDVCLSSVFSQTKVLNPQQVTETIDVCVEDETVNYLNRKDVQSALHAHLVGVQRWSACSNVLDYELRDLEIPTITVVGKLVKEGIPVLVYSGDQDSVIPLTGSRTLVHKLAKELGLNTTVPYRVWFEKQQVGGWTQVYGNILSFATIRGASHEAPFSQPERSLVLFKSFLEGGPLPQEI

SEQ ID NO: 182175 - protein, 111 aa, Glycine max
  Coding DNA Sequence Number=SeqID_65397
  Gene Ontology: Mol. function=protein kinase activity; Biological process=protein amino acid phosphorylation
  Homolog annotation: Hit_ID=Q9LYU7; Match level="QueryCoverage=91%, HitCoverage=25%, E-value=1e-35, Identity=72%"; Hit description =Protein kinase-like
MALHIWVCRYTDKSDIFSFGMILGVLLTGKDPTDPFFGEAASGGSLGCWLRHLQQAGEAHEALDKSMLGEEGEEDEMLMAVRIAAACLSDMPADRPSSDELVHMLTQLHSF

SEQ ID NO: 182176 - protein, 262 aa, Glycine max
  Coding DNA Sequence Number=SeqID_65398
MEEEQTHIMKDSDDMESQEEEEEEREEALSLCDLPLNRNSRTPSLDDMSFKKILRPSSLPDHAGEIFNGFSSSSSSDMCPADDIIFCGKLVPFKAEQPLKNLIAAEEEKSPARRRRSESLSSVTRSNSVSTFTGSRHLMMRNSKSLDYSRLRESAAPEVDRNSSSRSVVPPEAAVKKATKPRWYSLMFGTMKIPPEMELSDMKNRQVRRNPSSTMFLTADSGGKMAVNRSHGKVSWRILKALSCKDHSSVAVTTSFPLPQAS

SEQ ID NO: 182177 - protein, 369 aa, Glycine max
  Coding DNA Sequence Number=SeqID_65399
MVPSQNGKQQQNINRSAMNQVIEVEGGYNCLLGSDFVARRHIMAEAEESSRHNNNTNEEAEVGACGSISKEEEEEEDEEEANNNSNNNNNSNWLQLSIGLTSTKQERDTRTVVPTTTTTSSGLVELDLLPLRRSSEQQQQQPPPPAVFPVMASGRGGGSSSSLLFEQHHRTTSYSSSSSMSTMMSMASGPITSTFGHQEMMNWAFGPLLPQYSMPIMPSSSSFTPLPIPSSSSSSQTCYSSLRPHPLGSYFPTVPFHHHFPSSSSSGFDQYDVAAGPGPSSDNNVTVRVVDPPRRPHSGIWFMLQASPNQAREPFLPQIPKNYLRIKDGRMTVRLLLKYLVSKLRLESESEYIARDMIFHRCSLGHAPC

SEQ ID NO: 182178 - protein, 1237 aa, Glycine max
  Coding DNA Sequence Number=SeqID_65400
  Gene Ontology: Mol. function=phosphoprotein phosphatase activity; Cellular component=intracellular
  Homolog annotation: Hit_ID=Q8LL04; Match level="QueryCoverage=99%, HitCoverage=97%, E-value=0.0, Identity=44%"; Hit description=CTD phosphatase-like 3
  Pfam annotation: Domain name=BRCT; Domain location=1142-1222; Score =43.6; E_value=6.8e-10; Accession=PF00533.16; Description=BRCA1 C Terminus (BRCT) domain
  Pfam annotation: Domain name=NIF; Domain location=915-1141; Score =40.7; E_value=6.3e-11; Accession=PF03031.8; Description=NLI interacting factor-like phosphatase
  Pfam module annotation: Pfam domain module=BRCT::NIF; Domain location= 1142-1222::915-1141
MGKEVEDVEEGEISDTASVEEISAEDFNKQDVKVLNNNNKPNGSDARVWAVHDLYSKYPTICRGYASGLYNLAWAQAVQNKPLNDIFVMEVDSDANANSNSNNSNRLASVAVNPKDVVVVDVDKEEGELEEGEIDADAEPEGEAESVVAVPVVSDSEKLDDVKRDVSNSEQLGVRGVLEGVTVANVAESFAQTCSKLQNALPEVLSRPADSERDDLVRLSFNATEVVFCSMDSLKKEQNKDSILRLLSFVKDQQQAQLFSPEHIKEIQGMMTAIDYFGALVNSEAIGKEKELQTTVQTHEIKTQENQAVEAAELISYNKPLHSDIIGASHALKFGQNSIKGRGVLLPLLDLHKDHDADSLPSPTREAPSCFPVNKLLSVGEPMVSSGSAAAKPESGKMELDSEGSKFHLYETDALKAVSTYQQKFGRSSLFTNDKFPSPTPSGDCEDEIVDTNEEVSSASTGDFLTSTKPTLLDLPPVSATSTDRSSLHGFISSRVDAAGPGSLPVKSSAKNRDPRLRFVNSDASAVDNPSTLIHNMPKVEYAGTTISRKQKAAEEPSLDVTVSKRQKSPLENTEHNMSEVRTGIGGWLEEHTGPGAQFIERNHLMDKFGPEPQKTLNTVSSSCTGSDNFNATSIRNEQAPITSSNVLASLPALLKGAAVNPTMLVNLLRIAEAQKKSADSATNMLLHPTSSNSAMGTDSTASIGSSMATGLLQSSVGMLPVSSQSTSMTQTLQDDSGKIRMKPRDPRRILHTNNTIQKSGNLGNEQFKAIVSPVSNNQGTGDNVNAQKLEGRVDSKLVPTQPSAQPDIARQFARNLKNIADIMSVSQESSTHTPVAQIFSSASVPLTSDRGEQKSVVSNSQNLEAGMVSAHETAASGTCRSQNTWGDVEHLFEGYDEQQKAAIQRERARRIEEQNKMFAARKLCLVLDLDHTLLNSAKFVEVDPVHDEILRKKEEQDREKPHRHLFRFPHMGMWTKLRPGIWNFLEKASKLYELHLYTMGNKLYATEMAKVLDPKGLLFAGRVISRGDDTDSVDGEERAPKSKDLEGVLGMESSVVIIDDSVRVWPHNKLNLIVVERYTYFPCSRRQFGLPGPSLLEIDHDERPEAGTLASSLAVIEKIHQIFFASRSLEEVDVRNILASEQRKILAGCRIVFSRVFPVGEANPHLHPLWQTAEQFGAFCTNQIDEQVTHVVANSPGTDKVNWALNNGRFVVHPGWVEASALLYRRANEQDFAIKP

SEQ ID NO: 182179 - protein, 308 aa, Glycine max
  Coding DNA Sequence Number=SeqID_65401
  Gene Ontology: Mol. function=protein kinase activity; Cellular component=integral to membrane; Biological process=protein amino acid phosphorylation
  Homolog annotation: Hit_ID=Q9LYU7; Match level="QueryCoverage=74%, HitCoverage=57%, E-value=8e-79, Identity=64%"; Hit description =Protein kinase-like
  Pfam annotation: Domain name=Pkinase; Domain location=129-306; Score=- 72.1; E_value=0.00029; Accession=PF00069.15; Description=Protein kinase domain
  Pfam annotation: Domain name=Pkinase_Tyr; Domain location=129-304; Score=-123.1; E_value=6.5e-05; Accession=PF07714.7; Description =Protein tyrosine kinase
  Pfam module annotation: Pfam domain module=Pkinase::Pkinase_Tyr; Domain location=129-306::129-304
  Subcellular localization annotation: CTP_CleavageSite=4; ConfidenceScore=5.05e-01
MGVLSMKRHTLSSLARELLAFQPLFLLFLFSLHHNTMQCQGRLSKHVSSEPPSPSRSTPSPPSSSGYKDDPRKIILSMVLGAVTGLVSSALFALVVRCVVQYLNRTPILKGPVIFSPKIAPMTLQSALAKENHLLGSSPNGKYYKTVLDNGLTIAVKRLTPFESNSPEAKRKSVKRQIQTELELLASLRHRNLMSLRAYVREPDGFSLVYDYVSTGSLADVLSKVRENELPFGWEVRLRIAVGVVKGLQYLHFTCVPQILHYNLKPTNVMLDAEFEPRLADYGLAKLLPNLDGGSSLYTPPECFHNCR

SEQ ID NO: 182180 - protein, 62 aa, Glycine max
  Coding DNA Sequence Number=SeqID_65402
MTEIGGMFGSDDFRETISSPSRWYGEIVCCVVVSLKDGGWSGVAGGEKRRWRRNCDGISGRR

SEQ ID NO: 182181 - protein, 629 aa, Glycine max
  Coding DNA Sequence Number=SeqID_65403
  Gene Ontology: Mol. function=thiamin-phosphate diphosphorylase activity; Biological process=thiamin biosynthetic process
  Homolog annotation: Hit_ID=Q2UVH9; Match level="QueryCoverage=90%, HitCoverage=88%, E-value=1e-152, Identity=53%"; Hit description =Phosphomethylpyrimidine kinase/thiamin-phosphate pyrophosphorylase
  Pfam annotation: Domain name=Phos_pyr_kin; Domain location=65-402; Score=306.7; E_value=4.3e-89; Accession=PF08543.2; Description =Phosphomethylpyrimidine kinase
  Pfam annotation: Domain name=TMP-TENI; Domain location=426-611; Score= 317.8; E_value=1.9e-92; Accession=PF02581.7; Description=Thiamine monophosphate synthaseTENI
  Pfam module annotation: Pfam domain module=Phos_pyr_kin::TMP-TENI; Domain location=65-402::426-611
  Subcellular localization annotation: CTP_CleavageSite=42; ConfidenceScore=5.38e-01
MATQLLCMCCGAQPQPQPQAAPFMRFPFWNSVHPKNPTSVVRVQAEAADMNMNSIPHVLSVAGSDSGGGAGIQADLKTCAARRVYCSTVITAVTAQNTAGVQGLNILPEDFVADQLHSVLSDMHVHVVKTGMLPSLNIVKVLCQTLRKFPIKVTSMLSSSWLKAALVVDPVMISTSGDVLVGPSVLAGFLEELLPMTDIVTPNIKEASVLLGGVPLKSVSDMRTAAKLIHDLGPRNVLVKGGDLPNSLDAIDVFFDGMAMGPEPVGPAPILTGETRVDRGRIFPDSQSRHVGGGGGSGTRKIRPRQGRGEWGVEGRGGVSKIWSRPVPLPCLCEEFYELCSPRVNTRNSHGTGCTLASCIAAELAKGSSMLSAVKTAKHFIEAALDYSRDMTIGNGAQGPFDHFLALNINQSSCRLNRFNPNDLLLYAVTDSAMNRKWGRSIAEAVKAAVEGGATIVQLREKDAETRDFLEAAKVCLEICHSYGVPLLINDRIDVALACDADGVHVGQSDMPARLARTLLGPEKIIGVSCKTPEQAHQAWIDGADYIGCGGVYPTNTKANNRTIGLEGLKEVCLASTLPVVAIGGIGLSNAREVMKLGAPNLNGVAVVSALFDRECILTETRNLHALVS

SEQ ID NO: 182182 - protein, 141 aa, Glycine max
  Coding DNA Sequence Number=SeqID_65404
  Gene Ontology: Mol. function=binding; Cellular component=integral to membrane
  Homolog annotation: Hit_ID=Q1SWN1; Match level="QueryCoverage=60%, HitCoverage=14%, E-value=5e-34, Identity=75%"; Hit description =Nonaspanin
MSMLFRFSLLLPLFLSTAFASESDHRYQQDDPVILWVNKVGPYNNPQETYNYYSLPFCRSPGNPAHKWGGLGEVLGGNELIDSQLEIKFLGNVEKTTFCRIELDEAKDIALNSGLAAQSTAVTCWIQPKTSFIQGYAPGSG

SEQ ID NO: 182183 - protein, 206 aa, Glycine max
  Coding DNA Sequence Number=SeqID_65405
  Gene Ontology: Mol. function=prenyltransferase activity; Cellular component=integral to membrane
  Homolog annotation: Hit_ID=Q647J9; Match level="QueryCoverage=87%, HitCoverage=45%, E-value=5e-44, Identity=49%"; Hit description =Homogentisate phytylprenyltransferase
MEYNLLRFQQSSLNHHYKCIEGGSAYQEWNKKYVVKATSKPSFDSGLPTSNSKNMLDSVKNFLAAFYLFCYPYVMIGRALVPYTFLDVYINGLNQLSDIEIDKINKPYLPLASGQLSFRTGVIIAGSSLILVPYKTIHFTTIFFKMNFIDKSFWLGWIIGSWPLIWSLVMCFSLWTAYSINVMEGSHGAIVGFAIMGPRSYWFNWS

SEQ ID NO: 182184 - protein, 818 aa, Glycine max
  Coding DNA Sequence Number=SeqID_65406
  Gene Ontology: Mol. function=protein binding; Cellular component =cytoplasm; Biological process=regulation of GTPase activity
  Homolog annotation: Hit_ID=Q5W7F2; Match level="QueryCoverage=99%, HitCoverage=94%, E-value=0.0, Identity=68%"; Hit description=ARF-GAP
  Pfam annotation: Domain name=Ank; Domain location=724-756; Score =43.8; E_value=5.7e-10; Accession=PF00023.20; Description=Ankyrin repeat
  Pfam annotation: Domain name=Ank; Domain location=757-789; Score =33.1; E_value=9.8e-07; Accession=PF00023.20; Description=Ankyrin repeat
  Pfam annotation: Domain name=ArfGap; Domain location=495-640; Score =162.9; E_value=8.2e-46; Accession=PF01412.9; Description=Putative GTPase activating protein for Arf
  Pfam annotation: Domain name=PH; Domain location=288-423; Score=70.1; E_value=7e-18; Accession=PF00169.19; Description=PH domain
  Pfam module annotation: Pfam domain module=Ank::Ank::ArfGap::PH; Domain location=724-756::757-789::495-640::288-423
EGLGEAYDGDIAFASALETFGGGHNDPISVAFGGMLPFYINLMMVDERFSVPPGPVMTKFTIALREIGTYKEVLRSQVEHMLNDRLLQFVNIDLQEVKEARKRFDKASLIYDQTRERFLSLRKGTKTGVATALEEVGPCVSYVFVQLRFTLELHSARSTFEQARFNLVTALSNVEAKKRFEFLEAVSGTMDAHLRYFKQGYELLHQMEPYINQVLTYAQQSRERSNYEQAALNERMQEYKRQIDRESRWASNGSNGSPNGDGIQAIGRSSHKMIEAVMQSAAKGKVQTIRQGYLSKRSSNLRGDWKRRFFVLDSRGMLYYYRKQCSKSSGSSSQHSGQRNSSELGSGLLSRWLSSHHHGGVHDEKSVAHHTVNLLTSTIKVDADQSDLRFCFRIISPTKNYTLQAESALDQMDWIEKITGVIASLLSSQIPDRMLPASPMGSGHHRSTSESSSFESSDFDHSAVEECAADRSFTSAYLERPSRSLQQQRSCTKSEKPIDVLRRVCGNDKCADCGAPEPDWASLNLGVLVCIECSGVHRNLGVHISKVRSLTLDVKVWEPSVISLFQSLGNTFANSVWEELLQSRSAFQVDLVPTGLSKSDKPMMFFITKPCQSDSLSVKEKFIHAKYAEKLFVRKPKDNQYRLLVAQQIWEAVHANDKKAVYRYIVNSDVDVNAVYEPTCSSSLTLAKVMLLQEQTSHDHSSTLAGNTLDWSSTKEGQVMDNLDGCTLLHLACETADIGMVELLLQYGANVNATDSRGQTPLHRCILKGRSTFARLLLSRGADPRAVDEQGRTPIELAAESNAGGDREVHAPSTDSNG

SEQ ID NO: 182185 - protein, 738 aa, Glycine max
  Coding DNA Sequence Number=SeqID_65407
  Gene Ontology: Mol. function=hydrolase activity; Cellular component =nucleoplasm; Biological process=mRNA polyadenylation
  Homolog annotation: Hit_ID=Q1SWM0; Match level="QueryCoverage=86%, HitCoverage=96%, E-value=0.0, Identity=80%"; Hit description=Beta -lactamase-like; RNA-metabolising metallo-beta-lactamase
  Pfam annotation: Domain name=Lactamase_B; Domain location=109-269; Score=49.3; E_value=1.3e-11; Accession=PF00753.17; Description =Metallo-beta-lactamase superfamily
  Pfam annotation: Domain name=RMMBL; Domain location=436-478; Score =65.4; E_value=1.9e-16; Accession=PF07521.2; Description=RNA -metabolising metallo-beta-lactamase
  Pfam module annotation: Pfam domain module=Lactamase_B::RMMBL; Domain location=109-269::436-478
MTWIHVCWFEKFYASLLSHAKFYPNRTWLVFNASLFKSYHKENLPKSGRVEKCQLEKDKEVEEDQGNDIVLNVRLRVMMDCGVKRRESVREEDDEVMIVTPLGAGNEVGRSCVYMSYKGKSILFDCGIHLGFSGMSALPYFDEIDPSTLDVLLITHFHLDHAASLPYFLEKTTFRGRSARSPSKICFLMNRTSIAPWIKLRCNTYFGTEGPLNSSHVLGAAMFMVDIAGVRVLYTGDYSREEDRHLRAAEIPQFSPDVCIIESTYGVQHHQPRHTREKRFTDVIHSTISQGGRVLIPAYALGRAQELLLILDEYWANHPELHNIPIYYASPLAKKCLTVYETYTLSMNDRVQNAKSNPFSFKHISALSSIEVFKDVGPSVVMASPGGLQSGLSRQLFDKWCSDKKNTCVLPGFVVEGTLAKTIMTEPKEVTLMNGLSAPLNMQVHYISFSAHADSAQTSAFLEELNPPNIILVHGEANQMGRLKQKLTSQFADRNTKILTPKNCQSVEMHFNSQKMAKTIGRLAEKTPEVGETVSGLLVKKGFTYQIMAPDDLHVFSQLSTTNITQRITVPYSGAFSFIQHRLKRIYESVEQSVDEESGVPELQVHECVTVKHEAEKHISLHWTSDPISDMVSDSIVALILNINRDVPKIMAESDVIKIEEENKKKAEKVMHALLVSLFGDVKAGENGKLIINIDGNVAVLNKESGEVESENEGLKERVRAAFQRIQSSVKPIPLSAP

SEQ ID NO: 182186 - protein, 494 aa, Glycine max
  Coding DNA Sequence Number=SeqID_65408
  Gene Ontology: Mol. function=calmodulin binding; Cellular component =integral to membrane; Biological process=cell death
  Homolog annotation: Hit_ID=Q1SWM9; Match level="QueryCoverage=99%, HitCoverage=100%, E-value=0.0, Identity=70%"; Hit description=Mlo -related protein
  Pfam annotation: Domain name=Mlo; Domain location=6-440; Score=589.4; E_value=3.3e-174; Accession=PF03094.6; Description=Mlo family
MAEVLQRGRSLAETPTYSVASVVTLMVFVCFLVERSIYRFGQWLKNTRRKALFASLEKIKEELMLLGLISLLLAQSARWISEICVNSSLFSSRFYICSEQDLGINENIMHQSSSSSSSSSFPQEINSGAFNQCGEGHEPFVSYEGLEQLHRFLFVLGITHVLYSCLAVGLAMSKIYSWRRWENQAAMATGGNLQGKKIKVMRRQTTFVFHHTSHPWSRSPILNWMLCFVRQFRSSIQKSDYLALRLGFITEHKLPLSYNFHQYMVRSMEDEFHGILGISWPLWIYAIVCIFVNIHGTKLQHVVSTLALEIMEQTGPSARTQVKPRDELFWFKKPDILLWVIQFVIFQNAFEMATFIWTLMGSRCKKALVTESVRESLHSWCKRVKHKSKHDSLHSHTARSVCSLESTIDERDEITVVSGTLTRSSSLESLNQITVTSVDQLNFETSSNNNPEKNSTKVAEYLSSESVYTNPPQPSHNRGEEAKAITLLDLFQKT

SEQ ID NO: 182187 - protein, 531 aa, Glycine max
  Coding DNA Sequence Number=SeqID_65409
  Gene Ontology: Mol. function=binding; Cellular component=integral to membrane; Biological process=phagocytosis
  Homolog annotation: Hit_ID=Q1RUQ0; Match level="QueryCoverage=75%, HitCoverage=68%, E-value=0.0, Identity=79%"; Hit description =Nonaspanin
  Pfam annotation: Domain name=EMP70; Domain location=1-358; Score =555.9; E_value=4e-164; Accession=PF02990.7; Description=Endomembrane protein 70
  Pfam annotation: Domain name=Fer2; Domain location=447-517; Score =77.2; E_value=5.3e-20; Accession=PF00111.17; Description=2Fe-2S iron- sulfur cluster binding domain
  Pfam annotation: Domain name=MFS_1; Domain location=36-386; Score= -45.8; E_value=0.04; Accession=PF07690.6; Description=Major Facilitator Superfamily
  Pfam module annotation: Pfam domain module=EMP70::Fer2::MFS_1; Domain location=1-358::447-517::36-386
MTYSVKWSPTNVTFGRRFDVYLDYPFFEHQIHWFSIFNSFMMVIFLTGLVSMILMRTLRNDYAKYAREDDDLETLERDVSEESGWKLVHGDVFRPPRSLVILSAVVGTGAQLALLVLLVILLAIIGMLYVGRGAIVTTFIVCYALTSFISGYVSGGMYSRNGGKNWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILTIVTVCVTIVGTYFLLNAENYHWQWTSFFSAASTAVYVYLYSVYYYYVKTKMSGFFQTSFYFGYTLMFCLGLGILCGAVGYLGSNLFVRRIYRNIKCPIDGLMSDSPTRFSYFFDGQVLSNIVTLEFGRTWRRVTAMASYKVKLITPEGEQEFECPDDVCILDQAEEKGLELPYSCRAGSCSVCAGKVEQSDGNFLDDDQIVAGFVLTRVAYPTSDVVVETHWEEELTA

SEQ ID NO: 182188 - protein, 175 aa, Glycine max
  Coding DNA Sequence Number=SeqID_65410
  Gene Ontology: Mol. function=transcription factor activity; Cellular component=nucleus; Biological process=regulation of transcription, DNA-dependent
  Homolog annotation: Hit_ID=Q1RZP2; Match level="QueryCoverage=97%, HitCoverage=85%, E-value=9e-43, Identity=52%"; Hit description =Pathogenesis-related transcriptional factor and ERF
  Pfam annotation: Domain name=AP2; Domain location=2-44; Score=47.3; E_ value=5.1e-11; Accession=PF00847.10; Description=AP2 domain
MDRKRRVWLGTFETAEAAARAYDQAAILMSGQNAKTNFPTQMNQPQGATTTTPCVDPFSSPNVLSEHLSRKLKRCCKDPSPSLTCLRLDADNSHIGVWQKGAGPHSDSNWIVRVEIGKKLHAEGESSSVSSSAAGGSPPKPSVGHGDGYGDEEDRIAMQMIDELLNWNHPCGSSN

SEQ ID NO: 182189 - protein, 93 aa, Glycine max
  Coding DNA Sequence Number=SeqID_65411
MRIHQRKREPTKVKGMQLSSDDSGMIKKGEEERLHALKSNKGKYELSSLVKSIKMKSKQVQLPSDDKTRKDGKSHIKETQQGEKDPRRILKEV

SEQ ID NO: 182190 - protein, 107 aa, Glycine max
  Coding DNA Sequence Number=SeqID_65412
  Gene Ontology: Mol. function=nucleic acid binding
  Homolog annotation: Hit_ID=Q10BX7; Match level="QueryCoverage=90%, HitCoverage=10%, E-value=1e-22, Identity=56%"; Hit description=RNA recognition motif family protein, expressed
MQMKKHLMSLKRRLRGIGFLKFKTVEATNTVISTASATSGMDILLNGRPLKVFKALDNKSADDKELQKAKNEVDDHRNLYMPKEGLIIEGTIGAEGVSASDMLKCQE

SEQ ID NO: 182191 - protein, 361 aa, Glycine max
  Coding DNA Sequence Number=SeqID_65413
  Gene Ontology: Mol. function=nucleic acid binding; Cellular component= beta-galactosidase complex; Biological process=DNA integration
  Homolog annotation: Hit_ID=Q1S4N1; Match level="QueryCoverage=99%, HitCoverage=28%, E-value=1e-133, Identity=63%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=RnaseH; Domain location=234-355; Score= -28.3; E_value=0.025; Accession=PF00075.14; Description=RNase H
  Pfam module annotation: Pfam domain module=RVT_2::RnaseH; Domain location=1-135::234-355
EKVYQLKKALYGLKQAPRSWNGRIDAHLISLGFEKCLSEFTLYVKKTDVGIVIVSLYVDDLLMTGSSKELIEEFKGGMKEAFEMNDLGKMPFFLGMQVQQDRGAVFVSQEKYAKEILRKFKMEEYKPIPMSMNQKEKFNNEDGAEKVDEKLYRSLIECLMYLTATRPDITYAVSLLSRYMHCASEIHFKAAKRILRYIKGTIGYGVKFQPVKDFSLYGYSDSDWAGSNDDMKNTSGYCFTFGSGVFSWRSKKQDVIAQSTAEAEYVAAVAAANQAIWLRKPMADLHMEQKESTQVLVDNQAAISISKNPVFHGKTKHFKIKLYFLREVQKQGDLQLLYCKTGNQLADFLTKSLPQARFEYL

SEQ ID NO: 182192 - protein, 57 aa, Glycine max
  Coding DNA Sequence Number=SeqID_65414
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=O24320; Match level="QueryCoverage=98%, HitCoverage=8%, E-value=2e-15, Identity=85%"; Hit description =Lipoxygenase
MNINGLARQSLVNAASIIEQSFLPGQFPVEMSSAVYKGWRNGSGGSILSLWASPCDR

SEQ ID NO: 182193 - protein, 166 aa, Glycine max
  Coding DNA Sequence Number=SeqID_65415
  Gene Ontology: Mol. function=ubiquitin-protein ligase activity; Cellular component=ubiquitin ligase complex; Biological process =protein ubiquitination
  Homolog annotation: Hit_ID=Q681N2; Match level="QueryCoverage=98%, HitCoverage=24%, E-value=3e-46, Identity=60%"; Hit description=Arm repeat containing protein
  Pfam annotation: Domain name=Arm; Domain location=11-51; Score=32.3; E_value=1.7e-06; Accession=PF00514.13; Description=Armadillobeta -catenin-like repeat
  Pfam annotation: Domain name=Arm; Domain location=52-92; Score=16.7; E_value=0.082; Accession=PF00514.13; Description=Armadillobeta -catenin-like repeat
  Pfam annotation: Domain name=Arm; Domain location=93-133; Score=6.6; E_value=1.8; Accession=PF00514.13; Description=Armadillobeta-catenin- like repeat
  Pfam module annotation: Pfam domain module=Arm::Arm::Arm; Domain location=11-51::52-92::93-133
MEKIRMLSKETPENRVLVVEHEGIPPLVQLLCYTNSKIQEHKVKTLLNLSIDEGNKSLISTKGAIPAIIEVLENGSCVAKENSAVTLLSLSMLNEIKEIVGQSNEFPPWVDLLRNGTITGKKDVVIAIFNLSINHATKVLDIKADIVTPLLELLKEPNLGMIDEGA

SEQ ID NO: 182194 - protein, 703 aa, Glycine max
  Coding DNA Sequence Number=SeqID_65416
  Gene Ontology: Mol. function=nucleic acid binding; Cellular component= chromatin; Biological process=DNA integration
  Homolog annotation: Hit_ID=Q1S4N1; Match level="QueryCoverage=99%, HitCoverage=61%, E-value=0.0, Identity=59%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=327-490; Score =161.5; E_value=2.2e-45; Accession=PF00665.16; Description=Integrase core domain
  Pfam module annotation: Pfam domain module=RVT_2::rve; Domain location=618-703::327-490
MTMKMAHKIWNFVKEEYEGSEKIKGMQALNLIRELEMQRMKDSETSKDYVDKLLGIANKIRLLGTEIPNSRIVQKILVTIPEKYEATLTSLENSKDLSTITLVELLTALQAPEQRRLMRQEEVDEEELFVVSCFATARSTESWLIDSGCTNHMTYDQELFKDLDATYNTNVRIGNGEKIAVKGKGTIVIEGCTGLKLIPDVLYVPEINQNLLSVGQLLEKGYKVLFEDKSCMIKDSDNKELFRVQMKGKSFALNLIDEEQLVVHKVEDNTLVWHKRMGHFHHGALLYLRKNDLVQGLPELEDKSPVCAACQYGKQTRLSFPKGKSWRATSKLQLVHTDVEGPQKTPSLNGSNYYIAFIDDFSRMCWIYFMKNKTEVASIFYKFKAWVENKSERKMQILRSDNGTKYTSDKFNKLCEDAGIEHQLTTPYTPQQNGVVERKNRTILEMARCLLHDKDLPKKLWAEAASTSDFLLNRLPTKALSKSTPFEAWYGFKPKLMNLKVFGFLCFSYIPQVKRDKLDKKAEAGIFVGYSSTSKAYRIFLPQSNKVIVSRDVLLFEEEKWSKESEKLQVQEESEEDVDDQLVRGTRPLSDIYQRCNVAVMEPVDYNEAATDSKWVSAMKEELDMIEKHQTWELTEKPKDKNVIGVKWVYRTKLNADGSVNKHKARLVVKGYAQMFGVDFSETFSPVARLDTIRLLLALAAQK

SEQ ID NO: 182195 - protein, 70 aa, Glycine max
  Coding DNA Sequence Number=SeqID_65417
MKNGSKLIGGGCMNENAIHGAPNKRRGWRIALEGPHKSIMKHGSKLFGGGCMNENAIHGAPKKREDGGLQ

SEQ ID NO: 182196 - protein, 259 aa, Glycine max
  Coding DNA Sequence Number=SeqID_65418
  Gene Ontology: Mol. function=helicase activity; Cellular component =membrane; Biological process=viral genome replication
  Homolog annotation: Hit_ID=Q2R1R7; Match level="QueryCoverage=100%, HitCoverage=16%, E-value=3e-69, Identity=52%"; Hit description=AT hook motif-containing protein, putative
  Pfam annotation: Domain name=DUF889; Domain location=1-209; Score =249.6; E_value=6.7e-72; Accession=PF05970.5; Description=Eukaryotic protein of unknown function (DUF889)
MRLQGNAQLIDDQETTKFAKWILDIGDGVIGNQNDGYATIEIPEYLLITEYNDPIDAIVKSTFPDLYQHHSNPKFFKSRAILASTNETVEEVNDYILSLILGEQMEYLSSDYIEKLETIDSWHFQSITTKFLNSLNTSSLPNPRIKLKIGSPIMLLRNLDQTQGLCNGTRLIVTRLAKHVIAVEIIFGKNVGKNVYIPRMSMSPTQSPWPFKLLRRQFPIMLSYAMTINKSQGQSLSMVGLYLPKPVFSHGQLYVALSR

SEQ ID NO: 182197 - protein, 224 aa, Glycine max
  Coding DNA Sequence Number=SeqID_65419
  Gene Ontology: Mol. function=RNA-directed DNA polymerase activity; Biological process=RNA-dependent DNA replication
MANVRAIKVMLRSFELVSGLKINFANICFWAIGMTEQWMNSAVRLQRWFLWGGHSDKKKITWVNWGSICLQKEKGGLGIKDLVKFNYALLGKWCWNLFQHQGELWPQVLFWEDGWKDDGISLIEKYPKLYHISQQQHQYIHQLEATSGAGWEWQFQGRRFFLECEMDMTAKFMEDIEGLIVQLQRQDTWNWEGDSSGGYTVGNVYMLLDRDSTNENQDGVFTAL

SEQ ID NO: 182198 - protein, 192 aa, Glycine max
  Coding DNA Sequence Number=SeqID_65420
  Pfam annotation: Domain name=RRM_1; Domain location=22-84; Score =13.2; E_value=0.0086; Accession=PF00076.12; Description=RNA recognition motif. (a.k.a. RRM, R
MRRTNRRDASDVHSFYFTKFLEEMREKDLWYEFKKWGDVQEVFIARNKNRSGRRYGFVKFEVGDVRRLERQLDDLIVGGLKLHVNITKHGREREANSNNNGGDKQQKDGTKKESNARESNKNNFSLVSAAKHTCVESTWLNNTWVGRLKNLAMFDRVEDEFMWNRGEDNVRKFHIACLSSWVQLIYLLDNFT

SEQ ID NO: 182199 - protein, 175 aa, Glycine max
  Coding DNA Sequence Number=SeqID_65421
  Gene Ontology: Mol. function=binding; Cellular component=nuclear pore; Biological process=protein import into nucleus, docking
  Homolog annotation: Hit_ID=Q5VN12; Match level="QueryCoverage=63%, HitCoverage=9%, E-value=4e-33, Identity=61%"; Hit description =Putative Importin 9
MGLFLEIKIAVNNVEIGEFEDNDFGTLRIFEIMKNKRDKGERKTKNKGIWVARKMWVSGKYRSSQAIKSIPECVHPLVSRILPYIGPILNKPQEQADGLVAGSLDLNAPADVVKAIYGVSFNAVINIILQSDDHSEIQNATECLSAFISGGRQEILAWGSDSGSTMRSLLDIASR

SEQ ID NO: 182200 - protein, 205 aa, Glycine max
  Coding DNA Sequence Number=SeqID_65422
  Gene Ontology: Mol. function=protein transporter activity; Cellular component=nuclear pore; Biological process=protein import into nucleus, docking
  Homolog annotation: Hit_ID=Q5VN12; Match level="QueryCoverage=61%, HitCoverage=10%, E-value=3e-20, Identity=42%"; Hit description =Putative Importin 9
MSNQTLIIRRLWVVVEFFDIIVALLADALTEIQEQVLAADDEDSDWEEVQADGIENDKEFLYSVSTSSGKATNEQLEAMAKVFNEDQDDHYEDDLLSIADPLNQINLANYLLDFFVSFSQSDRQLLDHICKLVSVSTKCHSNGTEEMRISCPVIECCLKDGLIIPERVKQRNGWKPISYIVQVGESVCSSERYFLSAAVFPLVCL

SEQ ID NO: 182201 - protein, 732 aa, Glycine max
  Coding DNA Sequence Number=SeqID_65423
  Gene Ontology: Mol. function=RNA-directed DNA polymerase activity; Cellular component=nucleus; Biological process=RNA-dependent DNA replication
  Homolog annotation: Hit_ID=Q1SLB1; Match level="QueryCoverage=42%, HitCoverage=66%, E-value=6e-60, Identity=35%"; Hit description=RNA -directed DNA polymerase
MEACDYPEEEEANNSLSGPIKNNSVERQGGEHKLLGPKVNGPDPIWKEIEWERPRLAGVRFQSIGQQDNVLLVARFEEKEVKAVVWDCGSAKSSGLDGLNFKFIKEFRDVHDPQSLNEYRPISLIGCMYKIVAKLLSRRLKKVLPTIIDERQTAFIEGRNMLYNVVIANEVVEEAKRCNKSCLVFKVDYEKVYDLVCWDFLLYMMRRMGFCTKWIRWIQGCLKSTSIFILVNGSPRAEFTPQRGLRQDDPLVPFSFNIVAEGLTGLMREAREKNLFEGFTVGRNVEIGVLQYADDTVFFGTTMMTNVRAIKQWMNNAVSYLNCKMLFSTLSLFGCPYWGTPKTGSCGEALGSEKDCMGELGFSLSIKGKRWLGHQGFGEIQLCTAWKMVLEFVSSPRSIVATSFGIQLWRVEEFGCDKKDQQRVPLGEIDMTAKFMKDIEGLIVQLQRLDTWNWEGDSSGGYTVGNAYMLLDRDSTNENQDGVFTALWKFKIPSKASFFAWRLTLEGLPTKSNLRSRNVEINNIREATLFALSSLSEELLETEETGFDTSSLKHLVEQIFTEDSLIGPLEYPFLYARIFTSVAKLSSLASDETLLMVLDTLLAAVKADYCLHKMQIVLVGNPISCKSKKQNVVARFIAELEYRAIGHESSTLVEHMISPVILNVWASHVSDPFISIDALEVLERPQNWVQWKPVDESLKTRTDVRLLKSENEPPWMMNLMTEGIENPAKQKI

SEQ ID NO: 182202 - protein, 360 aa, Glycine max
  Coding DNA Sequence Number=SeqID_65424
  Homolog annotation: Hit_ID=Q5VN12; Match level="QueryCoverage=28%, HitCoverage=8%, E-value=3e-24, Identity=51%"; Hit description =Putative Importin 9
MLTIVGNPRLGKVVVANIRELVYYTIAFLQMTEQQVHTWSVDANQFIADEEDATYSCRVSGVLLLEEVVNSFAGEGILAITDGAKQWFTESQIRKAAGVDDFRKLERQLDNLILGGLKLHANLPKHGREWKLIEKTNKISTRGWQQNYGEEVVTEICASNENDIPLVNLVNYTNGKEDMVQQCLGEDIKSKYLGGDMVLLMCLIDTRAEEICREEFENGLPMFLVDIDDNVEGLQCLDRARVLIKTSWYLTINHTVTASINGDDYVINIVEETCYNPCRCKCNSGSLIGSSEEIFSDESEVGLTLSLEDASSHDESLAIAMLADADGDEQNRSEDKDLPRCDKLLIRSGRTKEEAIRHGF

SEQ ID NO: 182203 - protein, 502 aa, Glycine max
  Coding DNA Sequence Number=SeqID_65425
  Pfam annotation: Domain name=RRM_1; Domain location=59-129; Score =1.5; E_value=0.1; Accession=PF00076.12; Description=RNA recognition motif. (a.k.a. RRM, R
MSRERNTEWERDRISGKAVERNRVRFSEDPRRTSVRNWKGNQQYYIRSNWRDHKDVSSFYFTHFSDDTTEKELWYNFKKWGDVREIFIPKRRNNNGRRYNFARFKGVNDVQRLAMQLDSIVIGGLKLIQGKERHKNSEPYSRASSTSSVHLDIAPDDTKWLNEAWVGQLKNPTMFKRIEDHLLWDIRANSRTNAQQRKPRRNLNVSLTGEVESEPARGFRLTWVQCWGIPILAWDTKQIQKIVAAMGDMVEVDDDIENGRRMDRARVLIKLHGSLLFSTRLMCTSKGRPTKYRWWRNVAMAPNIAIADDGVSWGRRRRFSPLKKKRYKTGRSQKPELNREGPPSVLTPTTITTGPRQYPPIKSEKEHPQDNRKTSQIIETIQKESREGTNIVRKELLIMGWIFLSTPLMSTQHNMALAHKLKKLTPSVHGRSTHETEGTTPLKRRTQLQGNQLKEAIDIWNMAKQLGAIRGTDQGEIIGKIRAMEERDKKEAERLENRSSTP

SEQ ID NO: 182204 - protein, 534 aa, Glycine max
  Coding DNA Sequence Number=SeqID_65426
  Gene Ontology: Mol. function=RNA-directed DNA polymerase activity; Cellular component=extracellular region; Biological process=RNA -dependent DNA replication
  Homolog annotation: Hit_ID=Q1SQP0; Match level="QueryCoverage=73%, HitCoverage=73%, E-value=1e-61, Identity=39%"; Hit description=RNA -directed DNA polymerase
MKKVMPLIIDETQSAFIGGRQFLHSVIIANEVIEEAKRSQKSCLVFKVDYEKAYDSVSWDFLSYILRRTGFSSKWIKWIEGCLTYASISVLVNGSPSTEFTPQRGLRQGDRLAPLLFNVVAEGLNGLMRKAVEKNLFRGFPVGSDNPVCLPKEKGGLGLKDIRTFNLALLAKWKWILFQHHGQLWARVLESKYGGWRSLDTTSRATNDSIWWRDLKMALLHSQEGQNLQNRTLWRVGCGDRIKFWEDRWVSGEETLSAKYPRLYLISCQQNQFIRQMGDHKGTEWEWEFTWRRPLFDNEISTAVSFLREVEGKTIQQHRSDEWVWKADPSDIYSVQSAYNMLRGEIAEGNYSEIGCQQEQIYKEGRCKLTTCLAHSADVRRRMQPTYSSIATKSNLSGLDKGIRVNRWQCWWLTLTWSIWQHRNSILFSNAVFNGNKLFEDALKKLATIPTDANVEQGESKPVPEINLPIADGKEQLRSGENEADQSRHREDKSEQSEADGIVVGVKHRFTQQRFGGNCTKEATEKELSKEAGT

SEQ ID NO: 182205 - protein, 103 aa, Glycine max
  Coding DNA Sequence Number=SeqID_65427
MKDALQPLGNIPFAWNSARNRRTSGLSIKNFVPHCPEALRYAKSKKRFHPAWVYADQILEIFGKKQSDFLFHSCWFINPGSINPDSFQRIMSAISIRQQVKVM

SEQ ID NO: 182206 - protein, 197 aa, Glycine max
  Coding DNA Sequence Number=SeqID_65428
TLSEVEKNDACIFGTIKGCVTSGCSFVGVVATCSKYIEIVFSSSGFTFTSCWIVTEAMDEILGSMLVIECWVKDGSGKGSVKVGIGSRMRTRGLLEVATVSDETGSSEGGETSNAATAKTDIVVVATGTIGKGLGKDNGNVGGSGRGWRINMLEVSGRDLPWVFAVVTMVALRAIVLAIVEEEKGFRRVTHERGAPG

SEQ ID NO: 182207 - protein, 361 aa, Glycine max
  Coding DNA Sequence Number=SeqID_65429
  Homolog annotation: Hit_ID=Q6Z9Z3; Match level="QueryCoverage=92%, HitCoverage=97%, E-value=2e-38, Identity=31%"; Hit description =Clathrin-coat assembly protein-like
  Pfam annotation: Domain name=Syntaxin-6_N; Domain location=13-120; Score=103.8; E_value=4.9e-28; Accession=PF09177.1; Description =Syntaxin 6, N-terminal
MLVANSFDLWRKDAFFSAAEEVQESADMRELGQLVMSSMHYSVMESAYRAWLREKRERSTPEELNELCRELQTALGTAKWQLEEFDKAVRLSYRPHSDDNTSTRHRQFISAIESQITQVEAALRESYIEEGKQPLRWVNLDEEERDDLAAFLSGTCQTTQSTNDEYMEVKQAKKEDKIVDIYTFRNRDISASEKSSKDVISVNKDTDYLIEIKADAVSRSNDDLVSQTDRTTSTRKTWSPPNYGALKIVIADEGEQRDKPTRTVDATPKEKGFRNLFWKQKFEDYPQATRIVRMFNQRFGGIGICQSQRQFQSPLHLRYGCSVQVTLALMLTIFLIERNRMRTEVITIQIGSMPISKERSI

SEQ ID NO: 182208 - protein, 82 aa, Glycine max
  Coding DNA Sequence Number=SeqID_65430
  Subcellular localization annotation: CTP_CleavageSite=49; ConfidenceScore=5.11e-01
MALTSTMDGGSSPHRKLLNARHCNSMSLQLRNAPELRQRNEHRKQRRTTASQGKERKCWVKKKKNSKSVRKNKKAVACVINY

SEQ ID NO: 182209 - protein, 71 aa, Glycine max
  Coding DNA Sequence Number=SeqID_65431
  Subcellular localization annotation: CTP_CleavageSite=19; ConfidenceScore=5.06e-01
MKNDVEVDYSRNSVVPRPRFSLLSSSSLRFLSISLNVGLLEPFTQPPSRLFIAKDGIRGHGNLPRRAVAST

SEQ ID NO: 182210 - protein, 117 aa, Glycine max
  Coding DNA Sequence Number=SeqID_65432
  Gene Ontology: Mol. function=DNA binding; Cellular component=nucleus; Biological process=regulation of transcription
  Homolog annotation: Hit_ID=Q67UM4; Match level="QueryCoverage=74%, HitCoverage=25%, E-value=8e-16, Identity=48%"; Hit description=Gt-2 -related-like
MSYICPSSAAYSIRMLTFAHFWESTTNGKRATPNPEMGSTSQGERKRKRLATDGEEETLQSQLIDVLEKNGKMLHDQLEAQNLNFQLDRQQQKDTASNIVAVLDKLADALGRIADKL

SEQ ID NO: 182211 - protein, 370 aa, Glycine max
  Coding DNA Sequence Number=SeqID_65433
  Gene Ontology: Mol. function=lyase activity; Cellular component =anchored to membrane
  Homolog annotation: Hit_ID=Q1SGJ9; Match level="QueryCoverage=79%, HitCoverage=81%, E-value=1e-134, Identity=76%"; Hit description =Pectolytic enzyme, Pectin lyase fold
  Pfam annotation: Domain name=Pec_lyase_C; Domain location=121-306; Score=236.4; E_value=6.2e-68; Accession=PF00544.9; Description =Pectate lyase
MAAHSTNHILWCFVLVIIVVALYTPNISAAKQSKINGLNVIDQCWRLNPKWRRHRPQLATCSVGYTGKMTNNIGKDLIHYKVIDPNDDPINPKPGTLRYGASVIQGKVWITFQRDMHIKLERPLLISSFTTIDGRGVNVNIADNACLMIFKATNVIIHGIRVHHCKPQAPGIVMGPEGKVIPLGHVDGDAIRLVTASKIWIDHNTLYNCQDGLLDVTRGSTDVTVSNNWFRNQDKVMLLGHDDGYVRDQNMKVTIVYNHFGPNCNQRMPRIRHGYAHVANNLYLGWVQYAIGGSMGPSLKSEANLFIAPTIGSKEVTWRKSTQKNGNTWEFHSVKDAFENGASFTITKGGRVPKPIIARNNTLKLLMSNL

SEQ ID NO: 182212 - protein, 58 aa, Glycine max
  Coding DNA Sequence Number=SeqID_65434
EACHAIAERLECHLNLRIVKAGTETHEVMEECIRIARGVTEDCIVYARSRRRRRTDEA

SEQ ID NO: 182213 - protein, 246 aa, Glycine max
  Coding DNA Sequence Number=SeqID_65435
  Gene Ontology: Mol. function=DNA binding; Cellular component=nucleus; Biological process=regulation of transcription
  Homolog annotation: Hit_ID=Q67UM4; Match level="QueryCoverage=57%, HitCoverage=41%, E-value=3e-35, Identity=53%"; Hit description=Gt-2 -related-like
MALDQPSNPNAVDGAGNGATPCSAADGGDDGRPAARLPRWTRQEILVLIQGKSDAESRFRPGRGSGSAFGSGEPKWALVSSYCKKHGVNREPVQCRKRWSNLAGDYKKIKEWESQVRDEAESFWLMRNDLRRERKLPGYFDREVYNILDSPSSTAAAAAAETPVAVAEAASAGDEEVHLYDSNRRVGSEDGLFSDSEKDEVLLLAAAKDVPAPVPLSEKQYQPHLHGCEGEGNPQGKGVLYPFFYR

SEQ ID NO: 182214 - protein, 121 aa, Glycine max
  Coding DNA Sequence Number=SeqID_65436
  Subcellular localization annotation: CTP_CleavageSite=38; ConfidenceScore=5.31e-01
MMLRSNLTRFQFTWLNSMTRKFLLTMVWRLRKPPGLPTAEESGNMTKFSACTSPQVVKQLFHVLSSSFHKKQLEGEDFTGIDHGEGVSRLRELAMPMAMAVLLTRTIARFSRPVVRDGIQL

SEQ ID NO: 182215 - protein, 161 aa, Glycine max
  Coding DNA Sequence Number=SeqID_65437
  Gene Ontology: Mol. function=protein serine/threonine kinase activity; Biological process=protein amino acid phosphorylation
  Homolog annotation: Hit_ID=Q1T003; Match level="QueryCoverage=65%, HitCoverage=13%, E-value=1e-24, Identity=50%"; Hit description =Protein kinase; Concanavalin A-like lectin/glucanase
MQVSDLVGIRVDLKSGDSMNTSIEYNGNDKGLHVWVSYSNVRPKDPILKVDFNVGMYVKDFIYVGFSRSTQGTIEVHNVEWFMAKEAAMLTTVTRWSYDSSMAEGKGKQENMVVSWLGFVSGMQKIPKGRGKRVISGGLLNPGSPRLASGSLGPPNSLGVK

SEQ ID NO: 182216 - protein, 71 aa, Glycine max
  Coding DNA Sequence Number=SeqID_65438
  Pfam annotation: Domain name=zf-C2HC_plant; Domain location=18-70; Score=4.1; E_value=0.013; Accession=PF07567.3; Description=Protein of unknown function, DUF1544
MDEACSSRRKRGGRPKSKYWSEAEKLEGKNMWKCNHCKHEFAGGATRIEEHITGKGNNITKCPKYGAHEEF

SEQ ID NO: 182217 - protein, 542 aa, Glycine max
  Coding DNA Sequence Number=SeqID_65439
  Gene Ontology: Mol. function=cysteine-type peptidase activity; Biological process=proteolysis
  Homolog annotation: Hit_ID=Q2QME9; Match level="QueryCoverage=43%, HitCoverage=32%, E-value=2e-30, Identity=36%"; Hit description=Ulp1 protease family, C-terminal catalytic domain containing protein, expressed
  Pfam annotation: Domain name=NB-ARC; Domain location=373-540; Score= -132.9; E_value=0.082; Accession=PF00931.13; Description=NB-ARC domain
  Pfam annotation: Domain name=Peptidase_C48; Domain location=32-259; Score=123.0; E_value=8.7e-34; Accession=PF02902.9; Description=Ulp1 protease family, C-terminal catalytic domain
  Pfam module annotation: Pfam domain module=NB-ARC::Peptidase_C48; Domain location=373-540::32-259
MKEDEINLGDQIVEHDSAAFKKAYPKGDPDAVCIKKSDIELLQPEKCLNDTIIDFYINYLKNKLPSDKQDRFHFFNCFFFAKLAGLSRNDTSIACDGKAAFQRVSTWGRKVNLFKTDYIFIPINYSLHWSLIVICHPAEVMTCYRDEETKGSPKEACILHMDSRKGIHVHLQNVFQSYLCEEWKERHNNVRDDVSPKFLDLPFVPLELPQQQNAYDCGIFLLHYVEHFLEQAPINFNRSTKFSVPPPDASLKRSHIQKLLIAAEGDSKMIVGGSVNPQNNTQFSAALLGGDVEDHAVNGGSNGDDALTINNLLSDLAREEDYFDKELQWREFQAIKRKRQDDDWSDKLKDLKKRVIDVKNSLHQSGSTNELPKPSELHAKFIYLLIEKLWELRDENVKKMWDLLEDEEVFIIGIDGMGGVGKTFMATHFKNEIKRKGTFKDVFWVTVSHDFTIFKLQHHIAETMQVKLYGDEMTRATILTSELEKREKTLLILDDVWEYIDLQKVGIPLKVNGIKLIITTRLKHVWLQMDCLPNNTITNIPL

SEQ ID NO: 182218 - protein, 54 aa, Glycine max
  Coding DNA Sequence Number=SeqID_65440
MDEKGTLNDKVVELCELHVKGVTVKKGPSWSSNSNNNHSFKVLRTYHHSELKDN

SEQ ID NO: 182219 - protein, 87 aa, Glycine max
  Coding DNA Sequence Number=SeqID_65441
MGNTRIDFPIEALERVAVNVGKETEGSWKGSKEMISSKVNCLKIRQSSEIRTKVEGKGPKNELACAFNSSSCKRCPDTFGNFPEKAS

SEQ ID NO: 182220 - protein, 166 aa, Glycine max
  Coding DNA Sequence Number=SeqID_65442
  Subcellular localization annotation: CTP_CleavageSite=72; ConfidenceScore=5.42e-01
MLQPYGISIGLKEHSNPMTPKAYTPKNPLGPLPPDSASNSSISSGSLRFLQFFSSSCSDRIPKRQRDREGIEASTCTVTMRFIFLPPQILSRKSQRHNIEIPNGKNARNWVSNAALKFHDDPTVNESEIVVFLRQVRWSAGKREGFGRREKNNIVRQRRLRSQSEN

SEQ ID NO: 182221 - protein, 140 aa, Glycine max
  Coding DNA Sequence Number=SeqID_65443
MTEVTLQNKFGFSLTHHQKLAQEVRIAPLKGKYMKAYLGEHLQGTTTKGHEPEVTVVKKSGTSSGELSGQLKKKNERVGLEPKNLLPKQTYTEHTLGCTGYTHGEEVSAIENNKLQWRTTLGCRGYTHGEEESASKIGGV

SEQ ID NO: 182222 - protein, 96 aa, Glycine max
  Coding DNA Sequence Number=SeqID_65444
MAMGGDVEEVLLDKEECDCDKEEYDLEKGEFREIDIGRGGGFHGLIRERRIRIETATQRKKKTILLRWCLVRRRQHTRYAFVLGVCEWDGAQMSYE

SEQ ID NO: 182223 - protein, 88 aa, Glycine max
  Coding DNA Sequence Number=SeqID_65445
MENVFVVMYYDGDILSSSEGVLFECLIVPKFITINDDCVEYECMELKCDDDVDEIFFIFSEFSSKGPIELNATFDRSPDEILVLLHKQ

SEQ ID NO: 182224 - protein, 149 aa, Glycine max
  Coding DNA Sequence Number=SeqID_65446
MSIVHIQIALMLVTTKWPRTPTIGIFRTNNNNLTHRIASYMLGLTHALCLSFHKITIRCIPNSDKNILAMVEENEQLIVPTFIAFVRQEFEYTIIYRKAWLAKQWALEKSFFIITDCYKKTTHTTLPGLIKYQGRNGRWHGMMESGGDT

SEQ ID NO: 182225 - protein, 512 aa, Glycine max
  Coding DNA Sequence Number=SeqID_65447
  Gene Ontology: Mol. function=protein binding; Biological process =defense response
  Homolog annotation: Hit_ID=Q19PN3; Match level="QueryCoverage=97%, HitCoverage=44%, E-value=8e-38, Identity=26%"; Hit description=NBS -LRR type disease resistance protein
  Pfam annotation: Domain name=LRR_1; Domain location=123-145; Score =9.2; E_value=5.4; Accession=PF00560.23; Description=Leucine Rich Repeat
  Pfam annotation: Domain name=LRR_1; Domain location=147-169; Score =13.9; E_value=0.6; Accession=PF00560.23; Description=Leucine Rich Repeat
  Pfam annotation: Domain name=LRR_1; Domain location=171-192; Score =13.0; E_value=1.1; Accession=PF00560.23; Description=Leucine Rich Repeat
  Pfam annotation: Domain name=LRR_1; Domain location=194-216; Score =10.8; E_value=2.8; Accession=PF00560.23; Description=Leucine Rich Repeat
  Pfam annotation: Domain name=LRR_1; Domain location=218-241; Score =3.2; E_value=71; Accession=PF00560.23; Description=Leucine Rich Repeat
  Pfam annotation: Domain name=LRR_1; Domain location=243-265; Score =3.7; E_value=58; Accession=PF00560.23; Description=Leucine Rich Repeat
  Pfam annotation: Domain name=LRR_1; Domain location=350-373; Score =1.3; E_value=1.6e+02; Accession=PF00560.23; Description=Leucine Rich Repeat
  Pfam annotation: Domain name=LRR_1; Domain location=378-401; Score =4.9; E_value=35; Accession=PF00560.23; Description=Leucine Rich Repeat
  Pfam annotation: Domain name=LRR_1; Domain location=413-437; Score =8.7; E_value=6.7; Accession=PF00560.23; Description=Leucine Rich Repeat
  Pfam annotation: Domain name=LRR_1; Domain location=439-462; Score =1.6; E_value=1.4e+02; Accession=PF00560.23; Description=Leucine Rich Repeat
  Pfam annotation: Domain name=LRR_1; Domain location=467-490; Score =3.7; E_value=59; Accession=PF00560.23; Description=Leucine Rich Repeat
  Pfam annotation: Domain name=LRR_1; Domain location=99-121; Score =7.7; E_value=11; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=123-145::147-169::171-192::194-216::218-241::243-265::350 -373::378-401::...
  Pfam module annotation: Domain location=413-437::439-462::467-490::99- 121
MFLQSALFPNHIFKEEWVMMLVESGLLDGKRSLEETFDEGRVIMDKLINHSLLLGCLMLRMNGLVRKMACHILNDNHTYLIKCNEKLRKMPQMREWTADLEAVSLAGNEIEEIAEGTSPNCPRLSTFILSRNSISHIPKCFFRRMNALTQLDLSFNLRLTSLPKSLSKLRSLTSLVLRQCSKLKDIPPLGDLQALSRLDISGCDSLLRVPEGLQNLKKLQCLNLSRDLYLSLLPGCALPGLSNMQYLDLRGSSVSFLDQDYYNRYVQEIQDTGYGPQIYFIYFGKFDDYTLGFPENPIYLCLEFKRRRVCFGDCDELPYLLPRDLTELLVSGNDQWECLCAPLSSNGPLSLKDINIKHCTKLKSLFCVSCSLCTNIQNLKSLKLDNLGSLSVLCKEDVAGLTQSLSRSGVFSHLKELSIEKCHQIEKLLTPGLVPQLQNLASISVEDCESIKEIFAGDSSDNIALPNLTKLQLRYLPELQTVCKGILLCNSEYIFYIKDCPNYETPRIGGRV

SEQ ID NO: 182226 - protein, 105 aa, Glycine max
  Coding DNA Sequence Number=SeqID_65448
MEGHGGIYYDREEPGTTHHVSRSVGHGYILNRINIRTRHDNGTGRGQVLSPQFPTPTLQHVPLPVPDTRWVKIYYPIPVPVGYRWRGGSGFGVEADVVISSRTRT

SEQ ID NO: 182227 - protein, 213 aa, Glycine max
  Coding DNA Sequence Number=SeqID_65449
MSPRSLTEAMKILLMSHLGILTETKVAVVTNADTMERLTWLTDLYYRYIELGSYVWAAMTYLLHLIEIKGLCGGGPDSHQMKAIERYRACPSDVRPFAHQTLFSNLIRCVTDMRPYHLERMLRQFGHVQTIPRQPPTRLTYQLCDKAWAEWQQHIIPLGDVVLTNGPWADTFDYLPWFHNFAYLYVISLNEGQPSHGLVRLPPIQYNHNLGNH

SEQ ID NO: 182228 - protein, 94 aa, Glycine max
  Coding DNA Sequence Number=SeqID_65450
MKKEKGMKFKVYDRVDPATLKSNFKELGTIRIRPSTYQSIHPLESLAKNKLAFKSKWCIFHTPPAAKPSVIPIMMSLTTLGPFKVAWAILGPAI

SEQ ID NO: 182229 - protein, 53 aa, Glycine max
  Coding DNA Sequence Number=SeqID_65451
MGSNWKRNQNKARKCLGFCFWYRSEKMMVTRESTHDFDTRSVNPTYISYSGNN

SEQ ID NO: 182230 - protein, 63 aa, Glycine max
  Coding DNA Sequence Number=SeqID_65452
MLRNANTKSTLKSTEVPLSCAKNNAHLERTARVRNASPGAKGVIFQIQRRDLLPIMMKLGYLN

SEQ ID NO: 182231 - protein, 51 aa, Glycine max
  Coding DNA Sequence Number=SeqID_65453
MRGFGKAITDANPFDIPLQGHPFMWWRSKGGAEWVVEKVQRPFLLGPPYPL

SEQ ID NO: 182232 - protein, 131 aa, Glycine max
  Coding DNA Sequence Number=SeqID_65454
  Subcellular localization annotation: CTP_CleavageSite=28; ConfidenceScore=5.27e-01
MRPHSLRWFLSLVHNASPFFFVSLRSVRFGEGEATSVQRYGGRRRHTRYAFALGVRSGVPQVVQIKLIRNLRTDQLDPQIRLTNQVDPQMDQDQWMSKEVNMDYENKKEYSVNEPYVDCSKAFNTSQVFDS

SEQ ID NO: 182233 - protein, 104 aa, Glycine max
  Coding DNA Sequence Number=SeqID_65455
  Pfam annotation: Domain name=zf-C2HC_plant; Domain location=20-69; Score=1.9; E_value=0.024; Accession=PF07567.3; Description=Protein of unknown function, DUF1544
MDGACGSKRKRGGRPKSKYWNEAGKIGKDMWKCNHCKEKFSGGATRIEEHITGKGNSIRKCSKYPGHEGGHNIIASGSTSPREALHTLNQLREVSQGLSQGPSN

SEQ ID NO: 182234 - protein, 164 aa, Glycine max
  Coding DNA Sequence Number=SeqID_65456
MSSFLFDYATSMGGSDSEGSIEQPLMDREVISIGSSSSLDARRGAVDSKSSSLEKVKASCHTSGGSSHLRGRVRPSVASGEPFLVTMILPPVAFGGVRRGSGNGDARAFAHVRCSHSAGSPSSPLAIVGCRNLPFSGGAKRLLGWAKGASSKERKRMESPPMFI

SEQ ID NO: 182235 - protein, 112 aa, Glycine max
  Coding DNA Sequence Number=SeqID_65457
MKPLVPKTIGVEEYGQRYGFRLAIDEMLHGKLPLSSQASEEKEDTVEEFDAYNNYASWSSETDMSEMVSALAQVMGTTNRNPYMPQSTSFPFSTSVVKDQPQPYPSQPPPDQ

SEQ ID NO: 182236 - protein, 2582 aa, Glycine max
  Coding DNA Sequence Number=SeqID_65458
  Gene Ontology: Mol. function=protein binding; Cellular component =mitochondrion; Biological process=defense response
  Homolog annotation: Hit_ID=Q19PN1; Match level="QueryCoverage=79%, HitCoverage=54%, E-value=5e-82, Identity=31%"; Hit description=NBS -LRR type disease resistance protein
  Pfam annotation: Domain name=LRR_1; Domain location=1036-1059; Score =6.3; E_value=19; Accession=PF00560.23; Description=Leucine Rich Repeat
  Pfam annotation: Domain name=LRR_1; Domain location=1071-1095; Score =11.3; E_value=2.2; Accession=PF00560.23; Description=Leucine Rich Repeat
  Pfam annotation: Domain name=LRR_1; Domain location=1097-1120; Score =5.9; E_value=22; Accession=PF00560.23; Description=Leucine Rich Repeat
  Pfam annotation: Domain name=LRR_1; Domain location=1125-1147; Score =1.7; E_value=1.4e+02; Accession=PF00560.23; Description=Leucine Rich Repeat
  Pfam annotation: Domain name=LRR_1; Domain location=2009-2031; Score =7.7; E_value=11; Accession=PF00560.23; Description=Leucine Rich Repeat
  Pfam annotation: Domain name=LRR_1; Domain location=2033-2055; Score =10.2; E_value=3.5; Accession=PF00560.23; Description=Leucine Rich Repeat
  Pfam annotation: Domain name=LRR_1; Domain location=2057-2079; Score =16.2; E_value=0.12; Accession=PF00560.23; Description=Leucine Rich Repeat
  Pfam annotation: Domain name=LRR_1; Domain location=2081-2102; Score =13.0; E_value=1.1; Accession=PF00560.23; Description=Leucine Rich Repeat
  Pfam annotation: Domain name=LRR_1; Domain location=2104-2126; Score =11.5; E_value=2; Accession=PF00560.23; Description=Leucine Rich Repeat
  Pfam annotation: Domain name=LRR_1; Domain location=2128-2151; Score =1.5; E_value=1.5e+02; Accession=PF00560.23; Description=Leucine Rich Repeat
  Pfam annotation: Domain name=LRR_1; Domain location=2275-2298; Score =3.2; E_value=72; Accession=PF00560.23; Description=Leucine Rich Repeat
  Pfam annotation: Domain name=LRR_1; Domain location=2303-2326; Score =6.1; E_value=20; Accession=PF00560.23; Description=Leucine Rich Repeat
  Pfam annotation: Domain name=LRR_1; Domain location=2338-2362; Score =12.7; E_value=1.2; Accession=PF00560.23; Description=Leucine Rich Repeat
  Pfam annotation: Domain name=LRR_1; Domain location=2364-2396; Score =7.0; E_value=14; Accession=PF00560.23; Description=Leucine Rich Repeat
  Pfam annotation: Domain name=LRR_1; Domain location=740-762; Score =7.7; E_value=11; Accession=PF00560.23; Description=Leucine Rich Repeat
  Pfam annotation: Domain name=LRR_1; Domain location=764-786; Score =12.7; E_value=1.2; Accession=PF00560.23; Description=Leucine Rich Repeat
  Pfam annotation: Domain name=LRR_1; Domain location=788-810; Score =14.7; E_value=0.34; Accession=PF00560.23; Description=Leucine Rich Repeat
  Pfam annotation: Domain name=LRR_1; Domain location=812-833; Score =13.0; E_value=1.1; Accession=PF00560.23; Description=Leucine Rich Repeat
  Pfam annotation: Domain name=LRR_1; Domain location=835-857; Score =10.8; E_value=2.8; Accession=PF00560.23; Description=Leucine Rich Repeat
  Pfam annotation: Domain name=LRR_1; Domain location=859-882; Score =3.2; E_value=71; Accession=PF00560.23; Description=Leucine Rich Repeat
  Pfam annotation: Domain name=NB-ARC; Domain location=1631-1935; Score= 118.7; E_value=1.6e-32; Accession=PF00931.13; Description=NB-ARC domain
  Pfam annotation: Domain name=NB-ARC; Domain location=374-673; Score =135.4; E_value=1.6e-37; Accession=PF00931.13; Description=NB-ARC domain
  Pfam annotation: Domain name=Peptidase_C48; Domain location=1288 -1516; Score=135.3; E_value=1.7e-37; Accession=PF02902.9; Description= Ulp1 protease family, C-terminal catalytic domain
  Pfam annotation: Domain name=Peptidase_C48; Domain location=31-260; Score=131.1; E_value=3e-36; Accession=PF02902.9; Description=Ulp1 protease family, C-terminal catalytic domain
  Pfam annotation: Domain name=RRM_2; Domain location=1119-1191; Score =28.9; E_value=1.7e-05; Accession=PF04059.3; Description=RNA recognition motif 2
  Pfam annotation: Domain name=RRM_2; Domain location=2394-2492; Score =93.8; E_value=5.3e-25; Accession=PF04059.3; Description=RNA recognition motif 2
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::NB-ARC::NB -ARC::Peptidase_C48::...
  Pfam module annotation: Pfam domain module=Peptidase_C48::RRM_2::RRM _2; Domain location=1036-1059::1071-1095::1097-1120::1125-1147::2009 -2031::2033-2055::2057-2079::2081-2102::2104-2126::2128-2151::2275 -2298::2303-2326::...
  Pfam module annotation: Domain location=2338-2362::2364-2396::740 -762::764-786::788-810::812-833::835-857::859-882::1631-1935::374 -673::1288-1516::31-260::1119-1191::2394-2492
DEINLGDQIVEHDSAAFEKAFFYPKGDPDAVCIRNSDIELLQPEKCLNDNIIDFYINYLKNKLPTDKQDRFHFFNCFFFPKLVDLSTDNPSIASDGKAAFQRVSKLTRKVNLFEKDYIFIPINYSLHWSLIVICHPAEVMTCYRDEETKGSPKEACILHMDSRKGIHQDLHNVFQSYLCEEWKERHNNVRDDDVSSIFLHLPFVPLELPQQQNAYDCGIFLLHYVERFLEQAPINFNRSMISKFSYWFPPPDAPLKRSHIQKLLIAAEGDNKMIVGGSVNPQNSTKLSAALLGGDVEDHTVNGGSNGDDALTINQLLSKLTREEDWLHWREFQGNKRKRQDDDWLDKLKDLKKRAIDVKNSLHQSGSTNELDEPSELDIEFDVLLIQKPWGLRDKNVKKMWDLLEDEEVFIIGIDGMGGVGKTFMATHIKNEIKRKGTFKDVFWVTVSDDFTTFKLQHDIAETIQVKLYGDEMTRATILTSELEKREKTLLILDDVWDYIDLQKVGIPLKVNGIKLIITTRLKHVCLQMDCLPNNIITIPLNIITEEEEEEAWELFLLKLGHRGTPARLSPHVLEIARSVVMKCDGLPLGISVMARTMKGKNEIHWWRHALNKLDRLEMGEEVLSVLKRSYDNLIEKDIQKCFLRSALFPTIIRKEEWVTMVVESGLLNGKRSLEETFDEGRVIMDKLINHSLLLDRGSLRMHGLVRKMACHILNENHTYMIKCDENLRKIPQMREWTADLEAVSLAGNEIEEIAEGTSPNCPGLSTLILSHNLISHIPKCFFRHMNALTLLDLSYNYELTSLPKSLSKLRSLTSLVLRQCSKLKDIPPLGDLQALSRLDISGCDSLLRVPEGLQNLKKLQCLNLSRDLYLSLLPGCALPGLSNMQYLDLRGWSGIKVEDVKGMTMLECFAVSFLDQDCYNRYVQEIQDTGYGPQTYFIYFGKFDDYTLGFSENPIYLCLEFKRRRVCFGDCDELPYLLPRDLAELLVSGNHQWECLCAALSSNGSLSFKDIDIGYCTKLKSLFCVSCSLCTNIQNLKSLKLNNLDRLSVICKEDVAGLTQSLSRRGVFSHLKELSIDGCHQIEKLLTPGLVPQLQNLESISVSDCESIKEIFAGDSSDNIALPKLTKLLLRWLPELKTFRRDLPNSVEVHKEEKVKVFNGKKWEKFNSEKVASLAYARIQGKAALIAHFQNSSLMNEDKHCKPISSSTPMALMPVIRDEATKWVLTLLATQVPFPVGINIRNEVGRVRNNTQEDNLQGKDVEHDSAAFKSNDMEKAICYPKGDPDAIYIRKSDIELLQPEKCLNDNIIDFYIKYLINNKLPSDKQKRFHFFNCFFFPKLVDLSTDNRSIACDGKAAFQRVSNWTRKVNLFEKDYIFIPINYSLHWSLIVICHPAEVMTCYRDEETKGSPKEACILHMDSRKGIHQDLHNVFQSYLCEEWKERHNNVRDDASSKFLDLPFVPLELPQQQNAYDCGIFLLHYVERFLEKAPINFNRSLITNFSSWFPPLDASLKRSHIQKLLIVEGGNKMIDGDSVNSQNNTKLSASAGGDVEDHAVNGGSNGDDALTINKLLSDLARQEDYFDKSLQWREFQGKKRKRQDDNWLDKLKDLKKRAIDVKNSLHQSGSTNEFPKPSELGDEFFYLSIEKRWASRDKKVENMWDLLEDEEVFIIGIDGMGGVGKTFMATHIKNEIKRKGTFKDVFWVTVSHDFTNFKLQHDIAETIQVKLYGDEMTRATILTSELEKREKALLILDDVWEYIDLQKVGIPLKVNGIKLIITTRLKHVCLQMDCQPYNIITIFPFEEEEEEEEEEEEEEKEEEEEAWELFLLKLGHRGTPARLPPHVLEIARSVVMKCDGLPLGISVMARTMKGKNEIHWWRHALNKLDRLEMGEEVLSVLKRSYDNLIEKDIQKCFLQSALFPNADEGKWAMMIVESGLLNGKGSLEEIFDEARVIVDKLINHSLLLGYWSLRMNGLLRKMACNILNENHTYMIKCHENLRKIPQMREWTADLEAVSLAGNEIEEIAEGTSPNCPRLSTFILSRNSISHIPKCFFRHMNALTQLDLSYNRRLTSLPKSLSKLRSLTSLVLRQCSKLKDIPPLGDLQALSRLDISGCNSLLRVPEGLQNLKKLQWLSLSRKLNLSLVPLCVLPGLSNMQYLDLRGWSGIKVEDVKGMTMLECFAVSFLDQDYYNRSVQEIQDTGYGPQTYFIYFGKFKDYTLGFSENLIYGEFKHRRVCFGDCDGLHYLLPRDLAELLVSGNDQWECLCAPLSSNGSLSLKHITIRDCTKLKSLFCVSCPLCTNIQNLKSLTLNNLDSLSVICKEDVAGLTQSLSRRGVFSHLKELSISGCHQIEKLLTPGLVPQLQNLKSISVSNCQSIKEIFAGDSSHNIALPNLTNLQLYWLPDLKTVCKGILLINSEDILHINNCPNYEKPRISRNNGNVGYAFINMINPGLIILFYQVFNGKKWEKFNSEKVASLAYARIQGKAALIAHFQNSSLMNEDKHCKPISSSTPMALMPVIRDEATKWVLTLLATQVPFPVGINIRNKVGRVRNNTQEDNLQGNLPNFANCKLSSDGDSHSLDSD

SEQ ID NO: 182237 - protein, 187 aa, Glycine max
  Coding DNA Sequence Number=SeqID_65459
  Gene Ontology: Mol. function=structural constituent of ribosome; Cellular component=ribonucleoprotein complex; Biological process =translation
  Homolog annotation: Hit_ID=Q9M5M6; Match level="QueryCoverage=54%, HitCoverage=91%, E-value=9e-50, Identity=92%"; Hit description=60S ribosomal protein L30
  Pfam annotation: Domain name=Ribosomal_L7Ae; Domain location=7-101; Score=111.5; E_value=2.5e-30; Accession=PF01248.16; Description =Ribosomal protein L7AeL30eS12eGadd45 family
MQKKTHESINNRLALVMKSGKYTLGYKTVLKSLRSSKGKLIIIANNCPPLRKSEIEYYAMLAKVGVHHYNGNNVDLGTACGKYYRVCCLSIIDPGDSDIIKTLPGEGGEEEVAAGANSWSGRRRGSGCAGYRLIGDEGFSDASVGDGDDDALVEGSEEEVLLGCLADEINIVLEECEVTMVVKLGLA

SEQ ID NO: 182238 - protein, 216 aa, Glycine max
  Coding DNA Sequence Number=SeqID_65460
  Gene Ontology: Mol. function=transcription factor activity; Cellular component=nucleus; Biological process=regulation of transcription, DNA-dependent
  Homolog annotation: Hit_ID=Q2Q0A9; Match level="QueryCoverage=63%, HitCoverage=73%, E-value=4e-21, Identity=44%"; Hit description =Putative AP2/EREBP transcription factor
  Pfam annotation: Domain name=AP2; Domain location=28-92; Score=154.2; E_value=3.4e-43; Accession=PF00847.10; Description=AP2 domain
MPNEKPIGFEFKYHLNYSNLPTTKVAKKPHYRGVRQRPWGKWAAEIRDPKKAARVWLGTFETAEDAALAYDKAALKFKGTKAKLNFPERVHQDVPFMQQHQQRSSNRNVFPIHATSTTSSATGSVSSVDAVAPPSLSTHDQHGHQVFPNLYQYAQILSSDDAQLPYFTSHLFNQQQQQQQQQPFNSQFSSTFSSTSSYFYNQQQQYDQQGHDHSNH

SEQ ID NO: 182239 - protein, 121 aa, Glycine max
  Coding DNA Sequence Number=SeqID_65461
MKQHRVVPPVSGDMVQCGTSLEETYKVTPHVLTGNLKRWLTLKRSKKIRKQCGEVNEVRFKYKKPGQKEGLCKKLFALPADDDTCLRSSEIKDDYKSSISRGYYGNCCDFWGQKKKDNQCD

SEQ ID NO: 182240 - protein, 357 aa, Glycine max
  Coding DNA Sequence Number=SeqID_65462
  Homolog annotation: Hit_ID=Q2QWI0; Match level="QueryCoverage=29%, HitCoverage=97%, E-value=3e-37, Identity=68%"; Hit description=RNA polymerase Rpb3/Rpb11 dimerisation domain containing protein, expressed
  Pfam annotation: Domain name=RNA_pol_L; Domain location=258-333; Score=61.5; E_value=2.7e-15; Accession=PF01193.14; Description=RNA polymerases L  13 to 16 kDa subunit
MASTAEPLPYSSRRRDESEFNLREWAVKARISREGTNSRRYSGSYMRSFREDTRSFRSNITISSTASSPGYLLKDEIDPSTYSFTTALKALQARSSYYSWECLSPDGFALNSKWNEAERYICNPLSGEVPLECLSAKTLSGRSFRNSINRIAMSAPLVYSSKHIPTKPATFTQEEVALQFPNPEKKKEGMTRDVGTQSTPPYISSTSPSPASTPSITERSKPLVSDSPNSNAKTKSEEEHPNSFDRWCGAMEHGSYTDQSKSTFSLVDEDHTFANAVRFTLNQDPRVSFCGYSIPHPSDNRVNIRVQTTGDPSREVLKDACQDLMLMCQHVRSTFDKAVSDFKISKARKNNEDMDVE

SEQ ID NO: 182241 - protein, 39 aa, Glycine max
  Coding DNA Sequence Number=SeqID_65463
MKTVADDVGVGSTTVRTLPVVLIYIMDASYDKFHPFRVS

SEQ ID NO: 182242 - protein, 139 aa, Glycine max
  Coding DNA Sequence Number=SeqID_65464
  Homolog annotation: Hit_ID=Q5VN12; Match level="QueryCoverage=64%, HitCoverage=7%, E-value=2e-17, Identity=51%"; Hit description =Putative Importin 9
  Subcellular localization annotation: CTP_CleavageSite=37; ConfidenceScore=5.48e-01
GKGSAAKCEAAKATNVAVPSSSSRVFHFAHGEPRGSRSAMAAQLLVRHTRPQPRVLLKQFVKKHWQEGEDSFEPPVVASDEKEIIRRMLLLALDDPHKKICTAIGMAVASIAMHDWPELWPDLLPFLLNLINNQTNMNG

SEQ ID NO: 182243 - protein, 100 aa, Glycine max
  Coding DNA Sequence Number=SeqID_65465
MNEEYEAAIAVAFQSQKPKSLDVVIEIGVGCHWLYALKKTLPKADAFTAPCSSITRACNPEKLTPLAHLASQTGESPAWSNRQCNWRDQCHVSTPAQTHQ

SEQ ID NO: 182244 - protein, 58 aa, Glycine max
  Coding DNA Sequence Number=SeqID_65466
MISFSDDNDDNTDVSNNNDDRNISNDHDVVTMMAVVAMIQMVVVVVVAMSQLRWWWWW

SEQ ID NO: 182245 - protein, 110 aa, Glycine max
  Coding DNA Sequence Number=SeqID_65467
  Gene Ontology: Mol. function=RNA-directed DNA polymerase activity; Cellular component=chromatin; Biological process=RNA-dependent DNA replication
LSEAPMVSQDGEAVAQEVLAPLMHDDSDGVQLADVGGGSMDAWAECLAKERDWVSLLEEDNSHGGARRVGLNSEGQVESQKGQDWSRRHGCFEQVEGGLRLRRPAEGIFT

SEQ ID NO: 182246 - protein, 99 aa, Glycine max
  Coding DNA Sequence Number=SeqID_65468
MEQFFGFAGLGCDRKMALREAGFTEQRTPPIPNSGGITGCCNHSPPWPACDSSGGTKVMEQFFGFAGALREAGFTEQRTPPIPNSGGITGCCNHSPPWP

SEQ ID NO: 182247 - protein, 90 aa, Glycine max
  Coding DNA Sequence Number=SeqID_65469
  Subcellular localization annotation: CTP_CleavageSite=65; ConfidenceScore=5.37e-01
MNSLRSSMIAVIFAMTLIFSYEVIMSQARAHSSSSLVSKMSQSSQSHSHSFFHKEEQKPTQEPAVATSLRRIPPSRPNPTQNRLKPRIRG

SEQ ID NO: 182248 - protein, 121 aa, Glycine max
  Coding DNA Sequence Number=SeqID_65470
MGRVNLELNLDFENLQNYAAKLSNCAANSANYAGKKWLSASFCCHGKGSFMTNGIELFGYCESLAGLMGTRAERNEEKATCVHLYLEICHGGQETLGTSGGMLLPKTKLGQSRPNPGIVSQ

SEQ ID NO: 182249 - protein, 126 aa, Glycine max
  Coding DNA Sequence Number=SeqID_65471
MTWKYDLLIDVGNALACACCVCSWGALCTDLSGSLALAFGHVHTLDVVYDRGGHCALTFQGALIGPWSLALTFGRDHNSYDTGNRVIVAKEHLWAPRLITYGRGAVTCTTGWSRQTQHSSLSESVV

SEQ ID NO: 182250 - protein, 138 aa, Glycine max
  Coding DNA Sequence Number=SeqID_65472
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=45%, E-value=9e-33, Identity=43%"; Hit description =Integrase, catalytic region
MDRGVIRPFGQGEVCEPGRAHLQGGATQAKQLALEGADKYGVAIGDDVARKPVMFAHNVEEQGCDFISSETGCDKIHRNILPDTGRRRNGVEQADRLSIDWLHLLANLALAHEVLNICAHIWPRRSWLEGDGGSSSFP

SEQ ID NO: 182251 - protein, 419 aa, Glycine max
  Coding DNA Sequence Number=SeqID_65473
  Homolog annotation: Hit_ID=Q655Q3; Match level="QueryCoverage=30%, HitCoverage=37%, E-value=2e-16, Identity=39%"; Hit description =Pectin methylesterase PME1-like protein
  Pfam annotation: Domain name=NAD_binding_6; Domain location=47-354; Score=-19.0; E_value=0.0023; Accession=PF08030.2; Description=Ferric reductase NAD binding domain
  Pfam annotation: Domain name=PMEI; Domain location=216-373; Score =108.8; E_value=1.6e-29; Accession=PF04043.6; Description=Plant invertasepectin methylesterase inhibitor
  Pfam module annotation: Pfam domain module=NAD_binding_6::PMEI; Domain location=47-354::216-373
  Subcellular localization annotation: CTP_CleavageSite=42; ConfidenceScore=5.40e-01
MHIPTTHHPPPHNQNPSSLISVSLQHVNPTSVLSIPPFVLPRCTITISSGSITISQHILLILHHLQKIHILPSTSTPPSSKHSPPPPSSPPPSPKHAPPPLPPSSPPPPSPKHAPPPPPSSSPPPPSPKHAPPPPPPPPPPPPSSPPPPSPKHAPPPPFSPPPSQTHVPPPPPSPSSPKHAPPPPTPSPPSSTHSPPPPPPSPTPPPARAPSPPPPPPPSSPSSACKSTLYPKLCRSILSSIRSSPSDPYNLGKFSIKQSLKQAKKLVKVFKNFLTKHKSSSSLNTAEIAALEDCSELNKLSIDYLESVSIELKSIDSNNTELVEKIETYLSAVATNHYTCYDGLVVIKSNIANAIAVPLKNVTQLYSVSLGLFTQALKKNLKKHKTRKHGLPTKDYKVRQPLRKLIKHCTWPHSCVES

SEQ ID NO: 182252 - protein, 138 aa, Glycine max
  Coding DNA Sequence Number=SeqID_65474
MDVGIDTDNAGDHREIWRDKELKTSLNDKVKNLSFHHDHDVYDPPPSCEFMCIFKVELDRTREAVAQALTDCAHVEKKAPKWFMTEDYFYKINGWKPPRPPTLPSNPINLSSDSDDFGDEFLWKLDEEVVKDEANCII

SEQ ID NO: 182253 - protein, 419 aa, Glycine max
  Coding DNA Sequence Number=SeqID_65475
MASRKRKSTASQPRELYDTTRFVFEVAWECYSQNIHSWNILPERNINLFVTEYDEFRRELIRRNWHKALTQHMDGHIDVALVKEFYLNLYDPEDKSPKQIRVRGKLINFEAALLNAFWETPPVILPGEQYPSYSIFCRAWTHPQELASKLCILGHGFVLNVEGAPWRLLRKDLTTLAKTWSVLSYSNLAPTSHTSDFNMDRARLVYGPVMKMDMDVGFLISHQMSQMAKFNSCRLGTRKAQARGSEVPSSAAPPASASSAPAPSPALAPSTSAPPLPPTYSHSPASFAPSSSCQCQCSKVTIPMLQSIHRGLCLVMQSMHDSTQHWPFISMDEFMAQVAWPRVQPSPLGGGEASTTQEPQPEPEVAHEATLHATSPIVEVSEGEEAAHETPQPAQDTPSLPYGEPAPAQDEPTAAPDDC

SEQ ID NO: 182254 - protein, 348 aa, Glycine max
  Coding DNA Sequence Number=SeqID_65476
  Gene Ontology: Mol. function=enzyme inhibitor activity; Cellular component=cell wall; Biological process=cell wall modification
  Homolog annotation: Hit_ID=Q1STF1; Match level="QueryCoverage=97%, HitCoverage=64%, E-value=1e-111, Identity=56%"; Hit description =Pectinesterase; Pectinesterase inhibitor
  Pfam annotation: Domain name=Pectinesterase; Domain location=36-334; Score=686.6; E_value=1.9e-203; Accession=PF01095.10; Description =Pectinesterase
LLHTKYSCTGSSNCSTRSERILQESENKGVLLKEFAIVSLDGTENFTSIGDAIAAAPDNLRPEDGYFLIYAREGNYEEYVTVPIQKKNILLIGDGINKTCMTGNHSVVDGWTTFNSSTFAVSGERFVAVDVTFRNTAGPQKHQAVALRNNADLSTFYRCSFEGYQDTLYVHSLRQFYRECDIYGTVDFIFGNAAVVFQSCNIYARKPMPNQKNAVTAQGRTDPNQNTGISIQNCKIDAAPDLAADLNSTENYLGRPWKVYSRTVFMQSYIGELIQSAGWLEWNGTDGLSTLFYGEFQNFGPGSDTSKRVQWSGYNLLSATQARNFTVHNFTLGYTWLPDTDIPYSEGL

SEQ ID NO: 182255 - protein, 85 aa, Glycine max
  Coding DNA Sequence Number=SeqID_65477
MRNTYLDMEKINAQEATKAEEDECTMQRVQVSAASLSAGHSLSEHSMTFEFSEFKLTRLAGRLASPNSKIWHSREKVRLSAKGRA

SEQ ID NO: 182256 - protein, 350 aa, Glycine max
  Coding DNA Sequence Number=SeqID_65478
  Gene Ontology: Mol. function=RNA-directed DNA polymerase activity; Biological process=RNA-dependent DNA replication
MVHLRLCDTIKQPNINKEYIRIAIFPFSLNGKACFFVINIDKLQGNLSEAWERFQELLKSCPHHGFNQQRIMHIFYGGVPSHNRTSLDATCQGNMMMKPPIDAIKIIEDMRSNPYNNSKDKRIMKITVNQEDAKAIKIRSKKVKEDFKQKEESTSNTTEEVLTEESLVPDKGVEEKKEASSEAERPWELREPKPTNITVHLVDHLVEDEKVPIILGCPFLNTCVLVVESRDILDDLVEERLPSVWMIDPLERVLTNENFEKEMGLGEKEGNGPKEKPSIEDPPNFELKPLLSNLKYVFLNITSSLPVVISTSLHESEKGKLLRVLRDIREAFGWTIHDIKGLDSTICTTR

SEQ ID NO: 182257 - protein, 212 aa, Glycine max
  Coding DNA Sequence Number=SeqID_65479
  Homolog annotation: Hit_ID=Q0KIN0; Match level="QueryCoverage=39%, HitCoverage=5%, E-value=5e-23, Identity=60%"; Hit description =Integrase core domain containing protein
MPPLFGGIFSKIRHGKPPWRRHLTTLFVGDYLRPPSPIFGDPDTINALTSMTRDIFLAMYFTHAQQNDKWSSVRKSHIICLSSWGAAYISVGQLHLVPLHPPVIPHTDPPASSPAPTGPPTIPPAPEFTIALSKGEAMADLRWRQAMLDEMAALQTSGTWELVAPDGIDRFKAHLVTKGYTQIFGLDYGNTFSPVAKITYVRMFLAMAVIRH

SEQ ID NO: 182258 - protein, 66 aa, Glycine max
  Coding DNA Sequence Number=SeqID_65480
MDFTVKQMAGRKKSPLNTSRSPSHFEHWDLCLQLHCKHLRDSCLIPRITLPPVVVSLVNDLLSFAK

SEQ ID NO: 182259 - protein, 225 aa, Glycine max
  Coding DNA Sequence Number=SeqID_65481
MEKKPLLAESDYYYRVEFRACKDDAWYATRVSLEGETLKVKYFNFPDEYDNAFRASEFGDLEKLQEFGERFRTLSKQAQDSDCRSLAEGVWVCACQCFGDDDLRYYDAVVDGVQHGKHYWKAGKETCFCTFILFWLQGPNAGNLTATTIQDICMVQLERQLDPVVASFLEMARRKIERPAKAMLDMISYITLQEKQCANQSVVKFCSPEGLRHSSQNHRSTFRII

SEQ ID NO: 182260 - protein, 116 aa, Glycine max
  Coding DNA Sequence Number=SeqID_65482
MVIFLYIALLREVKLECLIQEIKGIILFQVGREKFLIRWLLVANQKNVEVHHEISKKFWDSQHWPKHILVQYTWKEHSEIDVTSRFFVLFGSAKEEEKNEGPTEESDDDIAHPLGN

SEQ ID NO: 182261 - protein, 498 aa, Glycine max
  Coding DNA Sequence Number=SeqID_65483
  Gene Ontology: Mol. function=transporter activity; Cellular component= integral to membrane; Biological process=transport
  Homolog annotation: Hit_ID=Q2PF04; Match level="QueryCoverage=99%, HitCoverage=99%, E-value=0.0, Identity=71%"; Hit description =Putative transporter-like protein
  Pfam annotation: Domain name=MFS_1; Domain location=40-449; Score =100.0; E_value=6.9e-27; Accession=PF07690.6; Description=Major Facilitator Superfamily
  Pfam annotation: Domain name=Sugar_tr; Domain location=61-491; Score=- 147.7; E_value=0.03; Accession=PF00083.14; Description=Sugar (and other) transporter
  Pfam module annotation: Pfam domain module=MFS_1::Sugar_tr; Domain location=40-449::61-491
MEENVKQPLLERKYYEDCPGCKVDQAKELSEGQGVPVRNLFIIWMVVLCADKHSCYKVAKLALPISSLFPFLYFMVRDFNIAKTEADISSYAGYVGSAFMFGRCLTSVMWGIVADRYGRKPVIVIGIIVVVIFNTLFGLSTSFWMAVIMRFLLGSLNGLLGPVKAYATELFREEHQALGLSTVSAAWGVGLIIGPALGGYLAQPVEKYPHIFSKDSFWDKFPYFLPNFIISAVAFVVVIGCIWIPETLHNHNCRNESIDNAEALENGGSVASKDKIIQKKENLLLNWPLMSSVIVYCVFALHDIAYQEVFSLWAVSPQRLGGLNFTTDDVGNVLSISGLALIIYQLTIYPSVEKASGPIVIGRISGMISIPLLQSYPFIALLSGLAIYIVLSIASVLKNILSATINTGLFLLQNRAVEQHQRGAANGISMTGMSLFKAIGPATGGAILTWSQKRMDASFLPGTHMVFFALNIVEALGLLMLFKPFLVEKNKTHLNQLH

SEQ ID NO: 182262 - protein, 81 aa, Glycine max
  Coding DNA Sequence Number=SeqID_65484
MKEALVMTDGESVDADIGGRQWRRPFSGSYAQPSGNIKKNHWCLKVSGILSLHMIGNNELPYLGRGIQSDSPTSAIREFSL

SEQ ID NO: 182263 - protein, 107 aa, Glycine max
  Coding DNA Sequence Number=SeqID_65485
  Homolog annotation: Hit_ID=Q2PF04; Match level="QueryCoverage=45%, HitCoverage=9%, E-value=5e-09, Identity=64%"; Hit description =Putative transporter-like protein
MTEKNGKQPLLERKYYEDCPGCKVDQAKELSKGQGVSFTNLFIIWVVVLCAVCRCQKRHRDTSNKKGLRASLVPALPLCFVGCLKVPHAPLSIPEVQLIYCSALIGI

SEQ ID NO: 182264 - protein, 580 aa, Glycine max
  Coding DNA Sequence Number=SeqID_65486
  Gene Ontology: Mol. function=enzyme inhibitor activity; Cellular component=cell wall; Biological process=cell wall modification
  Homolog annotation: Hit_ID=Q43111; Match level="QueryCoverage=99%, HitCoverage=99%, E-value=1e-139, Identity=47%"; Hit description =Pectinesterase-3 precursor
  Pfam annotation: Domain name=PMEI; Domain location=67-222; Score =124.9; E_value=2.3e-34; Accession=PF04043.6; Description=Plant invertasepectin methylesterase inhibitor
  Pfam annotation: Domain name=Pectinesterase; Domain location=274-566; Score=723.3; E_value=1.7e-214; Accession=PF01095.10; Description =Pectinesterase
  Pfam module annotation: Pfam domain module=PMEI::Pectinesterase; Domain location=67-222::274-566
MSSFKSYGKVDESEQARLEARRKTGKRVTIIALSTIVLIGVVCAAVFGTVAHNNSDNNDGVNSNSAPFLSNSVKSVCDLTLYKGACYSSIGPLVHSGQVRPEKLFLLSIEVALAEASRAVEYFSEKGVFNGLINVDNKTMEGFKNCKDLLGLAVDHLNSSLASGGKSSLLDVLEDLRTWLSAAGTYQQTCIDGFGEAGEALKTSVVNNLKNSTEFTSNSLAIVTWLNKAASTVNLRRLLSTTLPHHHHMVEPKWLHSKDRKLIQKDDNLKRKADIVVAKDGSGKFKTITAALKHVPEKSDKRTVIYVKKGVYYENVRVEKTKWNVMIIGDGMNATIVSGSLNFVDGTPTFSTATFAVFGKNFIARDMGFRNTAGPQKHQAVALMTSADQAVYYRCQIDAFQDSLYAHSNRQFYRECNIYGTVDFIFGNSAVVLQNCNIFPRVPMQGQQNTITAQGKTDPNMNTGISIQSCNIAPFGDLSSVKTYLGRPWKNYSTTVFMQSTLGSFIHPNGWLPWVGDSAPDTIFYAEFQNVGPGSSTKNRVKWKGLKTITKKQASMFTVNAFLSGEKWITASGAPFKSST

SEQ ID NO: 182265 - protein, 197 aa, Glycine max
  Coding DNA Sequence Number=SeqID_65487
LRLPAIRQPLILQFKATFHCDKDAIEIPGFYQRQWLPNYPEIVEFKYDGETYEILVRQQKDKLYFADGLTRFRTELQIYESVTINFLACDHPAKFDLHFTPPLDQQKCKRRRPTRKHIWTYEITQSMLGAPYPLQLPTSVTQCLIHCGDHMTILRRFGPPLQWNVVVLDKGIGDKRAEKIWEVVIRRAIDWDDSDID

SEQ ID NO: 182266 - protein, 49 aa, Glycine max
  Coding DNA Sequence Number=SeqID_65488
  Homolog annotation: Hit_ID=Q9ZR45; Match level="QueryCoverage=90%, HitCoverage=4%, E-value=1e-07, Identity=64%"; Hit description=Alpha -N-acetylglucosaminidase
MPQHHPLWSTIDNTGEVKYQSPSLVIFAEGNIFVKAAGTFPEKDGSTRK

SEQ ID NO: 182267 - protein, 226 aa, Glycine max
  Coding DNA Sequence Number=SeqID_65489
  Homolog annotation: Hit_ID=Q9FNA3; Match level="QueryCoverage=70%, HitCoverage=19%, E-value=6e-32, Identity=50%"; Hit description=Alpha- N-acetylglucosaminidase
MFPDWNPSTNSVTGTSNNQKIYLLPPGNRRYLFQETLSDMPQAHLWYPSDDVIKALQLFLAGGKNLAGSLTYRPSVDSSNQDNNLREIVGKALLQASKVYHKAVTSYQKKNIEALQFHSNKFLQLIKDIDVLLASDDNFLLGTWLESAKKLAVNPSEIKQHIPFGSLRSVRISTFHIGSLLIVFFLRGEQYCTVPLPLFGSLPDTLLSAMLLMADGGSWRKVKNPP

SEQ ID NO: 182268 - protein, 69 aa, Glycine max
  Coding DNA Sequence Number=SeqID_65490
MEITGLTSGRWKRGVNHMNWTMHAACVSFASTSVEHILKNGHEGIKQYFLRKMVMSSVSGVVQGKSHLN

SEQ ID NO: 182269 - protein, 182 aa, Glycine max
  Coding DNA Sequence Number=SeqID_65491
  Gene Ontology: Mol. function=hydrolase activity, acting on glycosyl bonds; Cellular component=extracellular space; Biological process =metabolic process
  Homolog annotation: Hit_ID=Q9ZR45; Match level="QueryCoverage=73%, HitCoverage=16%, E-value=9e-62, Identity=75%"; Hit description=Alpha- N-acetylglucosaminidase
MLKRSISTSLLMDVCGGDSCFLINNHNKSSQNEPEIIIRGTTAVEIASGLHWYLKYWCGAHVSWDKTGGIQTTSIPEPGSLPSLKDEGLKIKRPVPWNYYQNVVTSSYSYVWWNWERWEKELDWMALQGVNLPLAFTGQEAIWQKVFKVKCYSHACVCLDKAWFKKNEFSSLRILIEPKICS

SEQ ID NO: 182270 - protein, 203 aa, Glycine max
  Coding DNA Sequence Number=SeqID_65492
MLLRLRIVLLRAVIQHIPIMGVIAFSTMIVVVDEIFLVVAVVVVTAIEMVMAKEYPNQYPNQSQYQMLPPPSHYPNQYPNQYHNQYPSQPHYNHPQAPAPQAHSQTHPPASHHVTNLPQNIHQTTPFEGLDQITIGNGQGLSINSSALLQLTKQQLQSSFTVNTMSRASSSDSVSPSVNRINNVSAVNTVSIVLFLLPLGIPD

SEQ ID NO: 182271 - protein, 538 aa, Glycine max
  Coding DNA Sequence Number=SeqID_65493
  Gene Ontology: Mol. function=nucleic acid binding; Cellular component= mitochondrion; Biological process=DNA integration
  Homolog annotation: Hit_ID=Q1SRN1; Match level="QueryCoverage=74%, HitCoverage=35%, E-value=1e-104, Identity=42%"; Hit description =Integrase, catalytic region
MVPRQPMKACSDDGDHGVLSLLCTWTAWCSSARSLKKLPKIQKQIFKEGEKGPRSTGTWKHQSNLSNNEQIPIPAAAGPLPSSQPEVSSTAAPAPSSSPVISASAPTAESLPLLARPDNTHSMCTRAKAGIAEYDALIHNGTWTLVDIPSSRLGYDYNETFSPVIKPVTVKIFLTLAITHKWKLQSLDVSDAFLNGIVQEEVYKTQPLALRTPTNSLFASSTNVIPPFVYSGSTTVVYMLVYVDDIIVTGNNPTFINLSYINSILSPLKDLGDLDYFWELRDLLEKTTMDEANSFSYPMVGGRKSTSTGYESFSDPSLYRSVVGALQYATVTRPEISFSVNKVCQFMGKPTEQHWMAVKRILRYLKGTINFGLHMQPRPNFSVSHFSVHAYCDADWASDPDDRRSSSGAAIFLGPNLVSWWSKKQTVVARSIPHAPPVIFCDNLSTVALAHNPVLYSSTKHIELDLFFVREKVIGKHLQVVHVPAADQRADILTEALTLSNFTTYGTKLRVVEKPSANHSGACGGVIGVHLLVVMFSF

SEQ ID NO: 182272 - protein, 89 aa, Glycine max
  Coding DNA Sequence Number=SeqID_65494
MAAASCTDGGALLESKRCSKGSMASYLDSAAGSKGVRINIRNTNPNFNIVLFFPQREMKNGILFRHLIATALTVATGIIDTHTHVQTKS

SEQ ID NO: 182273 - protein, 349 aa, Glycine max
  Coding DNA Sequence Number=SeqID_65495
  Homolog annotation: Hit_ID=Q9FNA3; Match level="QueryCoverage=23%, HitCoverage=8%, E-value=3e-25, Identity=89%"; Hit description=Alpha -N-acetylglucosaminidase
MGAFFSNLDATVEEIEIGRDDAFFNGVHDDNVSSRPGGEGSAGAKAVSLTSQFPISPLMLTVMLTRYLIRMTEPNLVSWWSKKQTVVARSSTEAEYQSLALATGQKHVELDLFFVCEKVIGKHLQVVHIPVADQRADIFTKALTSSNFTTYRTKLRVVEKSANHSSACRGYRSILTHCNVFFLAKAHLTSRFCGIELGPKLKFKDGNIESTIVEFALTRASTGPEEIESRVPYISILPPKLCSMHLKQNLVTRANKVLITRYKEYHKTERNFSILVLHQQIDQEQSSSQMEQNHWQFGIKKHYHVDCYRAEYGKQRFIMQSMLHEYLEWDPNTTTTLELEVNDHFAKML

SEQ ID NO: 182274 - protein, 132 aa, Glycine max
  Coding DNA Sequence Number=SeqID_65496
  Homolog annotation: Hit_ID=Q9M4G9; Match level="QueryCoverage=41%, HitCoverage=41%, E-value=1e-12, Identity=53%"; Hit description =Putative ripening-related protein
  Pfam annotation: Domain name=Bet_v_I; Domain location=2-105; Score =3.4; E_value=2.8e-06; Accession=PF00407.9; Description=Pathogenesis -related protein Bet v I family
MALSGKVETQVEIQAPAAKFYYVFRKQLHHVPNGAKVHDADWENVGSVKHWDFTIDVIEHLNSKRIKLNLKSKLEEKKVCVLDNIKCMNVCRESMREPDTYSVERKLRVLVGRSCYSDIIAFADNYQFVDNS

SEQ ID NO: 182275 - protein, 117 aa, Glycine max
  Coding DNA Sequence Number=SeqID_65497
  Gene Ontology: Mol. function=transporter activity; Cellular component= integral to membrane; Biological process=transport
  Homolog annotation: Hit_ID=Q2PF04; Match level="QueryCoverage=85%, HitCoverage=21%, E-value=2e-28, Identity=59%"; Hit description =Putative transporter-like protein
MAVIMRFLMGSLNGLLGTAKAYATEIFREEHQALGLSTVSAAWGIGLIIGPALGGYLAQPVEKYPHIFPKDSFWDKFPYFLPNFVVSALAFVVAIGCIWIPIVSYAYCNLALTVQLK

SEQ ID NO: 182276 - protein, 61 aa, Glycine max
  Coding DNA Sequence Number=SeqID_65498
MMIMTHPSGVVHALRLSKALKGESTTTVIGSGTEALSCYGLTTTLLVDHDPHELTTTMVRP

SEQ ID NO: 182277 - protein, 89 aa, Glycine max
  Coding DNA Sequence Number=SeqID_65499
MLVQRERERENGSMKSELGERKEHRLKDEQRFHERFKEETFMQKAWRNHSQQQALFNVLLCGSSYRGSAHSRVLKAIAKDQSSSTQKKG

SEQ ID NO: 182278 - protein, 223 aa, Glycine max
  Coding DNA Sequence Number=SeqID_65500
  Subcellular localization annotation: CTP_CleavageSite=41; ConfidenceScore=5.38e-01
MAESSKKRKGSSSTAVAAAHHRHRPSEAPTAPIHPSLSSPRSSTLFSSDDRRLRYLSQFSSRIILDPMYLDIDFFNDETFDWYQDGILSSEVHGITMIIDSQGAPFEGTIVDDWKFDYSSHDAHRMVCNDQAKITSRLLVGSLTFDNCIMHYIIVRILLPRSSNFAQASEEDLILMWAFLTGRQIDWAHLVRYRMHKAYITGQCTSPLPSIGHSISLSFSNSA

SEQ ID NO: 182279 - protein, 59 aa, Glycine max
  Coding DNA Sequence Number=SeqID_65501
MLGFVVLELVRVIFTVDDFLVRAIVVDNISVLIRKVDVDIDLLECVIGGGGGHRRGSVA

SEQ ID NO: 182280 - protein, 535 aa, Glycine max
  Coding DNA Sequence Number=SeqID_65502
  Gene Ontology: Mol. function=protein dimerization activity; Cellular component=nucleus; Biological process=regulation of transcription, DNA-dependent
  Homolog annotation: Hit_ID=Q1SYN6; Match level="QueryCoverage=93%, HitCoverage=73%, E-value=6e-79, Identity=32%"; Hit description=Zinc finger, BED-type predicted
  Pfam annotation: Domain name=hATC; Domain location=420-503; Score =103.6; E_value=5.9e-28; Accession=PF05699.5; Description=hAT family dimerisation domain
MREIIATAIMVHEYPFSVDEDSIWMWAFQYANPDFHKVTHKTAGNDCLALFEMEKKTLKKLLESVSKIGLTTYMWKSSHQVVEYMVITGHFIDAGWNLQKRVLSFVKVPAPRRGIDVVDAIFKCLKTWGIENKVFSISVNNASYNDSCIRCLKENISLSLQDDLSTIKDIIFNIRESVKYINHNDARLKAFCDVVEQKHLKERKLVIDCPTRWNSTFNMLSTALKFKTAFASYKEREPHYNYAPLLEEWNQVEKVCKLLEVFNLATHVISGSEYPTANLYFAEVWKVKKILDKEIEDEDIFMREMIGPMKKKFDKYWGERNMLMAIASVLDPSKFHMVSTCFPLIYSKEDVDENIKKVKSSFEELYDEYVGLCLQESTSSVVNLDDNISSSSQLNTSVVTGFDDMSMLREKEVVSPIKSELQDYLDEGIYVPNTNSFSALDWWRNNNMKYKMLSKMAADILAISISTVASESTFSAGGRVIDEFRSKLNEESVEALICDGNWFRQKYNVKKKSKIFYVPVLFKWNGDVGQDYQLN

SEQ ID NO: 182281 - protein, 271 aa, Glycine max
  Coding DNA Sequence Number=SeqID_65503
MATIMEAMMSIKRMMEVNVATVVALSTATEMDPTHLLGFDQVNHPTSDMVGQAGEAFESMNDPHFVQVQNKHSFPPYGLPPNYTPPDVARTPNENVDNFACIPSESQQTQFDHAHVSQPMGETHEASRDHNLVDSKPHLECAAEGQAFCIVPLPNSLKGPQFRPQLQPLHFAVGRVPPTVVERGKFDHIEERLRAIEGGRDYAFVDMAELCLVPDVIIPPKFKVPNFDKYKGTTCPKNHLKMYNRKMGAYSKNEKMLMHFFQESLTGAAVT

SEQ ID NO: 182282 - protein, 630 aa, Glycine max
  Coding DNA Sequence Number=SeqID_65504
  Gene Ontology: Mol. function=translation initiation factor activity; Cellular component=eukaryotic translation initiation factor 2B complex; Biological process=cellular metabolic process
  Homolog annotation: Hit_ID=Q9FFV8; Match level="QueryCoverage=99%, HitCoverage=94%, E-value=1e-168, Identity=53%"; Hit description =Similarity to guanine nucleotide exchange factor
  Pfam annotation: Domain name=IF-2B; Domain location=358-630; Score =251.0; E_value=2.5e-72; Accession=PF01008.8; Description=Initiation factor 2 subunit family
MDARRAPRAVIDPKVRRVGFFAPPEPDPISFEVSPSANSLSPVMIPPPRHSSENLGLHTRLAATSPSAQESFAAGSYSSSSDFFPAPMSPATSPYSSRIVGGDGDFFAGGKAASSFPRGGFDLTATMASSVPASELTTVSVVNAASLSIRGEFGTSFVKVKMKLQLKSVGGLIEYFLYHFLPPLERKKANKGGGSAVEVKDQALNTKQQKKEKTSKAERRALQEAQRAAKAAAKGNKASGTLASVNVKPAKAAKPPQKVDNASVAASEKKGGDRPPEKDRKKDVPQPRLQYDDKSRVEKAKRRAVVKQTEAKNRVELFRHLPQYEHGSQLPDLEAKFFQLGPVHPAVYKVGLQYLSGDISGGNARCIAMLQAFQEAIEDYRVPSEKTLVRDLTAKISSYVSFLIECRPLSISMGNAIRFLKSRIAKLPLTLSESESKTSLQSDIERFIYEKIILANKVIVKHAVTKIRDGDVLLTYGSSSAVEMILLHAHGLGKQFRVVVVDSRPKLRGKLLLRRLVEKGLSCTYIHINAVSYIMNEVTRVFLGASSVLSNGTVYSGVGTACVAMVAHAFHVPVLVCCEAYKFHERVQHDSICSNELGDPDVISTVQSREDVNHLEAWANTENLQLLNLM

SEQ ID NO: 182283 - protein, 71 aa, Glycine max
  Coding DNA Sequence Number=SeqID_65505
MTLQLLEIVKLVARNFWALCGIWVLSNGIDISFYLVVTMPQAISFNIKKLSCSWNCNALYASPLPTVRSVL

SEQ ID NO: 182284 - protein, 1126 aa, Glycine max
  Coding DNA Sequence Number=SeqID_65506
  Gene Ontology: Mol. function=binding; Cellular component=nucleus; Biological process=signal transduction
  Homolog annotation: Hit_ID=O04390; Match level="QueryCoverage=99%, HitCoverage=98%, E-value=0.0, Identity=42%"; Hit description=Nuclear matrix constituent protein 1
MAVKLYEYQFNMGLLLIEKKEWNSKYTELSQDLVEVKDALDREKAAHLIALSEAEKREENLRKALGVEKECVLDLEKALREMRSEHAKIKFTADSKLAEANALVASIEEKSLEVEAKLRSADAKFAEISRKSSEFDRKSLDLESQESALRRDRLSFIAEQEAHESTLSKQREDLREWEKKLQEGEERLAKGQRIINEREQRANENDRLCRQKEKDLEEAQKKIDATNVTLRNKEDDVNNRFANITLKEKEYDSLRINLDIKEKELSAWEEKLNAREKVEMQKLLDEQNTILDVKKQEFEVELDEKRKSFEDGLKNKLVEVEKKEAEITHAEEKVVKREQALGKKAEKLKEKEIEYEQKVKALKEKEKLIKSEEKSLETEKRKIESEREELLTHKAEVEKIRANNEEELLRINEEIDRLKVTEEERSEYLRLQSQLKHEVDQYRHQKELLLKEAEDLRQQKETFEREWDELDLKRTDVEKELKSVVQQKEELLKLQQYEEEKLKNEKQDTQAYVQRELETLKLAKESFAAEMELEKSSLAEKALSERNQMLLDFELQKKELEADMHNQLEQKEKDLIERKKLFEEKRESELNNINFLREVANREMDEMKLQRSKSEKEKQEADENKKHLERQRMEMQEDIDVLVDLNRKLKNQREEFIVERRRFIEFVEKLRSCQNCGEMISEFVLSDLQSSVDIENLEVPSHPKLAADIVQGVSNENLASSRQNTGVSPATDPKSPVSGGTVSWLRKCTSKIFKISPIRKIESEDSGTLRDVVTLSVEKTNVEDSPGRIPDAENEAELSFAVVNDSFDVQRVQSGNDIVEVEADHEPSVENLNNVDSKAPEDLQAPDSKVGQQKSRKGGGRPRVKRTHTVKAVIKEARGILGESAEALPGESVDDHENEFPNGNAEDSANVNSESQKPSNRRIPANVRKRNRVQTSSQMTVSGHGGDASEGHSDSLIPGQRKRRRQKAAAPPAQTAGESRYNLRRPKIGATTSSVRAMSGGGKESQGEVDRVKDTGEGIVDSKTSHSHSVGITNENGGSIHLEQSLKGAETRDGYGGDTIGTFVNNMALSEEVNGTADDVEENDAEYRSESHGEDAAGGVENEDDEDYLQPGEASIGKKLWNFFTT

SEQ ID NO: 182285 - protein, 367 aa, Glycine max
  Coding DNA Sequence Number=SeqID_65507
  Gene Ontology: Mol. function=protein binding; Biological process =defense response
  Homolog annotation: Hit_ID=Q19PN3; Match level="QueryCoverage=87%, HitCoverage=27%, E-value=6e-15, Identity=27%"; Hit description=NBS -LRR type disease resistance protein
  Pfam annotation: Domain name=LRR_1; Domain location=178-201; Score =0.9; E_value=1.9e+02; Accession=PF00560.23; Description=Leucine Rich Repeat
  Pfam annotation: Domain name=LRR_1; Domain location=223-246; Score =3.7; E_value=58; Accession=PF00560.23; Description=Leucine Rich Repeat
  Pfam annotation: Domain name=LRR_1; Domain location=251-274; Score =4.3; E_value=45; Accession=PF00560.23; Description=Leucine Rich Repeat
  Pfam annotation: Domain name=LRR_1; Domain location=27-48; Score =13.0; E_value=1.1; Accession=PF00560.23; Description=Leucine Rich Repeat
  Pfam annotation: Domain name=LRR_1; Domain location=3-25; Score=13.7; E_value=0.68; Accession=PF00560.23; Description=Leucine Rich Repeat
  Pfam annotation: Domain name=LRR_1; Domain location=50-72; Score=9.6; E_value=4.5; Accession=PF00560.23; Description=Leucine Rich Repeat
  Pfam module annotation: Pfam domain module=LRR_1::LRR_1::LRR_1::LRR _1::LRR_1::LRR_1; Domain location=178-201::223-246::251-274::27-48::3- 25::50-72
MNALTLLDLSENYGLTSLPKSLSKLRSLTSLVLRECRQLEYIPPLGDLQALSRLDISRCDSILRVPEGLQNLINLKWLDLLQNENSTVKLIAGRVLAGLSNMQYLDLRSWSGIKVEDVKGMTKLECFAGSFLDQDNYNRYVQEIQDTGYGPQTYIIYFGKFKTATPGFCEDSIYVKFKLRRVWFGDCDELPYLLPTDLAELCVGHNNQWECLCAALSSNGSLSLEDIYIHNCTNLKSLFCLCFSLCTNIQSLKSLELDFLESLTAICKEHIVDLTQSLSLSGVFSQLQRFSIHECHAIEMLLTTELVPQLRNLEFISVWNCQSMKEIFAVSYSGGDDDSFTITLPKLNTLELGFLPQFVQRNFSLCI

SEQ ID NO: 182286 - protein, 39 aa, Glycine max
  Coding DNA Sequence Number=SeqID_65508
MVALIGIGAHHKNNKCIVSCYGWATVHEGTVALELGTQG

SEQ ID NO: 182287 - protein, 449 aa, Glycine max
  Coding DNA Sequence Number=SeqID_65509
  Gene Ontology: Mol. function=protein binding; Cellular component =mitochondrion; Biological process=defense response
  Homolog annotation: Hit_ID=Q19PN1; Match level="QueryCoverage=91%, HitCoverage=33%, E-value=2e-56, Identity=34%"; Hit description=NBS -LRR type disease resistance protein
  Pfam annotation: Domain name=NB-ARC; Domain location=84-387; Score =163.0; E_value=7.7e-46; Accession=PF00931.13; Description=NB-ARC domain
  Pfam annotation: Domain name=zf-C2HC_plant; Domain location=10-61; Score=8.4; E_value=0.0041; Accession=PF07567.3; Description=Protein of unknown function, DUF1544
  Pfam module annotation: Pfam domain module=NB-ARC::zf-C2HC_plant; Domain location=84-387::10-61
MGRPKDEHYWNLVTKEENGTLKCKQCGLMFKGGVSRIKAHVDRIKGKGVRICSSIDHDHVQNNIIYGSNHSKRKRQVDIWLNKVQELKRRAIVINDLQELQFGLTDLYGLEIRMWKFLKNDQVFVIGIHGMGGVGKTFLATYMENEINRKGTFKHVFWINVSHDFSIFKLQHDIAETIGVKLNRDDERTRATILSLALETREKTVIILDDVWKYIDLQNVGIPLKVNGIKLIITTRLRHVCLQMDCLPNNIIKIFPFEEEEEAWELFLLKLGHRGTPATLPPHLLEIARSVVMKCNGLPLGISVMARTMKGENDIRRWRHALNNLEKSEMGEEMKEEVLTVLKRSYDNLIEKVMQNCFLFCALLPSIRQEELVMMLVQSGLLNGKRSLEEIFDEGHVIVDKLMDHSLLFDEIEVLRMHGLEWTVDLEVVSLAGNEIEEIPEGTSPHCPP

SEQ ID NO: 182288 - protein, 48 aa, Glycine max
  Coding DNA Sequence Number=SeqID_65510
MAEPLRAWAIAQGSRTLKPPMTTRTLSTLMPLAFRKKLQGIVNAKLKE

SEQ ID NO: 182289 - protein, 1158 aa, Glycine max
  Coding DNA Sequence Number=SeqID_65511
  Gene Ontology: Mol. function=protein binding; Biological process =defense response
  Homolog annotation: Hit_ID=Q19PN1; Match level="QueryCoverage=65%, HitCoverage=53%, E-value=8e-72, Identity=37%"; Hit description=NBS -LRR type disease resistance protein
  Pfam annotation: Domain name=LRR_1; Domain location=1025-1048; Score =6.1; E_value=20; Accession=PF00560.23; Description=Leucine Rich Repeat
  Pfam annotation: Domain name=LRR_1; Domain location=1060-1084; Score =4.7; E_value=37; Accession=PF00560.23; Description=Leucine Rich Repeat
  Pfam annotation: Domain name=LRR_1; Domain location=1086-1109; Score =5.7; E_value=24; Accession=PF00560.23; Description=Leucine Rich Repeat
  Pfam annotation: Domain name=LRR_1; Domain location=1114-1137; Score =2.4; E_value=1e+02; Accession=PF00560.23; Description=Leucine Rich Repeat
  Pfam annotation: Domain name=LRR_1; Domain location=733-755; Score =7.7; E_value=11; Accession=PF00560.23; Description=Leucine Rich Repeat
  Pfam annotation: Domain name=LRR_1; Domain location=757-779; Score =10.2; E_value=3.5; Accession=PF00560.23; Description=Leucine Rich Repeat
  Pfam annotation: Domain name=LRR_1; Domain location=781-803; Score =14.7; E_value=0.34; Accession=PF00560.23; Description=Leucine Rich Repeat
  Pfam annotation: Domain name=LRR_1; Domain location=805-826; Score =13.0; E_value=1.1; Accession=PF00560.23; Description=Leucine Rich Repeat
  Pfam annotation: Domain name=LRR_1; Domain location=828-850; Score =10.8; E_value=2.8; Accession=PF00560.23; Description=Leucine Rich Repeat
  Pfam annotation: Domain name=LRR_1; Domain location=997-1020; Score =2.5; E_value=98; Accession=PF00560.23; Description=Leucine Rich Repeat
  Pfam annotation: Domain name=NACHT; Domain location=410-556; Score= -38.3; E_value=0.056; Accession=PF05729.3; Description=NACHT domain
  Pfam annotation: Domain name=NB-ARC; Domain location=374-666; Score =147.7; E_value=3.1e-41; Accession=PF00931.13; Description=NB-ARC domain
  Pfam annotation: Domain name=Peptidase_C48; Domain location=29-257; Score=123.2; E_value=7.1e-34; Accession=PF02902.9; Description=Ulp1 protease family, C-terminal catalytic domain
  Pfam module annotation: Pfam domain module=LRR_1::LRR_1::LRR_1::LRR _1::LRR_1::LRR_1::LRR_1::LRR_1::LRR_1::LRR_1::NACHT::NB -ARC::Peptidase_C48; Domain location=1025-1048::1060-1084::1086 -1109::1114-1137::733-755::757-779:...
  Pfam module annotation: Domain location=:781-803::805-826::828 -850::997-1020::410-556::374-666::29-257
QILEHDPAAFESNDIEKAFFYPKGDPDAVCIRKSDIELLQPQKCLNDNIIDFYIKYLINKLPTDKQDRFHFFNCFFFPKLVDLSTDNPSIASDGKAAFQRVSKLTRKVNLFEKNYIFIPINYSLHWSLIVICHPAEVMTCYRDEETKGSPKEACILHMDSRKGIHQDLHNVFQSYLCEEWKERHNNVRDDVSSIFLDLPFVPLELPQQQNAYDCGIFLLHYVERFLEQAPINFNRSLISKFSYWFPPPDASLKRSHIHKLLIAAEGDNKMIVGGSVNPQNNTQLSALLGGDVEDHAVNGGSNGDDALTINRLLSDLAWEEDYFDKRLQWREFQGNKRERQHDDWLDELKDLKKRAIDVKNSLHQSGSTNEFPKPSELDDEYDDLLEENPWVSRDENVKEMWDLLEDEEVFIIGIDGMGGVGKTFMATHIKNEIKRKGTFKDVFWVTVSDDFTTFKLQHDIAETIQVKLYGDEMTRATILTSELEKREKTLLILDDVWDYIDLQKVGIPLNGIKLIITTRLKHVCLQMDCLPNNIITIFPFEEEEAWELFLLKLGHRGTPARLPPHVLEIARSVVMKCYGLPLGISVMARTMKGKDEIHWWRHALNKLDRLEMGEEVLSVLKRSYDNLIEKDIQKCFLQSALFPNDISQEQWVMMVFESGLLNGKGSLEEIFDEARVIVDKLINHSLLLGGWRLRMNGLVRKMACNILNENHTYMIKCHENLTKIPQMREWTADLEAVSLAGNEIEEIAEGTSPNCPRLSTFILSRNSISHIPKCFFRHMNALTLLDLSYNYELTSLPKSLSKLRSLTSLVLRECRQLEYIPPLGDLHALSRLDISGCDSLLRVPEGLQNLKKLQCLNLSRDLYLSLLLGCALPGLSNMQYLDLRGWSGIIVEDVKGMTKLECFAGSFLDQDNYNRYVQEIQDTGYGPQTYFIYFGKFDDFPLGFRTLVMDLKRPRVYFGDCDELPYLLPRDLAELLVIGNDQWECLCAALSSNGSLSLKDINIRDCTKLKSLFCVSCPLCTNIQNLKSLKLDNLDSLSVICKEDVAGLTQSLSRSEVFSHLKELSIIRCDQIEKLLTAGLVAQLQNLESISVSYCKSIKEIFAGDSSDNIALPNLTKLQLYRLPELKTVCKGILLCNSLDILGIDDCPNHEKPRIGRV

SEQ ID NO: 182290 - protein, 97 aa, Glycine max
  Coding DNA Sequence Number=SeqID_65512
MLKFSGSSSSISHPNSIDWILSSAHVITPSPWTIFGYQNGLRQFKEAKDKDSNGKKWDNHLAIMVVGVVDGTSIRSHLPDSSEVVACGMKEMSEDDK

SEQ ID NO: 182291 - protein, 279 aa, Glycine max
  Coding DNA Sequence Number=SeqID_65513
  Homolog annotation: Hit_ID=Q9FML3; Match level="QueryCoverage=42%, HitCoverage=44%, E-value=4e-32, Identity=52%"; Hit description =Arabidopsis thaliana genomic DNA, chromosome 5, P1 clone:MDC12
MANDFSFSTNGLNGSSSEKDPPDGGGVVEKLNMIEYKNGNPLNPMIHIVDWVYEGLCAPWQDALVIKLLGRNLGFQILHERLTRLWKLFAGFEMLDIYNGTATRLLLLHHPSALLHYWELDPAIIQVAREYFNLACLERDYQDRLFIYVDDALNTTVPNGFSGGGRIMVNVGGSCVEAENRLRDGKVVMEETLGAMKEVFGKKVFVLSLGNRKDDSSLTLTGDLPHLEEWKKLLPGPFKCYANIVNSFLATKFYEVSGDCVGGTDNRCDCGVYAKVHKF

SEQ ID NO: 182292 - protein, 128 aa, Glycine max
  Coding DNA Sequence Number=SeqID_65514
MSSGSEVDNFGDFEGSSLWLRWTEISSNERVSVDAPLNDNVTIIVKPKCQVPVKKKEYSPITLLWYSWVDEIPFDYFTMMCFTFPIRLLHNFIRMGKWQFKPSAFYIDSLGWNQRLGYSFIISKLGNG

SEQ ID NO: 182293 - protein, 49 aa, Glycine max
  Coding DNA Sequence Number=SeqID_65515
MTIEEKSYKKEGIGKEQTKGSYIKRHDKSLMTREKKTRIICQTGISSIF

SEQ ID NO: 182294 - protein, 413 aa, Glycine max
  Coding DNA Sequence Number=SeqID_65516
  Gene Ontology: Mol. function=transporter activity; Cellular component= integral to membrane; Biological process=transport
  Homolog annotation: Hit_ID=Q2PF04; Match level="QueryCoverage=88%, HitCoverage=75%, E-value=1e-156, Identity=73%"; Hit description =Putative transporter-like protein
  Pfam annotation: Domain name=MFS_1; Domain location=2-364; Score =11.7; E_value=9.3e-05; Accession=PF07690.6; Description=Major Facilitator Superfamily
  Pfam annotation: Domain name=TatC; Domain location=202-351; Score= -79.5; E_value=0.036; Accession=PF00902.8; Description=Sec -independent protein translocase protein (TatC)
  Pfam module annotation: Pfam domain module=MFS_1::TatC; Domain location=2-364::202-351
MHHFQMFDICIMGNCSRSLWPKTCYSYGDYCSLLVRNYQWLLDFSVIFNTLFGLSTNFWMAVIMRFLLGSLNGLLGPVKAYASELFREEHQAIGLSTVSAAWGIGLIIGPALGGYLAQPVEKYPHIFTKDSFWDKFPYFLPNLIISAFAFVVAIGCIWIPETLHNHNCSNESTDDAKALESGNSGAGNEKIIQKNDNLLLNWPLMSSIIVYCVFSLHDIAYQEVFSLWAVSPQRLGGLNFTTDNVGDVLSISGLALIIYQLTLYPFVEKASGPIVIARFSGMLTIPLLQSYPFIALLSGLALYIVISIASILKNIMSITIITSLFLLQNRAVEQHQRGAANGISMTAMSLFKAIGPATGGAVLTWSQKRMDASFLPGTHMVFFVLNIVEALGILMMFKPFLVEKKKTHSDQLH

SEQ ID NO: 182295 - protein, 65 aa, Glycine max
  Coding DNA Sequence Number=SeqID_65517
MVQKSPFAKRELRAKRIFDHALSHESQVLSAQPLHLRLIWSAKLAKDKLSQLQFDLNLAKLQPGR

SEQ ID NO: 182296 - protein, 135 aa, Glycine max
  Coding DNA Sequence Number=SeqID_65518
MEVEPFSLSEEFVKGCALSKYEGWRGLVREDSRVRESLWWEKNKFWLHEWVDGDDYFLVSDPNFVCGQSFANVFILASRIELFDTSCRTIRKVFRCFGKEYGKYPKKEGEKVIWEFFLTPNSPRLASGSLGPPIT

SEQ ID NO: 182297 - protein, 206 aa, Glycine max
  Coding DNA Sequence Number=SeqID_65519
MMLFLLPTKTKKRKCTKEGDEEAQPQKRLEQQTLHQLNTLPSSSLKALSMVFGKEFFNSTYHPQSLMSNSVVSEFGILGNKASFDKAIRQVRHKFEIPDTVEFDILKDVHEGVLMSINDIPKKAPSSSRPPTPPVDTLLTNAGFGEEEERYKQDYLGGEPMNLMKVHPWLSRTTRERNLVNLNFYRIKGTFLPEYEFSGGKSHFQD

SEQ ID NO: 182298 - protein, 288 aa, Glycine max
  Coding DNA Sequence Number=SeqID_65520
  Homolog annotation: Hit_ID=P27323; Match level="QueryCoverage=22%, HitCoverage=9%, E-value=3e-16, Identity=75%"; Hit description=Heat shock protein 81-1
  Subcellular localization annotation: CTP_CleavageSite=30; ConfidenceScore=5.08e-01
MLWSGFSAELLSTPFSVELLSTLLSLPTARNTTLSSRLDNKNKQKQGTSLQCLHELLGLETCNGTLVVHQICFGHSNVTVNNGKSLVGFVGHKTDEELWLSIKLALVRMILHNFYCNNGIISLWRWLRRWWLIWRRASTPDLAVTVKGGGVDVGAVVGGGCAFIGNELGGSSSLLGIGMWGLLLASRWTVEEGLVFWCSNIAVDTAKSMEGGVGMVCTVCRARVPHKAKKVGAEMEGMTPARVVAGGWLCEEVATKRGGLEGGVLWHGRSKGRGNHGRQPWTIGRTNC

SEQ ID NO: 182299 - protein, 177 aa, Glycine max
  Coding DNA Sequence Number=SeqID_65521
  Gene Ontology: Mol. function=RNA-directed DNA polymerase activity; Cellular component=mitochondrion; Biological process=RNA-dependent DNA replication
MSRSQSEAANKIILVELKKKLGLAKGKWAKELLEVLWGIYCTPQATTKETPFQLTYGTDALIPVEVGEPSFRQLYYNKAGNINALKGELDLIEKTKDQARITIEACKQRMVKRFNSKPKPREFLEEALVWRVQGDARKDSRGGLRENLINEASKLEELFGKLILCTWNSTHLKFYYN

SEQ ID NO: 182300 - protein, 283 aa, Glycine max
  Coding DNA Sequence Number=SeqID_65522
  Subcellular localization annotation: CTP_CleavageSite=67; ConfidenceScore=5.34e-01
VTKTVASNTSDIVSNALSDTADTISEVSNIISSSNKSLSGAAASSSNPLQIASDVTKTITSNTSDIISDTVSGISNTIEDVANILIPNPLQIASKIITSKITGNIPNTIIPSNTSNIPGNITSSSKTLLNAANKSKPTSSKKLLQNASSTISNPSNAVDVMNSPEKLFKNALGNALNATLLLSLLDYVLSLATSFLGKLRDSPTPAQLLGLMITPLWNLLRRFVTLGLVMLLLLAGIIITVFILSMPLLMIVTSPIWIPTVFLGHLNVSGEDPESINQSAIQD

SEQ ID NO: 182301 - protein, 288 aa, Glycine max
  Coding DNA Sequence Number=SeqID_65523
  Gene Ontology: Mol. function=protein serine/threonine kinase activity; Cellular component=membrane; Biological process=protein amino acid phosphorylation
  Homolog annotation: Hit_ID=Q9FFW5; Match level="QueryCoverage=83%, HitCoverage=36%, E-value=1e-107, Identity=79%"; Hit description =Similarity to protein kinase
  Pfam annotation: Domain name=Pkinase; Domain location=4-213; Score= -22.1; E_value=3e-07; Accession=PF00069.15; Description=Protein kinase domain
  Pfam annotation: Domain name=Pkinase_Tyr; Domain location=3-213; Score=-39.8; E_value=5e-10; Accession=PF07714.7; Description=Protein tyrosine kinase
  Pfam module annotation: Pfam domain module=Pkinase::Pkinase_Tyr; Domain location=4-213::3-213
MIYCFSVNSSLSPLLLLLSLNPSRLLSENRPVLDWPTRVKVAAGAARGIAYLHEDCHPRIIHRDIKSSNILLDLNYEAQVSDFGLAKLALDSNTHVTTRVMGTFGYMAPEYATSGKLTEKSDVYSFGVVLLELITGRKPVDASQPIGDESLVEWARPLLTEALDNEDFEILVDPRLGKNYDRNEMFRMIEAAAACVRHSSVKRPRMSQVVRALDSLDEFTDLNNGMKPGQSSVFDSAQQSAQIRMFRRMAFGSQDSSGFFNESQSSWRSRDHDPTTVFSQNKTGHGNV

SEQ ID NO: 182302 - protein, 43 aa, Glycine max
  Coding DNA Sequence Number=SeqID_65524
MMSTVNGRRITTLLRIFPDANFPCPLGSRTEGSFMVEMKSAAE

SEQ ID NO: 182303 - protein, 488 aa, Glycine max
  Coding DNA Sequence Number=SeqID_65525
  Gene Ontology: Mol. function=carboxypeptidase activity; Cellular component=proton-transporting two-sector ATPase complex; Biological process=ATP synthesis coupled proton transport
  Homolog annotation: Hit_ID=Q5VQ36; Match level="QueryCoverage=66%, HitCoverage=80%, E-value=5e-92, Identity=47%"; Hit description=Leaf senescence protein-like
  Pfam annotation: Domain name=DUF231; Domain location=157-327; Score =126.6; E_value=6.9e-35; Accession=PF03005.6; Description=Arabidopsis proteins of unknown function
MKRCNIFSGEWIPYSKGPYYDNETCDLMIDQQNCMKFGRPDREFLKWRWKPDECELPLFDATLFLELVRGKSMAFVGDSVAHPEDITKRYATDPIYFRRWFYADYNFTVVTLWSPFLVRTSDIDNSLTKLYLDKADESWTSEVETFDFVIISAGQWFFRPALYYEKGQIVGCHKCERRKIKDLSYYYGYRKAFRTALRTIASLEGYRGVTFLRTFSPAHFENAEWNKGGSCERTRPYSKEQMRFDGYIFETYKTQVEEFRTARKVARKRGLKFLMMDTTEIMLRRPDGHPNNHVWHAVNQNVTHSDCVHWCLPGPIDTWNEFLFHMLKMHSVTSAVPYTAPTIGNILSPTNTLLGATNIVSETISGVTKTVTSNTLSETSDPISEVSKIISPDSLSDPSKLISSNLLQDVSKVISGTVSHVSKTVSSNTSDIISNTLSETSKIISSSSHPLQDASKIIFDTVSDVSKTIASDTADILKTIPRRFQDHL

SEQ ID NO: 182304 - protein, 205 aa, Glycine max
  Coding DNA Sequence Number=SeqID_65526
MILEASESVSEGLILGAPESGFEEIISEASESESKGLMLDAPESGSEMLLETSETILETSERVFETILEVFEVMVLATSETVSVIFEATWSGFEELIMEASGSTESGEMILEASESGFEEMILEASESDSEGLIMLEAPESGSEMMFAVSERVFEMISEVFEVMVLVTSETIVDYWNGGLNCTGDTFCEVLQHLREVVLLMNDEK

SEQ ID NO: 182305 - protein, 45 aa, Glycine max
  Coding DNA Sequence Number=SeqID_65527
MHHQKRKTLDEASQLSSESETKHDYRSTFTPYGSHRPGYRSQHLK

SEQ ID NO: 182306 - protein, 148 aa, Glycine max
  Coding DNA Sequence Number=SeqID_65528
  Subcellular localization annotation: CTP_CleavageSite=27; ConfidenceScore=5.21e-01
PAKLLRSAVRQFSILQFFRSPMNLLPGAVHVSSTIESGAPRIWSPEKLLRSTVRQFSILHFFRSPMNLLPSAVHVSSTFESGAPRIWSPAKLLRSAVRQFSILHFFRSPMNLLPSAVHVSSTIESGALRSYCIALFANSPFSTFFGAP

SEQ ID NO: 182307 - protein, 184 aa, Glycine max
  Coding DNA Sequence Number=SeqID_65529
  Pfam annotation: Domain name=zf-CCHC; Domain location=47-64; Score =8.1; E_value=0.045; Accession=PF00098.13; Description=Zinc knuckle
MSSDLNYKLNGHEVFKELPSEIVQRNPKDKFGHGFKGKKIVHSEEVTVCYFCGKVGHETHKCNDLPIKGNPSKGNKKVLIAGVGNQKGLIASVGKVCIHSKGVMLTFSQRASLVYNSRTLTVEEAIHVRLNDNKPDTTMLELDGSFAEMKIENIMKSAARSSQDQYASNSPADYQPKEVREPIG

SEQ ID NO: 182308 - protein, 258 aa, Glycine max
  Coding DNA Sequence Number=SeqID_65530
MVEACVESMRKDKKESSSDATRNLRVLGGYFAGKVLGIIVKLTAKAIAQGIGCERRGTKFMNNRGNELEDYIGGTPCEELGEDSKEIWNPIEQGEDFPIDFKQGHYSQTRIEGLPGTSFDLPQILFNCFGTKVMKNKSIGKNIYHNVVLAKVFQAHGVIRKFLYETLVDVQEKIYFDGVFILMQKAFSQENISNMRLVDDGSYQQTPQKATEQDEGMDANATTSQVQKKTKKKMDTSSSKVASTYQRPPPTLFAPNTT

SEQ ID NO: 182309 - protein, 673 aa, Glycine max
  Coding DNA Sequence Number=SeqID_65531
  Gene Ontology: Mol. function=histone-lysine N-methyltransferase activity; Cellular component=nucleus; Biological process=chromatin modification
  Homolog annotation: Hit_ID=Q9FF80; Match level="QueryCoverage=94%, HitCoverage=95%, E-value=0.0, Identity=52%"; Hit description=Histone- lysine N-methyltransferase, H3 lysine-9 specific SUVH1 (EC 2.1.1.43) (Histone H3-K9 ...
  Homolog annotation: Hit description=methyltransferase 1) (H3-K9 -HMTase 1) (Suppressor of variegation 3-9 homolog protein 1) (Su(var)3-9 homolog protein 1)
  Pfam annotation: Domain name=Pre-SET; Domain location=391-491; Score =129.7; E_value=8.2e-36; Accession=PF05033.6; Description=Pre-SET motif
  Pfam annotation: Domain name=SET; Domain location=493-650; Score =179.5; E_value=8.4e-51; Accession=PF00856.18; Description=SET domain
  Pfam annotation: Domain name=YDG_SRA; Domain location=205-362; Score =216.2; E_value=7.3e-62; Accession=PF02182.8; Description=YDGSRA domain
  Pfam module annotation: Pfam domain module=Pre-SET::SET::YDG_SRA; Domain location=391-491::493-650::205-362
  Subcellular localization annotation: CTP_CleavageSite=55; ConfidenceScore=5.07e-01
MEEGLCQNSIPGSGFVDKTRIVEAKPLRSLAPVLPKSLQSSFSGRYPSVFPPFVLFDEPQESQPSPAPMPAPLRSYRNPLDEEEAPHGSNGETSSPMEGLNGNSVDNSQKRAVPPMHSCKYSQKRSKKTKESQFDLSPSVGGISVATREDGDRELVNLVLMTYDSLRRRLCQLEDAKELNTTMAIKRADLRASNAMTVKAFRTNTRRRVGAVPGVEIGDIFFLRMEMCLVGLHGQSMSGIDYMTIKDELQEEPVALSIVSSGVYDNDAEDNDVLIYTGQGENFNKKDKHVIDQKLQRGNLALDRSSRRHNEVRVIRGLRDAANKNAKIYVYDGLYKIQDSWIERGKSGGGVFKYKFVRLPGQSSAFAVWKSVQKWKMSSSTSSRTGIILADLSTGVESIPVSLVNEVDNEKGPSFFTYFHSLRDPKPFSLAQSSYGCNCNKTCVPGDLSCSCIQRNEGDFPYTANGVLVSRKPLVHECGPLCKCFPNCKNRVSQTGLKHQMEVFKTKDRGWGLRSLDPIRAGTFICEYAGEVIDIAKVNKNRGYDDEYVFDTSRIYDTFKWNYEPSLLEEISSNVSSEDYDIPSPLIISSKKFGNVARYMNHSCSPNVFWQPVLYAENNQSFLHIAFFALRHIPPMTELTYDYGCSGHADGSSAPKGRKKCSCGSSKCRGSFG

SEQ ID NO: 182310 - protein, 422 aa, Glycine max
  Coding DNA Sequence Number=SeqID_65532
  Gene Ontology: Mol. function=transporter activity; Cellular component= integral to membrane; Biological process=transport
  Homolog annotation: Hit_ID=Q2PF04; Match level="QueryCoverage=99%, HitCoverage=89%, E-value=1e-170, Identity=68%"; Hit description =Putative transporter-like protein
  Pfam annotation: Domain name=MFS_1; Domain location=44-422; Score =109.8; E_value=7.8e-30; Accession=PF07690.6; Description=Major Facilitator Superfamily
  Pfam annotation: Domain name=Sugar_tr; Domain location=43-419; Score=- 144.2; E_value=0.023; Accession=PF00083.14; Description=Sugar (and other) transporter
  Pfam module annotation: Pfam domain module=MFS_1::Sugar_tr; Domain location=44-422::43-419
MAEENIRQPLLEKKYYEDCPGCKVDQAKELSKGQGVSIRNLLIIWMVVLCSALPISSLFPFLYFMVRDFNIAKTEADISSYAGYVGSSYMLGRCLTSVLWGIVADRYGRKPVIVIGIISVVLFNTLFGLSTSFWMAFIMRFLLGSFHGLLGTVKAYATELFREEHQALGLSTVSAVWGIGLIIGPALGGYLAQPAEKYPDIFPKDSFWDKFPYFLPCFIISAAAFVVAIGCIWIPETLHNHNSNNESIDNSEALENGSSGASNEKTIQKNENLLRNWPLMSSILSYCVFSLHDIAYQEVFSLWSVSPQRLGGLNFTTNDVGNVLSISGLALITYQLTIYQSVEKASGPISIARISAMLSIPLLQSYPFIALLSGLALYIVLSIASILKNILSEQHQRGAANGIAMTGMSLFKAIGPAAGGAL

SEQ ID NO: 182311 - protein, 616 aa, Glycine max
  Coding DNA Sequence Number=SeqID_65533
  Gene Ontology: Mol. function=identical protein binding; Cellular component=cytoplasm; Biological process=negative regulation of enzyme activity
  Homolog annotation: Hit_ID=Q9LJ20; Match level="QueryCoverage=99%, HitCoverage=79%, E-value=0.0, Identity=56%"; Hit description =Putative subtilisin-like protein
  Pfam annotation: Domain name=PA; Domain location=240-333; Score=64.1; E_value=4.6e-16; Accession=PF02225.12; Description=PA domain
  Pfam annotation: Domain name=Peptidase_S8; Domain location=42-474; Score=27.8; E_value=2.9e-08; Accession=PF00082.12; Description =Subtilase family
  Pfam module annotation: Pfam domain module=PA::Peptidase_S8; Domain location=240-333::42-474
MTVLHLGIWPESPSFRDEGIGEIPSKWKGVCMEGRDFKKSNCNRKLIGARYYKIQATSGDNQTHIEAAKGSPRDTVGHGTHTASIAAGVHVNNASYFGLAKGTARGGSPSTRIAAYKTCSDEGCSGATILKAIDDAVKDGVDIISISIGLSSLFQSDFLSDPIAIGAFHAEQKGVLVVCSAGNDGPDPFTVVNSAPWIFTIAASNIDRNFQSTIVLGNGKYLQVGINFSNLTHSKMHRLVFGEQVAAKFVPASEARNCFPGSLDFNKTAGNIVVCVNDDPSVSRRIKKLVVQDARAVGIILINENNKDAPFDAGVFPFTQVGNLEGHQILKYINSTKNPTATILPTTEVARSKPSPIVASFSSRGPSSLTENILKPDVMAPGVGILAAVIPKSKEPGSVPIGKKPSLYAIKSGTSMACPHVTGAAAFIKSVHKKWSSSMIKSALMTTATNYNNMRKPLTNSSNSIAGPHEMGVGEINPLRALNPGLVFETDVEDYLRFLCYFGYSQKIIRSISETNFNCPKNSSEDLISSVNYPSISISTLKRQQKAKVITRTVTNVGYLNATYTAKVRAPQGLVVEVIPNKLVFSEGVQRMTYKVSFYGKEAHGGYNFGSLTWLD

SEQ ID NO: 182312 - protein, 139 aa, Glycine max
  Coding DNA Sequence Number=SeqID_65534
MVRGGGKAGDDDDLGLDVGEVVGVEHGAEERSGVESVVGLGGGDGEEAEVVGVEVVKLALIAEAHDNRLGMRERRECVLIRELRDQATEAGGVREVRGVGVSKLGFFGFAVAKKGEKLMVTGFQGGCGGGMLERREWGL

SEQ ID NO: 182313 - protein, 229 aa, Glycine max
  Coding DNA Sequence Number=SeqID_65535
  Gene Ontology: Mol. function=nucleic acid binding
  Homolog annotation: Hit_ID=Q8W4I9; Match level="QueryCoverage=74%, HitCoverage=17%, E-value=2e-11, Identity=33%"; Hit description=Mei2 -like protein
MDQRGVSTSSHYFDDISFRSEDTLVLNSKMWKQWNGSITWQHFECYTPLDVNAKAGLLVPQASLPGDNIHSTESSNYRPKSLFDACLQSTPTSYGLIGNKIVTNAAPFEIRLFGNDVWSDHPTTAGSPPKEEPYKSLEEIEADTIGNLIPGEDDLFFGVVDELGCSSHARTNDDFEDFDLFNNGGGMEMEGDEHLSRGKRMSALDGDFGFFGMNFEAKQTRRSILSNLN

SEQ ID NO: 182314 - protein, 245 aa, Glycine max
  Coding DNA Sequence Number=SeqID_65536
  Gene Ontology: Mol. function=catalytic activity; Cellular component =intracellular; Biological process=metabolic process
MGKNATKRKVRGKGAATSSPIVDLTSKEDAIRENTIATLKLTKAKEAKNVKVLYKILKEETSTISEDQHKLWKQIVDEILEDNIEEEIMRYLREMLLQAENNNQPKRRRIINRNREDRHSRLLNDSFCENYIYTENAISNHDSYFRMRFDVVGRMGLSPLHIRILAYGSPVDSVNENVRITECTTIQCLEAFVKGVNEIFGDKYLRRPNNNDINCLLQIGEARGFPGLLGSIDCMHWEWKNCPVA

SEQ ID NO: 182315 - protein, 538 aa, Glycine max
  Coding DNA Sequence Number=SeqID_65537
  Homolog annotation: Hit_ID=O22784; Match level="QueryCoverage=43%, HitCoverage=77%, E-value=6e-98, Identity=67%"; Hit description =Expressed protein
  Pfam annotation: Domain name=DUF26; Domain location=190-241; Score =52.2; E_value=1.8e-12; Accession=PF01657.8; Description=Domain of unknown function DUF26
  Pfam annotation: Domain name=DUF26; Domain location=86-140; Score =54.3; E_value=4e-13; Accession=PF01657.8; Description=Domain of unknown function DUF26
  Pfam module annotation: Pfam domain module=DUF26::DUF26; Domain location=190-241::86-140
MGFTRKPMFPVLLVLFITSLLEPPHVAESTSSDYSTLVYKGCSKEPFTDPNGVYSQALSALFGSLVSQSTKAKFYKTTSGSGQNTITGLFQCRGDLTNSDCYNCVSRLPVLCDKLCGKTTAARVQLLGCYILYEVAGFSQISGMQMLYKTCGATNAAGRGFEERRDTAFSVMENGVVSGHGFYTTSYQSLYVMGQCEGDVGDSDCGECVKNAVQRAQVECGSSISGQVFLHKCFISYSYYPNGVPSRSSSSSSASYSSSSSGQNPGKTAAIILGGAVAVAFLVILLLFARSLKKKHDVAEWSIEPSSSTTTLQLLSSITTILALISSSTKRSRIKGKTVANDDNSYEIVVEEDNSWISDEEMTSKRGREKDWINKPGGEIYLGVGRGGEGWGENGKGRSRRGRVDVEGKGRSQWRRSVKVEERRESGLVWGGAELDMTMGRGGDEYCLPNPRPRLPNMSPYPYPIPVGLKFIIPSPYPSGIGLSAGEKWETKEVISERMSVGEKWFKGHYKQAVDLKKSGYIENDVMINAYAIWKEDE

SEQ ID NO: 182316 - protein, 55 aa, Glycine max
  Coding DNA Sequence Number=SeqID_65538
MVDRSRLSIPSSVLLMRMKKRLMNCIYGWLSVVDFIHKLDIVVSIFSPLMCIGFS

SEQ ID NO: 182317 - protein, 211 aa, Glycine max
  Coding DNA Sequence Number=SeqID_65539
  Gene Ontology: Mol. function=transition metal ion binding; Biological process=proteolysis
  Pfam annotation: Domain name=Transposase_21; Domain location=43-185; Score=-107.6; E_value=2e-05; Accession=PF02992.5; Description =Transposase family tnp2
MLPEQYTLPKNHYEAKKILCPVGMEYQKIYACRNDCILYRNQFEKMCKCPTCGVSRYKVKDDEFSEDASKKNSHPAKTRENCGKTGLMCGMGICSRPSAQGNLSGYSVKGHHACLICEKNTSFIQLKHGKKTLYTRHRRFLKPYHPYRRLKKAFNESQKNENVMHVEKNICDSLIGTLLNIKGKKTEGLKCHQDPVDMGIPEQLHPISQGQ

SEQ ID NO: 182318 - protein, 149 aa, Glycine max
  Coding DNA Sequence Number=SeqID_65540
MEHATRGTARCTRQQQGSALDAGASGSALSLGATGSAQRVGATGGAPDAGTTQAPIYSAWVVPASGAPPVAPTRWALPVAPSGRALPDAPASGTLPCCCLVRRAVPRVACSMEAPVWGALCNKKTDPQVGTCNPNMHYLDGNNSTSETV

SEQ ID NO: 182319 - protein, 373 aa, Glycine max
  Coding DNA Sequence Number=SeqID_65541
  Gene Ontology: Mol. function=metal ion binding
  Homolog annotation: Hit_ID=Q6H6V3; Match level="QueryCoverage=76%, HitCoverage=51%, E-value=8e-55, Identity=44%"; Hit description=Zinc finger (C3HC4-type RING finger) protein-like
  Pfam annotation: Domain name=zf-C3HC4; Domain location=285-332; Score= 61.4; E_value=3e-15; Accession=PF00097.15; Description=Zinc finger, C3HC4 type (RING finger)
MDNAAAELQSVAADPALLLHHQTCAGNGIGDSTSLIPESSRRPSLSSLQIPALSVENALSSFNKTDGPILISSPGSSRGLPPRPNSARVIKSTMKTLLSERSFRAKNSSMDSERTVLIIPDGSPSDGPVDNKPSTSRSLSLNKILFSSSTKAAHSLPVTPTANSGPENVHGRHLGCDSDLSKMKVNQHMTRSVSVPVNIKTANLRHTDSRRLVRVISVRSLPGTSGSISADNASGSEIGIPFEFLDQEYEIRNSEVFRQASILLTASFPVNEDASEDIPEEDAVCRICLVELAEGGNTLRMECSCKGELALAHQDCAVKWFSIKGNKTCDVCKQEVQNLPVTLLKITNPQTVTRQPLNAPEPQQREVTSYRQV

SEQ ID NO: 182320 - protein, 830 aa, Glycine max
  Coding DNA Sequence Number=SeqID_65542
  Gene Ontology: Mol. function=binding; Cellular component=anaphase -promoting complex; Biological process=cell division
  Homolog annotation: Hit_ID=Q8LGU6; Match level="QueryCoverage=99%, HitCoverage=99%, E-value=0.0, Identity=61%"; Hit description=HOBBIT protein
  Pfam annotation: Domain name=TPR_1; Domain location=136-179; Score =1.1; E_value=4; Accession=PF00515.18; Description=Tetratricopeptide repeat
  Pfam annotation: Domain name=TPR_1; Domain location=507-540; Score =8.6; E_value=0.51; Accession=PF00515.18; Description=Tetratricopeptid e repeat
  Pfam annotation: Domain name=TPR_1; Domain location=604-637; Score =43.4; E_value=7.5e-10; Accession=PF00515.18; Description =Tetratricopeptide repeat
  Pfam annotation: Domain name=TPR_1; Domain location=638-671; Score =23.5; E_value=0.00073; Accession=PF00515.18; Description =Tetratricopeptide repeat
  Pfam annotation: Domain name=TPR_1; Domain location=672-705; Score =29.1; E_value=1.6e-05; Accession=PF00515.18; Description =Tetratricopeptide repeat
  Pfam annotation: Domain name=TPR_1; Domain location=706-739; Score =10.4; E_value=0.31; Accession=PF00515.18; Description=Tetratricopepti de repeat
  Pfam annotation: Domain name=TPR_1; Domain location=740-773; Score =13.4; E_value=0.13; Accession=PF00515.18; Description=Tetratricopepti de repeat
  Pfam annotation: Domain name=TPR_1; Domain location=774-807; Score =12.8; E_value=0.16; Accession=PF00515.18; Description=Tetratricopepti de repeat
  Pfam annotation: Domain name=TPR_2; Domain location=136-179; Score =1.2; E_value=24; Accession=PF07719.7; Description=Tetratricopeptide repeat
  Pfam annotation: Domain name=TPR_2; Domain location=507-540; Score =10.0; E_value=2.3; Accession=PF07719.7; Description=Tetratricopeptide repeat
  Pfam annotation: Domain name=TPR_2; Domain location=604-637; Score =32.0; E_value=2.1e-06; Accession=PF07719.7; Description =Tetratricopeptide repeat
  Pfam annotation: Domain name=TPR_2; Domain location=638-671; Score =15.3; E_value=0.22; Accession=PF07719.7; Description=Tetratricopeptid e repeat
  Pfam annotation: Domain name=TPR_2; Domain location=672-705; Score =21.5; E_value=0.003; Accession=PF07719.7; Description=Tetratricopepti de repeat
  Pfam annotation: Domain name=TPR_2; Domain location=706-739; Score =12.2; E_value=1.3; Accession=PF07719.7; Description=Tetratricopeptide repeat
  Pfam annotation: Domain name=TPR_2; Domain location=740-773; Score =22.2; E_value=0.0019; Accession=PF07719.7; Description =Tetratricopeptide repeat
  Pfam annotation: Domain name=TPR_2; Domain location=774-807; Score =13.3; E_value=0.89; Accession=PF07719.7; Description=Tetratricopeptid e repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2; Domain location=136-179::507-540::604 -637::638-671::672-705::...
  Pfam module annotation: Domain location=706-739::740-773::774 -807::136-179::507-540::604-637::638-671::672-705::706-739::740 -773::774-807
MEAILVDCVQKSLRHFMHANAIFLCQRLCAEFPTEVQVYFWLFVSFVRVVDLYVMVFPLPRFEVACVHCVTNLQLLAGCYLQNNQAYCAYHILKGAQMAQSRYLFAISCFQMDLLSEAEAALCPVNEPSVEVPNGAAGHYLLGLIYRLLISLTYRQGYTDRRKSAIHNFKQALSMDPLMWAAYEELCILGAAEDATAVFGEAAALCIQKQYLHCTTSPKLHSSAEDCNIVDTRHSVSEDTSPRQLKLMQGMKDFPGNHHGASILGGTAQPNNSGLSNISFYNTPSPMAAQLSGVAPPPLCRNVQPNGQNLSSLNADSSPKSTVNSTIQAPRRKFVDEGKLRKISGRLFSDSGSRRSSRLSSDASVNANANATVVSGNGTNNSSKYLGGSKLSTMAFRSMAVRKGQSWANENADEGIHNDVLDDSRLNVTSTTSSSSPTMEAKSYEQKAANFPIGGQIVSGSKVISGASEILTLLRIFGEGCRLAYLYRCQDALDTYMKLPHKHYSTGWVLSQVGKVYFELVDYLEAEQAFGLAHQITPYSLEGMDVYSTVLYLPASISCLIAEYISACLMLDQKTNLSLVQHLKEDMKLSYLAQELVSTDRLAPQSWCAMGNCYSLQKDHETALKNFQRAVQLNPRFAYAHTLCGHEYVALEDFENGIKCYQSALTVDARHYNAWYGLGMVYLRQEKFEFSEHHFRMAFHINPRSSVIMSYLGTALHALKRSEEALMVMEKAILADKKNPLPMYQKANILMSLEKFDEALEVLEELKEYAPRESSVYALMGRIYKRRNMHERAMLHYGISLDLKPSATDAAAIKAAIEKLHVPDEMEDNL

SEQ ID NO: 182321 - protein, 404 aa, Glycine max
  Coding DNA Sequence Number=SeqID_65543
  Gene Ontology: Mol. function=structural constituent of ribosome; Cellular component=intracellular; Biological process=translation
  Homolog annotation: Hit_ID=Q9C887; Match level="QueryCoverage=53%, HitCoverage=59%, E-value=5e-31, Identity=39%"; Hit description =Myosin-like protein; 97843-94399
  Pfam annotation: Domain name=Fez1; Domain location=63-218; Score= -89.1; E_value=0.039; Accession=PF06818.5; Description=Fez1
MGSKGRMPPPPHLRRPHPQDPAAMPHPLVVPFDFLPPPQVMEQKLASQHAEMQRLSTENQRLAATHSVLRQELAAAQHEMQMLHGHVVALKGEREQQIRAQMEKIAKMESEAQGSESVKMELQQARGEAQNLVVSRDELVSKAQHLTQELQRVHADAVQIPALISEFECLRQEYQHCRATFDYEKNLYNDHLESLQVMEKNYVSMSREVEKLRAELTNTANVDRRSSGPYGGTSGTNENEASGLPVGQNAYEDGYSVMQGRGPLPAAAGSGGGNATTITTAGGQPGPAPAGTGYDAPIGPGYGASTGSTYDAQRGATYDTQRLTGSNAFRGSAYDSKRGSGYDMQRAPAYDAPRAAGYDAQSRGVAGPHGHARPMNNMPYGSTTPPARSGGGYEPARGVNPARR

SEQ ID NO: 182322 - protein, 121 aa, Glycine max
  Coding DNA Sequence Number=SeqID_65544
MDQIEVLMYKLKPGKDWLNLRTDLGDASKQNGRSSETNKFWQGNAWPSHAGKASNACLRAHEQSLSCEILGYGQTLDGKSFGKVASQRDLSTMKVLEIGRVYEADCQLINKDGRVYLAPNN

SEQ ID NO: 182323 - protein, 79 aa, Glycine max
  Coding DNA Sequence Number=SeqID_65545
  Gene Ontology: Mol. function=methyltransferase activity
  Homolog annotation: Hit_ID=Q5VPE9; Match level="QueryCoverage=95%, HitCoverage=22%, E-value=4e-19, Identity=61%"; Hit description =Leucine carboxyl methyltransferase family protein-like
MYVEVDFKEVTSKKAALIENYSQLRNKLGEIATISREKGEVVSAHYKLVPADLRDIQQLNNIISVAGMDPRYHPFLGKE

SEQ ID NO: 182324 - protein, 166 aa, Glycine max
  Coding DNA Sequence Number=SeqID_65546
MVVVRCTLHRCWYIPNPDDDGSKKVPLDPPFVDSISYVVVVNKPKTITTKAAEVAPSTVSCKKVVPLETPISMPFEVVPSIVAFQEIVPAETRTSILSKVMPSTVVCKKIDQSHIASSMATEVLPLTVASNKFDQPETSTSRATKVARSSVACKKMLDFAKIKVEK

SEQ ID NO: 182325 - protein, 128 aa, Glycine max
  Coding DNA Sequence Number=SeqID_65547
  Homolog annotation: Hit_ID=Q5VPE9; Match level="QueryCoverage=39%, HitCoverage=15%, E-value=7e-20, Identity=82%"; Hit description =Leucine carboxyl methyltransferase family protein-like
MAEIIFSEFLTREGCDNDWGEGLKAEKSVAWDMLRIYNDFIDAPERHRIERLELFDEFEEWYMMQEHYCVAYAINDGMQIGRGNLSDAGSGLAYAINSGYAFIVWFPFMMQGLFGDFGFVNDNNVLPS

SEQ ID NO: 182326 - protein, 239 aa, Glycine max
  Coding DNA Sequence Number=SeqID_65548
  Gene Ontology: Mol. function=DNA-directed RNA polymerase activity; Cellular component=nucleus; Biological process=transcription
  Homolog annotation: Hit_ID=Q9LSZ5; Match level="QueryCoverage=95%, HitCoverage=99%, E-value=1e-45, Identity=43%"; Hit description =Arabidopsis thaliana genomic DNA, chromosome 5, P1 clone:MQM1
  Pfam annotation: Domain name=RNA_pol_Rpc34; Domain location=1-238; Score=-0.8; E_value=3.6e-11; Accession=PF05158.3; Description=RNA polymerase Rpc34 subunit
MSHLQGSSSLKRKRQDLALVTGSLTDGERVLYNLIHSKKDMGIWTGDMKRETNLPDSIVKKSLKLLQSKNLIKEVVNIQNKGRKHYMAAEFEPSKEITGGVWYNQGRLDTDFINLVKDVCLKYIFRQKVATRDGVMEWSRKSGVFNVEVTTQQIDEILRTLVLDDEIVEVKSTGFGDFSSVPVGRICYRCKSKGGNRGEQKPGAMASIPCGVCPRINFCTPDGIISPRTCVYYQKWLDF

SEQ ID NO: 182327 - protein, 336 aa, Glycine max
  Coding DNA Sequence Number=SeqID_65549
  Gene Ontology: Mol. function=protein binding; Cellular component =integral to membrane; Biological process=ER to Golgi vesicle -mediated transport
  Homolog annotation: Hit_ID=Q01E40; Match level="QueryCoverage=86%, HitCoverage=66%, E-value=2e-42, Identity=35%"; Hit description=[S] KOG3094 Predicted membrane protein
  Pfam annotation: Domain name=YIF1; Domain location=66-293; Score =394.3; E_value=1.8e-115; Accession=PF03878.6; Description=YIF1
  Pfam annotation: Domain name=Yip1; Domain location=101-263; Score= -3.1; E_value=0.00026; Accession=PF04893.7; Description=Yip1 domain
  Pfam module annotation: Pfam domain module=YIF1::Yip1; Domain location=66-293::101-263
MVLNCGCNRSFVILWEILDKADATTIAVAESKNLDVVAKIMHHPQPPTSSQPNLFGNAFNSAGSGLIRGGLGAYGEKILGSSSEYVQSNISRYFSDPQYYFQVNDHYVKNKLKVVLFPFLHRGHWTRITEPVGGRLSYKPPIYDINAPDLYIPLMAFGTYVVLAGISLGLRGMFSPEALNWLFIKGLVGWFMQTALLKVTLLSLGSGEAPLLDIIANAGYTFAGLCLAVCGRMIWSYSYYFLMLWTCICMAVFLVKTMKRVLFAEVRSYDSSKHHYLLLFIALAQFPLFTWLGNITDALAVGCVSAVNAAPHNSDHHGNSNRHHELKRKPKITSCS

SEQ ID NO: 182328 - protein, 128 aa, Glycine max
  Coding DNA Sequence Number=SeqID_65550
  Gene Ontology: Cellular component=signalosome complex; Biological process=red or far red light signaling pathway
  Homolog annotation: Hit_ID=Q94JU3; Match level="QueryCoverage=68%, HitCoverage=33%, E-value=4e-19, Identity=54%"; Hit description=COP9 signalosome complex subunit 7
MSQIGNGICLPSANFWLSTSENMLVSIQEKIKWADAMSEIDKKHRKDVEEKVEEVKKSIFKADIDFRGHEEICSESGGVMDYEEDRSRPKRGYQLLQTDKYISSILPLSVTPQSEIGTRKKRRENLLI

SEQ ID NO: 182329 - protein, 100 aa, Glycine max
  Coding DNA Sequence Number=SeqID_65551
MGGNQKKREKGVDQGLLGHELLYRVTNPTHKKPNTNSHKSTMPHRAAIFNNNPGRSNEIAILTRLRLEDGKEDCKLIQSYASNHNFDYHGYVIDGGKSVC

SEQ ID NO: 182330 - protein, 36 aa, Glycine max
  Coding DNA Sequence Number=SeqID_65552
MTDAASDSRNDAAVQATNDDASARFCSLCTIVEIKD

SEQ ID NO: 182331 - protein, 67 aa, Glycine max
  Coding DNA Sequence Number=SeqID_65553
MRLTPNKLTPLDSHINNPCTIWPSLFEEKRIEEMRFATARVEQRDVKSSETKVRFQGQKHGRKGSLR

SEQ ID NO: 182332 - protein, 145 aa, Glycine max
  Coding DNA Sequence Number=SeqID_65554
  Subcellular localization annotation: CTP_CleavageSite=80; ConfidenceScore=5.20e-01
MAKVNGHLITIFLLFFWTKGNYVNGVALAFISCTSQYESYTSQKASVVKNTLNPNTSPFSLCCPSMILLEVVKFLRLKPSEVAKKAMPSLSLHASTRLTPNSHCTGRRSSSNFSCILYKDIAELIKDCSTQEARLAQESQPRGQL

SEQ ID NO: 182333 - protein, 254 aa, Glycine max
  Coding DNA Sequence Number=SeqID_65555
HPGRVCVAGSSITISQYYGRASRGSNSSSTSITQQQLAEIIGSLKEEWRNEIIGNLKEEVGNEIEEENKQSLEKMKQELKDAIKIDFFQRGSQYSPLIEVDIQTLGARVSIKGSNVETVVNPLDEEHDGHVIPTMGLYVQRENCTHLVALGKIYEGGSSIHRVAYANDVDSHISPKKLFEPVQRLNNVSTGLGCRSKCLWCFDDDHDDLMQMMQMGFSSLNSRQRFKNTRHNIKMITSILGREFLIDLAKGLAK

SEQ ID NO: 182334 - protein, 89 aa, Glycine max
  Coding DNA Sequence Number=SeqID_65556
MEVQMKAQEEINATFEAEISVDLKEEIEGITKDLHGTISEGIVRALLTLICEGNVCIPPHNSRGFCEGIAREEYGSSKGIARDFPVATL

SEQ ID NO: 182335 - protein, 141 aa, Glycine max
  Coding DNA Sequence Number=SeqID_65557
  Gene Ontology: Mol. function=protein binding; Cellular component =endoplasmic reticulum; Biological process=ER to Golgi vesicle -mediated transport
  Homolog annotation: Hit_ID=UPI0000660A89; Match level="QueryCoverage =72%, HitCoverage=27%, E-value=2e-15, Identity=39%"; Hit description =Homolog of Brachydanio rerio "Similar to serologically defined breast cancer antigen 84.
  Pfam annotation: Domain name=DUF1692; Domain location=13-140; Score =35.5; E_value=4.2e-11; Accession=PF07970.2; Description=Protein of unknown function (DUF1692)
MTNDNKNHEHSEQKIHLQNLDESTENIIKKVKEALKNGEGCRVYGVLDVQRVAGNFHISVHGLNIYVAQMIFDGAKNVNVSHFIHDLSFGPKYPGLHNPLDDTTRILHDTSGTFKYYIKLLNNMVIQWKTKLRLCRRPRPG

SEQ ID NO: 182336 - protein, 327 aa, Glycine max
  Coding DNA Sequence Number=SeqID_65558
MERWSGVLRVPLHPNSRTFHRVGASLCLSPETRTLLVPKANAIFFCGDRVEGTGNPVIERLSNLQKLSEIIVSKFGSFTNAWVIEASAFNGPFAVYKDFIPSVNQYGEPSSYHPNGFPASTSTVSLLSNCLEEAKKVILGTQVDTKSGLSPSCSFSRSKTFILGFSKGGAVLNQIVTELGFSDIGSNANSPDVGQLMGRKFAGSEEIYVVPKTKEDLLNSISEIHYVDVGLNSAGAYLTNHDVFERISKRLMQGASELRFILHGTPRQWSDKRRDWIRNEKDKMLRLLESEAPKSGGKLKVLERFYFTDKPPSMQMHFEIIESLDAS

SEQ ID NO: 182337 - protein, 142 aa, Glycine max
  Coding DNA Sequence Number=SeqID_65559
  Gene Ontology: Mol. function=nucleic acid binding; Cellular component= ribonucleoprotein complex; Biological process=mRNA processing
  Homolog annotation: Hit_ID=Q41124; Match level="QueryCoverage=87%, HitCoverage=43%, E-value=2e-64, Identity=95%"; Hit description =Chloroplast RNA binding protein precursor
  Pfam annotation: Domain name=RRM_1; Domain location=1-43; Score=4.0; E_value=0.061; Accession=PF00076.12; Description=RNA recognition motif. (a.k.a. RRM, R
  Pfam annotation: Domain name=RRM_1; Domain location=63-134; Score =77.0; E_value=5.9e-20; Accession=PF00076.12; Description=RNA recognition motif. (a.k.a. RRM, R
  Pfam module annotation: Pfam domain module=RRM_1::RRM_1; Domain location=1-43::63-134
VLYDRDTGKSRGFAFVTMSCIEDCNAVIENLDGKEFLGRTLRVNFSSKPKPKEPLYPETEHKLFVGNLSWSVTNEILTQAFQEYGTVVGARVLYDGETGRSRGYGFVCYSTKAEMEAALAALNDVVFYSPSLLSCLYWLCIL

SEQ ID NO: 182338 - protein, 428 aa, Glycine max
  Coding DNA Sequence Number=SeqID_65560
  Gene Ontology: Mol. function=adenosylmethionine decarboxylase activity; Cellular component=cellular_component; Biological process =spermidine biosynthetic process
  Homolog annotation: Hit_ID=Q8LKJ7; Match level="QueryCoverage=82%, HitCoverage=97%, E-value=1e-144, Identity=72%"; Hit description=S -adenosylmethionine decarboxylase
  Pfam annotation: Domain name=AdoMetDC_leader; Domain location=25-75; Score=101.6; E_value=2.3e-27; Accession=PF08132.2; Description=S -adenosyl-l-methionine decarboxylase
  Pfam annotation: Domain name=SAM_decarbox; Domain location=72-402; Score=694.5; E_value=7.7e-206; Accession=PF01536.7; Description =Adenosylmethionine decarboxylase
  Pfam module annotation: Pfam domain module=AdoMetDC_leader::SAM _decarbox; Domain location=25-75::72-402
MTIVMYLFVQDVERLHYMAGLNDLMESKVGKKKSSSSKSLLYEAPLDYTIEDVRPHGGIKKFRSAAYSNMAGSAIGFEGYEKRLEISFFENGVFADPGGLGLRALSKDQLDEILKPAECTIVASLSNDYVDSYVLSESSLFVYPYKIIIKTCGTTKLLLSIPVILKLADALDIAVKSVRYTRGSFIFPGAQSFPHRSFSEEVSVLDSYFSNLGSGSKAYVMGDPSKSQIWHIYSASAQTKGSSEAVYGLEMCMTGLDKESASVFFKENTSSAASMTENSGIRKILPQSDISDFEFDPCGYSMNGIEGSAISTIHVTPEDGFSYASFEAVGYDFNDMALGELVERILACFCPAEFSVALHIDMHGEKLNKFPLDIKGYYCGERSTEELGVGGAVVYQTFVQGCDGSASPRSILKCCWSEDENEDEVREI

SEQ ID NO: 182339 - protein, 63 aa, Glycine max
  Coding DNA Sequence Number=SeqID_65561
  Homolog annotation: Hit_ID=Q8LCW4; Match level="QueryCoverage=62%, HitCoverage=59%, E-value=3e-09, Identity=75%"; Hit description=ABA -inducible protein-like protein
MDSQKASYNAGVTKGQTQEKASNMMDKASNTAQSAKDSMQETGQQLKAKAQGAADAVKDAVNK

SEQ ID NO: 182340 - protein, 629 aa, Glycine max
  Coding DNA Sequence Number=SeqID_65562
  Gene Ontology: Mol. function=binding; Cellular component=chloroplast thylakoid membrane; Biological process=metabolic process
  Homolog annotation: Hit_ID=Q94DI0; Match level="QueryCoverage=84%, HitCoverage=95%, E-value=2e-74, Identity=32%"; Hit description =Pentatricopeptide (PPR) repeat-containing protein-like
  Pfam annotation: Domain name=PPR; Domain location=127-161; Score =18.3; E_value=0.028; Accession=PF01535.11; Description=PPR repeat
  Pfam annotation: Domain name=PPR; Domain location=259-293; Score =18.7; E_value=0.021; Accession=PF01535.11; Description=PPR repeat
  Pfam annotation: Domain name=PPR; Domain location=294-328; Score=7.6; E_value=0.94; Accession=PF01535.11; Description=PPR repeat
  Pfam annotation: Domain name=PPR; Domain location=366-400; Score=7.1; E_value=1.1; Accession=PF01535.11; Description=PPR repeat
  Pfam annotation: Domain name=PPR; Domain location=436-470; Score =29.1; E_value=1.6e-05; Accession=PF01535.11; Description=PPR repeat
  Pfam annotation: Domain name=PPR; Domain location=472-506; Score =14.8; E_value=0.13; Accession=PF01535.11; Description=PPR repeat
  Pfam annotation: Domain name=PPR; Domain location=508-542; Score =10.4; E_value=0.44; Accession=PF01535.11; Description=PPR repeat
  Pfam module annotation: Pfam domain module=PPR::PPR::PPR::PPR::PPR::PP R::PPR; Domain location=127-161::259-293::294-328::366-400::436 -470::472-506::508-542
  Subcellular localization annotation: CTP_CleavageSite=56; ConfidenceScore=5.36e-01
MRHQWRLLHHLLRSRPRITYHSQVLPYSSSIPRRFAANSTFPLNPSFRRFSSEPVLAQADTDHLLVADIFSKPVDSEDFKTLLGSNRVSITHDAVLAVLGKFDSNVDAARRFFQWVSENHPERLSSKCYNSMLCVLGTNGFVDEFWDLVNVMKKKGYGVSKGVKERVLESFEKGGMDGDVAKLKGLFDNSKEKNIAIVCRIVRNNVWGDDVEKQIEDLNVGFSSEVVKTVLESLVLEPVKALIFFRWLEESGLFKHDGRTYNAMARVLGREDLIDRFWKLVGDMRSAGFEMEAETFVKVLGRFCKRRMVKDAVELYEFAMAGANKPTVQCCVFLLRKVAAGKELDTDLFSRVLKVFTGNGNVLTDSVANAVLKSLTSVGRTGEWNKVLKEMEDCGFVAGGSLQSKIAYRLGAAGNKEQAHEFMNRIEVSGSNPYRKTWESLIQGYCVAGNLDKAFESFKEIVEKEGVASAGYSFNVLMNSYCQMNRAVDASKILCRLVNEKQLKPWHSTYKLLVTKLLVQGGFTDALNILGLMRTHGFPPFTDPFIEHLSKSGSGDDAVLFLKAMTSKRFPSTSMFLRMFEAFFKHRRHEEAQNFLSKCPRYIRNHADVLNLFCSLNSKEAASSSMLAA

SEQ ID NO: 182341 - protein, 98 aa, Glycine max
  Coding DNA Sequence Number=SeqID_65563
  Homolog annotation: Hit_ID=Q8LAM9; Match level="QueryCoverage=47%, HitCoverage=70%, E-value=4e-09, Identity=61%"; Hit description =Pollen coat-like protein
MTNEFSKALLVNRFEASPENQHNLRTPQISEDMDPQKMNYQAGQAQGQAQEKTNNLMDMAGNAAQSAKETAQQAGQTVMASAQGAADAVKNATGMNKN

SEQ ID NO: 182342 - protein, 415 aa, Glycine max
  Coding DNA Sequence Number=SeqID_65564
  Gene Ontology: Mol. function=pepsin A activity; Cellular component =anchored to membrane; Biological process=proteolysis
  Homolog annotation: Hit_ID=Q9M8R6; Match level="QueryCoverage=97%, HitCoverage=72%, E-value=8e-83, Identity=42%"; Hit description =Putative aspartyl protease
  Pfam annotation: Domain name=Asp; Domain location=17-286; Score= -197.1; E_value=0.058; Accession=PF00026.14; Description=Eukaryotic aspartyl protease
MDLTLYDIKESSSGKFVPCDQEFCKEINGGLLTGCTANISCPYLEIYGDGSSTAGYFVKDIVLYDQVSGDLKTDSANGSIVFGCGARQSGDLSSSNEEALGGILGFGKANSSMISQLASSGKVKKMFAHCLNGVNGGGIFAIGHVVQPKVNMTPLLPDQPHYSVNMTAVQVGHAFLSLSTDTSTQGDRKGTIIDSGTTLAYLPEGIYEPLVYKIISQHPDLKVRTLHDEYTCFQYSESCAPIAVVSMVRGIGHIKKARCHHPSIWQLNAMLALFKLAVMSIGICSGWCLRCLDFCIEYVLLEFFDNWTAPFAYPMHLCLYYQLHVGVGLKGVNVGSDNLLQFADLVLSNKLVFYDLENQVIGWTEYNCSSSIKVRDERTGTVHLVGFHYISFACGLNINLVMILSLLALLHKWVY

SEQ ID NO: 182343 - protein, 122 aa, Glycine max
  Coding DNA Sequence Number=SeqID_65565
MCKRMRVRGGMLKSKLNRIAWECHARKLLELTKRQSIGGFHTAWCGRNVTSSVYETCCWSLGLVWDSFDNSMLFSITWNSMVTKNIKSLLKYMEDSLVHFVQDQATGKELGLHLEDECTWKR

SEQ ID NO: 182344 - protein, 123 aa, Glycine max
  Coding DNA Sequence Number=SeqID_65566
MAKAIQDPVMRQVLLDIQETHSVIISFGGWVMVNGVATHKNHALFMEMRKWKGPEYAKGFLRKISQECILTNFRRMLYPWYCVRMGADTTGSKTGHGSYKQSTTRNWHCNKGQRQDQAAQQQK

SEQ ID NO: 182345 - protein, 197 aa, Glycine max
  Coding DNA Sequence Number=SeqID_65567
  Homolog annotation: Hit_ID=Q6K6G8; Match level="QueryCoverage=31%, HitCoverage=9%, E-value=9e-14, Identity=60%"; Hit description =Putative Importin 7<Ran-binding protein 7
DDFSDDEELQSPIDDVDPFVFFVDTIKVIQSSDPSRFVNLTQTLEFNYQALANGVAQHAEQRRAEIEKEKIEKVCSIEVPGALCTEVAICPEREDDAFRELWSQQFLQVLVQLIVWCFGAILLEESAHSCKDCVCPLPPLSLLWAPFIVSMYVPTYFCFMDTISVIFVACHIDGFPNSSSFPNNKPVEHWFSWSPVV

SEQ ID NO: 182346 - protein, 133 aa, Glycine max
  Coding DNA Sequence Number=SeqID_65568
  Subcellular localization annotation: CTP_CleavageSite=21; ConfidenceScore=5.21e-01
MAIGNTSEILTSKENSNARIRISSKARTRSSNTPMPQNEARTLEKEPTRTRRTNNANDDNKREEDEARRTTHRKSKRQTTRSGRAIGTRRGSKKAEEQNEREREEEAGRQKSRKSKRKKWKHAVTCTNESLFV

SEQ ID NO: 182347 - protein, 150 aa, Glycine max
  Coding DNA Sequence Number=SeqID_65569
  Gene Ontology: Mol. function=transferase activity; Biological process= RNA-dependent DNA replication
  Pfam annotation: Domain name=C1_4; Domain location=11-49; Score= -12.1; E_value=0.077; Accession=PF07975.2; Description=TFIIH C1-like domain
MKVFLWRVARWCLSTRGKLIRKTMECPIYCSFCVECDENDWHIFVGCEQVAKVWQEASLKHQVDDTREFIFTALQQFSYPKIEVFVFAMWTQWKHHNQTCIRDLRGNFILVMTSYFSRIPTPWRMKPELFLMPLAGYPHENTTIKVIIEI

SEQ ID NO: 182348 - protein, 84 aa, Glycine max
  Coding DNA Sequence Number=SeqID_65570
MVWLESLQSNWRLTSSSIVVRNGMVFTVYGEWHEKVERRIKDLARVRAVGIPVDHLEGCRRSLHWKRKRKRIRRWEWNGKDEIQ

SEQ ID NO: 182349 - protein, 72 aa, Glycine max
  Coding DNA Sequence Number=SeqID_65571
MEITIYKLRVEVNQSNFQLSKGARDNSFMNKKINENPINNHPELVFAHPGLVQARHEVRREHPGLVGVSLDL

SEQ ID NO: 182350 - protein, 246 aa, Glycine max
  Coding DNA Sequence Number=SeqID_65572
  Gene Ontology: Mol. function=copper ion binding; Biological process =copper ion homeostasis
  Homolog annotation: Hit_ID=Q6D476; Match level="QueryCoverage=91%, HitCoverage=89%, E-value=2e-94, Identity=72%"; Hit description =Copper homeostasis protein cutC
MAKFVKLVIGAHGDARLAVTHGRRHQVTGRTVQFMQANIDKLVQIAEAHAGTRHDYRALTGLAQIAQQRQAQFGALLLAGGQNARHAQLAQLLQRHHRVLAHIERAMERHRHALAQPHHFAHARQIDVPFFVQHANHYAGEPHLADLAEILFDHLEIHRAVAEIATARANDRMHRDRNPLARQTQRAIARRQSPLALAGAQLNAIGARPFGRQRAVDAKATNFQFYHCHPQITANIRRQLFISSFS

SEQ ID NO: 182351 - protein, 193 aa, Glycine max
  Coding DNA Sequence Number=SeqID_65573
MSEIYGIKMVIDQSLFYDLTKLPSEGVPFEGALIDDWKFDFSVHDARRLVCTNQADMIGRLLAGSLAFESRILHNLIVRILLPRSSNLAQVSEEDLIVMWAFHKGLQIDWAHLVRYRMHKALRLNALLPFPHLVTLFLQHFNIPLDSEPYVPIKRSFLIGASVIASFGYIKEHDGSWVKKGARNVGEVGHEGE

SEQ ID NO: 182352 - protein, 363 aa, Glycine max
  Coding DNA Sequence Number=SeqID_65574
MTRVAKVVKISTEELDWVKHNRNGVIGVPRKCLEEKAKALANQGEWASFIDVLALLIFGVTLFPNVERLVDLVAIDAFLAYHHSKENPIIAILVYLYDTPACLLQGHCLCAEKGKANWDQLLARGCINYNPVLAIRQLGYPMRVSPSEKSIIPFHRTGCQRPQCEGASRSPQGMGCGTKEGQSAQGKQKEEAEAPKESEEVQALKAELEQARAVKEKFKTSIWPLPKPWNEKPRGPKKKNTVKTSCEELYGAATMSLSSKETKRDQSRVEGMILKDELKACLRSKSGLSQQLSKTEGNMWAIIDEYKEKLNLTVTHEQKLEDDRKRCKKGLDGEGRLLVLGVEGADRGEWDRVQREQHRVVVP

SEQ ID NO: 182353 - protein, 245 aa, Glycine max
  Coding DNA Sequence Number=SeqID_65575
MKANMSALKNQMVSMMEAMLSMGRLIESNAATATAASTVVKADPIFLSATNLVHQLPPDMVGRGGDILGNTSGSHRGYSRNAYPYGLPPNFTPPTMHENMDPVVPFTFKGKPPQPIGGAHEEPREHACCNMPFCGLARRGSRVRFPKEEKMRVVATNVYLWKTSEKLKETSQKDIPSSGVVFTFEEGISTSHVDKSGALAPTYPPSKRKSDLREELATQLAQVSSARPSEPGCFLQKQPPSGGRI

SEQ ID NO: 182354 - protein, 171 aa, Glycine max
  Coding DNA Sequence Number=SeqID_65576
MAPRKLSSKRSRKEAAAAGTSAAPEFDSHRFRSAEHQQRFKAIKGWSFHRERRVQLRDDEYTDFQVRSRYSSRVLRQCLACRGGRTGPPVMGEGPVDSFRCKHPKSIPGISASQDFAWTAAWRRVRIMRTNMTTLTQTWMTLLLSNILPSDHNSDLPLPKCQLVCHLSGTL

SEQ ID NO: 182355 - protein, 54 aa, Glycine max
  Coding DNA Sequence Number=SeqID_65577
MKAKCNQRWLRGAKTASLDTGLPCNDVFHLSRAEKGRRSVGRDPILHLHSSLST

SEQ ID NO: 182356 - protein, 246 aa, Glycine max
  Coding DNA Sequence Number=SeqID_65578
  Subcellular localization annotation: CTP_CleavageSite=29; ConfidenceScore=5.07e-01
MTTSQCIWSFQMKTSRPCSKHPVDSLRCRCSESVPRPPTGLGGGLAVEMGANHAHQHDLPFPDMDNVSVHMAQLISDAIYQFAGTVPTRHPMDPERSNSALGFPALITGLCQFYGVPVTPSKVIRPPITRAFIEKYCTPRQAADAPPSPPESTSAHLRRLEHCIRHVASQKVANHRGQMEAGPAGTSGGGDKAQEDEDMADLIDFLLKCDAILPRKGPVTRAMSKRLQEDWARVDKEGLRVLMNLR

SEQ ID NO: 182357 - protein, 114 aa, Glycine max
  Coding DNA Sequence Number=SeqID_65579
MQRPNKVAYSFSETSVSFDRDYYSLHYVIQRHSSPMACEDHDGHSLSMLQDYQSSLIIQRQADCQVRWHVETDIVIYFPCQETQCLLTKATEVSLVILRQASLMACGDRHGFDD

SEQ ID NO: 182358 - protein, 523 aa, Glycine max
  Coding DNA Sequence Number=SeqID_65580
  Gene Ontology: Mol. function=monooxygenase activity; Cellular component=endoplasmic reticulum; Biological process=electron transport
  Homolog annotation: Hit_ID=Q6J540; Match level="QueryCoverage=92%, HitCoverage=89%, E-value=1e-171, Identity=61%"; Hit description =Cytochrome P450
  Pfam annotation: Domain name=p450; Domain location=36-514; Score =264.0; E_value=2.9e-76; Accession=PF00067.12; Description=Cytochrome P450
MDHSLLIIIIIFSITFLKAFRSHLFKKSKKQELPLPPGPKPWPIIGNLPEMLTHRPTFRWIQNLMKEMNTEIACIRLGNVHVIPVTCPTIAREFLRKQDATFASRPNSITTSLISRGYLSTTLVPFGEQWKKMRRIVSNDLLSTTTHQRLENKRVEEADNLVFYIYNKCKNNVNDNVCLVNVRYVAQHYSCNVIKKLIFSTRYFGEGKKDGGPGREEEEHVDSIFTMLKYIYDFSVSDYVPFLRGLDLDGHEGKVKKALEIVEKYHDPIIEQRIKERNNGSKIDGEDFLDILISLKDANNNPMLTTQEIKAQITELMMAAMDNPTNAFEWGLGEMINQPKLLQRAVEELDTVVGKERLVQESDIPKLNYIKACAREAFRLHPIVPFNVPHVSLKDTIVGNYLIPKGSHILLSRQELGRNPKVWNDEPLKFKPERHLINKSDVVLTDQDLNLISFSTGRRGCPGFMLGTTMTVMLFARLLHAFTWIAPPNVSHINLAESSHDISLAHPPLALAKPRLPPELYNK

SEQ ID NO: 182359 - protein, 536 aa, Glycine max
  Coding DNA Sequence Number=SeqID_65581
  Gene Ontology: Mol. function=transcription factor activity; Cellular component=nucleus; Biological process=regulation of transcription, DNA-dependent
  Homolog annotation: Hit_ID=Q9FR97; Match level="QueryCoverage=89%, HitCoverage=86%, E-value=9e-85, Identity=41%"; Hit description=MYB65
  Pfam annotation: Domain name=Myb_DNA-binding; Domain location=37-84; Score=48.4; E_value=2.5e-11; Accession=PF00249.21; Description=Myb -like DNA-binding domain
  Pfam annotation: Domain name=Myb_DNA-binding; Domain location=90-135; Score=41.4; E_value=3.1e-09; Accession=PF00249.21; Description=Myb -like DNA-binding domain
  Pfam module annotation: Pfam domain module=Myb_DNA-binding::Myb_DNA -binding; Domain location=37-84::90-135
MRRMKKDIEDEVLPNDMSGAQLNDESYEGSAGIVLKKGPWTSTEDDILVDYVKKHGEGNWNAVQKHTGLFRCGKSCRLRWANHLRPNLKKGAFAAEEERLIAELHAKMGNKWARMAAHLPGRTDNEIKNYWNTRIKRRQRAGLPLYPPEVSLHALQESQHSQSTGGLNGGDKMHPDFLQKNSYEIHDAIFDSLKDNQGILPYVHELSDISVYGNKLKGLDSSQYCSFVPPTSPKRKRLKESTIPFIDSCAMKKKDLYPFDQIQDNNSDKIAQSFGMQAPLDPGLSSHSSMCYSHSLSNGNSSTSKPYEAMKLELPSLQYPELDLGSWGSSPPPSLLESVDDFLQSPTAISTLESDCSSPQNSGLLDALLYQAKTMSSSKNHCSDKSSNSSTATPGDRADSSILNVYETEWEDYADPVSPFGATSILNECPALRANANSLNGQLPVQTFTGNLPKLESVDQVWTPNNENLTLSLLNITRPDFLLASDWYDLGSGHCKNQTITTDAATAFLGDDLATDLKHMTAGISKTMFENPFQPL

SEQ ID NO: 182360 - protein, 867 aa, Glycine max
  Coding DNA Sequence Number=SeqID_65582
  Gene Ontology: Mol. function=histone-lysine N-methyltransferase activity; Cellular component=nucleus; Biological process =intracellular signaling cascade
  Homolog annotation: Hit_ID=Q9C5X4; Match level="QueryCoverage=95%, HitCoverage=76%, E-value=0.0, Identity=50%"; Hit description=Histone- lysine N-methyltransferase, H3 lysine-4 specific ATX1
  Pfam annotation: Domain name=C1_1; Domain location=613-659; Score= -2.7; E_value=0.055; Accession=PF00130.12; Description=Phorbol estersdiacylglycerol binding
  Pfam annotation: Domain name=C1_3; Domain location=621-652; Score =7.9; E_value=0.06; Accession=PF07649.3; Description=C1-like domain
  Pfam annotation: Domain name=FYRC; Domain location=511-601; Score =66.5; E_value=8.6e-17; Accession=PF05965.4; Description=FY rich C -terminus
  Pfam annotation: Domain name=FYRN; Domain location=454-506; Score =49.7; E_value=9.6e-12; Accession=PF05964.4; Description=FY-rich N -terminus
  Pfam annotation: Domain name=PHD; Domain location=622-671; Score =35.3; E_value=2.1e-07; Accession=PF00628.19; Description=PHD-finger
  Pfam annotation: Domain name=PHD; Domain location=745-782; Score=5.1; E_value=0.017; Accession=PF00628.19; Description=PHD-finger
  Pfam annotation: Domain name=PWWP; Domain location=305-384; Score =36.5; E_value=9.5e-08; Accession=PF00855.8; Description=PWWP domain
  Pfam module annotation: Pfam domain module=C1_1::C1_3::FYRC::FYRN::PHD ::PHD::PWWP; Domain location=613-659::621-652::511-601::454-506::622 -671::745-782::305-384
MTAAFQEGGGGGGGGGDDDATIDVHTTRGTPIRYLPLDHLYSATSPCRVTASGSSNVMSKKIKARKLTLTHNNHFNNHDQKKTAPSSSSSLTLPPKPPLLFVYSRRRRKRHSPSATASFADGAENDESERRLLKKRKIGSTELERLGVDLNTAIGDVDGPRLRECRNQFGNSGAAGNAKCGSLENLPKMLPESRNVKKWVGLTFDNADPEAFVGLRCKVYWPMDLKAYIGYVRSYDKETKIHHVKYDDGDEESLILANENIRFHVSRDEMKHLKLNFAKVRDNNVSDYDVEEMLALAASLDDCQDFEPGDIIWAKLTGHAMWPAVVLDESLASNCKGLKMFLGGRSVPVQFFGTHDFARVRLQQVKSFLSGLLTDLHSKCKKHSFIEGLEEAKRYLSEQKLPSEMLELRKRCTADDCNNISGEDGGCTDSGDDCLNDNGTLTALETIETFPYEVGDLQILSLGKIVEDSAFRDGRFIWPEGYTAVRKFTSVTDPKVSAPYKMEVLRDPESKVRPLFRVTVEGGEQFNGYTPSACWNEVYEKIKKMEKDASEGTVAGGEEKSYESGSDMFGFSNPIVLKLIRGLSKSKISSKNSTCKLGSRRYNNNLPLGYRQVHINWFDLDKCNVCHMDEEYENNLFLQCDKCRMMVHARCYGELEPVNGVLWLCNLCRSGAPPPPCCLCPLIELYVFGYLMEFLLGGAMKPTTDGRWAHLACAMWIPETCLADVKRMEPIDGLSRISKDRWKLLCSICGVSYGACIQCSNNSCRVAYHPLCARAAGLCVELENEDRLYLLSVDDDEDQCIRLLSFCKKHRQPSNEPSVADERMVRVAGLCSDYEPPPNLSGCARSVFLVPSGKGNSSVLGAGWQSS

SEQ ID NO: 182361 - protein, 535 aa, Glycine max
  Coding DNA Sequence Number=SeqID_65583
  Gene Ontology: Mol. function=protein serine/threonine kinase activity; Cellular component=cytoplasm; Biological process=protein amino acid phosphorylation
  Homolog annotation: Hit_ID=Q5ZBB1; Match level="QueryCoverage=47%, HitCoverage=32%, E-value=2e-66, Identity=52%"; Hit description=Dual -specific kinase DSK1-like
  Pfam annotation: Domain name=Pkinase; Domain location=307-533; Score =69.0; E_value=1.5e-17; Accession=PF00069.15; Description=Protein kinase domain
  Pfam annotation: Domain name=Pkinase_Tyr; Domain location=307-533; Score=64.5; E_value=2e-16; Accession=PF07714.7; Description=Protein tyrosine kinase
  Pfam module annotation: Pfam domain module=Pkinase::Pkinase_Tyr; Domain location=307-533::307-533
MSEETRRIVVIHYASRDFNTSAIKVVMEGYSLGHGDKLTLLVVLRHANSPSRIPFIASARLRGLFETDHKIVEKEVAKMKEEILNNASIREISEQCEAERIQFRIEVLQGNLPEVAVNAATRLEAKTVILDRQMKKYKKNFKQSLSCALLIMNRDNTLRHLRGPRETQLSDGSNGNANFASSYSKSPQRIQQVANAIFCSNSSSSIQTLTKVVCPQSHSQMKKFLDNREQDMARGYCILPTSDTRNTNHTDLYHIETPVEHSNNPESYQIVEQFKNSVCSVCNNRRPKFEPLKEFTYAELHEATQGFTPKNYLSEGGFGSVYKGKLQGGLRIAVKQHKCASFQGDKEFKSEVNALSRAIHENVVMLRGSCSEGNNRLLVYEFVCNGSLDQHLSRKRKILIGETNYDYNDAEHSRKPLSWAERIKVAIGAAKGLLFLHQNNIIHRDVRPSNILVTHDYEAMLGDFGLARTEQMDSLYSTDVVGTIGYLAPEYAESGKMSTKTDVYSFGVVLLQLITGMRTADKRLGDKSLVGWVTI

SEQ ID NO: 182362 - protein, 149 aa, Glycine max
  Coding DNA Sequence Number=SeqID_65584
  Subcellular localization annotation: CTP_CleavageSite=52; ConfidenceScore=5.74e-01
MEGGYGNRGSSFSQSRRGRGRGRGQRFPSNQSKVSSFAERGTPSSSSANRASASVISNTLEDDAQPSSNFVGTCPYMCPGIGRSKRVLRTLIHKVMVAITNVAENWKEILGRFAPMDHDPPHKGQSSPRAEVIIIYIREIYTNEPRATT

SEQ ID NO: 182363 - protein, 74 aa, Glycine max
  Coding DNA Sequence Number=SeqID_65585
MQSTRLTELCARLVFLTQATSDVVASLDKVDQQVGDTRVVDKVKVVKPPKLVTRSKVKSRNRVYQEVSSLPVGQ

SEQ ID NO: 182364 - protein, 1189 aa, Glycine max
  Coding DNA Sequence Number=SeqID_65586
  Gene Ontology: Mol. function=protein binding; Cellular component =membrane; Biological process=defense response
  Homolog annotation: Hit_ID=Q6R269; Match level="QueryCoverage=99%, HitCoverage=100%, E-value=0.0, Identity=87%"; Hit description =Disease resistance protein
  Pfam annotation: Domain name=LRR_1; Domain location=1002-1024; Score =9.6; E_value=4.5; Accession=PF00560.23; Description=Leucine Rich Repeat
  Pfam annotation: Domain name=LRR_1; Domain location=1027-1050; Score =6.2; E_value=20; Accession=PF00560.23; Description=Leucine Rich Repeat
  Pfam annotation: Domain name=LRR_1; Domain location=1075-1095; Score =0.8; E_value=2e+02; Accession=PF00560.23; Description=Leucine Rich Repeat
  Pfam annotation: Domain name=LRR_1; Domain location=1098-1121; Score =7.6; E_value=11; Accession=PF00560.23; Description=Leucine Rich Repeat
  Pfam annotation: Domain name=LRR_1; Domain location=1123-1146; Score =14.2; E_value=0.46; Accession=PF00560.23; Description=Leucine Rich Repeat
  Pfam annotation: Domain name=LRR_1; Domain location=574-595; Score =8.8; E_value=6.6; Accession=PF00560.23; Description=Leucine Rich Repeat
  Pfam annotation: Domain name=LRR_1; Domain location=597-618; Score =13.6; E_value=0.72; Accession=PF00560.23; Description=Leucine Rich Repeat
  Pfam annotation: Domain name=LRR_1; Domain location=620-642; Score =13.3; E_value=0.87; Accession=PF00560.23; Description=Leucine Rich Repeat
  Pfam annotation: Domain name=LRR_1; Domain location=644-665; Score =0.9; E_value=2e+02; Accession=PF00560.23; Description=Leucine Rich Repeat
  Pfam annotation: Domain name=LRR_1; Domain location=687-709; Score =0.2; E_value=2.6e+02; Accession=PF00560.23; Description=Leucine Rich Repeat
  Pfam annotation: Domain name=LRR_1; Domain location=778-799; Score =3.0; E_value=79; Accession=PF00560.23; Description=Leucine Rich Repeat
  Pfam annotation: Domain name=LRR_1; Domain location=801-824; Score =2.7; E_value=88; Accession=PF00560.23; Description=Leucine Rich Repeat
  Pfam annotation: Domain name=LRR_1; Domain location=856-876; Score =8.2; E_value=8.4; Accession=PF00560.23; Description=Leucine Rich Repeat
  Pfam annotation: Domain name=LRR_1; Domain location=878-903; Score =4.4; E_value=42; Accession=PF00560.23; Description=Leucine Rich Repeat
  Pfam annotation: Domain name=NACHT; Domain location=192-346; Score= -40.2; E_value=0.078; Accession=PF05729.3; Description=NACHT domain
  Pfam annotation: Domain name=NB-ARC; Domain location=151-457; Score =309.3; E_value=6.8e-90; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::NACHT::NB-ARC; Domain location=1002-1024::1027-1050::1075 -1095::1098-1121::...
  Pfam module annotation: Domain location=1123-1146::574-595::597 -618::620-642::644-665::687-709::778-799::801-824::856-876::878 -903::192-346::151-457
MPVLETLGGALFGAVLQVLFDKLDSHQVLDYFRGRKLDGRLLKTLKWKLMSVNAVLDDAEQKQFTDKNVKEWLDEVRDVLLNTEDLLEEIDYEFTKTELKAESQTSASKVCNFESMIKDVLDELDSLLNVKDTLRLKNVGGDGFGSGSGSKVSQKLPSTSLVVESVFYGRDDDKDMILNWLTSDTDNHNKISILSIVGMGGMGKTTLAQHVYNNPRIEEAKFDIKVWICVSDDFDVLMLSKTILNKITKSKDDSGDDLEMVHGRLKEKLSGNKYLFVLDDVWNEDRDQWKALQTPLKYGAKGSKILVTTRSNNVASTMQSNKVHELKQLREDHSWQVFAQHAFQDDYPKLNAELKEIGIKIIEKCQGLPLALETVGCLLHKKPSISQWEGVLKSKIWELPKEESKIIPALLLSYFHLPSHLKRCFAYCALFPKDHEFYKEGLIQLWVAENFVQCSTQSNPQEEIGEQYFNDLLSRSFFQRSSREECFVMHDLLNDLAKYVCGDICFRLQVDKPKSISKVRHFSFVTENDQYFDGYGSLYHAQRLRTFMPMTEPLLLINWGGRKLVDELFSKFKFLRILSLSLCDLKEMPDSVGNLNHLRSLDLSYTSIKKLPDSMCFLCNLQVLKLNFCVHLEELPSNLHKLTNLRCLEFMYTEVRKMPMHMGKLKNLQVLSSFYVGKGIDNCSIQQLGELNLHGSLSIEELQNIVNPLDALAADLKNKTHLLDLELEWNEHQNLDDSIKERQVLENLQPSRHLEKLSIRNYGGTQFPSWLSDNSLCNVVSLTLMNCKYFLCLPPLGLLPFLKELSIGGLDGIVSINADFFGSSSCSFTSLESLKFFNMKEWEEWECKGVTGAFPRLQRLSIEDCPKLKGHLPEQLCHLNYLKISGCEQLVPSALSAPDIHQLYLVDCGELQIDHLTTLKELTIEGHNVEAALLEQIGRNYSCSNNNIPMHSCYDFLLSLDINGGCDSLTTIHLDIFPILRRLDIRKWPNLKRISQGQAHNHLQTLCVGSCPQLESLPEGMHVLLPSLDDLWIEDCPKVEMFPEGGLPSNLKSMGLYGSYKLMSLLKTALGGNHSLERLSIGGVDVECLPEEGVLPHSLLTLEIRNCPDLKRLDYKGLCHLSSLKELSLVGCPRLECLPEEGLPKSISTLWIWGDCQLLKQRCREPEGEDWPKIAHIKRVSLLGNDVDV

SEQ ID NO: 182365 - protein, 121 aa, Glycine max
  Coding DNA Sequence Number=SeqID_65587
MLEARREAGIWWERVGTEEEGGLRSTKSAKYKLMRLIKQGVGLKQGVGFNVEFGDDEGDTHDDHEVDHEGGGGSELEAPSSGGGGEEGKEAWEGGEGKTSGDEERGAARGGVSRQDRMAHG

SEQ ID NO: 182366 - protein, 78 aa, Glycine max
  Coding DNA Sequence Number=SeqID_65588
  Gene Ontology: Mol. function=DNA binding; Cellular component=nucleus; Biological process=regulation of transcription
  Homolog annotation: Hit_ID=Q2LME0; Match level="QueryCoverage=60%, HitCoverage=13%, E-value=1e-15, Identity=72%"; Hit description=MYB24
MLPGLAGVPMLKITKFSLRMTAQEREIGTTPCCDEANVKRGPWSTEDDSKLKEYINKYGIRGNWIGLPLKAGIKYIHV

SEQ ID NO: 182367 - protein, 105 aa, Glycine max
  Coding DNA Sequence Number=SeqID_65589
MTCWSWVRIRKQPLCICKGKAAYNIPPPYLRIAKSLWAMGHKTINSHHLVHRIAPLTDHSKPPNQPQLTYVYNWLTPLPNIDLFNYRSAISQPHGGNLTTSRHKP

SEQ ID NO: 182368 - protein, 142 aa, Glycine max
  Coding DNA Sequence Number=SeqID_65590
MEGTKLKFSLAYHPQADGQTKVVNRCIEMYLQCLTSSKRKQWPTVSVGLSIGITPIIMAPLHLPASSCLLLLIFKHCLPFYLMSDEWELEIQPDAAKVLDYRINTEDLTKTTVATDKSQNEEQSKVIEEIAEEKTITEVNSD

SEQ ID NO: 182369 - protein, 370 aa, Glycine max
  Coding DNA Sequence Number=SeqID_65591
  Gene Ontology: Mol. function=RNA-directed DNA polymerase activity; Biological process=RNA-dependent DNA replication
MTVMTMSVTAKTTVTIDGSDNNWLRRIIAAMRVEELTKLKVDHDQLGARLKHSQGDEKTAHTLPEHTQGESHPRHTSNTADSLSFSHMHRPVGWTIYQNAFVNCIMEADIPLGWKPLNLDRYDGTTNTNEHLDAFLTQANLYTNDDTILCHVFPMSLKVATLTWSYCMTSTALASLRPEDDEYLRKLMDRFGRTGVQIQNLNPKVALHSMFIALHPSKIIDSLREKPPGCMDELCERAKGYIQMEEMSRFRNEVHQAGQRHDKNESNTKANLHKKHSTLRYPSDYPRRNLLGRAQKQPNTTDIIVAGYLAKFVKRLDSHQVGAKLEGHKSTGTRKQTEEEQKTEADKDTSNNDVSDNLHKNRNLPSKSEV

SEQ ID NO: 182370 - protein, 401 aa, Glycine max
  Coding DNA Sequence Number=SeqID_65592
  Subcellular localization annotation: CTP_CleavageSite=79; ConfidenceScore=5.31e-01
MEKVKRIQDNMKVTHKTSGTFPVGAKLSRTGIFSGFTSDSPNEIAKLKGSCSNLIFSSSCYCWNNSLLVDGSRTSMGIMASVPYALRLVESSTQGPEDDSISCRYMFEFFVSLSFELSVNGVWEVVPTNEDVHSSHGERPKGAQTVKIVRRSVWHVCKLLASPGPLGSHPVWFFLFFGHNFLNIYDGSLEHLLDDDLKVPSLLGAAQLREQALKLSLRAHSRVILSGPSRMTLASLCFMLDAPSINTPVLVTGEVPTKPHALPGFRIKLYLVDDQGSNLRHFVHSHELSAFSSYETSDGEAPGELTLTKGGHQVHVPFGLCSLTYKAEEWTGVRMDGVGLDLESLEGFLVQDINWIALIDEGLGHYEVRNDDGDNHRVVLVDRVDALEVPVREGDRRETSL

SEQ ID NO: 182371 - protein, 253 aa, Glycine max
  Coding DNA Sequence Number=SeqID_65593
  Homolog annotation: Hit_ID=Q2LME0; Match level="QueryCoverage=11%, HitCoverage=8%, E-value=2e-07, Identity=80%"; Hit description=MYB24
  Pfam annotation: Domain name=Transposase_23; Domain location=97-167; Score=2.5; E_value=0.00061; Accession=PF03017.5; Description =TNP1ENSPM transposase
MARTKKTGQMTSEAAKEIANKIEHASQGSFVAHGHQDDLPCIFIHGSQTPGVANAKNQGPMQSQGLTLPPEPKVSPSAARVSTKESYVDPSGNDPDTGESEKCGLYVEENPPRLVAFRRLYEGSTTIHNIPLGNDQVKVGVEEVRNADARIPVPTQEVQLMGQTLNTFPSWPTHLVKRFPEHDKYGAVGPAKPANRSDPDVNDPLYLMTLTIPQLFLKPLDREIGTTPCCDEANVKRGPWSTEEDSKLKEYIE

SEQ ID NO: 182372 - protein, 51 aa, Glycine max
  Coding DNA Sequence Number=SeqID_65594
MASYRAHFAEVCQKVSYEPNATLQKWLFIMTVSLLDVGLQDVPFCPRLLAM

SEQ ID NO: 182373 - protein, 166 aa, Glycine max
  Coding DNA Sequence Number=SeqID_65595
  Homolog annotation: Hit_ID=Q0ZCD8; Match level="QueryCoverage=67%, HitCoverage=25%, E-value=5e-08, Identity=33%"; Hit description=CCHC -type integrase
MANLVLDTRKKITEISSSTEQHISEASKEHEENHHIQHTQILKPRTFLATFYPKPMTSATSAAAWDRLKKHYASRSHNRIMSLKESLASITKDTLSVTERLLSIFPLADELSLIGRLVDDLDLLIIGLKGLGPAFHEFSASIRECDSPLLFAELFNKLVDRDFSPA

SEQ ID NO: 182374 - protein, 145 aa, Glycine max
  Coding DNA Sequence Number=SeqID_65596
MAPRTDKPDKSVDEVSAQFREMQLCLEAVTKQQTDFQNFLTTQLPLLIREQISSQSAAHSSSPVRTDPPQSTIKLPKITLSSFDGKDPLDWIFKVEHYFDLTDTPPPRRLILIPFFLQGPALSWFKWLHSNHLLTTWSEFLHALE

SEQ ID NO: 182375 - protein, 91 aa, Glycine max
  Coding DNA Sequence Number=SeqID_65597
MKRGRRILERRSHFSRRKKKKRFSEMNNDSYGRVTVPLLYERVKGIFALSLTLLGVPAKMLGAPNNCQPFPSFRSALQLFFYCHSNQATSL

SEQ ID NO: 182376 - protein, 454 aa, Glycine max
  Coding DNA Sequence Number=SeqID_65598
  Gene Ontology: Mol. function=transferase activity, transferring hexosyl groups; Cellular component=cytoplasm; Biological process =metabolic process
  Homolog annotation: Hit_ID=Q9SGA8; Match level="QueryCoverage=99%, HitCoverage=97%, E-value=1e-135, Identity=53%"; Hit description =Putative UDP-glucosyl transferase
  Pfam annotation: Domain name=UDPGT; Domain location=4-442; Score= -71.5; E_value=5.1e-07; Accession=PF00201.9; Description=UDP -glucoronosyl and UDP-glucosyl transferase
MARPHVMVVPYPAQGHVIPLMELSLLLIKQGIKITFVNTKDNHERIMSALPSGNDLSSQISLVWISDGLESSEERKKPGKSSETVLNVMPQKVEELIECINGSESKKITCVLADQSIGWLLDIAEKKGIRRAAFCPASAAQLVLGLSIPKLIDRGIIDKDGTPTKKQVIQLSPTMPSVSTEKLVWACVGNKIAQKHIFQLMVKNINSMQKTEWLLCNSTHELEPAAFSLAPQIIPIGPLLSSNHLRHSAGNFWPQDLTCLKWLDQHSPCSVIYVAFGSFTTFSPTQFQELCLGLELTNRPFIWVVQPDFTEGSKNAYPEGFVQRVADRGIMVAWSPQQKILSHPSVACFISHCGWNSTLESVSNGIPVLCWPYFADQFLNRSYVCDVWKVGLGLEPDGSGMITRGEIRSKIKQLLDDEQLKERVKDFKEKVQIGTGQGGLSKNNLDSFIRWLKT

SEQ ID NO: 182377 - protein, 215 aa, Glycine max
  Coding DNA Sequence Number=SeqID_65599
  Gene Ontology: Mol. function=RNA-directed DNA polymerase activity; Cellular component=chromatin; Biological process=RNA-dependent DNA replication
MLICEAKYWWHGASQLMESSEEAITGASLKEHFLRKYFPIEGERIEIQKTIIPVTIREFPKLVERIKTVECLEYDVGFITANQAHAALEEKAQGYMVLSFLEVKSYLDLNFVDVVRHFAKVSPKDIHDLSLKREIKFIIDLVLGVRPVSIVPYRMAPAELVMLKKQVKELLKKQMIRLNVSPWGAPILLVKKNDIGSRLCVDYRQLNKVTIKNKY

SEQ ID NO: 182378 - protein, 196 aa, Glycine max
  Coding DNA Sequence Number=SeqID_65600
  Gene Ontology: Mol. function=protein binding; Cellular component =membrane; Biological process=defense response
  Homolog annotation: Hit_ID=Q6R271; Match level="QueryCoverage=97%, HitCoverage=16%, E-value=7e-46, Identity=56%"; Hit description =Disease resistance protein
MAAEFVGGALLSSFLQVVFDRLVSRQVLEYFRGRKLDEKLLNKLKVKLRSIDALADDAEQKQFRDPRVREWLVAVKDADIPINRMNATKKEDLLDEIDYEINKWAVENDSESQTCTCKESSFFETSFSSFNMKIESRMKQVLADLEFLSSQKGDLGLKEASGLGVGSGSKVSQKLPSISLVTESVIYGRDNDRNYP

SEQ ID NO: 182379 - protein, 1186 aa, Glycine max
  Coding DNA Sequence Number=SeqID_65601
  Gene Ontology: Mol. function=protein binding; Cellular component =membrane; Biological process=defense response
  Homolog annotation: Hit_ID=Q6R269; Match level="QueryCoverage=99%, HitCoverage=100%, E-value=0.0, Identity=77%"; Hit description =Disease resistance protein
  Pfam annotation: Domain name=LRR_1; Domain location=1000-1022; Score =9.6; E_value=4.6; Accession=PF00560.23; Description=Leucine Rich Repeat
  Pfam annotation: Domain name=LRR_1; Domain location=1025-1048; Score =5.3; E_value=30; Accession=PF00560.23; Description=Leucine Rich Repeat
  Pfam annotation: Domain name=LRR_1; Domain location=1096-1119; Score =9.6; E_value=4.5; Accession=PF00560.23; Description=Leucine Rich Repeat
  Pfam annotation: Domain name=LRR_1; Domain location=1121-1144; Score =15.7; E_value=0.17; Accession=PF00560.23; Description=Leucine Rich Repeat
  Pfam annotation: Domain name=LRR_1; Domain location=574-595; Score =6.6; E_value=16; Accession=PF00560.23; Description=Leucine Rich Repeat
  Pfam annotation: Domain name=LRR_1; Domain location=597-618; Score =12.4; E_value=1.3; Accession=PF00560.23; Description=Leucine Rich Repeat
  Pfam annotation: Domain name=LRR_1; Domain location=620-642; Score =14.7; E_value=0.34; Accession=PF00560.23; Description=Leucine Rich Repeat
  Pfam annotation: Domain name=LRR_1; Domain location=644-665; Score =4.1; E_value=49; Accession=PF00560.23; Description=Leucine Rich Repeat
  Pfam annotation: Domain name=LRR_1; Domain location=778-799; Score =1.3; E_value=1.6e+02; Accession=PF00560.23; Description=Leucine Rich Repeat
  Pfam annotation: Domain name=LRR_1; Domain location=854-877; Score =11.3; E_value=2.2; Accession=PF00560.23; Description=Leucine Rich Repeat
  Pfam annotation: Domain name=LRR_1; Domain location=897-920; Score =1.8; E_value=1.3e+02; Accession=PF00560.23; Description=Leucine Rich Repeat
  Pfam annotation: Domain name=NB-ARC; Domain location=151-457; Score =314.5; E_value=1.9e-91; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NB-ARC; Domain location=1000-1022::1025-1048::1096-1119::1121-1144::574-595::597 -618::620-642::...
  Pfam module annotation: Domain location=644-665::778-799::854 -877::897-920::151-457
MPVLETLGGALFGAVLQVLFDKLDSHQVLDYFLGRKLDGRLLKKLKRKLVSVNAVVDDAEQKQFTDAYVKAWLDDVRDVLLDTEDLLDEIDCEFSKTELEAESQTSASKVCDFESRIIDVLDDLDSLLDQKNDLGLKNVSHVGVGSGSGSKVSQKLPSTSLVVESIIYGRDDDKEIILNWLTSDTDNHNKISILSIVGMGGMGKTTLAQHVYNNPRIQEAKFDIKVWVCVSDDFDVLMLTKTILNKITKSKEDSGDDLEMVHGRLKEKLSGNKYLLVLDDVWNEDRDQWKALQTPLKYGAKGSKILVTTRSNKVASIMQSNKVHELKQLQEDHSWQVFAQHAFQDDYPKLNEQLKEIGIKIVEKCQGLPLALETVGCLLHTKPSVSQWEGVLKSKIWELPKEDSKIIPALLLSYYHLPSHLKRCFAYCALFPKDHEFYKDSLIQLWVAENFVQCSQESTPQEEIGEQYFNDLLSRSFFQRSSREKCFVMHDLLNDLAKYVCGDICFRLGVDKTKSISKVRHFSFVPEYHQYFDGYGSLYHAKRLRTFMPTLPGRDMYIWGCRKLVDELCSKFKFLRILSLFRCDLIEMPDSVGNLKHLRSLDLSKTYIKKLPDSICFLCNLQVLKLNSCDHLEELPSNLHKLTNLRCLEFMYTKVRKMPMHFGKLKNLQVLSSFYVGMGSDNCSIQQLGELNLHGRLSIEELQNIVNPLDALAADLKNKTHLLDLELKWNEHQNLDDSIKERQVLENLQPSRHLEKLSIGNYGGTQFPSWLLDNSLCNVVWLSLKNCKYCLCLPPLGLLPLLKELLIGGLDGIVSINADFYGSSSCSFTSLESLEFYDMKEWEEWECMTGAFPRLQRLYIEDCPKLKGHLPEQLCQLNDLKISGCEQLVPSALSAPDIHQLFLGDCGKLQIDHPTTLKVLTIEGYNVEAALLEQIGHNYACSNKNIPMHSCYDFLVKLEIIGGCDSLTTIHLDIFPILGVLYIRKCPNLQRISQGHAHNHLETLSIIECPQLESLPEGMHVLLPSLDSLWIIHCPKVQMFPEGGLPSNLKNMRLYGSSKLISLLKSALGDNHSLERLSIGKVDVECLPDEGVLPHSLVTLDISHCEDLKRLDYKGLCHLSSLKKLHLSNCPRLQCLPEEGLPKSISTLSIYNCPLLKQRCREPKGEDWPKIAHIKRVSLHGNDVDV

SEQ ID NO: 182380 - protein, 93 aa, Glycine max
  Coding DNA Sequence Number=SeqID_65602
  Subcellular localization annotation: CTP_CleavageSite=38; ConfidenceScore=5.56e-01
MSFWRTTTRVRSNTMYSAVSLNSWSGFTASSSPSWVVVVVVVVGIKCCEFLGYTVWGVNVIREERVLGLSNGDSRVCHLMVLVTTEMPLSFLL

SEQ ID NO: 182381 - protein, 122 aa, Glycine max
  Coding DNA Sequence Number=SeqID_65603
MENNDGFWWLMVPVGDGESSWNFRNGFGRKKEEENDVFSKLHESKEASYKSFIKRSLAHSRHLLKDPNGQIMDNCLLKLQTKFREDPTVNEGWTVFLPRQLHVAFSRSFIKRLPPEASSWLL

SEQ ID NO: 182382 - protein, 543 aa, Glycine max
  Coding DNA Sequence Number=SeqID_65604
  Gene Ontology: Mol. function=RNA-directed DNA polymerase activity; Biological process=RNA-dependent DNA replication
MVSTQSGLKRETLFESSNPSLAVMTDTNTLQQLQNRITKMERCHEKELRKLNADYDRPETYVRRPQDNELFAHTMPERTQGESHPGRTVNTPNDLNFSHMHRPAGQTTHPYEHLDTFLTQANLYTNNDVILCHVFPTSLKGVALTWYSGVPPRSIDSFDTFVERFNGESLRKFMDRFGCTAVQIQNLNPEVALHSMLLALRPDKHNPDKRYTPLTVNHTTILEETFNLEVPIKLPLTEPPKSGFDATKYCSLSKGWTTIKQEQDLEDTKKSNIETTKQTKEEIEWKIEVDRDTNNNNMSDNLHKNRNSPNKSERSLPPITFMDRDFNGINPLNQDDLVVVSIIIANFMVSKRPEVCPHTVHTYTSPLHGFAGEIVETKDYVDLITTFGQGQLSRSFTIRYLLVDADTSYFALIGKKTLNELGAIVSMPHLKMKFPTLTGEIVTIKIRMHAPDEEKTTFITEDDNFCARQVPRLYDHSPGIEANPEKCTAILEMRNPTNIEEVQKLNGRLASLSRFLVKLAEKAKPFYKLLKEIGPFLWDETCE

SEQ ID NO: 182383 - protein, 54 aa, Glycine max
  Coding DNA Sequence Number=SeqID_65605
MWEKFKSFGVLTVRPGCDSPWSHGRRQMYLPKSRASTRQGGCGQSGVLEFVRWL

SEQ ID NO: 182384 - protein, 369 aa, Glycine max
  Coding DNA Sequence Number=SeqID_65606
MGDFICRPLMKQIEHVGGVMLLSTAPVIGEEGQPPAEKSRAPSSILALRKVAGLTSGVGRPSSVQDVPLTPSVIEAPAANVVIVITLDPPPRHGNRTGRAPQVDLITAEESVPAALASSVVASSSTTVAPLLSVGVVTTNALVVPPLSPSTPMGANPNRRPRMALSQPLKKNLIRSIEFQHAIDSAKRLKLPNGGRLLALSREWNTISVLAKLLHNRLDGDELQEEKKNLVGRMEDVAAEKDEPSKKESESRLEEFELQAARDREVNRELEEELLIFKKEGFNKAVRQVGFFAKELSLGLFNPFKDVKDDVLLDEDDIVVKEEAVVRSRDLKLSLRACSRMTLLGPSRMILAPTSFYVGRTVHIEAPPV

SEQ ID NO: 182385 - protein, 169 aa, Glycine max
  Coding DNA Sequence Number=SeqID_65607
  Gene Ontology: Mol. function=protein binding; Cellular component =integral to membrane; Biological process=defense response to fungus
  Homolog annotation: Hit_ID=Q1SWI6; Match level="QueryCoverage=81%, HitCoverage=61%, E-value=2e-33, Identity=53%"; Hit description =Leucine-rich repeat, plant specific
  Pfam annotation: Domain name=LRRNT_2; Domain location=26-66; Score =49.5; E_value=1.2e-11; Accession=PF08263.3; Description=Leucine rich repeat N-terminal domain
  Pfam annotation: Domain name=LRR_1; Domain location=117-142; Score =10.8; E_value=2.7; Accession=PF00560.23; Description=Leucine Rich Repeat
  Pfam annotation: Domain name=LRR_1; Domain location=144-166; Score =14.3; E_value=0.44; Accession=PF00560.23; Description=Leucine Rich Repeat
  Pfam module annotation: Pfam domain module=LRRNT_2::LRR_1::LRR_1; Domain location=26-66::117-142::144-166
MNSSIYILVFVQLWLLSLPCRESVCIPSERETLLKFKNNLIDPSNRLWSWNHNNTNCCHWYGVLCHNVTSHLLQLHLHTSPSAFYHDYDYQYLFDEEAYRRWSFGGEISPCLADLKHLNYLDLSGNRFLGEGMSIPSFLGTMSSLTHLDLSYTGFYGKIPPQIGNLSNL

SEQ ID NO: 182386 - protein, 49 aa, Glycine max
  Coding DNA Sequence Number=SeqID_65608
MCLLGKEEETLGPTKIGENHSKCINLTQCVARKLLAHRILSAIKGRGSL

SEQ ID NO: 182387 - protein, 198 aa, Glycine max
  Coding DNA Sequence Number=SeqID_65609
  Gene Ontology: Mol. function=binding; Cellular component=mitochondrion
  Homolog annotation: Hit_ID=Q94CZ7; Match level="QueryCoverage=93%, HitCoverage=42%, E-value=2e-16, Identity=28%"; Hit description =Putative DNA-binding protein
MMLKMLEKQVKPKQRDAYHCLLGLYAGTGNLGEVHRVWNSLKSVSPVTNFSYLVMLSTLRRLNDIEGAHLNQNKLEEAESVFEEASRRSKGPFFRVREEFMKFFLKKHQLDAAVRYLEAALSEVKGGKWRPSPQVLGAFLKYYEEETDVDGVDELSKILKANNFDDSWIKNHITASELSPEIDPGFKEDSRVYHAQEN

SEQ ID NO: 182388 - protein, 318 aa, Glycine max
  Coding DNA Sequence Number=SeqID_65610
  Gene Ontology: Mol. function=NADH dehydrogenase (ubiquinone) activity; Cellular component=integral to membrane; Biological process=ATP synthesis coupled electron transport
  Homolog annotation: Hit_ID=Q1GZM1; Match level="QueryCoverage=46%, HitCoverage=29%, E-value=1e-66, Identity=83%"; Hit description =Proton-translocating NADH-quinone oxidoreductase, chain M
MVFGDFFRNVIFVNPEAHPAMEHLAHHYHEFMHSPAGMAIHGFSSLPFILAASGVLLSWFFYMKRPDIPAAIKARFIVIYNILDNKYGFDSFNEKFFAGGSRCLGNLLWKFGDITLIDGAMVNGTANTMGKIAAKLRNLQSGLIYHYAFAMIIGSGRLATGTLRCAGIGARGFLVTVPLYTQFDVQDGFFQFEELLPWVPAFNMHYHLGIDGFSMPLVLLTSFTTVIVVLAGWEVITKHVAQYMAAFLIMSGIMIGVFTALDAILYYVFWEAMLIPMFLVIGIWGGPNRVYATIKFFLYTLLGSLLMLVAFIYLYHQT

SEQ ID NO: 182389 - protein, 44 aa, Glycine max
  Coding DNA Sequence Number=SeqID_65611
  Gene Ontology: Mol. function=NADH dehydrogenase (ubiquinone) activity; Biological process=ATP synthesis coupled electron transport
  Homolog annotation: Hit_ID=Q1GZM0; Match level="QueryCoverage=99%, HitCoverage=12%, E-value=6e-12, Identity=93%"; Hit description =Proton-translocating NADH-quinone oxidoreductase, chain L
MKELPAAPAAESPPSLEIQAEGIEGGDKHADNHGKIGKAATRNM

SEQ ID NO: 182390 - protein, 179 aa, Glycine max
  Coding DNA Sequence Number=SeqID_65612
  Homolog annotation: Hit_ID=Q6CQF2; Match level="QueryCoverage=41%, HitCoverage=92%, E-value=1e-09, Identity=60%"; Hit description =Kluyveromyces lactis strain NRRL Y-1140 chromosome D of strain NRRL Y- 1140 of Kluyveromyces lactis
ICTDDRSARARALGFAATAAPSYSSGLGPCPDGRNSPAGSSYPEGNFGGNQLLDGSISLSPLYPSQTNDLHVSIAAGLHQSFLWLRPAQHSSPSFGPDRYALTRTLHRRSGSVGGATHRRIPPISFLAPYGFTRPLTRTHVRLLGPCFKTGRMGSPQADARSAQVPRHAKGARCHPQSR

SEQ ID NO: 182391 - protein, 61 aa, Glycine max
  Coding DNA Sequence Number=SeqID_65613
MNRKLGYGAQLRANLDPTKGVGRLRQQDGGHGSRNPLRRRGGRCKTQGASPGGAVVGADLG

SEQ ID NO: 182392 - protein, 148 aa, Glycine max
  Coding DNA Sequence Number=SeqID_65614
  Gene Ontology: Mol. function=chitin binding; Cellular component =extracellular region; Biological process=chitin metabolic process
  Homolog annotation: Hit_ID=Q2N2B2; Match level="QueryCoverage=87%, HitCoverage=48%, E-value=5e-17, Identity=37%"; Hit description=RPGR ORF15 isoform
MPLRSRIASLTFRGLHALAFKGLDILAFRGLHVLAIRGLHVLTFRGLHVLAIRGLHVLTFKGLHALTFRGLHIHTFRGLRVLTFRGLHILAIRGLHVLAIRGLHALTLRGLHVLAIRGLHALTFRELRVLTFSRLHIHSLREFKVLCP

SEQ ID NO: 182393 - protein, 74 aa, Glycine max
  Coding DNA Sequence Number=SeqID_65615
MFECGSRMLPKMNEMAPKKLSAKRSRRDVAAEGISASPEFDSHCFRSAEHQQRFEAIKGWSFHKERRVQLREDE

SEQ ID NO: 182394 - protein, 273 aa, Glycine max
  Coding DNA Sequence Number=SeqID_65616
  Gene Ontology: Mol. function=recombinase activity; Biological process= DNA recombination
  Homolog annotation: Hit_ID=Q1XW88; Match level="QueryCoverage=99%, HitCoverage=52%, E-value=1e-79, Identity=54%"; Hit description =Resolvase-like:Recombinase
  Pfam annotation: Domain name=Recombinase; Domain location=177-266; Score=18.8; E_value=0.00059; Accession=PF07508.4; Description =Recombinase
  Pfam annotation: Domain name=Resolvase; Domain location=4-153; Score =126.0; E_value=1.1e-34; Accession=PF00239.11; Description=Resolvase, N terminal domain
  Pfam module annotation: Pfam domain module=Recombinase::Resolvase; Domain location=177-266::4-153
MKKADLYIRVSTDEQADKGYSQRDQEERLKRYCENNNIKVGQIIYEDYSAKTFIRPEWIKLLDMLKKKSSKTDLLLFTKWDRFSRNAGDAYQMINILRKINVEPQAIEQPLDLSIPENKMMLAIYLAAPEVENDRRALNTYYGMRRAKKEGRLMGRAPYGYANRITENGEKYVIPKEPEASNMKWAFNEMSKGVYSASQIMDMMNRKEGKSVKISAFLASLRNTAYCGKIYVEQFNEEEAHFVKSIHEPLISEELFEKVQCIMDGNVNPARPN

SEQ ID NO: 182395 - protein, 270 aa, Glycine max
  Coding DNA Sequence Number=SeqID_65617
  Homolog annotation: Hit_ID=Q9F6T2; Match level="QueryCoverage=47%, HitCoverage=78%, E-value=2e-26, Identity=46%"; Hit description=TraQ
MGSKIFAQQMIPKQIGVEFTYSVFPKSPEKQNYVFSTGLVSYSKNGNYFFGLTEFSRKYYKYTSCDIPIDTFLLSGGYSFYLWGDFMRNVNLNLGIGGLVGYEQVNRGNELLYDGSMLTATNNFIYGANAKIQLKCFLLLFVIGLFLQSCEKDDLEIQQNYPFKVSVMPVLKDIAKDEYVEIRIKIIPEGNFADTKYYLRYFQFEGTGKLQYYNTQPYFPNDIYPLYEKEFRLYYTSTSEVSQSFTVWLSDSFGNEEKIEFQFNNKKLNG

SEQ ID NO: 182396 - protein, 349 aa, Glycine max
  Coding DNA Sequence Number=SeqID_65618
  Gene Ontology: Mol. function=6-phosphofructokinase activity; Cellular component=6-phosphofructokinase complex; Biological process=glycolysis
  Homolog annotation: Hit_ID=Q1S171; Match level="QueryCoverage=97%, HitCoverage=66%, E-value=1e-150, Identity=78%"; Hit description =Phosphofructokinase
  Pfam annotation: Domain name=PFK; Domain location=4-236; Score=-42.2; E_value=2.4e-10; Accession=PF00365.10; Description=Phosphofructokinase
MLCVIYGVTDSNELNVSQEGYSGFYSRNTIPLTPKVVNDIHKRGGTILGTSQGEGGNDTLKIVDSIQHRGINQVYILGGDGTQRGASVIFEEIRKRGLKVSVVGIPESVDNDIPVIDKSFGFDTAVEEAQRAINAAHVEAESTENGIGIVKLMGRHSGFISMYATLASRDVDCCLIPESPFYLDGPGGLFEFIRKRLAENGHMVIVIAEGAGHELISESLSATNKQDASGNKLFLDVGLWLSQKIKDHFTKSRKMDITLKYIDPTYMIRAVPSIASDNVYCTLLAQSAVHGAMAGYTGFAAGAVNGKHAYIPFYRINEIEKKVVITDRMWARLLSSTNQPSFLKPLSSH

SEQ ID NO: 182397 - protein, 393 aa, Glycine max
  Coding DNA Sequence Number=SeqID_65619
  Gene Ontology: Mol. function=hydrolase activity, acting on ester bonds; Cellular component=cellulose and pectin-containing cell wall; Biological process=lipid metabolic process
  Homolog annotation: Hit_ID=Q1SAY6; Match level="QueryCoverage=84%, HitCoverage=93%, E-value=1e-165, Identity=83%"; Hit description =Lipolytic enzyme, G-D-S-L
  Pfam annotation: Domain name=Lipase_GDSL; Domain location=71-384; Score=194.4; E_value=2.7e-55; Accession=PF00657.12; Description=GDSL- like LipaseAcylhydrolase
MAVPNSHPPPSIGVIFGCHISSHFLLHSMHIQRNKNIIKMINIIGALVLLFAFLFLSCVYAQDTTTLVPAIITFGDSAVDVGNNDYLPTLFKADYPPYGRDFVNHQPTGRFCNGKLATDFTADTLGFKTYAPAYLSPHASGKNLLIGANFASAASGYDENAATLNHAIPLSQQLSYFKEYQGKLAKVAGSKKAASIIKDALYVLSAGSSDFVQNYYVNPWINKVYTPDQYSSYLIGSFSSFVKDLYGLGGRRLGVTSLPPLGCLPAARTIFGFHENGCVSRINTDAQGFNKKLNSAATSLQKQLPGLKIAVFDIYKPLYDLVQSPSKSGFVEANRGCCGTGTVETTSLLCNPKSPGTCSNATQYVFWDSVHPSQAANQVLADALILQGISLVT

SEQ ID NO: 182398 - protein, 639 aa, Glycine max
  Coding DNA Sequence Number=SeqID_65620
  Homolog annotation: Hit_ID=Q1SAY7; Match level="QueryCoverage=99%, HitCoverage=99%, E-value=1e-157, Identity=51%"; Hit description =Actin-binding, actinin-type
MERIVRRFFNVVTREEKGMKPLLQKCGLALALTFAGFLYSHIRTNATSSREQHPSGHGKDDNFGRGKRVASSSCSTVSEENVLDNEETCIGKVIRKNSPSGPSPRTRQSGEKDEFLLLEFNDLTKEADFGANISGSSFKELDYPKKKKEVETPRSKLGSPMAYANLDKDDCEIEIRKLRSMIIMLQERETNLEVQLLEYCGIKEQEAAVMELQNRLKISNMETKMFNLKVETLQSENRRLEAQVVDHAKLMTELETTKTKVKFLKKKLKYEAEQNREHIMNLKQKVAKLQDNEYNASANDQEIQIKLKRLKDLECEAEQLRKSNLRLQLDNSDLVRRLDSTQILANAVLEDPEAHALKEEGERLRRENEGLTKELEQLHADRCLDLEELVYLRWINACLRHELRSYQPPPGKTVARDLSKSLSPTSEKKAKQLILEYASNEGRGSVSDMDSDQWSSSQASFLTDPGEREDYFPLDNSSELKATNNTSKSRIFGKLMRLIRGKESQNQRDRATSKEKSMSREDSNTNSPHFSLSISTGTEGLRSENATPSATSRTSFDFNQTMSMKEESSRNSDSHTPGSSKNLSPRRTRSVDFKNHLRSFSESSGSEKSNLVKYAEAIKDSSGTLKQRTHRRSASISSF

SEQ ID NO: 182399 - protein, 401 aa, Glycine max
  Coding DNA Sequence Number=SeqID_65621
  Gene Ontology: Mol. function=nucleoside-triphosphatase activity; Cellular component=membrane; Biological process=proteolysis
  Homolog annotation: Hit_ID=Q0WVW9; Match level="QueryCoverage=95%, HitCoverage=63%, E-value=1e-128, Identity=60%"; Hit description=DNA repair protein-like
MANFVYNSGFEGSLTLIGGDPGVGKSTLLLQIAAIIAKGDSDGEACPVVYVSGEESVEQIGNRADRLRIESDIYLYSSNDVEDILKKVQYLSPGALIVDSIQTVYLKGIMGSPGGIMQIGHVTKSGDIAGPRVLEHIVDVVLYMEVVGKADLCLLLYFLLLVMFLGFLFPFRYGEKYSSHRMLRAVKNRFGSADENCGMLGVFEMSHSGLQAVSNASEMFLSEQLLDSEILAGLAVAVIMDGSRTFLIEIQALCLSGSTGSRQVNGIQQKRADMIISVLIKQAGLRLQEHAVFLNVVSGLALTETAGDLAIAAAICSSCLEIPIPNDIAFIGEIGLGGELRMVPRMEKRVYTVAKLGYRMCIVPKVAEKALGTEGLEKMEVVGCRNLKEVINTVFLNIMRR

SEQ ID NO: 182400 - protein, 102 aa, Glycine max
  Coding DNA Sequence Number=SeqID_65622
MVILVVEHDDSEGIARWHWGVCIDFNIEVMVLYHFYGKKISYPTVMTWDTYPKGGSHVSNMSIFSVQSKKLVILNRVLVFSIVINLDGDECWIEHLPLGQKL

SEQ ID NO: 182401 - protein, 428 aa, Glycine max
  Coding DNA Sequence Number=SeqID_65623
  Gene Ontology: Mol. function=hydrolase activity, acting on glycosyl bonds; Cellular component=amyloplast; Biological process =carbohydrate metabolic process
  Homolog annotation: Hit_ID=Q944B5; Match level="QueryCoverage=99%, HitCoverage=100%, E-value=0.0, Identity=87%"; Hit description =Dehiscence-related endopolygalaturonase
  Pfam annotation: Domain name=Glyco_hydro_28; Domain location=89-428; Score=518.3; E_value=8.7e-153; Accession=PF00295.8; Description =Glycosyl hydrolases family 28
MALQRHHLSLLFIMFSFVACHSTVLFDDGSTFKDFIKQKSTDVLSLKKFVKLGDISSSLKTVNVNDYGARGDGKTDDTQAFNDAWEVACSSGGAVLLVPENNYLLKPFRFSGPCRSNIEVQISGTIEASENLSDYSEDLTHWLTFDSVEKLSVKGGGTIHGNGNIWWQNSCKVNEKLPCKDAPTALTFYKCNDLTVEDLTIKNGQKMQVSFQDSENVKVSGLTVTAPGDSPNTDGIHVTNTQNIQISSSVIGTGDDCISIVSGSKDVLATDIICGPGHGISIGSLGAGGSKDFVSGITVKGAMLSGTTNGLRIKTWQGGSGSASNIQFQNIQMDNVTNPIIIDQNYCDQETPCEEQKSAVQIRNVMYQNIKGTSASDVGVQFDCSNNFPCQGIVLQNIDLQLEGGGGAKASCNSVELSYRGDVIPLCP

SEQ ID NO: 182402 - protein, 107 aa, Glycine max
  Coding DNA Sequence Number=SeqID_65624
MALEMIHGHNSTAPGLYFSSSHFPSTFLLYFLQFQNPLNPSLAWLFIGKGHLVQGKPPRLAGARPGELTLDAILPRKGPVTRAMSRRLQEDWTRATEEGPRVLMNLR

SEQ ID NO: 182403 - protein, 109 aa, Glycine max
  Coding DNA Sequence Number=SeqID_65625
  Homolog annotation: Hit_ID=Q1RWP6; Match level="QueryCoverage=90%, HitCoverage=7%, E-value=1e-07, Identity=35%"; Hit description=Zinc finger, CCHC-type; Polynucleotidyl transferase, Ribonuclease H fold
MSATSASAWDRLKKYYASRSHTPIMSLKESLDSITKGTLSVTEHLLSIFLLADELSLIGHLVDDLDLLIIGLKGLGPAFHEFSASIRECDSPLFAELFNKLFDRDFSPT

SEQ ID NO: 182404 - protein, 178 aa, Glycine max
  Coding DNA Sequence Number=SeqID_65626
  Gene Ontology: Mol. function=protein serine/threonine kinase activity; Cellular component=membrane; Biological process=protein amino acid phosphorylation
  Homolog annotation: Hit_ID=Q1SH43; Match level="QueryCoverage=58%, HitCoverage=62%, E-value=6e-25, Identity=55%"; Hit description =Protein kinase
MSPKISDFGLARAFENGKRPGKYKTINGHFAWNMWCAGKCFELMDPLEKSFMANEVVKSLHIGLLCVQQDAIVRPTISTVVLMLGSDTISLPKPNHPAFSVGTMNSNNEEFSFRSSKNISINNESRQCGTKNIAFHSLSNIYIKGEQRSFPEPPHVPDLVNIEKRRNIMEKKKEAKVP

SEQ ID NO: 182405 - protein, 678 aa, Glycine max
  Coding DNA Sequence Number=SeqID_65627
  Gene Ontology: Mol. function=protein serine/threonine kinase activity; Cellular component=membrane; Biological process=protein amino acid phosphorylation
  Homolog annotation: Hit_ID=Q1S5I7; Match level="QueryCoverage=85%, HitCoverage=98%, E-value=1e-168, Identity=52%"; Hit description =Protein kinase
  Pfam annotation: Domain name=DUF26; Domain location=201-253; Score =15.3; E_value=7.3e-05; Accession=PF01657.8; Description=Domain of unknown function DUF26
  Pfam annotation: Domain name=DUF26; Domain location=90-144; Score =56.9; E_value=6.7e-14; Accession=PF01657.8; Description=Domain of unknown function DUF26
  Pfam annotation: Domain name=Pkinase; Domain location=304-545; Score =106.9; E_value=5.9e-29; Accession=PF00069.15; Description=Protein kinase domain
  Pfam annotation: Domain name=Pkinase_Tyr; Domain location=304-545; Score=74.4; E_value=3.7e-19; Accession=PF07714.7; Description =Protein tyrosine kinase
  Pfam module annotation: Pfam domain module=DUF26::DUF26::Pkinase::Pkin ase_Tyr; Domain location=201-253::90-144::304-545::304-545
  Subcellular localization annotation: CTP_CleavageSite=66; ConfidenceScore=5.19e-01
MEGKLLHVSTYSFVFLLFLSFKQHVVTKAQSPNYVGADCQNTTQQKALSSAYQTNLNSLLSWLSTDAATSKGYNHNSFGNNTPGGDDSAVYGLYNCRGDVVGYFCQFCVSTASREVLQRCPNRVSAIVLYDFCILRYSNENFFGNVTVYPSWHAVQSKNVSSKEEIQKGLDFMRGLIRKATVETNLLYYMDGFNLSSTQKRYGLVQCSRDLTSDGCRECLEAMLAQVPKCCEQNLGWQVLAASCLINVYCFWFRKRSRRGRGKDGRIPDTIDQSSYHNVQTEETLNVDLPTIPLITILKSTDNFSEASKLGEGGFGPVYKGTLPDGRQIAVKRLSQASGQGSEEFKNEVMFIAKLQHCNLDKKAISREMKGILISSVFILSDERKKRQLDWNLRLSIINGIAKGLLYLHEDSRLKVIHRDLKASNILLDDEMNPKISDFGLARAFEKGQNQANTNRVMGTYGYMSPEYAMEGLFSVKSDVFSYGVLVLEIICGKKNSGKSLELMDPVLEKSCIESEVMKCIHIGLLCVQEDAADRPTMSTVVVMLASDKMSLPEPNQPAFSVGRMTLEGASTSKSSKNLSINDVTVTNILPRSNGPNHLIKMGHIMMLTDLYQFPSLLHMPFATAINTGSHKPKQQIEAKDFFVALANAASSFFLRRGEVRVEGLESQHLNFRILVLK

SEQ ID NO: 182406 - protein, 642 aa, Glycine max
  Coding DNA Sequence Number=SeqID_65628
  Homolog annotation: Hit_ID=Q1SNK3; Match level="QueryCoverage=97%, HitCoverage=98%, E-value=0.0, Identity=58%"; Hit description=Calcium- binding EF-hand; UBA-like
  Pfam annotation: Domain name=UBA; Domain location=166-205; Score =39.7; E_value=1e-08; Accession=PF00627.21; Description=UBATS-N domain
  Subcellular localization annotation: CTP_CleavageSite=41; ConfidenceScore=5.68e-01
MSPSVKSKSKSQEKAPARAGQEQHKTSPKTSKSPTHGSGTPASARNPMSATFQTPETSLVASSTLVHDNSQFPKLDDADEHSSSPQGTVSECDSVSNSGSCSGESEESKEKVTATSSSTRPDSIPGCDNDRREKIRLKNERKHQRQRERRAQELHDRCCGYLMSRKLESLAQQLVAMGFSSERATLALMLNDGKLEQSVSWLFEGSEEYSQPKDTTSLVSEGDMKIDISDELAQISALEVKYNCSKQEVERVVVACEGDLQKAENTLKTQKQESPTTQLKSEDSAQNNNSLVRSQGLPAASVSMQYRGNESDFNHYNKVGGSDSMFLDVETGNVHSLQLNHPNITTEKRWSGVPGSIPSAMFGMAPSMQAMSPFAKMEGGRSIAHTNEGRMIQQGPGREPVMMQHPQFTNAKQNSMMSLNSFPSGAAGWHVNSIPGADNVRPNGKLLQTQSIRSVSPNHLEQFGQTPYKEYSHFLGPADYSSAGVGGYCKPMGASSSPPPTIPPWHQGSWSTSTPSPSLTVPTSLGLFSGHQNAARTFSSHSHMDWNAGGFMPEFDYTSIDWSLNAPSSSVSGGLRLGISSVLRNSYGDRRGSQCVSGLQMARETSSSGGLREWTTPFAGKDIFSVPRQGLVLEKKCLNGCL

SEQ ID NO: 182407 - protein, 328 aa, Glycine max
  Coding DNA Sequence Number=SeqID_65629
  Gene Ontology: Mol. function=protein serine/threonine kinase activity; Cellular component=mitochondrion; Biological process =protein amino acid phosphorylation
  Homolog annotation: Hit_ID=Q1SH45; Match level="QueryCoverage=99%, HitCoverage=71%, E-value=8e-98, Identity=58%"; Hit description =Protein kinase
  Pfam annotation: Domain name=DUF26; Domain location=29-83; Score =28.6; E_value=1.5e-06; Accession=PF01657.8; Description=Domain of unknown function DUF26
  Pfam annotation: Domain name=Pkinase; Domain location=173-326; Score=- 33.5; E_value=1.4e-06; Accession=PF00069.15; Description=Protein kinase domain
  Pfam annotation: Domain name=Pkinase_Tyr; Domain location=173-326; Score=-85.1; E_value=3e-07; Accession=PF07714.7; Description=Protein tyrosine kinase
  Pfam module annotation: Pfam domain module=DUF26::Pkinase::Pkinase _Tyr; Domain location=29-83::173-326::173-326
MEGLITKATIETKQFWAVEEFDWGDNETLYGWVQCDRDLPSDECRKCLNAMLEIFPQCCGTKVQWAVFAPTCGMRMDDEKFYQKSETKVTTLHSFGDQLEYSPNFDDNGTSTSRKLIISFSVLGSVALLCFSVYCFLYRKRVRKDEMMLDEETLNGDLPTIPLITILNSTNNFSKASKLGEGGFGPVYKGILPDGRQIAVKRLSQFSGQGSEEFRNEVMFIAKLQHRNLVEALLVGAIGFKVVRWNLIRYDEKKKQLDWKLRLRIIHGIARGILYLHEDSRLRVIHRDLKPSNVLLDDEMNAKISDFGLARAFEIGQNQANTKRVMGT

SEQ ID NO: 182408 - protein, 188 aa, Glycine max
  Coding DNA Sequence Number=SeqID_65630
  Homolog annotation: Hit_ID=Q1S909; Match level="QueryCoverage=96%, HitCoverage=31%, E-value=5e-35, Identity=60%"; Hit description=MATH domain, putative
MAGISGEESGVGKSAEGTFSGQRCQSGEALAEWRSSEQVENGTPSTSPPYWDIDDDDDGPKPSELYGRYTWKIENFSQITKRELRSSAFEVGSYKCFCTFWREIDQTSRRRMSREKTDALEGQNKCKKGRVKLLDAEEMPAPIVGAEKDMFVLVDDVLLLLERAAKEPLPPKDEKGPQNRTKVRKIMC

SEQ ID NO: 182409 - protein, 577 aa, Glycine max
  Coding DNA Sequence Number=SeqID_65631
  Homolog annotation: Hit_ID=Q8H6Q7; Match level="QueryCoverage=99%, HitCoverage=52%, E-value=7e-17, Identity=24%"; Hit description=CTV.22
VQRMNSAYFPTVNTIYQQMNRKLQQLESSPQEPNTVERMRFNMKLLEQILAILRVNKWQITTEFKENLDKAEKFIQSKFFSKNVSSHHQGQQRSADVQSRQQSGPSHSSISPLMILEMKPSPQALGSQNYHPMKDVSQQNKMCLQEKQAAKQYGGSQQSGPSHSSISPVKTLEMRPSPQALGTQNYHMMKDVSQQNKMCLQEKQVTIKYRNLQQDVNQLSIIKGTSINSLSAVYIFVYTTFSMLSMPEVTRKHFYNLSISGAGNTVQQQTQGTQKATEAFSVSVNSQGISASPLIENCNNLKEISRKPTLTSDEPSAAMQYFLKVLTSISPEALSASLGEIREVVYLNDAIPSPELMHGPPEMVQQQMQPCLISQTGINLASDIEPCSQARYITCNDFVPTGRKRSCSMNSMTAFDTSSTCASSCDSNQLTDTEKPDLTLVTSKHPRIVEKCSLLEEIKEINNLLIDSEIVIGEKDSIQSAAGGAAEDGEGLVIKFLFNAVTFNQNLISHLSADKKSIIKPLWLLVPASYPFCPPVVLDKMPLEVRYSSPLDNEIVKYSFSIHYIELKKSMILEPVF

SEQ ID NO: 182410 - protein, 237 aa, Glycine max
  Coding DNA Sequence Number=SeqID_65632
  Gene Ontology: Mol. function=zinc ion binding
  Homolog annotation: Hit_ID=Q1S0W0; Match level="QueryCoverage=91%, HitCoverage=19%, E-value=4e-67, Identity=65%"; Hit description=PHD -finger, putative
MMKFSGAILKAFEYSTAGHVKEQISGSAAVPEKRQSESSFPIQSQTQKDYNAIHSRQLDNFSTNDISSLSSKKLKVKKKGGDGISLAPDSAELQGTYIERFREFLEDLCNNAEFHSDDRDEAEWLPLPLTDLRLLVNEITSIREKKLLHLVPVEVLVRLLKVLDHQIHRAEGLSIEECDNSDSELVSSVLIALESIHAALAVMAHTDMPKQLYNEELMMYYNFSEVTMGMAEFTDNI

SEQ ID NO: 182411 - protein, 142 aa, Glycine max
  Coding DNA Sequence Number=SeqID_65633
MSQIPTIYVLPLKKTYPSAQRLLAMQRYMGGSLYATLPCICKEVVSGFESMTYGGGRAAQRVEGVIKQSGLPLARLNGLVQFLERFEAKVNAAAKNEVEYLKSLSEKVKEISSQLKTAESKPRPSNSTGSVEVCSAQGIEMG

SEQ ID NO: 182412 - protein, 49 aa, Glycine max
  Coding DNA Sequence Number=SeqID_65634
MNYGQGIPRLVLVGMINGIGNCHVKNDEGNGLIRRKGNEIERQEIIPSH

SEQ ID NO: 182413 - protein, 91 aa, Glycine max
  Coding DNA Sequence Number=SeqID_65635
MVYTEMLNLTQQGNGYRASSSWQQIRVLKAEELGESKEAEEGDPESKIESFEQKERPYHQQDEIEETHFRSKGHSLSLRFIQRNMPQWRVC

SEQ ID NO: 182414 - protein, 83 aa, Glycine max
  Coding DNA Sequence Number=SeqID_65636
MAAERASCSHPSEVLGFRYLPCRTLCDLPYATTNLCSSICIVNGGVNDGSGPWVFIGPAFSFFLSVGPWASSATFLCYIFLQG

SEQ ID NO: 182415 - protein, 295 aa, Glycine max
  Coding DNA Sequence Number=SeqID_65637
  Gene Ontology: Mol. function=transition metal ion binding; Cellular component=cytoskeleton; Biological process=actin cytoskeleton organization and biogenesis
  Homolog annotation: Hit_ID=Q6AVJ1; Match level="QueryCoverage=98%, HitCoverage=26%, E-value=1e-69, Identity=51%"; Hit description =Expressed protein
MVVAEKIKIGVCVMEKKVKCDFEVFSAPMGQIFERLLAFGEFEALNSPTATTCFCGVVFSRASAQLAYVSAEAMERGGMLGSKCKVWDLSLTLGVWDSGVGFIRLWTLQLQCLAFERLEMFGIPVPRYALVIRDAPYQQLDYFIEEEDFVEVHGMRFFKPFVEKPVDGKLVSRVGNRSSEFHPEVRRVRREGSYIYEEFMPTGGTDVKVYTVGPEYAHAEARKSPVVDGVVMRNLDGKEGKAAYNIPPPYLRIAKSLWAMGYEVRYPVLLTPAEKEMARDVCIAFSQAGVRLLVC

SEQ ID NO: 182416 - protein, 65 aa, Glycine max
  Coding DNA Sequence Number=SeqID_65638
  Subcellular localization annotation: CTP_CleavageSite=13; ConfidenceScore=5.01e-01
MLTTQSSPSFCPRSALNLKTDNNSTTDRSIPEFFLLENDATVHGAEFSPLPSVMLLLQCNVQIFL

SEQ ID NO: 182417 - protein, 148 aa, Glycine max
  Coding DNA Sequence Number=SeqID_65639
  Homolog annotation: Hit_ID=Q8H6Q8; Match level="QueryCoverage=63%, HitCoverage=3%, E-value=3e-09, Identity=36%"; Hit description=CTV.20
MVQQDPTPKPSNNYVSKNKFYNVLQMEPEYWDKNPFKATAKTFPPGFHYRPTALNKTIKFYEFILVDTNSVSIKHFKDPKDPNLNTHSTIQILKLAAFLAGSKSKEILAKNLKEVLHLLQQEEEEEKPSKKEIESSDEIDDQDDDPFY

SEQ ID NO: 182418 - protein, 54 aa, Glycine max
  Coding DNA Sequence Number=SeqID_65640
MAIQPVVPIMRQIDEGRWKTSPLNRIQTGDQLWKMKIISDEDKLACPFYKGLGW

SEQ ID NO: 182419 - protein, 75 aa, Glycine max
  Coding DNA Sequence Number=SeqID_65641
MHRSQGYLRETTKERIESLFLYRIVEVDSKDSALIKMFLYMRQATMACGGHRWSWVVEKYANLAEQIFSSGWNFA

SEQ ID NO: 182420 - protein, 285 aa, Glycine max
  Coding DNA Sequence Number=SeqID_65642
  Homolog annotation: Hit_ID=Q1SYP9; Match level="QueryCoverage=35%, HitCoverage=10%, E-value=1e-11, Identity=38%"; Hit description=Myb, DNA-binding
MTTTNIMQIENFRKVGIRPPHMFSDFTNNFGFPNRLHNKLACSSATSCGEGLKKDQGGLEVWNIEQYNRALIGKWWWRVLCEKDLLWVKVLEAKYRSLKVPSVDLHVQGQSQWWKGALALSEEGVEPSWFQMNLACALGDKAMFSFWDDGWSREDATPPHGDQPGSQGSSKPSDMPPRISNLVTAPPSTYITYIIIMTLSTLTTPHLNVTINFNTISSGCHYEHQHHPITMSFSTSTSSHPNGTININTISSECHYEHQHHPISMSFSTSTSSHPNSTINIISSQ

SEQ ID NO: 182421 - protein, 595 aa, Glycine max
  Coding DNA Sequence Number=SeqID_65643
  Gene Ontology: Mol. function=microtubule binding; Cellular component =phragmoplast; Biological process=positive regulation of microtubule polymerization
  Homolog annotation: Hit_ID=Q1S5M9; Match level="QueryCoverage=99%, HitCoverage=100%, E-value=0.0, Identity=68%"; Hit description =MAP65/ASE1; t-snare
  Pfam annotation: Domain name=MAP65_ASE1; Domain location=35-591; Score=8.1; E_value=2.3e-08; Accession=PF03999.3; Description =Microtubule associated protein (MAP65ASE1 family)
MAATPPSFSPSRTTCASLLRELQMIWDEIGESDNDRDNTLLQLEQECLDIYHRRVEETRKHKADLYQWLAEAEAEVANIVSSLGECTILPRKDFVILTLNNGYTGGIDIQAGIDMPACIGKGTLKQQIATIRPVIEDLRSKKDDRIKEFSKIKSQISQICAEIAGCGQYNSVTDSDNQSDLTTKKLRELKSHLQELQNEKILRQQKVKSHISTISELTVVMSMDFRETLNEIHPSLGDSSKGTLQSISNDTLARLTGVIHSLKREKQKRLQKIQELAKLLVELWELMETPIEDQQAFSHVTRLISASVDEVSTECCLSAEVIEQVEVEVQRLNVVKASKMKDLVFKRQNELEEIYRGVHMDVDSEAARQILTSLIESGNIDLSDLLQSMDDQIRQAKEQALSRRDILDRVEKWKFAAEEEKWLDEYERDENRYSAVRGAHKNLKRAEKARILVSKLPSIVENLTAKVKAWEMEKGIPFLYEKVPLLHNLDEYIVQRQLREEEKRKYREQKRLQEQHAVEQEALFGSRSATKKPLGQSTHANTILGTPTGRRMLSTPSGRHGNSGGKDRRESGRVNSIIPVNYVALPKDDSVSRGN

SEQ ID NO: 182422 - protein, 180 aa, Glycine max
  Coding DNA Sequence Number=SeqID_65644
  Gene Ontology: Mol. function=sequence-specific DNA binding; Cellular component=intracellular
  Homolog annotation: Hit_ID=Q1SNM1; Match level="QueryCoverage=78%, HitCoverage=52%, E-value=5e-26, Identity=43%"; Hit description =Histone-fold/TFIID-TAF/NF-Y
MDLRLRKKHILVSASVTVAFSIHELGHTGSTGRGRGRGRGRGRGRGRPPLNREIYHQDAESEPCTSVQPSNPQNTNTSVAMDSGSESKEIPKEQNIAVPVESTDSLRNIDLNAITNENDDKKASAAADASVPEPPTESKHEEIPGWSLSDVDKMAIDSLQLAQLGRPLEEDEEDYDEEEG

SEQ ID NO: 182423 - protein, 223 aa, Glycine max
  Coding DNA Sequence Number=SeqID_65645
MRVHIPCLDKTVRREMIEPIVSRNERHNEKTENQQINTKQQGVAAGGNDRNYAQAMRRDEVYIVGGMGEVKLKYLGDDMVLLNGIKKEEVTQGTRVEDQEWSRNFKWGRAQDLQCLVLIEMMLIKRLKEKEKECSKGGPGRGILCGRSRGAISKDVKNGLGFKHDTMVTISKNSEGGPNYRLNNGCKGGDFVIEGPNGGCVTPLAKRETRGNSQNLITNADST

SEQ ID NO: 182424 - protein, 120 aa, Glycine max
  Coding DNA Sequence Number=SeqID_65646
  Homolog annotation: Hit_ID=Q1S909; Match level="QueryCoverage=81%, HitCoverage=11%, E-value=6e-21, Identity=47%"; Hit description=MATH domain, putative
MVVYFCNDLSIFVLLIMTNFFQKQNNRKEKDKDREERPTVVVHDKQQDIAANEKKDSKMEEDSVDGITKVIQLDSEDRDKFILQLCRSNAIGSISSVRKGMAEKRSSSVMDDSPSACSTD

SEQ ID NO: 182425 - protein, 72 aa, Glycine max
  Coding DNA Sequence Number=SeqID_65647
MAPSRLEEVQGEAHHEDPNSPRLRSDYSASREQHHQAEICLTCHFRTCYINNICSRIGYLTIHFSCPTACIT

SEQ ID NO: 182426 - protein, 96 aa, Glycine max
  Coding DNA Sequence Number=SeqID_65648
MKGGLEEATFGMGFTCGLCWLSLLVVVVVLVQGVDGDCRPNIVCVKNFKQLKIWNFKFILKSEKLKFFFYRLLQETPSETVEYRSDLRTSSSRNTV

SEQ ID NO: 182427 - protein, 140 aa, Glycine max
  Coding DNA Sequence Number=SeqID_65649
MRDQDPTDQFHSQRVKLEETTEAMGQGALEGLDIIASCAMDLLVSLGGEVQLLLVIQKLKMKMPLYQSIVRHQKMFSRHEQIEFLEDYYLRMLFSFGRPSSSTALFTLTWSSMLSIFCGEKNILFLSNRKAKAHDIRLKL

SEQ ID NO: 182428 - protein, 178 aa, Glycine max
  Coding DNA Sequence Number=SeqID_65650
MEWARTRVEVVREWGSVVVQNFRAPLQLPPITEDSAFPLNGVQGLWGSIEQPIIDRKVILISSSLSEDTCRERVRVSRRTSGGTSRLHGGAWPSVAAGEPVPITMILPSSAFGGVRSDNGGGDARASPHVQRSQSIGLLSSTLAIAGYEWVMDDFLKYKSSLTSVASVVALQHQAKQA

SEQ ID NO: 182429 - protein, 84 aa, Glycine max
  Coding DNA Sequence Number=SeqID_65651
  Gene Ontology: Mol. function=DNA binding; Cellular component =mitochondrion; Biological process=DNA integration
  Homolog annotation: Hit_ID=Q1S3Z1; Match level="QueryCoverage=97%, HitCoverage=6%, E-value=3e-16, Identity=51%"; Hit description =Integrase, catalytic region; Zinc finger, CCHC-type
  Subcellular localization annotation: CTP_CleavageSite=21; ConfidenceScore=5.11e-01
MEHSKAPNSQNGCSPTWPLFCAQPFKTLSYATSHRRNAHKTEEVSPCDFHVSLTCPEYPDIFHSSGPDANAIENYQMSHWTHGF

SEQ ID NO: 182430 - protein, 257 aa, Glycine max
  Coding DNA Sequence Number=SeqID_65652
  Homolog annotation: Hit_ID=Q1S9T9; Match level="QueryCoverage=23%, HitCoverage=6%, E-value=2e-10, Identity=61%"; Hit description =Peptidase S8 and S53, subtilisin, kexin, sedolisin; Integrase, catalytic region; Zinc finger, CCHC-type
MVARGGHRWSWVVEEEFLGCTIPLGLGFALSATIRTKRNSSCAKRDNSSSAQFPLGLELHLVQFLNDVILKIPTVKWWRDALGTYRCYPTHLHTCFVALVATLDMELEQLNVKTTFLYGRLEEDILTQQLEGSGTGYLMRSLSLMGTSEVLVTHVFIIARNTCFGMASTKLVCTPLTTSILLSELNTTQLELEKEYMSHVPYASVVGSLMYVMDVKHILRYLKDRIDIGLVYYGDTFCALTGYSDSNMLRVWMQRDL

SEQ ID NO: 182431 - protein, 1017 aa, Glycine max
  Coding DNA Sequence Number=SeqID_65653
  Homolog annotation: Hit_ID=Q7XDI4; Match level="QueryCoverage=94%, HitCoverage=96%, E-value=0.0, Identity=48%"; Hit description =Expressed protein
  Pfam annotation: Domain name=DUF810; Domain location=62-1017; Score =1621.6; E_value=0; Accession=PF05664.2; Description=Protein of unknown function (DUF810)
MGQQTRRESYSGPLPSTAHRKDYNYNYCHHRCHHYHRDPRFFEFVSKNETSDLVLPFDKLEKLSQDDIRECAYEIFFTACRSSPGFGSRQAHSFSSWNNEAKSSNVVMSPTSKVKRALGLKMLKRSPSRRMVSGGSRGPSSPVGGSSPFHQTGPPLRPRRPMTSAEIMRQQMRVTEHDDNRLRKTIMRTLVGQAGRRAETIILPLELLRNLKPSEFNDSNEYHMWQKRQLRVLEVGLLTHPSVPIEKATTFAMRLRDIIRSGESKIIDTGKNSDTLRTLSNSVVSLAWRSSNGTPTDVCHWADGFPLNIHLYTSLLQAIFDNRDDTLVLDEVDELLELMKKTWSVLGITRPIHNVCFTWVLFQQYVATGQIEPDLLCATHTMLSEVAIDAKRERESFYVKLLTSVLSSIQGWAEKRLIDYHEHFQRGNIGQIENVLPVVLSVTNILGEDLVISDSGEGGEKGDITIVDSSGDRVDYYIRSTIKNAFEKAIEAVKAKAGELEIKGEFSEFLLHLAQEVEDLAMKERENFTPMLKKWHPAPGAVAAMMLHSCYGHALRQYLGDVTSLTHETVEVLQRAEKVEKVLLQMVVEEDYGEGEDNAKTVMREMVPYEVDSIILNLMRKWINESLSNGKECLLRAKETETWNPKSKSEPYAPSAAELVKLTKTTVEEFFQIPVGITEDIVQELADGLESLFQDYMMFVAACGTKQSYIPSLPPLTRCNRGSKLIKLWKKASPCGANISELDNTNEGHNPRPSTSRGTQRLYVRLNTLHYLLSHIHTLEKSLSHTPGVVPSSNRKHSGPYFEIVNSSIPAACQHVSEVAAYRLIFLDSNSVFYDSLYVGDVANSRIRPALRILKQNITLMTTLVADRAQALAMKEVMKASFDAFLMVLLAGGSSRVFNRSDHVMIQEDFESLNRLFCTCGEGLIAENLVQREAAVVEGVIALMGQYTEQLMEDFSIATCETSGIRVMGNGQKLPMPPTTGRWNRSDPNTILRVLCSRKDRAANHFLKRTFQLAKRR

SEQ ID NO: 182432 - protein, 166 aa, Glycine max
  Coding DNA Sequence Number=SeqID_65654
MEQHHEEELRKLKADHDQLEAHVRRPQGDEQSAHTLYAVRQHHFVDNIMEANIPLGWKPLNLERYDETTNPDKHLGAFPTHVNLYTNDNVILCRVFPTSLKGVSLTWYSGLPPRPIDSFDTIIEQFSVQCSTSRFGHTSIEIQNLNPEVALYSMRKQGLHPDGRNV

SEQ ID NO: 182433 - protein, 82 aa, Glycine max
  Coding DNA Sequence Number=SeqID_65655
MDVRELMRGNEVCFIAAPWWTPNVLTQIQNCDTSGRTWLSGVPNFTHRLGSIPLTGGGIYKTKNSDAQGGSPTAKDRASALL

SEQ ID NO: 182434 - protein, 171 aa, Glycine max
  Coding DNA Sequence Number=SeqID_65656
MNFTIRYLLVYTVISYFALIDRKTLNELRAIVSMPNLKMKFPKFTVEIVTVKADQKQAQQCYAESLKVAPYPPIREPAMPYPITAEGTQVMTMDEGPQIQALTVYQAIQGSEVDIDPQDETFNRGPKPIKELVQLQLGPKPGQCMQLCRDFTSQEHWWIANLLCRNADLFA

SEQ ID NO: 182435 - protein, 100 aa, Glycine max
  Coding DNA Sequence Number=SeqID_65657
METMALSSLSVFLSIKAKYDMTSLEGFPVQDINGTALVNVDPGHYEVHYDDEDYHGVVLVDEVDALEVPIREGLAGLSSIGKSASDGVDYTSDVKGRFLF

SEQ ID NO: 182436 - protein, 55 aa, Glycine max
  Coding DNA Sequence Number=SeqID_65658
MQGPLSKTLLQKLAYAAVGDKYTIKMPFFFFVYNWSQSTAADRIIVIKYEKAERF

SEQ ID NO: 182437 - protein, 97 aa, Glycine max
  Coding DNA Sequence Number=SeqID_65659
  Subcellular localization annotation: CTP_CleavageSite=50; ConfidenceScore=5.34e-01
MNSLPSVVHVSSTIESGAPRIDCLSLFAYPPSSNLIRRPMNSLPSAVHVSSTNESGAPRIDCLALFANSPFSNLIRRPMNSLPSLVHVPSVIKRGAS

SEQ ID NO: 182438 - protein, 212 aa, Glycine max
  Coding DNA Sequence Number=SeqID_65660
  Gene Ontology: Mol. function=transcription regulator activity; Cellular component=nucleus; Biological process=regulation of transcription
  Homolog annotation: Hit_ID=Q1T454; Match level="QueryCoverage=88%, HitCoverage=76%, E-value=1e-52, Identity=64%"; Hit description=Helix- loop-helix DNA-binding
  Pfam annotation: Domain name=HLH; Domain location=26-73; Score=49.4; E_value=1.2e-11; Accession=PF00010.16; Description=Helix-loop-helix DNA-binding domain
MDGEAVSWYYDSSSPDGTGASSSVASKYIVSERNRRKKLNDRLLALRAVVPNITKMDKASIIKDAIEYIQHLHEQEKRIQAEILDLESRNKFKNPTYEFDQDLPILLRSKKKKTEHLFDSLSSRNSPSIEIIELRVTYMREKTFVVNLTCSKRTDTMVKLCEVFESLKLKVIAANITSFSGTLLKKTAFIEGQLMKIKDLMAVLSDSNQLMR

SEQ ID NO: 182439 - protein, 267 aa, Glycine max
  Coding DNA Sequence Number=SeqID_65661
  Gene Ontology: Mol. function=electron carrier activity; Biological process=electron transport
  Homolog annotation: Hit_ID=Q7N8Q2; Match level="QueryCoverage=54%, HitCoverage=97%, E-value=2e-53, Identity=68%"; Hit description =Similar to unknown protein YqcA of Escherichia coli
  Pfam annotation: Domain name=Flavodoxin_1; Domain location=6-140; Score=100.0; E_value=7.3e-27; Accession=PF00258.15; Description =Flavodoxin
MAKIGIFTGTVYGNALLVAEEAQPVLEAQGHEVKVFEDPSLADWQSYSKEVALIVTSTTGQGDFPDNIARLYVQVRDELGYQPELRYGVIALGDSSYDHFCGAGKTFDATLQEQQAQRIGEVLLVDATENPEPESVTTPWVESWGMKLNGSPEQLPLPPGLRTSRHRCRIEYCQLNQLKQPPADLFNTLFARRDGAGIDVHQIMPAVRQRAARRHLDHRNCRQAVRRAAPGGKHLQRNAGSHLLGATDKIAGRRGGVNQPTLRRALS

SEQ ID NO: 182440 - protein, 129 aa, Glycine max
  Coding DNA Sequence Number=SeqID_65662
MRLGSTRSTWSILVKTNDQIDFVAQTSVVASHEGGGLIVVVASHRGTHSDFSSFGHLGCGEGNIERKKLKKWRRTNCTRESKKVWDDSQVAMGRVFREASKGLFLLSGSYWLSNGLLSLFIFMEGHADV

SEQ ID NO: 182441 - protein, 91 aa, Glycine max
  Coding DNA Sequence Number=SeqID_65663
  Gene Ontology: Mol. function=transmembrane receptor activity; Cellular component=exocyst; Biological process=exocytosis
  Homolog annotation: Hit_ID=UPI000034F2F4; Match level="QueryCoverage =100%, HitCoverage=13%, E-value=1e-38, Identity=85%"; Hit description= protein binding
MQWEVLEAKIGNWIHYMRIAVKLLISGEKKICDQIFDSVDSLKAQCFAEVTASSVAMLLSFGEAIAKSKRSPEKLFVLLDMYEIMRELQPE

SEQ ID NO: 182442 - protein, 165 aa, Glycine max
  Coding DNA Sequence Number=SeqID_65664
  Homolog annotation: Hit_ID=Q1SFS3; Match level="QueryCoverage=50%, HitCoverage=16%, E-value=3e-08, Identity=32%"; Hit description =Lambda repressor-like, DNA-binding
MGLSQAPSLKKRFYQVKVKSLGVAGLKELGQLMGQLQQQAFHKAYGKIWDLAMVEVSTEAIASLAQYYDQPLRCFTFGDFQLSPTVEEFEEILGCPLGGRKPYLFSRFYPSLARISKIVQVSTQELDRGKQVEMGWLEYQGNVKKQKQESWQAAIFAFLTFHLLS

SEQ ID NO: 182443 - protein, 44 aa, Glycine max
  Coding DNA Sequence Number=SeqID_65665
MKPYKRECEREKEVTGSCRISQHGASSARARHRDGSGLGGIDSE

SEQ ID NO: 182444 - protein, 231 aa, Glycine max
  Coding DNA Sequence Number=SeqID_65666
MVGFPMEARRTDDGKEIVDRATSHQPYKEKLMVPMGEGKMEWNEKEYDPFPDIRVLDEKLKSWSSVWKNALVVHVLRKKVSFKALEAKLHHGWEKEGWIHVDLSQHFYVLQFLPPVRRMTLSLKYEGLQLVYFSCGRYGGRQTICLDGPILEVKVDAITIGEKVSKEHVVMELATLLIVAKEGNNDEGVKADLAGMLFVCPNLDHHINDTIIGVLHNHNEASETYPLPDGD

SEQ ID NO: 182445 - protein, 1101 aa, Glycine max
  Coding DNA Sequence Number=SeqID_65667
  Homolog annotation: Hit_ID=Q9LSR1; Match level="QueryCoverage=99%, HitCoverage=82%, E-value=0.0, Identity=67%"; Hit description =Arabidopsis thaliana genomic DNA, chromosome 5, BAC clone:F24B18
MAHLHEDALREYDELELCYLETVNMTGKQRDFGGADHGDDQAALVNPGNKALTQIVQEDSFQEFEFRQYLFACQSKLLFKLNRPIEAASRGYSFIISFSKSLALHERILPFCMREVWVTTACLALIEATTSNYNDGHVAPDVEKEFFRLLGDLYSLARVKFMRLAYLIGYGTDIERSPVNSASLSLLPWPKPAVWPSVPADTSTEVLEKEKKNCSSLMSLIANGSEEVGKWIFIRNSSPLAHHQGGGRVEENRNKHNTVTETENERKQIRVGKLLCPVAIDTHNYPNDYQPSDFPSLPLYPTYSQYFPHFLPHMQLILQTTSRTKHFGIQRKPLPLEPTVLLREANRRRASLSAGNVSEIFDSRQGPMDGSGFDASTRMSPQKALASSMSRTNSSPGNFDSSIDRPMRLAEIFVAAEHALKQTISNPELGKSLSSSEEFEQKYLELTKGAADNYHRSWWKRHGVVLDGEIAAVDFKHGCFDQAAKSYEKVCALYAGEGWQDLLAEVLPNLAECQKSLNDQAGYLLSCVRLLSLDEGLFLTKERQAFQSEVVRLAHSEMKDPVPLDVSSLVTFSGNPGPPLELCDRDPGILSVTVWSGFPDDITLDSISLTLNATYNTDEGVKALKSSTAIVLHPGRNTITLNLPPQKPGSYVLGVLTGQIGHLRFRSHSFSKVGPADSDDFMSYEKPAKPILKVFKPRALVDLDAAVSSALLINEDQWVGILVRPVNYSLKAAVLHIDTGPGLEIKELHVIEMETDAAGVSRGDDDQVQNDGAQIRTLNSDKKFECLTLHDATTRRESIVDGMRTIALKLEFGAFHNQIFERTLAVHFTYPFYVRTRVTDKCNDGTLLLQVILHSEVKATLTIYDAWLDLQDGFVHTGQTEGRPNSSFFPLNISPTSKGGILFSICLDNTNAEEARKQSESILNVKYGISGDRTIGAHPPVMNESTGVDGARQELIFRSAITLQRPVLDPCLAVGFLPLPSDGLRVGQLVKMQWRVERLKDLDEEGVSKQNDEMLYEVNANSGNWMIAGRKRGYASLSTKQGARIVISVLCMPLVAGYVHPPVLGLPDVDEANISCKPAGPHLVCVLPPPLSSSFCIPVNS

SEQ ID NO: 182446 - protein, 46 aa, Glycine max
  Coding DNA Sequence Number=SeqID_65668
MLSSMSEFEYEEFGTSECERSRPAEYEKNLETKRRLEVMQQVIWMT

SEQ ID NO: 182447 - protein, 62 aa, Glycine max
  Coding DNA Sequence Number=SeqID_65669
MMEFNKPNVCTSVVEIPKFDTGIMEIGLHDFEEAMGDCDLIKASKVLLLLGSVAILKRGLIV

SEQ ID NO: 182448 - protein, 162 aa, Glycine max
  Coding DNA Sequence Number=SeqID_65670
  Gene Ontology: Mol. function=structural constituent of ribosome; Cellular component=intracellular; Biological process=translation
  Homolog annotation: Hit_ID=Q9AVH1; Match level="QueryCoverage=91%, HitCoverage=59%, E-value=4e-59, Identity=69%"; Hit description =Putative senescence-associated protein
MLFQATGEDYSVEPAESRRPFRALLDVGLVRTTTGNRVFGALKGALDGGLDIPHSDKRFAGFDKEKKELDAEILAEDEPEKYQSHFSEYIKRGIEADGIEALYKKVHAAIRADPTLRKSDKEPPKEHKRYNMKKLTYEERKAKLIARVAAINSAADSDEDDE

SEQ ID NO: 182449 - protein, 441 aa, Glycine max
  Coding DNA Sequence Number=SeqID_65671
  Gene Ontology: Mol. function=structural constituent of ribosome; Cellular component=ribonucleoprotein complex; Biological process =translation
  Homolog annotation: Hit_ID=Q6UNT2; Match level="QueryCoverage=59%, HitCoverage=94%, E-value=1e-116, Identity=76%"; Hit description=60S ribosomal protein L5
  Pfam annotation: Domain name=Ribosomal_L18p; Domain location=188-331; Score=230.0; E_value=5.1e-66; Accession=PF00861.12; Description =Ribosomal L18pL5e family
  Subcellular localization annotation: CTP_CleavageSite=18; ConfidenceScore=5.11e-01
MDMLESLLGVGLKFNHLRAKRFGGGVSALLRISLLATRLFFSPGSMPVWTGEPRPSTYLCAAHNSNHPPCARKRAPLVKVVNFLRFVAQIPKHPYEGGFEKWKLCVDFGLEEVLKLPYEGGFVEVETLVWFETRDIILKGSKANPKSLLLSFVSFGGRDPAAMVYVKAQKSKAYFKRYQVKFKRRREGKTDYRARIRLINQDKNKYNTPKYRFVSNKDIVAQIISASIAGDLVLATAYSHELPRYGLEVGLTNYAAAYCTGLLLARRVLKTLEMDEEYEGNVEATGEDYSVEPAESRRPFRALLDVGLVRTTTGNRVFGALKGALDGGLDIPHSDKRFAGFDKEKKELDAEILAEDEPEKYQSHFSEYIKRGIEADGIEALYKKVHAAIRADPTLRKSDKQPPKEHKRYNMKKLTYEERKAKLVARVAAINSAADNDEDDE

SEQ ID NO: 182450 - protein, 427 aa, Glycine max
  Coding DNA Sequence Number=SeqID_65672
  Gene Ontology: Cellular component=integral to membrane
  Homolog annotation: Hit_ID=Q69LX3; Match level="QueryCoverage=55%, HitCoverage=55%, E-value=7e-91, Identity=66%"; Hit description =Peroxisomal membrane protein-like
  Pfam annotation: Domain name=Mpv17_PMP22; Domain location=292-354; Score=11.3; E_value=8.2e-06; Accession=PF04117.3; Description=Mpv17 PMP22 family
  Subcellular localization annotation: CTP_CleavageSite=51; ConfidenceScore=5.61e-01
MASVPSTVAPRTFLPSIPKPRAPLHAAKSVASAARNFPRLSHNLILSGNKRAVAVNSASEEFDVISVQSEDITDQQEGVVVSRVEMEGGDGELATQVSRFGANEGLLSLEGFSSSSSPSSSSLIGSESVDMEKLIDRTINATIVLAAGTFAVTKLLTIDSDYWHGWTLYEILRYAPQHNWSAYEEALKTNPVLAKMMISGIVYSLGDWIAQCVEGKPLFEFDRARMFRSGLVGFTLHGSLSHFYYQFCEELFPYKEWWVVPAKVAFDQTAWSALWNSIYYTVVALLRLDPPMSILNELKATFFPMLTAGWKLWPFAHLITYGVIPVEQRLLWVDTIELIWVTILSTFSNEKSEARNSQSMVPSEVKSTTYVHPPEIFDAECEKANYIYVASRGNSSHRCSISGESSVHVRLRRLECTDILHAMCGPG

SEQ ID NO: 182451 - protein, 468 aa, Glycine max
  Coding DNA Sequence Number=SeqID_65673
  Gene Ontology: Mol. function=hydrolase activity; Cellular component =extracellular space; Biological process=biological_process
  Homolog annotation: Hit_ID=Q4KU02; Match level="QueryCoverage=93%, HitCoverage=94%, E-value=0.0, Identity=79%"; Hit description=Purple acid phosphatase
  Pfam annotation: Domain name=Metallophos; Domain location=161-360; Score=70.5; E_value=5.3e-18; Accession=PF00149.18; Description =Calcineurin-like phosphoesterase
MEGAKSCSCFATISVALVLLLLPNVAVVCHGGKTSTFIRKVEKTEDMPLHSDVFVSPSGYNAPQQVHITLGDQVGRAMIVSWVTLDEPGKSLVHYWSDDCPHKRVAKGNHFTYRYFNYSSGFIHHCTLRDLEFNTKYYYEVGIGHTTRQFWFVTPPEVHPDTPYTFGDLGQTFDSNKTLAHYESNPHKGQAVLYVGDLSYADNYPNHDNVRWDTWGRFVERSTAYQPWIWTTGNHELDYAPEIDETEPFKPFRHRYHVPYQASGSTEPFWYSIKIASAHIIVLASYSAYGKYTPQYEWLEAELPKVDRTKTPWLIVLVHSPWYNSYSYHYMEGETMRVMFEPWFVKYKVDVVFAGHVHAYERSERISNIGYNITNGRCGPSKDQSAPVYINIGDGGNIEGLARNMTNPQPEYSAYREASFGHAILEIKNRTHAHYSWHRNEDEYAVTADSMWFFNRHWHPVDDSTTTK

SEQ ID NO: 182452 - protein, 63 aa, Glycine max
  Coding DNA Sequence Number=SeqID_65674
  Gene Ontology: Mol. function=structural constituent of ribosome; Cellular component=ribonucleoprotein complex; Biological process =translation
  Homolog annotation: Hit_ID=Q6UNT2; Match level="QueryCoverage=84%, HitCoverage=17%, E-value=3e-22, Identity=90%"; Hit description=60S ribosomal protein L5
MVYVKAQKSKAYFKRYQVKFKRRREGKTDYRARIRLINQDKNKYNTPKYRFVVKMILPQPRFD

SEQ ID NO: 182453 - protein, 206 aa, Glycine max
  Coding DNA Sequence Number=SeqID_65675
MNVLDSNVEALAFNYLSFGFLTALNNLWTWLALLTAALSFWKIRSAGCPKPRPKTEAQAQPFFRPEAVADLLIVEKTEPTKQHAATAPFSPPLLRGENNSEENGERKGKFTVYYEEEDMGMQCTCDENEGLLTAWKEKEGTETEWWNRWERLLQLRNGESENGWYRWQDLTELNGSVVRIWDGGLSGSSVRESWYNNYNSSCMHVW

SEQ ID NO: 182454 - protein, 616 aa, Glycine max
  Coding DNA Sequence Number=SeqID_65676
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=97%, HitCoverage=88%, E-value=1e-127, Identity=46%"; Hit description =Chromo
  Pfam annotation: Domain name=Chromo; Domain location=535-589; Score =31.6; E_value=2.7e-06; Accession=PF00385.14; Description='chromo' (CHRromatin Organisation MOdifier
  Pfam annotation: Domain name=rve; Domain location=301-452; Score =79.5; E_value=1e-20; Accession=PF00665.16; Description=Integrase core domain
  Pfam module annotation: Pfam domain module=Chromo::Retrotrans _gag::rve; Domain location=535-589::8-98::301-452
MSDYDRLTIASVHLDQDVIPWFQMMQRANPFSSWHVFTRALKLDFSPSVYECPRSTLFKLMQIGTVGEYYMDFTSLANIVDGLSSEALMDCFLSGLKANKCRDVRAMSPSTLAKAVALAKLFEERYEPSSKPKFSNSQAKTSTTNQPYQKYTYNPVKTDAFGKALLPQPLKFAIKSYQKGLKSLLDQSLQTPKQQAWLHKSIGNDFRIEYKPGKDNVTTDALSRVFFMAWSEPQFQLIDKLKREMLHDEQTQVIMNDCQNAQLPDYPYKTRCEGVCTNLHHLSASQVGACRTAGLLQPLPIPNQVWEDIAIDFIIGLPNSSGFTVIMVVIDRLTKYSHFVSMKSNCTSKTLAEAFMCHIIKLHGVPKSIVSDRDKVFTSNFWQHLFKIQGTTLAMSSAYHPQTDGQSEALNKCLEMYLRCFTFDNPKAWAKEPPALLRYNGSSQDPPVVREVLHNIQMLLDRLKGNLIKAQTAMKIQADKKRLDRKFQVEDEVLFPNTAKIHPVFHVSQLKQFQGAAIEPYVPLPLTTSKLGPLLGPTTMLETRTIVKGSTLIPRVLIQWKGCSTTETTWEDVAEIQASYPQFNLEDKVPFKGEGNVMNLPGSRLHLANSKLRDFV

SEQ ID NO: 182455 - protein, 45 aa, Glycine max
  Coding DNA Sequence Number=SeqID_65677
MVLSVCILCHEDDKNTKCKAFVNKALPLLVNITFVDLNLEHKFLI

SEQ ID NO: 182456 - protein, 40 aa, Glycine max
  Coding DNA Sequence Number=SeqID_65678
MEAAKAAITGGILVLEIVVSTSGSTTAGEGASYNGPRGML

SEQ ID NO: 182457 - protein, 87 aa, Glycine max
  Coding DNA Sequence Number=SeqID_65679
MERKHMLKKILIQWSFTIPSTVAFLEKDLTFTLDTKDNKKEVKIKKKQAEEKQTDELKCNNPSYAQWKWTTTYPKKYLLMGSKRSNE

SEQ ID NO: 182458 - protein, 123 aa, Glycine max
  Coding DNA Sequence Number=SeqID_65680
MDSEDVNGCLMDKHKPVVASSLVCEKVEDHVNGEDDSDSNSLLPPRRGGMSRNCEKTRRKVQWNDRNGNKLAEVLEYEPRKRKEEGSDDMSVNIVVCDGKMEYLDQLKNYYSLKGWPMYHVMA

SEQ ID NO: 182459 - protein, 53 aa, Glycine max
  Coding DNA Sequence Number=SeqID_65681
MLFEIQLRTLSPLGFESHKDSTSGGFNLFSVSMTLENSIGAVGGKTGGISGNR

SEQ ID NO: 182460 - protein, 101 aa, Glycine max
  Coding DNA Sequence Number=SeqID_65682
MEPMQIAGGNGAFPVNATAGHGVAINDGVLLELGLASQTGELMLGHCLPSLRVQQEVAERDRLLQMKAPVPLAIWAAVGSSQWHWRFEVDVAIPNGDFSPL

SEQ ID NO: 182461 - protein, 77 aa, Glycine max
  Coding DNA Sequence Number=SeqID_65683
MWYHGDQLGSRCFARMLQPYGISIDLKEHSNPVTPKAYTPKSLSGPLPPDSGPTPKIILDTDTARELYNTHDLTLVC

SEQ ID NO: 182462 - protein, 85 aa, Glycine max
  Coding DNA Sequence Number=SeqID_65684
MVRTCCPLKARACNPLKERTCSPLKARACSLLKRRTYSPLKARAWSPLSHSLILGYGEFVPNSQPLNPSHHIHQLALRPLSMNTS

SEQ ID NO: 182463 - protein, 88 aa, Glycine max
  Coding DNA Sequence Number=SeqID_65685
  Subcellular localization annotation: CTP_CleavageSite=80; ConfidenceScore=5.40e-01
MCAKLIRVVLSGTMKFRKFMKYGSLASQTRLAQWLPQRNVLSSASLSHRYLNRRMSVHPHKMNSHSAIGALSEFVWKRINSMNIDELA

SEQ ID NO: 182464 - protein, 46 aa, Glycine max
  Coding DNA Sequence Number=SeqID_65686
MMLHSLNKRLLLGGLLSSILTILDHWSKEIKGALDPMGTILSPSYS

SEQ ID NO: 182465 - protein, 128 aa, Glycine max
  Coding DNA Sequence Number=SeqID_65687
QASAKHITHGLSARKTLEEDELYRLPGYEKLNPLLDLPCSGNWSDSKVLDSTGLCCHTITRNRDICRDGFQVDGEEQGVIGFDGVEGVSIGKGLKRGIGIAGFLCCCKGGGGSKGEMDKERGEEKEEE

SEQ ID NO: 182466 - protein, 35 aa, Glycine max
  Coding DNA Sequence Number=SeqID_65688
MLENLQVPPSTTESAPVLKRYAPPNQRDITRTQLK

SEQ ID NO: 182467 - protein, 65 aa, Glycine max
  Coding DNA Sequence Number=SeqID_65689
MSRLSLSPILSEVVWVRAPVRSLIKEIRPARAIMEGQAGILMYGSKRMMLGGLKPIPMEKSNRLA

SEQ ID NO: 182468 - protein, 460 aa, Glycine max
  Coding DNA Sequence Number=SeqID_65690
  Gene Ontology: Mol. function=translation elongation factor activity; Cellular component=cytoplasm; Biological process=translational elongation
  Homolog annotation: Hit_ID=Q7CHD8; Match level="QueryCoverage=46%, HitCoverage=51%, E-value=3e-92, Identity=78%"; Hit description =Tryptophan-specific transport protein
MKRGRVPAPLARLVGAAHVAAFGDMNANFVAGAEVFRHVDHQAGRHGGRFVAGAGGSAFDARRGLDDFHIHGLRQLQCQHLAFQRQHLHARQAAFRNEQQLVFDLVFLEDVRGVVFVIHEHVFFAVDIREVHLAARQGNGVQDIVALEAFFHFQAGAHVGEAHFVQGAGAAGAWALHVDIFYQQQLAVVADRHAALNFVSSCHFNSSAMKSIREVATRYSRRRFQAIARRKNSAGKGGRSPSRRGLAEDRQQAEQRKNMRGGVDQAEQDDEQDHAVAARCAVTGLRVAAAAGARHQRRHDHRPDGGRQPGETDGVQETVREQQRGQGRRHKGHQRGLAASDGVVLELAEVCQVVEQAQRHAEERAGQRHIGEGVQQLADGLAAGDVAHLLEQAADVAALGDHLLKGVARDIALDHVLPQDVDSQCQQGAVHQAAHHGAAVLMVILHQPGNVAVVAERGQQ

SEQ ID NO: 182469 - protein, 203 aa, Glycine max
  Coding DNA Sequence Number=SeqID_65691
  Gene Ontology: Mol. function=hydrolase activity; Cellular component =membrane fraction; Biological process=metabolic process
  Homolog annotation: Hit_ID=Q9I0E4; Match level="QueryCoverage=99%, HitCoverage=89%, E-value=1e-102, Identity=88%"; Hit description =Probable hydrolase
  Pfam annotation: Domain name=Isochorismatase; Domain location=2-148; Score=-28.1; E_value=0.00033; Accession=PF00857.11; Description =Isochorismatase family
MAFGVQSIDRQTLKNNVVGLAKAARTFNIPTTITTVETDGFSGNTYPELLAVFPENKILERTSMNSWDDQNVRDALAANGRKKIVVAGLWTEVCNTTFALCAMLEGDYEIYMVADASGGTSADAHKYAMDRMIQAGVVPVTWQQVMLEWQRDWARQETYDAVTGIAKEHSGAYGMGIDYAVTHVHKLAERVTHGERIGPNPAK

SEQ ID NO: 182470 - protein, 91 aa, Glycine max
  Coding DNA Sequence Number=SeqID_65692
MRPTGGVLHTESFDEGVEAIYGSWKASKCSSGSVVSSYRSRLSDFHPRGYVYLHNAVDKRMPMDSLCCWTMHERDSDRLQCCLSVGGVIPL

SEQ ID NO: 182471 - protein, 154 aa, Glycine max
  Coding DNA Sequence Number=SeqID_65693
  Subcellular localization annotation: CTP_CleavageSite=90; ConfidenceScore=5.24e-01
RALVNFGLARLFSLSGWTEAVHLAGWPFAQRTSTAHPSSRFFLALSRGMLHSTDSSLSQQIGSARGVGCDKRFKGSNDEVDGAGLVVLVVVIAKSKVVVWYRGGEESCDSGMVRGGKATGEVMVRDFGFMVVARSPWWRRGAEVWGGKGWVHGM

SEQ ID NO: 182472 - protein, 110 aa, Glycine max
  Coding DNA Sequence Number=SeqID_65694
  Gene Ontology: Cellular component=cytosol; Biological process=protein targeting
  Homolog annotation: Hit_ID=O81728; Match level="QueryCoverage=87%, HitCoverage=40%, E-value=9e-39, Identity=73%"; Hit description =Expressed protein
  Pfam annotation: Domain name=DUF862; Domain location=5-110; Score =126.6; E_value=7.1e-35; Accession=PF05903.5; Description=Eukaryotic protein of unknown function (DUF862)
MGWCISCWDGFVHGVEYGFGAHERDTTGIFEVEPGHCPGFTFRKSIFIGSTDMGPKDVRVFMERLADEYSGNTYHLIQKNCNHFCEDLCFRLTGKSIPRWVNRLARLGKG

SEQ ID NO: 182473 - protein, 46 aa, Glycine max
  Coding DNA Sequence Number=SeqID_65695
MDTLEPYTGTMRDTMHEAQANLWANQKFSPGTIAKPAGRAMQTIHA

SEQ ID NO: 182474 - protein, 65 aa, Glycine max
  Coding DNA Sequence Number=SeqID_65696
  Homolog annotation: Hit_ID=O81728; Match level="QueryCoverage=77%, HitCoverage=22%, E-value=4e-12, Identity=65%"; Hit description =Expressed protein
MLCKLVPRKKKPGSNPVYLNVYDLTPINGYAYWLGLGVYHSGVQGIKQNFGDWAYPISIHILGID

SEQ ID NO: 182475 - protein, 202 aa, Glycine max
  Coding DNA Sequence Number=SeqID_65697
MSKVEGSKYEELRMQRITENQAKIEALGLSKLATIFKDRIQKAKKKDKKKANDDDEDYLPKYEGGLGSNSSSKHVIKKGRGHTINAKFQKKKENLMAKGKNIDIQSPPPFYKICGKHTKYFKSEAQVCIHQKAPLQINGWSEISKDDVDEMWRHMKDAFSLSNEVKEYAMKQIQSQYKNKLYHLHQVYLKEKGRPKYVSPED

SEQ ID NO: 182476 - protein, 69 aa, Glycine max
  Coding DNA Sequence Number=SeqID_65698
MAALLVNGSRKMHWRVSCIRGGGFSPVVLATHPRHHASRQLCWRHMYHVATSRSFSPLIMAAHLSRQSC

SEQ ID NO: 182477 - protein, 68 aa, Glycine max
  Coding DNA Sequence Number=SeqID_65699
MKSLVPCSEPCSATLHPGSAALSSLVQLLVCAAWTPSHKWKQWKLRRRNPARRRTEERTLKRPDTHRP

SEQ ID NO: 182478 - protein, 92 aa, Glycine max
  Coding DNA Sequence Number=SeqID_65700
MEELINKTQLSPKIIPTSSRQLGGSTKESHFLSTTAVILLPRTKVCDHHRYQPHGTKIARGTSNKVTAPPSPMNIHITQRMKHGHHQCTDRG

SEQ ID NO: 182479 - protein, 139 aa, Glycine max
  Coding DNA Sequence Number=SeqID_65701
MGSPNWPTIMLAFNRGFKVLMVHEQKKAKYKVLMWGHTTLVTKGSEVRTNLWRFPIVIQHMRGEYKCNTIALEEFYDLAKQLLSCFADVTIEHVFKGENDEVNQQAHHAFGYKRLKDETLKSTIKEYCIMEIGLVNPQQ

SEQ ID NO: 182480 - protein, 237 aa, Glycine max
  Coding DNA Sequence Number=SeqID_65702
  Gene Ontology: Cellular component=mitochondrial matrix
  Homolog annotation: Hit_ID=Q69T76; Match level="QueryCoverage=98%, HitCoverage=94%, E-value=8e-16, Identity=29%"; Hit description =Mitochondrial glycoprotein-like
  Pfam annotation: Domain name=MAM33; Domain location=59-235; Score =25.5; E_value=6.9e-07; Accession=PF02330.6; Description =Mitochondrial glycoprotein
  Subcellular localization annotation: CTP_CleavageSite=37; ConfidenceScore=5.21e-01
MTSSLIRTLQRASASLIRTSRPLSPHAATTRVGARTYAAEPKPEPATKSPFDSNIIRILRNEIEYQEEYAPPHQPETKFNSFTVEELRGEQVVTIKGKFGECEDIKIEATMFDGCEHVPACGDDSSGVNLRLHLSLIVDIAKGEEGDSELEFVCSAWPDCLNVEKVYMLRRSRMAARPYVGPDFRDLKAKVQETFYEYLDVRGVNNELAIFLHEYMMNKDRIELLRWMDSLKSFMER

SEQ ID NO: 182481 - protein, 74 aa, Glycine max
  Coding DNA Sequence Number=SeqID_65703
MMLDLVCFAYVDLNRTAHVSEPLSSARQQERVDVQRPSFPFRFDGEICEQSYNNCCLVVEDLTIGDSVYYIGYL

SEQ ID NO: 182482 - protein, 153 aa, Glycine max
  Coding DNA Sequence Number=SeqID_65704
MESELKDLNSKPPNYNDNANSVFDDHLLLKLEPPASADSIAEMEKKYAAVMCTTPWDATSFRKRRSSSSAFHWICTLFSASTGEEEQKDYAHILRMSLLNAFAIDSDAGGIEKNNNIKAIDLLQKNQDNAKASLQVLAADIHFLRDQVTLTQV

SEQ ID NO: 182483 - protein, 63 aa, Glycine max
  Coding DNA Sequence Number=SeqID_65705
  Gene Ontology: Mol. function=metal ion binding
  Homolog annotation: Hit_ID=O23280; Match level="QueryCoverage=87%, HitCoverage=14%, E-value=3e-10, Identity=55%"; Hit description=RING -H2 finger protein RHF1a
MPTSHTTLLFFRSQRSKECPICWQSLALKDPVSQELVAAVEDEKCMRSRNIANSRAPLGIIFL

SEQ ID NO: 182484 - protein, 67 aa, Glycine max
  Coding DNA Sequence Number=SeqID_65706
  Homolog annotation: Hit_ID=O04084; Match level="QueryCoverage=41%, HitCoverage=6%, E-value=1e-07, Identity=89%"; Hit description=Serine carboxypeptidase isolog; 30227-33069
MTCTYQFQRQACDTIRTIEGYSDIIVMRQHPTQLGNPETSNAEDWMGLVDYAWSHAVISDEHLNTLR

SEQ ID NO: 182485 - protein, 258 aa, Glycine max
  Coding DNA Sequence Number=SeqID_65707
  Gene Ontology: Mol. function=transmembrane receptor activity; Cellular component=integral to membrane; Biological process=signal transduction
  Homolog annotation: Hit_ID=P02941; Match level="QueryCoverage=99%, HitCoverage=46%, E-value=3e-96, Identity=70%"; Hit description =Methyl-accepting chemotaxis protein II
  Pfam annotation: Domain name=HAMP; Domain location=185-254; Score =71.5; E_value=2.6e-18; Accession=PF00672.15; Description=HAMP domain
  Pfam annotation: Domain name=TarH; Domain location=35-170; Score =156.8; E_value=5.7e-44; Accession=PF02203.6; Description=Tar ligand binding domain homologue
  Pfam module annotation: Pfam domain module=HAMP::TarH; Domain location=185-254::35-170
  Subcellular localization annotation: CTP_CleavageSite=64; ConfidenceScore=5.24e-01
MLMMVLVIFALLQLISGGLFFSSLKQNQDSSAASNDLRLQQSELTSTWDLMLQTRINLSRSSARMMMDPNNQQSSAKTDLLKNARATLADAAKHYDAFKKITPQPAMEQVSQNIDEKYNAYYAGLTELIQFLESGNMDAYFAQPTQGMQNALGAALGEYAKASGDLYHSAFTESQNDYRFAKWQMAVMALALVIVLVAVWYGIRHILLNPLGRVIAHIREIAGGDLTKTLTVSGRNEITELANSVDHMQRSLIDTVAN

SEQ ID NO: 182486 - protein, 76 aa, Glycine max
  Coding DNA Sequence Number=SeqID_65708
MEICLRKLRTKFEDDPTGVTQCITIRGKLKMRLHCHQVSRRPIMTTDRPPLLMAHIDPGIGPSISMCVQGVGVMCL

SEQ ID NO: 182487 - protein, 279 aa, Glycine max
  Coding DNA Sequence Number=SeqID_65709
  Homolog annotation: Hit_ID=Q47522; Match level="QueryCoverage=18%, HitCoverage=70%, E-value=4e-14, Identity=70%"; Hit description=LacZ protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGIRSQEHRSLEQTDQWLALENPDESLETSNNNFQNCPMDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 182488 - protein, 102 aa, Glycine max
  Coding DNA Sequence Number=SeqID_65710
HLRMSSDSPSLDDKGADDDVSLGVSIGSLASGAEDDVSLCVSTGSLAPGADNHSGIFACHLSSRVRINRNHLCTDNHSGISACQLTSRVQINRNRLCTDNHS

SEQ ID NO: 182489 - protein, 68 aa, Glycine max
  Coding DNA Sequence Number=SeqID_65711
MQCIKYYDPLIGARFRFYKILLSHAPGTRCGLAQKSSWTSLLSNWGVENTGFDSRLRCSSRPSTFQLN

SEQ ID NO: 182490 - protein, 52 aa, Glycine max
  Coding DNA Sequence Number=SeqID_65712
MDDSISNPLCDVNDDEIEVEDVEKEYKFVEPDKKKTKSTTFDCWKFFTKIGV

SEQ ID NO: 182491 - protein, 191 aa, Glycine max
  Coding DNA Sequence Number=SeqID_65713
MIGGYNSEHYINIILIFQCNAYKKLNTTADGKVPKTGPQWLELKTHIQRGGYECGYYVMHWMWNIIGAELKSDWSVWFGDGSALDPEAITTLRKKWVAYFLKLRTIQCVIFIYERSQTYNSYCRDHQGDLNISIAIQLKYAENRNKHGKTRVAIGVLVFASDWWKWQLVRWQSHLELTDPLCFSLSSGRTG

SEQ ID NO: 182492 - protein, 86 aa, Glycine max
  Coding DNA Sequence Number=SeqID_65714
MRKSSVSIDSLIKHPKEIAKSLNKCPHQPVIEEWIHDKMNPYVVLQTKDLAGQHMRYACASGQLRMRRIVLPESHFFTPLSLCAHF

SEQ ID NO: 182493 - protein, 154 aa, Glycine max
  Coding DNA Sequence Number=SeqID_65715
  Gene Ontology: Mol. function=nucleic acid binding; Cellular component= intracellular; Biological process=chromatin modification
  Homolog annotation: Hit_ID=Q6Z3F1; Match level="QueryCoverage=98%, HitCoverage=33%, E-value=5e-37, Identity=46%"; Hit description =Putative zinc finger protein
  Pfam annotation: Domain name=RS4NT; Domain location=103-140; Score =17.8; E_value=0.015; Accession=PF08071.2; Description=RS4NT (NUC023) domain
  Pfam annotation: Domain name=zf-C2H2; Domain location=118-140; Score =20.5; E_value=0.0061; Accession=PF00096.16; Description=Zinc finger, C2H2 type
  Pfam module annotation: Pfam domain module=RS4NT::zf-C2H2; Domain location=103-140::118-140
  Subcellular localization annotation: CTP_CleavageSite=55; ConfidenceScore=5.22e-01
MAAPFSAASLFAIREEDQNQMKQQQHSSTPSSSTTPAAPPQKKRRNQPGTPCKSRCGGDSTISQDPNGNKQQKTNKEPKRKVYLCPEPTCVHHDPSRALGDLTGIKKHYSRKHGEKKWKCDKCSKKYAVQSDWKAHSKTCGTREYRCDCGTLFS

SEQ ID NO: 182494 - protein, 79 aa, Glycine max
  Coding DNA Sequence Number=SeqID_65716
MCARKEKAQCKEHFFHHKHNFQTSNDVTHRVIRDDGRLREEGSRYMTMAVYDFPHQQRRNNGETFHGEARQETPTTVGE

SEQ ID NO: 182495 - protein, 154 aa, Glycine max
  Coding DNA Sequence Number=SeqID_65717
MVPMGASFGALFFGGLGRCHGVQQAQHCQPISHFLLYNYWWLGKGKTKYWRVVWCAIAWSIWSYRNTLSSMRGVTIFIAGKGLVCIRAIHDSVSRTFAVGICDIIFTEREKEIARGQYKWRLQSVLSLYDIWELYRSSQRKKLEESQGTAATDV

SEQ ID NO: 182496 - protein, 181 aa, Glycine max
  Coding DNA Sequence Number=SeqID_65718
MVIVVESALATIDILVEVVMAVVAEVTVVVVVMFLVSVAMVVVLMVIDNGGDGGDSDRDDIGDSGDDNGAMVVVVAMSMGGIGSGGRGSSNVNDSGGDNGGSDDIRGGIGSGGGDNGGGNGGSNIGGDDGVVVVVMLVRMMVSTTSGGGMVGVVVVTMLVVVTVLVTLALTIVVVVVVAIM

SEQ ID NO: 182497 - protein, 680 aa, Glycine max
  Coding DNA Sequence Number=SeqID_65719
  Gene Ontology: Mol. function=DNA binding; Cellular component =intracellular; Biological process=DNA integration
MKDSGNAAIVQDGYESSEVLVVSNDNLEIESIMDSCCSWRMTPNISCFDEEFSDQAERLVLLQNNKPCKIAGIRSIRFRLYDGVERLLIEGEQGLLKAVKGSMVVMKGIKKNGLYSLEGDIVIGSTTSISEKLVSKTELWHMRENGIARHRTVAGTPQQNSLAKRFNITILERVRYMLLSVGLPMIFWAKAVMKCPSTALEMRTPEKVWSGHPPNLNRLKVFGCLSYAHIRQDKLKLRVVKCMFLGYPEGVKGYIHDVVFNETHMAYKIDSGMSKSSNDQNEKDEYEKLNLEVEPKDKADKGFYKVEKKSQGPQVAWGLDVGTGIKGVEPDRFKAKLIARGFTQKEGVNFNEVFSTVVKHRSIRLLLAMVAELDLELEQMDARKSMFASLRGSFMASNSLLDNGIRDLMNSWLTYCSKGVSMTIVFISNSLLKVKAELNREFEMKVLYLSQEAYLKKVFERFGTSNSKRVMTPISKQFKLSISQSPKNIEELAYMESIPYANIVGSIMYAMVCTRPDIAHVMSLLGIEKEQQQMKVTVGDGDGGNDVDGVNSNTGDDNDDVSSGSSTNIGDGVTMMVIMLVLTTNCDSNCDNIDDNYGDKSGIDVGGGNNDTLSDNIVMAIKGCRTRPDWKHALPGWPNRREVGATSEGWEEKESLGGGGCSWKGEEEKKEERKKEERAV

SEQ ID NO: 182498 - protein, 83 aa, Glycine max
  Coding DNA Sequence Number=SeqID_65720
METRRECDLFGKHRKRAKEELPRRKMCGGTVVTSSDLNHVRKSERRKVVRRHSTPSFVTDRAGRSSRVNRKGILVSCMKETEY

SEQ ID NO: 182499 - protein, 945 aa, Glycine max
  Coding DNA Sequence Number=SeqID_65721
  Gene Ontology: Mol. function=nucleic acid binding
  Homolog annotation: Hit_ID=Q1SV26; Match level="QueryCoverage=52%, HitCoverage=73%, E-value=1e-147, Identity=48%"; Hit description=Zinc finger, CCHC-type; FAR1; Zinc finger, SWIM-type
  Pfam annotation: Domain name=FAR1; Domain location=125-261; Score= -39.7; E_value=0.00096; Accession=PF03101.5; Description=FAR1 family
MGEGNTSTRDMSTINNTMGEGSTSTRDMSTDKINVDLNEYPIEDISLENGYSGTVSEHFDHDIVANDVLEVEEIETYEKENIVSSSQNIEINEFAEEVDRDETYNETNIVPFVGQIFLSEEEAFAFYKRYAYQHGFSVRKEVRFLPANRTISEDDIERIFLLKEGGLSVRQLMRVIELEKNVKHGYLPFIERDIRNLFVKTKKKVERNDAKDLLKYCEDAKKSCSKFQYAYTLDEERRLEHIFWSPASCSDWYQKYGDVVVFDTTYKVNSYEMPFGIFVGMNSHGKTVLFGCALLRNETISAFRWLMKPPKTILTDQDPWMKEAISKDLPSTKHSFCIWHITFKFSSWFNAILRDKYSKWCSDFYELYKLETCEEFEHQWPKVVAKYNLQSNKHVKGLYEIRNYWALAYLRDHFFGGMTTTGRSESINAFIKRFINSHTSLSDFTKQVDVAIDDIKQKEDHDIMLEKCKRINLKLMSPLQEQAHGVLTRFAFQKFQEEFERSTQYSIHHENGNEFVLRYYKDANSRKHMVFWDDCHEIPSNYLPSRWRLQTSHDDDEVDPQQVNVVFEEQVDVVHCPPPSKTKGRPKRRRLKGGKELSHNMNTCGLCKDGKEISPMFPRLHVKDAEKRGPKAPPRNKMALYEQFSIPSQNFAPGSTSLFPLPLRNYTGPTSSSHISSNQSIQFCTSSMPSILAEKSQAYNSRKTNLTKFTQDDFINSKNSLKALDGEDAFISSGSAHRKNSYCSIIQNNKDEGKLSCSNLSCSHKRLNSIRKVNSPGAVDLMSEQYEKNQIEEHTEVSQIGQKPEEVLPHSLDGFGDMTDASLISLEKGKNSKSMNKEHRSLKEENRSISVDSLKTLQGSSVRTQEELAAFRDQIKSRDHHIEKPAASELHKCSGELEIGRRCFLDKVNRNEDEETYSHYDAVNKYNSECTSVMDISPDNVVGAI

SEQ ID NO: 182500 - protein, 133 aa, Glycine max
  Coding DNA Sequence Number=SeqID_65722
MKTRTLLRKTVEIEIKKDKFILINKKDETNYCFPLRIQTLDNKSESEMLSASGSSTSSTTCYRAPATVDDGSAWWPKIASRWKMLKLGGFSCGHGEEAIDGGGFFVHDRSWLEKGRKKMLGFMREQKERTVTP

SEQ ID NO: 182501 - protein, 337 aa, Glycine max
  Coding DNA Sequence Number=SeqID_65723
  Gene Ontology: Mol. function=zinc ion binding; Cellular component =nucleus; Biological process=regulation of transcription
  Homolog annotation: Hit_ID=Q1SDI6; Match level="QueryCoverage=94%, HitCoverage=75%, E-value=5e-67, Identity=49%"; Hit description=FAR1; Zinc finger, SWIM-type
MVYGEVGCLLQYVQQQLLENPSFFHAYQMNIDEQITNVLWADAKMVLALLYDETNESFKWLFKTFSKAHSHKKPQTIFTDQDKTMAKALVEVMPEMHHGLCTWHLMQNGIKHLDNLMKGGSHFLRDFKKCMYEFDTKVEFEEAWTKLIANYNLQENNWINSIYKRKMGFLLHEGSIHTWMRSTQLSESLNSHFKALFEANDIKVVPEKYILKRWTREGRSGTIHDFRGREVEEDPRLSSTRRCRHLASKLIRVASDVSPSKEYFQLVGESIDVVCKKIKELCLQAQSIDKNKDDAVALVINYDTQPKGFKQQPSIKRHNQKRLKSWLELQLKKKKKL

SEQ ID NO: 182502 - protein, 385 aa, Glycine max
  Coding DNA Sequence Number=SeqID_65724
  Homolog annotation: Hit_ID=Q9LUA7; Match level="QueryCoverage=55%, HitCoverage=68%, E-value=3e-14, Identity=28%"; Hit description =Arabidopsis thaliana genomic DNA, chromosome 5, P1 clone:MIF21
  Pfam annotation: Domain name=DUF868; Domain location=22-342; Score =58.5; E_value=1.2e-15; Accession=PF05910.3; Description=Plant protein of unknown function (DUF868)
MFFLSLPFSSCFRASQPNHDPTTLSTNLTTYIYHTEYGTVSLTWSRSMLGRSLHVNLHNHSSFHLHVKPWRKKGSKKLSHNTVFLWNLSSARFESGRPEPRSRFYLAIEVEHSLSLLVGDLSPKSKAKKPSKTQQQLLVLKRDHVHVAPHRSRVYQTKARLGGKVREIEIDCDGYNGNGGGYENENESSLRLLFGVDGEKVLEVTRLKWKFRGSERVEIDGVHVQISWDVHDWLFEKDKDNNHCSTNNNNNNNGNEGHAVFVFKFEEDEVRGGGGKEEEQQWSLGSGGEWRNGKSWSSSSLSVSSSVGSFGGSSSVMEWSSAEENELVVPLGFSLVVYAWRREICYMKVVIGTVVIVIGCVIGTFYSCCARQMFDQMAASQQLVA

SEQ ID NO: 182503 - protein, 132 aa, Glycine max
  Coding DNA Sequence Number=SeqID_65725
MRESESEIQDGRRRGKLRNKRGEGEGETTTWESEREKSSLLVVKFEGSGCVVGWQKARKRAHPNLAKDYVWIRVEQRGRGTNMRREEKKRKKMDMSSDLHVWTHPLGGLSIQVIPMSIDPSSLSYSSKPIIE

SEQ ID NO: 182504 - protein, 182 aa, Glycine max
  Coding DNA Sequence Number=SeqID_65726
  Gene Ontology: Mol. function=transcription regulator activity; Cellular component=integral to membrane
  Homolog annotation: Hit_ID=Q1SJV8; Match level="QueryCoverage=86%, HitCoverage=60%, E-value=3e-24, Identity=40%"; Hit description=TRAM, LAG1 and CLN8 homology
VAYFAADLLHLAVFFAGAGDLPFVIHHLATLFVLLTCRHAASRGAVAVLALLALAEVTSALQNTWALARVRRSNCSSSTHVATACDAALALPFYGLYSIVRGLLGPYVVFRMVVFYSGGGAEGAIATWVWVSWVVVVSMAIAGSVAWVSNLWVEVYRESSNDRSSGDHVSGDHNDYSGDRGG

SEQ ID NO: 182505 - protein, 111 aa, Glycine max
  Coding DNA Sequence Number=SeqID_65727
  Gene Ontology: Mol. function=transcription regulator activity; Cellular component=integral to membrane
  Homolog annotation: Hit_ID=Q1SJV8; Match level="QueryCoverage=54%, HitCoverage=24%, E-value=5e-09, Identity=52%"; Hit description=TRAM, LAG1 and CLN8 homology
VQHEALEFRVFGGEASVCGGEDCSGGEERRRSAVEDGNETAGGFGSDLGAPLAEDDEVAEETGRMYIRMSFGHVLLVGFCGKRRAEKVRDERRGEGGGRGINGFCRVGEKK

SEQ ID NO: 182506 - protein, 255 aa, Glycine max
  Coding DNA Sequence Number=SeqID_65728
MVLGKVIDNCQSAFLGERKLLYRVRVANAFTWTSVLVNGSPSQEFKCHKGLRQGYPLAPFLFLVVTEEGSLWSEVLIPKYDGWKGLVREGELLRESLWWKDLKRICGGNSREKWFDEGIEWKTGQEDVVCEMGCWRLDRWVWKLNWRRETFEWELLEQLQILLNSVQILSNELDSWVWQNCNSGKYSTNWAYKLLLEDDDSSTYLSDMPYDLAAMASMPFLDASFNVNNTFSIFGEPFQSVFGFGKVKKCNGIWS

SEQ ID NO: 182507 - protein, 170 aa, Glycine max
  Coding DNA Sequence Number=SeqID_65729
MVQKAIDEGRLKFEDKPMKPNTGTFHIQTILKTRNILIDYARKGYFGDLSLSPKVVWVIQVSYFTPHRNPVVFNPPTDDMRCHTKTPNLTTMGMDTWSRSSAINSPSKEADQSSHGIYTIFASEGDQAMRRSALLEIEDSFYVNNKLGNEKDIEKDEYQCHQRKKKSDGY

SEQ ID NO: 182508 - protein, 150 aa, Glycine max
  Coding DNA Sequence Number=SeqID_65730
MVVSSQCNTLTDQDVSANTERSTPLQTPIVSSTTSDKGIELILILGHEEECKKVWETHKPTCPETSFWSNYFNLIDIAAITGLKPLGRTYAIGLIEDQMERNNIKIDFSAKAYGAFIEKNAKDTKETSDEEYVAFLMYWVSSHLLCTRSL

SEQ ID NO: 182509 - protein, 124 aa, Glycine max
  Coding DNA Sequence Number=SeqID_65731
MVIFSHGVAVEDKGEEPNTWEASLRSKEGRFLGKLEEESFLEKTEVGYSHPSNSLAHPHSKIHENTMGSFREKQGRVPYKPKMAKIQGPKEEKPILIFTKKSGPNLGLWAPKSILRFMRTIGPS

SEQ ID NO: 182510 - protein, 243 aa, Glycine max
  Coding DNA Sequence Number=SeqID_65732
  Subcellular localization annotation: CTP_CleavageSite=79; ConfidenceScore=5.16e-01
MKSPRKEKTLSSSNTGHQGSKKTNKAKIDDKVKLPPKPPKFQQPSKSTTSQPSKTNASKGLDDSDEDMPINSFFKPTSSAKTKQKDDKIMNLSSSQDPSQVCDGGEKENQESLVVNSSAKIVNKETIDSNIPVSTTGANNTGMVEDLEEQKDAQSHIEQHIPTTGEVLGFIDHANVSVLISVVKTNEPTTDQNIENLQGETNPLDVDPFSFIDVWSSDSMPSKASESSHKIPFTHFDEVVEKF

SEQ ID NO: 182511 - protein, 98 aa, Glycine max
  Coding DNA Sequence Number=SeqID_65733
MVKFYQDSSGFLRKWKRLRCEVYFSYLRHDFEIPNGGNAGKWDANLVLKFHDDPTVNESKIVIYSETGLVVCGKKRGFWEEKGKNENEGKRRHRWCEN

SEQ ID NO: 182512 - protein, 304 aa, Glycine max
  Coding DNA Sequence Number=SeqID_65734
  Gene Ontology: Mol. function=oxidoreductase activity, acting on the CH-OH group of donors, NAD or NADP as acceptor; Cellular component =cytoplasm; Biological process=lignin biosynthetic process
  Homolog annotation: Hit_ID=Q5H686; Match level="QueryCoverage=98%, HitCoverage=88%, E-value=4e-86, Identity=54%"; Hit description =Alcohol dehydrogenase
  Pfam annotation: Domain name=ADH_N; Domain location=1-99; Score=60.2; E_value=6.6e-15; Accession=PF08240.2; Description=Alcohol dehydrogenase GroES-like domain
  Pfam annotation: Domain name=ADH_zinc_N; Domain location=129-264; Score=135.8; E_value=1.2e-37; Accession=PF00107.16; Description=Zinc- binding dehydrogenase
  Pfam annotation: Domain name=AlaDh_PNT_C; Domain location=102-269; Score=-62.6; E_value=0.096; Accession=PF01262.12; Description =Alanine dehydrogenasePNT, C-terminal domain
  Pfam annotation: Domain name=Shikimate_DH; Domain location=107-238; Score=-27.0; E_value=0.074; Accession=PF01488.10; Description =Shikimate  quinate 5-dehydrogenase
  Pfam module annotation: Pfam domain module=ADH_N::ADH_zinc_N::AlaDh _PNT_C::Shikimate_DH; Domain location=1-99::129-264::102-269::107-238
MARNEWAVSRYPLVPGHEIVGRVLETGTQVTRFKAGDMVGVGVMVDSCRACHFCQQQEEQYCEAGFTATYNGIDKYTGDSTWGGYAQHVVVDQHFVVSIPQNLALAGVAPLLCAGVTVWSPLRHFGVKAGDNVGVVGLGGLGHMAVKLASALGAEVTLFTTSPEKGADARRLGATRVVVSRDAAQMAACQTSLDFIIDCVAAPHDLDPYLATLKTNGRLVLVGIPDQPHPSPNVTPLVFRRLSISGSSIGSIKETQEMLDFCGEHNITADIELIAGEEIETAFARMLKGEVKYRFVIDMLATRW

SEQ ID NO: 182513 - protein, 84 aa, Glycine max
  Coding DNA Sequence Number=SeqID_65735
MTILYLTYVKTATTTTTTVITAMTTIIATNMIVGGGDDDNNNDHVGGNSGGHGGDHNVVTVMTIVAETVTTVVVVIDGDMFRIL

SEQ ID NO: 182514 - protein, 73 aa, Glycine max
  Coding DNA Sequence Number=SeqID_65736
MALVTGPFLGRIASRTTKSYYKSISFEADSKEGFDNNQNPSIRNTTTTIGAQVSKPKRTTSKLAYLEDYVCPS

SEQ ID NO: 182515 - protein, 238 aa, Glycine max
  Coding DNA Sequence Number=SeqID_65737
MGLPFCIKMTPMALLEASVSKTNGMRNLGISKLRPSRWVIAQPERHDTVLIVTVIMSDRSNSKPASRFQIFGSKGVRRSGHLWGWWKAEEIYDEQGHEGTDVGQKLGYPRLDKTMGAATIDKNNEEKNTASAFVGGTPFFITIIAKAFFTTKDHFLESSMNKGLSRIRRRRVVACGKDMGCRARTSWQIFMDSPKRKIIVIRQSKMRLQGLQEAWPGGDEYVTVIEAIEKGIDLRIEV

SEQ ID NO: 182516 - protein, 288 aa, Glycine max
  Coding DNA Sequence Number=SeqID_65738
  Gene Ontology: Mol. function=chromatin binding; Cellular component =chromatin; Biological process=chromatin assembly or disassembly
  Homolog annotation: Hit_ID=Q1SAV4; Match level="QueryCoverage=49%, HitCoverage=38%, E-value=1e-23, Identity=42%"; Hit description =Integrase, catalytic region
MASIPPRTQIHNPDRLSELKGVDDPYHLDAETTILFIQIIGGMITKYNIKSRSSNVVADALSREKLQLISSKPTTYPNFQLNNGMIMHKGSIWLNVDNSFIPVLVMEFHATPMDGHLGVTKTIHRLQANFTWDHLQHDVKSFIKNYQTCHQIKHVTRKPGTIQIKWYIPYRQISASGAAHHKLSKGFFGPFELLEHIGKVAYRVRLPENSKIHPIFQCSLLRLYHDRLLPSSTPLPPLAYNHHPIMEPLAILAHRMYTITTPPTLMGPSVMAGIAARRDFMEKMADNV

SEQ ID NO: 182517 - protein, 119 aa, Glycine max
  Coding DNA Sequence Number=SeqID_65739
  Gene Ontology: Mol. function=RNA-directed DNA polymerase activity; Biological process=RNA-dependent DNA replication
  Homolog annotation: Hit_ID=Q1S4N5; Match level="QueryCoverage=93%, HitCoverage=23%, E-value=6e-16, Identity=44%"; Hit description =Peptidase M, neutral zinc metallopeptidases, zinc-binding site
MSKLHHEKSNRNQAQGSSQGARVLIIGKSHFAEEGSPKCFDEDIIKSEASKYFKDLFQTQSMCAPSSLILNSIHYICLEMHNDLMKLVTMEEVKFAIFSMDSYKAPSVDGFQSIFFKGF

SEQ ID NO: 182518 - protein, 247 aa, Glycine max
  Coding DNA Sequence Number=SeqID_65740
  Homolog annotation: Hit_ID=Q1S4N5; Match level="QueryCoverage=23%, HitCoverage=11%, E-value=3e-13, Identity=58%"; Hit description =Peptidase M, neutral zinc metallopeptidases, zinc-binding site
MGQPCYLEMKRLALLATRITKTKKDVVVVRVMRRKKLNKGVRKIQSPINIGHASIHRFVNMMSISTIAMLGKDKRLESPRGVARSGFCQSCRQLYLRDLHVFSMVMNSLLRGLHAILSWRIKIKVQNCSVAIIRIGNSDMPKGYVRISVSMGPALLGFVGPLTTASCCGYASSTCSTLFSTNGVQKLVFITTRNDVHNKTENSYNVSTKGTRGNQQHRISVLQLNHHRFRIAPEIKESRKVQRRCRE

SEQ ID NO: 182519 - protein, 96 aa, Glycine max
  Coding DNA Sequence Number=SeqID_65741
MHSLRELAQNRTIVPLEYFLEKVVWSEAQLPLVRPNEVAPPEPAPAQVELMSAEPQTPVLKKQLTPLLPQLEELLIFLIRHLEKLLLSLISQFRHC

SEQ ID NO: 182520 - protein, 411 aa, Glycine max
  Coding DNA Sequence Number=SeqID_65742
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=28%, E-value=1e-108, Identity=43%"; Hit description =Chromo
  Pfam annotation: Domain name=Chromo; Domain location=301-355; Score =23.5; E_value=0.00073; Accession=PF00385.14; Description='chromo' (CHRromatin Organisation MOdifier
  Pfam annotation: Domain name=rve; Domain location=77-206; Score=36.0; E_value=1.3e-07; Accession=PF00665.16; Description=Integrase core domain
  Pfam annotation: Domain name=zf-H2C2; Domain location=18-59; Score =10.8; E_value=0.013; Accession=PF09337.1; Description=His(2)-Cys(2) zinc finger
  Pfam module annotation: Pfam domain module=Chromo::rve::zf-H2C2; Domain location=301-355::77-206::18-59
MMIPLNEALKQKIMHEFHASKIGGHEGVTKSVSRIYKQFYWPKMQQDIRDFVKKCSICQQAKVEQALPAGVLQPLPIPQRIWEDIAMDFITHLPSSHGYSTILVVVDRLSKFARFIPLKAEFTSKSMANAFIVNIVKMHGFPKTIVSDQDHSDGQTEVLNKTLEMHLRRFVFDHPKAWFEMLPWAQFWYNTSFCHSIGMAPFKAVFGRDPPSVIPYECNSKDPPYRQHSVALRKNQKLGMKYFGPFQVVDRIGTVAYKLKLPETSRIHPIFHISALKKFVGSSNQPYLPLPLTVGESGLMVQPIAVLDSRVLLRDSSQVDQVLIQWEIAGPEEATWEDVTWVKASCPHFNLEDKVVYKGEGNVTCGKQEGKLACKSATKEGHVADDLHVGVNTLPVASLILLLIPYSLHLL

SEQ ID NO: 182521 - protein, 87 aa, Glycine max
  Coding DNA Sequence Number=SeqID_65743
MFVLNSALEGFDDNPQSKSKAAARCIVVKCNRQKGSTEYGYYVMHWMSTIILGGFKNNWETYFNNARPLEPKIEGALHPVGKLLFER

SEQ ID NO: 182522 - protein, 206 aa, Glycine max
  Coding DNA Sequence Number=SeqID_65744
MSEAIEEVFHDATHRLCGWHLQKNAFENMKNSSLLRIEEHVATLYTRYIYNKVKVQIVNVSGLNVTPRTEALDKLTKVLQQQRHMHSSDSHAEDDVGDPDVVKTKKGRWDIGCQTRVKDTKEKSAGQKSTKENTKCKGNDKNLSVAKDVNLNSSTLNSSKENKHCGPSSVETKETNAKDVLPSQQNNSFPYSGHSHGISYYNAYGV

SEQ ID NO: 182523 - protein, 47 aa, Glycine max
  Coding DNA Sequence Number=SeqID_65745
MEYMSHVPYAYTIGSLIYVKVCTRLYLAQVVREVILTTLQIEMQDRL

SEQ ID NO: 182524 - protein, 101 aa, Glycine max
  Coding DNA Sequence Number=SeqID_65746
MATMGVVCVLKDRNPCLVLITIARGERERRENERSEGEEKGSELRDPLRERKETFSRKLLNYVTLLLLTATSLSSHRNLSQPLALTHTHNLSFRRIISNWA

SEQ ID NO: 182525 - protein, 72 aa, Glycine max
  Coding DNA Sequence Number=SeqID_65747
  Gene Ontology: Mol. function=receptor activity; Biological process =DNA integration
  Homolog annotation: Hit_ID=Q1SF74; Match level="QueryCoverage=87%, HitCoverage=36%, E-value=7e-17, Identity=62%"; Hit description =Lectin receptor kinase-related
MEMSRSMLNEKGLPNTFWAEVVYTAIYILNRCLTKAVQDKTPIEACNGQKPLAKHLRVFGSLLHACSRPKET

SEQ ID NO: 182526 - protein, 112 aa, Glycine max
  Coding DNA Sequence Number=SeqID_65748
MCKKRANWSGPLPMRAYVGGPYVGRLAHLPIPNFRTDDASSFPHFHFSLFSFQNPLFSRRPPNMSQKNDDLRLIHRWIVMKFKHQVFNSIPSILTVGNFEIMSELGEIHFAL

SEQ ID NO: 182527 - protein, 86 aa, Glycine max
  Coding DNA Sequence Number=SeqID_65749
  Gene Ontology: Mol. function=DNA binding; Cellular component=nucleus; Biological process=regulation of transcription, DNA-dependent
  Homolog annotation: Hit_ID=Q700D9; Match level="QueryCoverage=85%, HitCoverage=30%, E-value=6e-26, Identity=72%"; Hit description =Putative Myb family transcription factor At1g14600
  Pfam annotation: Domain name=Myb_DNA-binding; Domain location=20-71; Score=44.7; E_value=3e-10; Accession=PF00249.21; Description=Myb -like DNA-binding domain
MGSCGREGVVRQYIRSKVPRLRWTPELHRCFVYAIETLGGHYKATPKLVLQLMDVKGLTISHVKSHLQMYRSMKGDRSCRQGTKRC

SEQ ID NO: 182528 - protein, 131 aa, Glycine max
  Coding DNA Sequence Number=SeqID_65750
MAEQKGIKKICVCSIWQQTQPLSTTFPMLPKQESDFLQVAKLNDKHPLNEVGNTWRVGLGAEDEDIEGCELSLSISLPQPHPSSQKSNNASSVSETSEAFSLCPEFSNNYMGCSSSSNVPKTINLDLSLAI

SEQ ID NO: 182529 - protein, 122 aa, Glycine max
  Coding DNA Sequence Number=SeqID_65751
  Pfam annotation: Domain name=RRM_1; Domain location=61-122; Score =7.7; E_value=0.028; Accession=PF00076.12; Description=RNA recognition motif. (a.k.a. RRM, R
MVIDYQRVKTLREKRERETQRVREDPYQNQAGNRNGQRQSYNQANWRGWKDIASFYFTHYPEDATEKELWHHIKKFGDVREVFISKNRNKNDRRYGFARFKDVEDVYILERKLDNIIYGGLK

SEQ ID NO: 182530 - protein, 311 aa, Glycine max
  Coding DNA Sequence Number=SeqID_65752
  Gene Ontology: Mol. function=protein binding; Cellular component =integral to membrane; Biological process=protein amino acid phosphorylation
  Homolog annotation: Hit_ID=Q949G9; Match level="QueryCoverage=99%, HitCoverage=82%, E-value=2e-42, Identity=32%"; Hit description =HcrVf1 protein
  Pfam annotation: Domain name=LRR_1; Domain location=133-154; Score =12.8; E_value=1.1; Accession=PF00560.23; Description=Leucine Rich Repeat
  Pfam annotation: Domain name=LRR_1; Domain location=159-181; Score =7.3; E_value=12; Accession=PF00560.23; Description=Leucine Rich Repeat
  Pfam annotation: Domain name=LRR_1; Domain location=183-208; Score =6.8; E_value=15; Accession=PF00560.23; Description=Leucine Rich Repeat
  Pfam annotation: Domain name=LRR_1; Domain location=210-230; Score =7.4; E_value=12; Accession=PF00560.23; Description=Leucine Rich Repeat
  Pfam annotation: Domain name=LRR_1; Domain location=232-254; Score =9.3; E_value=5.2; Accession=PF00560.23; Description=Leucine Rich Repeat
  Pfam annotation: Domain name=LRR_1; Domain location=256-278; Score =12.8; E_value=1.1; Accession=PF00560.23; Description=Leucine Rich Repeat
  Pfam annotation: Domain name=LRR_1; Domain location=27-49; Score=0.8; E_value=2e+02; Accession=PF00560.23; Description=Leucine Rich Repeat
  Pfam annotation: Domain name=LRR_1; Domain location=280-302; Score =20.8; E_value=0.005; Accession=PF00560.23; Description=Leucine Rich Repeat
  Pfam annotation: Domain name=LRR_1; Domain location=3-25; Score=13.8; E_value=0.61; Accession=PF00560.23; Description=Leucine Rich Repeat
  Pfam annotation: Domain name=LRR_1; Domain location=51-76; Score =12.4; E_value=1.3; Accession=PF00560.23; Description=Leucine Rich Repeat
  Pfam annotation: Domain name=LRR_1; Domain location=78-100; Score =14.7; E_value=0.33; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =133-154::159-181::183-208::210-230::232-254::256-278::27-49::280 -302::3-25::51-76::78-100
MTSLTHLNLSDTGFRGKIPPQIGNLSNLVYLDLRYVAANGTVPSQIGNLSKLQYLDLSGNYLLGEGMSIPSFLGTMTSLTHLDLSDTGFYGKIPPQIGNLSNLVYLDLNLEGYSVSEPPLFAENVEWVSSMWKLEYLDLSNANLSKAFHWLHTLQSLPSLTHLYLSDCTLPHYNEPSLLNFSSLQTLDLSGTSYSPAISFVPKWIFKLKKLVSLQLRGNKIPIPGGIRNLTLLQNLDLSFNSFSSSIPDCLYGFHRLKSLDLSSSNLHGTISDALGNLTSLVELDLSYNQLEGTIPTSLGNLTSLVELDLS

SEQ ID NO: 182531 - protein, 140 aa, Glycine max
  Coding DNA Sequence Number=SeqID_65753
  Gene Ontology: Mol. function=DNA binding; Cellular component =chromatin; Biological process=DNA integration
  Homolog annotation: Hit_ID=Q1SFL1; Match level="QueryCoverage=94%, HitCoverage=12%, E-value=3e-47, Identity=60%"; Hit description =Integrase, catalytic region; Peptidase aspartic, catalytic
MVFVSQIEPRNIDEALYDEHWLLAMHEELNLFKRNEVWDLVPKPIPHKSIETKWVFQNKLDESSIIVRNKAKLVAKGYNQEEGIDYYETYAPIARLFQMDVKSVFLNGYIEEEIYVDQPPGFVDFKHPNHVYKLKKVYMV

SEQ ID NO: 182532 - protein, 150 aa, Glycine max
  Coding DNA Sequence Number=SeqID_65754
MEPEYWDKNPFKAIAKAFPLGFHFKPTAINKTRTFYEFILIDSNSVSIKHFKDPNDPLNIPGADIARRKTTSNIHPFNDMHFSSGGISLMHQRPNQISSSSSSSTSDPRNLNLLTEQDNQTHEVTPKHNLFDEEVRFEEINQNMDDWSIP

SEQ ID NO: 182533 - protein, 154 aa, Glycine max
  Coding DNA Sequence Number=SeqID_65755
MVVLHKLPRGLHSKTLVELSFSKMSDPFFFLVIMDKFEYYSIRKAQKEKVEKTKAEKALEGHGPLGEGPSKRQRLKMVLVAAPSIIESIPTFLTMKEGANVDKVEEKLKIDLDEVEVEILKTHEVGFNKALHKDVTHQGELVREMDMPMKEVFY

SEQ ID NO: 182534 - protein, 63 aa, Glycine max
  Coding DNA Sequence Number=SeqID_65756
MTPLISTTTLLPLVTKSLAFLLVNEEVGSYTSSFLTYESIVEFLKLAEFCHIDRSDVMFVESC

SEQ ID NO: 182535 - protein, 423 aa, Glycine max
  Coding DNA Sequence Number=SeqID_65757
  Gene Ontology: Mol. function=RNA-directed DNA polymerase activity; Cellular component=intracellular; Biological process=RNA-dependent DNA replication
MEKQLHPFVDVIMEAQLPLRWKMLNIDRYDRLLDPDEHVDPFVTQMNLFTNDDAIMCRVFPTTLKDKDRTRDQKRERERIQECSKTRETIKAQHHRNTPLETQLRGVINTIVGGFMRGSSNSARKWHVRNLKMIDSVEGEKKPTRSMPPIIFIDEDFGNIDQCHNNPMVVKIEAANFLIPMFKQDEDKTTFMNNTTNYCYSIMPFGLKNTEATYQRLMDKILTNQLGRNLEVYADDMVVKSRSTTSHAEDIAKIFAKIRKYNMLKYELRGPMKAQCLTDFVIELVANIKPKFEWWKLFEFETKNNQAEHKALLAGLRLAKEVGAKYLKCWSDSKLITGKLNGEYHIKDPQMTRYYHMATQLKKAFFKFEILHIAIENNDLDKVVASVTPIDREWTEIRDILEKGSLPEIQQRQESSKGMPTIM

SEQ ID NO: 182536 - protein, 315 aa, Glycine max
  Coding DNA Sequence Number=SeqID_65758
  Pfam annotation: Domain name=PPR; Domain location=214-248; Score=5.8; E_value=1.5; Accession=PF01535.11; Description=PPR repeat
  Pfam annotation: Domain name=PPR; Domain location=69-103; Score=17.6; E_value=0.044; Accession=PF01535.11; Description=PPR repeat
  Pfam module annotation: Pfam domain module=PPR::PPR; Domain location =214-248::69-103
FLIYHRCPRPQPVEPPLTEETGTSSLAPIIHPVAVDSDLSITIHKASGKMEKAKQVVLDPIIPNKSLNEIKSVLVSALASHGQLSEALLVYEEIKKAGHNLRPKAVITLIEELTKFNGELDGLLLLLEEISDLDYWVDGCFKVIMYCIRNKNLSSAIVLFKQLKDKFKNDEIVTEALFDAVFSLIAVSEFTHLQIGLDLLWAIKDELGLMASRQCLDFLLSACANAGDLNNARLIWREYEVAGFPYNVLSYLRMYQALLAAGDDTSAHLILKKIPQDDAEICSVIIACQETYNGLNSVEEKKKQGKKRKKKKSKT

SEQ ID NO: 182537 - protein, 113 aa, Glycine max
  Coding DNA Sequence Number=SeqID_65759
MQNSGVTLRAESQHFASVHDANPCVASIPYFGFMDEIWELNYVKFTVCVFKCKWVDSNTMYLINCFMEKQSSPKQGKLPGNHIINETSKRVGLHPQKETTPEYLAFHRFKQKT

SEQ ID NO: 182538 - protein, 112 aa, Glycine max
  Coding DNA Sequence Number=SeqID_65760
  Homolog annotation: Hit_ID=O24515; Match level="QueryCoverage=90%, HitCoverage=9%, E-value=3e-31, Identity=71%"; Hit description =Unconventional myosin
MRYVQSSLSIAKKSLAMDDSERNSNASINASDDRDFSWDVGTNHQRQESNGARLMSATLSVISRLAEEFEQRSQVFGDDAKFLVEVKSGQVEASLNPNREVKFEQVESSCEG

SEQ ID NO: 182539 - protein, 307 aa, Glycine max
  Coding DNA Sequence Number=SeqID_65761
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=46%, HitCoverage=14%, E-value=9e-54, Identity=74%"; Hit description =CHASE; Lantibiotic regulatory protein
  Pfam annotation: Domain name=HATPase_c; Domain location=3-103; Score =43.3; E_value=8e-10; Accession=PF02518.16; Description=Histidine kinase-, DNA gyrase B-, and HSP90-like ATPase
MNGKIEKFRGSDKPMHMSGASESYEQVTLMVSMEGTGIGIPFLAKDRIFMPFVQADNSTSQHYGGTGIGLSFSKCLVKLISGEISFISQLQVGSTFSFTVDFGTIDKNAITDMKKHNLEDLPPNFRWLKAIVVDGKPVRASVTGYHLKRLGIQAKVANIMNKVAKCKVLQEQYDIESIAQHGVELLYATMTKIFSSLQEPCKETNAVNATMLEVVLVRRTLAWVTRIILLISILMGVCINKRAISLLCERGHFCSSEVKEETKGHVSHVGSGIVHITIKVVRVGIWFGHRSGTLYFQVSAFWLLLLL

SEQ ID NO: 182540 - protein, 337 aa, Glycine max
  Coding DNA Sequence Number=SeqID_65762
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=87%, HitCoverage=35%, E-value=1e-113, Identity=63%"; Hit description =CHASE; Lantibiotic regulatory protein
  Pfam annotation: Domain name=CHASE; Domain location=80-291; Score =171.3; E_value=2.5e-48; Accession=PF03924.4; Description=CHASE domain
MKLLIKFPTKCTFIQAHRAWLPKFLVLWILLMALIGCFIYKVLGSLCDQRARMLQDQFSVNVNHVHALAILVSTFHYYRTPSTIDQSIQLGQHLNDHYSMGVAYAQRVVNSERGTFEKQHGWVIKTIEREPSLVRDEYAPMIFAQETISYLESLDMMFRDMQEDRENIFMARATRKVVLTSPFNLLGSHHLGVVLTFPVYKSKLPPKPTMEECIKATVGYVGGSFDVESLMENLVGQLTGHEAILVNVYDIKNSTNPLIMYGNQNKEDDMSLVHETGNHIVKVKDDFHQMEELKVRAEVANVAKSEVLFPGILLAQFISSFDYSPITKTSFSFNVSF

SEQ ID NO: 182541 - protein, 156 aa, Glycine max
  Coding DNA Sequence Number=SeqID_65763
  Gene Ontology: Mol. function=actin binding; Cellular component =nucleus; Biological process=cytoskeleton organization and biogenesis
  Homolog annotation: Hit_ID=Q94HU9; Match level="QueryCoverage=99%, HitCoverage=25%, E-value=4e-36, Identity=47%"; Hit description =Putative transposable element
  Pfam annotation: Domain name=Transposase_21; Domain location=47-156; Score=-36.2; E_value=1.6e-11; Accession=PF02992.5; Description =Transposase family tnp2
MFPEENTLPKNHYEAKKILCPMGMEYQKIYACPNDCILYRSQFAKIHKFPTCGVSWYKVKDDECSDDATTNNSHPTNLFIKRKYNMLYMMIAGSRQPGNDIDVYLTPLIKNLRKLWEDGVDLWDRNLKQTFRLHAMVFCTINDFPAYGNLSGYSGK

SEQ ID NO: 182542 - protein, 65 aa, Glycine max
  Coding DNA Sequence Number=SeqID_65764
MIKIPKGVQNVPPEFDKLHINVFYLIEQMNNVVTKARRIPAANSERTTSQDVACCFGVGCAEWTS

SEQ ID NO: 182543 - protein, 457 aa, Glycine max
  Coding DNA Sequence Number=SeqID_65765
  Gene Ontology: Mol. function=RNA-directed DNA polymerase activity; Cellular component=nucleus; Biological process=RNA-dependent DNA replication
MHILEQPNEEIEDALNGISDLKSPGVDGYSSKFFKSCWNIVKKDVVNAAQEFFAQDQLFLPFNQTVVTLVPKSDNASTVKEYRPIAVCTTFYKILSKILTARLNKVLPSVVSLSQAAFIPGQVIHNHIMLAYELLNGYARKGGTPRTMIQLDLQKAYDMIDWFSLETVLRELGIPGRFISWLLIMLKTVTYIFNINGDLSDVMQAKRGIRQGDPISPLLFVVMMEYLNRLLVKLQLDPNFNHHAKCEKLGITHLTFADDVLLFCRGDVMSVEMMLHVINKFSATTGLVVNPNKCRIYFGGVDGTTKNKIQQISSYEEGQLPVRYLGVPLTSKKLNIKYYLPLIDKITTRIRHWTSKLLSMAGRVQMVNCTITAIVQFWMQCLPIPMSVIKKIDSMCRSFVWSGSTEITRKSPIAWNSVCRPKGQEGLNIFNLKVWNHITMLKCLWNLCKKADNLWVK

SEQ ID NO: 182544 - protein, 475 aa, Glycine max
  Coding DNA Sequence Number=SeqID_65766
  Gene Ontology: Mol. function=sequence-specific DNA binding; Cellular component=nucleus; Biological process=regulation of transcription, DNA-dependent
  Homolog annotation: Hit_ID=Q9M7S0; Match level="QueryCoverage=98%, HitCoverage=67%, E-value=1e-123, Identity=52%"; Hit description =Homeodomain protein
  Pfam annotation: Domain name=POX; Domain location=267-390; Score =225.8; E_value=9.4e-65; Accession=PF07526.2; Description=Associated with HOX
MSQDFQQGIFSFPNGLERGRLVSPQQQIRRDKVRFEAAAPLVGIEEEEPVYETAGMLSEMFNFPPATELLEQQHATATFRAARQAGEWYGNRQQQQQISGINADSAAAMQLFLMNPQTRSPSPPQTHATPSSTLHMLLPNPSSNSSLQGFTGSAAGGSFGQFTWVPESAHQQGGVVEGQGLSLSLSSSLEAAKAEELRMGDSGFLYYNHQQGGGGGGGSSSSSAVQFQYKNNNNNHHQALHLQGAMGHDNNHQGHVGFGSSSLGVVNVLRNSKYAKAAQELLEEFCSVGRGQFKKSKFNRQNSNPNSNAGGGASPSSKDAPPPPPLSAADRIEHQRRKVDRRYNHYCEQMQMVVNSFDLMMGFGAAVPYTALAQKAMSRHFRCLKEAITAQLKQSCEVLGEKDGAGNSGGLTKGETPRLKMLEQSLRQQRAFHQMGMMEQEAWRPQRGLPERSVNILRAWLFEHFLHPYVIPSIA

SEQ ID NO: 182545 - protein, 505 aa, Glycine max
  Coding DNA Sequence Number=SeqID_65767
  Gene Ontology: Mol. function=oxidoreductase activity; Cellular component=membrane; Biological process=electron transport
  Homolog annotation: Hit_ID=O81974; Match level="QueryCoverage=99%, HitCoverage=100%, E-value=0.0, Identity=82%"; Hit description =Cytochrome P450 71D8
  Pfam annotation: Domain name=p450; Domain location=34-497; Score =356.7; E_value=3.7e-104; Accession=PF00067.12; Description =Cytochrome P450
MEHSQLSIVITFFVFLLLLRLVKNHKPKSSHKLPPGPWKLPIIGNLHQVALAASLPHHALQKLARKYGPLMHLQLGEISTLVVSSPKMAMEIMKTHDLAFVQRPQLLAPQYMAYGATDIAFAPYGEYWRQMRKICTLELLSAKRVQSFSHIRQDENRKLIQSIQSSAGSPIDLSSKLFSLLGTTVSRAAFGNKNDDQDEFMSLVRKAVAMTGGFELDDMFPSLKPLHLLTGQKAKVEEIHKRADRILEDILRKHVEKRTRAKEEGNNSEAQQEDLVDVLLRIQQSGSLEVQMTTGHVKAVIWDIFAAGTDTSASTLEWAMAEMMKNPRVREKAQAVIRQAFKGKETIRETDLEELSYLKSVIKETLRLHPPSQLIPRECIKSTNIDGYEIPIKSKVMINTWAIGRDPQYWSDAERFIPERFDGSYIDFKGNSYEYIPFGAGRRMCPGMTFGLASITLPLALLLYHFNWELPNKMKPEDLDMNEHFGMTVGRKNKLCLIPTVYQAT

SEQ ID NO: 182546 - protein, 226 aa, Glycine max
  Coding DNA Sequence Number=SeqID_65768
  Gene Ontology: Mol. function=zinc ion binding
  Homolog annotation: Hit_ID=Q5SMM0; Match level="QueryCoverage=29%, HitCoverage=14%, E-value=6e-10, Identity=46%"; Hit description=LIM domain containing protein-like
  Pfam annotation: Domain name=UIM; Domain location=186-203; Score =11.8; E_value=0.73; Accession=PF02809.10; Description=Ubiquitin interaction motif
  Pfam annotation: Domain name=UIM; Domain location=42-59; Score=16.8; E_value=0.077; Accession=PF02809.10; Description=Ubiquitin interaction motif
  Pfam module annotation: Pfam domain module=UIM::UIM; Domain location =186-203::42-59
MGWFTKLLKGSDHKILRGQYHGKYGEDRIWDNHHSSMDDLTDIEKEDIDRAIALSLSEEDHKGKKVVESACVNQLIISTPKHNQKVSCFLSHNTLHYDSQSEDEELCKIDDDEEDEHLVKVHLDEDERLAKIQQEEEERLAKIQQEDEHLAKIQQEEEERLAKIQQEDECLAKIQQEDERLAKAQLEEDEQLARAIQESLKIGSPPQYDNGSSILSFPHLFPPGYR

SEQ ID NO: 182547 - protein, 87 aa, Glycine max
  Coding DNA Sequence Number=SeqID_65769
  Subcellular localization annotation: CTP_CleavageSite=46; ConfidenceScore=5.12e-01
MQVSSPGRAELAWASNPYTKWVKKGKGEGFCTKNSSPPPPPSFKKKAMGITNFAAHRSSFFTFLIPFCSIIHLQQHEVPYKMLGWVA

SEQ ID NO: 182548 - protein, 45 aa, Glycine max
  Coding DNA Sequence Number=SeqID_65770
MWALDRNIDACTVHDAPISVAISVIHKQSDQTSAVKLKTALSECA

SEQ ID NO: 182549 - protein, 108 aa, Glycine max
  Coding DNA Sequence Number=SeqID_65771
MMMEALFEETEKERKGITLKVNSSKEEYKDNSSSEEDEVQRQKILQVNNLRRWKISLENMVKRKERRPKNVEAKLHDESKVIQRCFDDNNDDDKGDEQKAQKIKEQLK

SEQ ID NO: 182550 - protein, 145 aa, Glycine max
  Coding DNA Sequence Number=SeqID_65772
MTDHSLSSPKVIIVTKKNECALRHPYRTRARARIMSEVEEVQEQMKADMEAKKDQMATMMEAMLSMKRIMESNATAVATTSATAEVDPTHLSGINQMSRPVLNVVGQGGEALGSMGGPHVVQSKNSLLLYGLPPNYTPPNVVHQC

SEQ ID NO: 182551 - protein, 221 aa, Glycine max
  Coding DNA Sequence Number=SeqID_65773
  Homolog annotation: Hit_ID=Q1SU58; Match level="QueryCoverage=34%, HitCoverage=10%, E-value=4e-13, Identity=59%"; Hit description=IQ calmodulin-binding region; Myosin head, motor region; Prefoldin
MVTNNSKECDEGSAILYRTIDSSTMAFNSQVRSFTFNSLFGQKYLGTSSSTWDLCCNRKEYRSIKLKTIHQLHRSRKFNLKNRTRPFTNCFGAECLSRNNRTRPFNNRSGAESSCRKNRTRTFSNCSRAESSSRKIAADHEVVVAEKMQVQPRVIADNMTSQIKNLDNGSPTEEEWQARKEPRAPVFLLTKQRSVTDRYRWPQEIFVKAYEMELGSQNYTN

SEQ ID NO: 182552 - protein, 158 aa, Glycine max
  Coding DNA Sequence Number=SeqID_65774
  Gene Ontology: Mol. function=monooxygenase activity; Biological process=electron transport
  Homolog annotation: Hit_ID=Q6Z2B6; Match level="QueryCoverage=97%, HitCoverage=20%, E-value=5e-14, Identity=27%"; Hit description =Pentatricopeptide (PPR) repeat-containing protein-like
  Pfam annotation: Domain name=PPR; Domain location=11-45; Score=24.8; E_value=0.00032; Accession=PF01535.11; Description=PPR repeat
  Pfam annotation: Domain name=PPR; Domain location=46-80; Score=34.8; E_value=3.1e-07; Accession=PF01535.11; Description=PPR repeat
  Pfam annotation: Domain name=PPR; Domain location=81-115; Score=27.1; E_value=6.3e-05; Accession=PF01535.11; Description=PPR repeat
  Pfam module annotation: Pfam domain module=PPR::PPR::PPR; Domain location=11-45::46-80::81-115
MVKKDVCFDSVTCNILAKGYCRIGLVQYAEWIMGNLVGGGVPLDVVGLNTLVDGYCEAGMMSRALDLVEDGRKNGVEPDIVTYNTLVNGFCMRGDLAKAESVVNEILGFGRDGESGLLNECRVETRDGIRDLQPTVVTWTTLIAAYFLFSMGFADMVN

SEQ ID NO: 182553 - protein, 113 aa, Glycine max
  Coding DNA Sequence Number=SeqID_65775
MGLRGRDQNRIFLDVGGESSSDGYQRVEEGSGRGGGENEHMGLLALEVLKFSCTLLWRGGVDYGGNGRGTTKKRLLPRYVIFILNPQFPTFGLHDQRQRPRVYEATFGHNFVC

SEQ ID NO: 182554 - protein, 345 aa, Glycine max
  Coding DNA Sequence Number=SeqID_65776
  Gene Ontology: Mol. function=transferase activity, transferring hexosyl groups; Cellular component=mitochondrion; Biological process= metabolic process
  Homolog annotation: Hit_ID=Q1SQX3; Match level="QueryCoverage=99%, HitCoverage=75%, E-value=5e-45, Identity=30%"; Hit description=IMP dehydrogenase/GMP reductase
  Pfam annotation: Domain name=PPR; Domain location=152-186; Score =42.9; E_value=1.1e-09; Accession=PF01535.11; Description=PPR repeat
  Pfam annotation: Domain name=PPR; Domain location=187-221; Score =36.9; E_value=7.2e-08; Accession=PF01535.11; Description=PPR repeat
  Pfam annotation: Domain name=PPR; Domain location=222-256; Score =35.3; E_value=2.2e-07; Accession=PF01535.11; Description=PPR repeat
  Pfam annotation: Domain name=PPR; Domain location=257-291; Score =39.2; E_value=1.4e-08; Accession=PF01535.11; Description=PPR repeat
  Pfam annotation: Domain name=PPR; Domain location=30-63; Score=3.1; E_ value=3.3; Accession=PF01535.11; Description=PPR repeat
  Pfam annotation: Domain name=PPR; Domain location=304-338; Score=0.1; E_value=7.3; Accession=PF01535.11; Description=PPR repeat
  Pfam annotation: Domain name=PPR; Domain location=64-98; Score=42.8; E_value=1.2e-09; Accession=PF01535.11; Description=PPR repeat
  Pfam annotation: Domain name=PPR; Domain location=99-133; Score=40.0; E_value=8.3e-09; Accession=PF01535.11; Description=PPR repeat
  Pfam module annotation: Pfam domain module=PPR::PPR::PPR::PPR::PPR::PP R::PPR::PPR; Domain location=152-186::187-221::222-256::257-291::30 -63::304-338::64-98::99-133
MDGYFKEGNESAALSIVQEITEKDVQFDVVAYNALTKGLLRLGKYEPKSVFSRMIELGLTPDCVTYNSVINTYFIQGKTENALDLLNEMKSYGVMPNMVTYNILIGGLSKTGAIEKAIDVLREMLVMGLRMTKKANVVLREMATKGISADIVTYNALIRGYCTSSHADKAFSTYSQMLVDGISPNITTYNTLLEGLSTDGLMRDADKLVSEMRGRGLVPNATTYNILVSGHGRVGNKRDSIKLYCEMITKGFIPTTGTYNVLIQDYAKAGKMRQARELLNEMLTRGRIPNSSTYDVLICGWWKLSCQPEMDRLLKLSYQNEAKILLREMCEKGHVPSESTLMYIS

SEQ ID NO: 182555 - protein, 87 aa, Glycine max
  Coding DNA Sequence Number=SeqID_65777
MGHFCFAKNPIPCAVDRVDGDNLLPSPPPDLILAAAAAAAAAAEFLLVVLSPPLTLCMYKVNLVLCRLKLIKDRQHVPAKFSGTPCR

SEQ ID NO: 182556 - protein, 35 aa, Glycine max
  Coding DNA Sequence Number=SeqID_65778
MAPKECTSLKGQHLNQQEVLAPAGPPFVAFDFTSK

SEQ ID NO: 182557 - protein, 1077 aa, Glycine max
  Coding DNA Sequence Number=SeqID_65779
  Gene Ontology: Mol. function=RNA-directed DNA polymerase activity; Cellular component=chromatin; Biological process=chromatin assembly or disassembly
  Pfam annotation: Domain name=RVP_2; Domain location=451-560; Score= -43.5; E_value=0.0024; Accession=PF08284.2; Description=Retroviral aspartyl protease
  Pfam module annotation: Pfam domain module=RVP_2::RVT_1::Retrotrans _gag; Domain location=451-560::685-854::211-301
MVHKVADLRLTMWKPPNEIALNVGGSVHGDPQTAGYGGLSQDLLAFKPLMMLTPSTPPWIALLQGQLAPRSLPRIRASLSLSPLPFFLLPPSRHHDHNKWSDLPPRPLPWLITGPETTTDRLEDAIARLSTSQANLNERYTDLSGKVDSILDHLRLRDTHQSQSSVNTMNSHRNSVKLDIPRFDGRDPLGWSFKMNQLFQYQNTSEEEKITVASLYLNDAALSWYQWMHNNGLITSWQAFLEALESRFAPTFYDDPKGALFKLVQRGSVNDYLTDFERLANRVIGLPPPFLLSCFISGLNPELRREVLALQPISLLQATALAKLQEDKLRDRRTLMPRPYPPSSAPTNLTSKPKAPYVQRTPEEMAFCREKGLFYNCNDKWSSNHHCKGRILLFVADDSVPDSGEPEAIIPSSSSDTTISDLDLTTETTPPHISLHAMSGLPSSETFRVYDTIRNACITVLIDSGSTHNFLQPRVAHFLHLPIESTHPLRVLVGNGFMLDCDKRCPNTQLSIQSHSFSINFHLLQIRGADVVLGIEWLKQLGPITTDYTSFLMRFTHMGQEISLQADVATGPEPASVAQVKHMIHTGSTSALFHLCLLSETPTGTTTHPPPIITPIANLLLRYDKLFQPPRSLPPSREVNHRITLLPATAPVNVRAYRYPHFQKAEIERQIAELLSAGLIRSSTSPYSSPVLLVKKKDGTWRICVDYRSLNVVTVRDRFPIPTIDEVLDELDQASWFTKLDLRQGFHQILMNEADIEKTAFRTHHGHYEYLVMPFGLCNAPSTFQSAMNHLLAPFLRRFAAVFFDDILVYSNSLSSHVHHLELIFQALLRGEFYLKQAKCLFAQRELEYLGHIVSAKGWPTPATAKELRAFLGLTGFYRKFVQRYAAIATPLTNLLCKDAFEWSIESQEAFDKLKAAMTSTPVLALPNFNEPFVVETDASGTAMGAVLNQQGHPLAFFSKNFNPRLLNASTYVRELHAITSEVRKWRQYLLGSPSTIFTDHKSLRELMTQVPQMLLRMHSLAGQLLVLSVPQFDFLREIQQTLEHDFDFQTLRDKVQHDPSSYPQYRVHNGYLLFND

SEQ ID NO: 182558 - protein, 161 aa, Glycine max
  Coding DNA Sequence Number=SeqID_65780
  Homolog annotation: Hit_ID=Q1W621; Match level="QueryCoverage=42%, HitCoverage=10%, E-value=3e-17, Identity=64%"; Hit description =Polycomb group protein EMF2
SVEPHVKEKPATTVNRTCLEVGHQFCKKSLSHVHIQFDDQLRPVIPPVFGLIGLYEPHWSRADVASRFHDAVRATMIMAMFSGCAMFSFAFWVRERPMALEQVLSDRDSEDEVDDDIADLEDRRMLDDFVDVSKDEKQLMHLWNSFMRKQRVLADGHVPWA

SEQ ID NO: 182559 - protein, 152 aa, Glycine max
  Coding DNA Sequence Number=SeqID_65781
  Subcellular localization annotation: CTP_CleavageSite=75; ConfidenceScore=5.16e-01
MVYHPLHNNIAYFLSVIIINDGHPKQKIVLSQPPPATISRPTSNRRTQIPCRCTTTRLSRTTTLLYVGIAIFVIQFMVRKEYRRAKQRLYHHEMQRGWLRPRRKRRRRKDTRRKTSISLDHFCSCSSATSNVHNDDDDNLKGFFLELHPARS

SEQ ID NO: 182560 - protein, 128 aa, Glycine max
  Coding DNA Sequence Number=SeqID_65782
  Gene Ontology: Mol. function=structural constituent of ribosome; Cellular component=ribonucleoprotein complex; Biological process =translation
  Homolog annotation: Hit_ID=Q9ZPX2; Match level="QueryCoverage=72%, HitCoverage=91%, E-value=5e-45, Identity=91%"; Hit description =Putative ribosomal protein L6
  Pfam annotation: Domain name=Ribosomal_L6; Domain location=38-115; Score=99.9; E_value=7.5e-27; Accession=PF00347.13; Description =Ribosomal protein L6
MAMIILVNYRCLSRNYGIKPHIGLALMEAKFFRFLKIVGVGYKARAEAAGRLLYLKLGYSHEVELTVPPAVRVFCFKNNVICCTGIDKQRVHQFAATVRTCKPPEVYKGKGIMYVDEVIKKKQGKKSK

SEQ ID NO: 182561 - protein, 124 aa, Glycine max
  Coding DNA Sequence Number=SeqID_65783
MEALSLKSQTEERKNVKELFETIGIPYEAAFGSPDMKGFMKTPPSKKTLFSDLTANKDQSRRNQASAMKSFEPETARRRRDSLDQFCSYKYAKELSRQIEENSVVIGKRKGNKNKEKVGKVERQ

SEQ ID NO: 182562 - protein, 640 aa, Glycine max
  Coding DNA Sequence Number=SeqID_65784
MVRGHSTETKDLAAEKSTVQKFDLISNSENKPTLLWKLPQNPSIPTYSTTETPSMKIKSSEMPFPNSKMTMASSSTTGDKLSSSFTPESWGKDFPSSGSHLSTISAPSTFLGKVTEFHVDKSLPKENIPAVPTFGGSFKSLSFPTIKTSPSPSSSSVSSAAVSVASSSLTSSNTSTDSNRVMSSSSTSAFLHLSNQAPKDTVPSLPNPPGLKLTLESLKSEIPPAAALKSDMQPAAVSNSKTVLDASAEVVTRPNEPLNGASELKLGPSRNYSPTIEQPFNNTTSSDLNVVSVSQAAQPSDASLQLSTSFLSSASVSNGKNEGLDFGISHEDEMEEEAPETSNNTTELSLGSFGGFGISSSPNPSMPKTNPFGGSFNNVGTSLSSSTVTFSVPSGELFKPASFNFSSPQSSSPTQTTNSGAFSGGFNAVAAVPAQAPGGFGQPAQIGSGQQVLGSVLGGFGQSRQLGSGFAAPSGFGGGFAGSSSPSGFSNTAIGGGFAGIASTGRGFGSVASTGSGGFSGIASGGGFGGGAAPGGGFGGAAAPGSGFGAAAAPGGGFGAAATPGGGFAGAAAPGVGFGAASSTGGFAGAGSGGGFGAFSSQGSGGFGAFGSVKMIGKLKLSLYCETPQRNYARTTTTIS

SEQ ID NO: 182563 - protein, 142 aa, Glycine max
  Coding DNA Sequence Number=SeqID_65785
MVKEECKEVSVSSKRLAKKENHFTIKKNIKETSPLRKPPHFLLCKKILVSIATPLGLEFIPQVKELLDEGLVRKSLNLCALVGLISDQRVPMNPKRIKVIPEWPTPPSVEDKSPKFQEPRDLRSNPFQGGENDAILSRKSIG

SEQ ID NO: 182564 - protein, 196 aa, Glycine max
  Coding DNA Sequence Number=SeqID_65786
  Homolog annotation: Hit_ID=Q8S912; Match level="QueryCoverage=48%, HitCoverage=4%, E-value=1e-25, Identity=63%"; Hit description =Microtubule bundling polypeptide TMBP200
  Subcellular localization annotation: CTP_CleavageSite=21; ConfidenceScore=5.67e-01
MRLFFYNQRLTSLSLFFYNSRLTSRSARTFSTRNRRKMQVTNELLMNNSYWAKRVFLLADIKGFLTDVKPALLSALDTEYEKNPFEGASAVTKRTVKAKDSSSTVVAGGLDSLPREDISGKISPTLLKSLESPDWKAYAKNHNDTKLLVEVMRLLKKNDLPLQLGTTDIVFSICYNTDDWELINKYPAFVLKSFQV

SEQ ID NO: 182565 - protein, 82 aa, Glycine max
  Coding DNA Sequence Number=SeqID_65787
MSEGRGREGARNFVPQMSGSGQNIDATGGGNDNNDCVGRDINSGSDGNYEGDNNNSSDDGGHNDNVVMAAMTIMIVRSHFSE

SEQ ID NO: 182566 - protein, 200 aa, Glycine max
  Coding DNA Sequence Number=SeqID_65788
MAKARAAVKELKVFLVCDSAEEMKKRLDKLFLVLILRSLRSDYDHVHDQILSGDQNPSMNSLVTRLLHIPTLVKGENAAAAVGTSAMVASHGIGRGGCGNRGGGHGGRGGHACLSQSMEGQGPWIVDSGASNHNSCNNSDEEYQEYLRLKSSSQAQSSLQYQVFQQHAFLNLWKFKNHGTGRLIGVGHESRDLYHLLLHL

SEQ ID NO: 182567 - protein, 92 aa, Glycine max
  Coding DNA Sequence Number=SeqID_65789
MDNVDAVDWGLKGSFVAVASKSVLSILSTKFEERVSISLSFRSWIGDFAADGSIKAVLDQGGRYKVNDFSEYSRDLDSAPLSKSLIFSQMTS

SEQ ID NO: 182568 - protein, 427 aa, Glycine max
  Coding DNA Sequence Number=SeqID_65790
MHLSKFVNSLFPENGDDNLLLGLCIDNVSIYQKVGVQIDVEERTELLPHCVLICLTLEGKLVMFHVASLAGCKTSPEIDSVLHNDEDTSVNLHEDEGCTLPQGLQKQESDKTFEVSGNLTAKPSGNPQQITRTDTNYTEVELVGNSESLKSNVQQVVPDVDAIQNTGNQNPFLPGEQQKNLGQKTATLGTSIGSLMVNSHSVSSGLSSYNNLQSTTEKTRELWTANSSRDSQRASLPGETFSFPKKYDVSSISASSYADGVGFQNKKYTMGATNVPGSMGGKPILVQDVNDVSPAIDSASRLVQSGGQLSTLVAGNMQPILNSSSRFSSDGNIAAVKSSARKFLPSNEQHGTPSKLGIFGSDLSKQFGNINEMTKELDLLLKSVEETGGFRDACTRSLRSSIEAVEQGMDALSKKCKILTVMFLYSF

SEQ ID NO: 182569 - protein, 339 aa, Glycine max
  Coding DNA Sequence Number=SeqID_65791
  Gene Ontology: Mol. function=nucleic acid binding; Biological process= DNA integration
  Homolog annotation: Hit_ID=Q1RTN7; Match level="QueryCoverage=94%, HitCoverage=76%, E-value=7e-31, Identity=36%"; Hit description =Peptidase aspartic, catalytic
MFILEKTLRFHSSPFLNWKNYHTWVKWKKRALIFMNKWKFLDGSLVPNRFDPSYDAWERCINQIHSWIVNSVSSLIAQNCNKNCIHSSKRQNGLDEGDQNQVDINAADGNRFYKGKNSGGKVCTYCGKTWHTIESCFRKHSFPLASKPKGYGSAVNNITGDGDDPDEKLEGGYVSKKNSPVSGLANEECRTLLNLLQKTNIQRSTVADPQSVQVNQACVGSPIPWLNEGTDCAFSCSIVKGNQLWIMDSEVTGHICTSMDWFESYRKINHIPESLPNGSVVMAQLAGDVKFSDTLILRYALFLPEFNINLVSISKLTKAAQCNLISHLLKMSVQFRIQR

SEQ ID NO: 182570 - protein, 156 aa, Glycine max
  Coding DNA Sequence Number=SeqID_65792
  Gene Ontology: Mol. function=sugar binding; Biological process =protein amino acid phosphorylation
  Homolog annotation: Hit_ID=Q0ZCC5; Match level="QueryCoverage=91%, HitCoverage=7%, E-value=5e-12, Identity=33%"; Hit description=CCHC -type integrase
MELCVFNDLGLGGRFQLHFQNGVLLLSPLSWPTQLRNRYYYRIDASHSPSRLVFDELGNIYVETVNGTRIQPQGPTWGNSSLDPKGYYYRATLEFNGVFTQYAHPRSNNAYQGWTIMRFVPDNICTAIFNDNGSSSCGYNSYCSTENNRSTCKCPY

SEQ ID NO: 182571 - protein, 774 aa, Glycine max
  Coding DNA Sequence Number=SeqID_65793
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=90%, HitCoverage=35%, E-value=1e-165, Identity=45%"; Hit description=CCHC- type integrase
  Pfam annotation: Domain name=B_lectin; Domain location=74-180; Score =70.3; E_value=6.2e-18; Accession=PF01453.15; Description=D-mannose binding lectin
  Pfam annotation: Domain name=Pkinase; Domain location=498-758; Score =106.6; E_value=7.1e-29; Accession=PF00069.15; Description=Protein kinase domain
  Pfam annotation: Domain name=Pkinase_Tyr; Domain location=500-758; Score=53.1; E_value=9.9e-16; Accession=PF07714.7; Description =Protein tyrosine kinase
  Pfam module annotation: Pfam domain module=B_lectin::Pkinase::Pkinase_ Tyr; Domain location=74-180::498-758::500-758
MEKKISCYLQTQLIFRVEEYVTLFAKVELNKPLTTDDNNAWRSASGEFAFGFRQLNNDTKLFMVAIWYNMMPGDQTVVWSAKRGYKLATAPTGSRIQITSEGLVLTGPKGDSIWIANSKDIVSEGAMLDSGNFVLLNGNSEHVWQSFDYPTDTLLPNQSLQLGGVLTSRLTDTNFTTGRFQLYFHKGDSHVLLCPLGWPSQLRYESYHTIDDSGNASQLVFDKSGDIYVETTNGTRIQPQGSTWGNSNLDLDRNYYRATLDFTGVFTQYAYPRNSTIAQPGWKIIRYVPGNICEAVNQYGSGCCGYNSYCSMENQRPTCTCLYGYSLVDPSNPFGGCQLNFTLTCGADVQAPPDELYEMHEFKNFNFPLADYEKIQPYTRQECQQACLQDCMCALAISGDFCWKKRLPLVNGREVNVTNRHFAYVKTRVRGYFYPDSNGELLQLGGVLNSFAYPEFFGDHLLLPLSLTPKLKKVVQASSLLETNLHSFSYEALKEATWGFSEELGRGSCGIVYKGKLEAATSCNLIAVKRLDRLTQEREKEFRTELSAIGKTCHKNLLLVYEFMSNGTLADILFGQSKAPIWNTRVRLALGIARGLLYLHEECDSAIIHCDIKPQNILIDEHFNAKISDFGLAKLLLFDQSRTNTMIRGTRGYVAPESFKNVAVTVKVDVYSFGVMLLEMICCRRSVMTMEAGEEEKAILTDWAYDCCVEGKLHDLVENDKEALSDIGRLEKWIKIAIWCIQEHPEMRPTMGKVNQMMEGLVEVPNPPSPNPDV

SEQ ID NO: 182572 - protein, 91 aa, Glycine max
  Coding DNA Sequence Number=SeqID_65794
MMPDREEIFIYINIQHNNNKYLIEKALNRVKPNVARDRSRKRRIIGGKSQCANPPNRNIDETQLLHWRATSLVLKLLRGINKVLRLCNEKT

SEQ ID NO: 182573 - protein, 93 aa, Glycine max
  Coding DNA Sequence Number=SeqID_65795
  Gene Ontology: Mol. function=protein serine/threonine kinase activity; Biological process=protein amino acid phosphorylation
  Homolog annotation: Hit_ID=Q39202; Match level="QueryCoverage=97%, HitCoverage=10%, E-value=4e-13, Identity=41%"; Hit description =Receptor-like protein kinase precursor
FGVMLLEIIRCTRSALMVDSGEEEKTILTDWASDCHMEGRIDALVENNEEVLSDNGRLQKWVKIALRCIHEQPEMGTTMGMVMQMLEGFVQVP

SEQ ID NO: 182574 - protein, 205 aa, Glycine max
  Coding DNA Sequence Number=SeqID_65796
  Gene Ontology: Biological process=protein targeting
  Homolog annotation: Hit_ID=Q9LVS8; Match level="QueryCoverage=75%, HitCoverage=63%, E-value=2e-55, Identity=64%"; Hit description =Similarity to EREBP-4
  Pfam annotation: Domain name=DUF862; Domain location=6-150; Score =147.5; E_value=3.6e-41; Accession=PF05903.5; Description=Eukaryotic protein of unknown function (DUF862)
MGGLASYGHERLYTLGVNEDGRRRIGMEREGMAIELERTISPEQIVDKELGSHEYPSSGVFEVEPRSCPGFIFRRSVLLGSTDMSNSEFRAFIEHLSAKYHGDTYHLIAKNCNHFTDEVCQHLTGSPIPGWVNRMARVGSFCNCLLPESLQVAAVRHLPERLAFDDDDGSASDGLSASLEGEEDESNHHLLTGPNGDVAFLKEKP

SEQ ID NO: 182575 - protein, 345 aa, Glycine max
  Coding DNA Sequence Number=SeqID_65797
  Gene Ontology: Mol. function=manganese ion binding; Cellular component=cytosol; Biological process=response to other organism
  Homolog annotation: Hit_ID=Q8L7W2; Match level="QueryCoverage=76%, HitCoverage=77%, E-value=5e-91, Identity=59%"; Hit description=Nudix hydrolase 8
  Pfam annotation: Domain name=NUDIX; Domain location=195-310; Score =22.3; E_value=0.0012; Accession=PF00293.18; Description=NUDIX domain
  Subcellular localization annotation: CTP_CleavageSite=67; ConfidenceScore=5.47e-01
MELKSLTSNSVCTSEFVHVGRTRTGTYSSLLSNFRSVRVSRQLNCFGGLFRRNNEASNKIYLADKAVISSVGPHNLAAETSFHHINGTNGSTSSLCSRNLRVLDAFDDVYEGVVIDSDRLPDNPSTFAANLRFSLSHWKKMGKKGIWLRLPSEQSDFVPIAIKEGFRYHHAEPGYVMLTYWIPEGPCMLPANASHQVGVGGFVINDSSESEELYAGAIREVKEETGVRLRYISLIDTEFVEVIAFRHARNVAFEKSDLFFICMLRPLSAEIIVDDPEIEAAKWMPLVEFVEQPLIQEDSMFKKIIDICIACLEKRYCGLNAHQMVSKFDGKSSSLYYNVINCIGS

SEQ ID NO: 182576 - protein, 225 aa, Glycine max
  Coding DNA Sequence Number=SeqID_65798
  Gene Ontology: Mol. function=metal ion binding
  Homolog annotation: Hit_ID=Q1S8T0; Match level="QueryCoverage=66%, HitCoverage=24%, E-value=9e-08, Identity=31%"; Hit description =Protein kinase
KVTYSTKCGDAGPEIHYPYQIKGQQQQQNDALSGFELLCKDNLTTIHFPSYGNLVVKSISYDTKNIHLLDPNNCAHRVFLNLNLSLTPFHYFYVLKNYTYLNCSTTLPRPFVEVPCLSASSYHVYTVDPAVPVPGSCEGVKTVAIPFAYSPYLSDKSLGLRLTWHLRELEGNEAVNLNRSSHKSRNIVIGFSICVFVMAMLLLISIKVRGATRNLHQKEEQLLQS

SEQ ID NO: 182577 - protein, 124 aa, Glycine max
  Coding DNA Sequence Number=SeqID_65799
  Gene Ontology: Mol. function=palmitoyl-(protein) hydrolase activity; Biological process=protein modification process
  Homolog annotation: Hit_ID=Q10T54; Match level="QueryCoverage=84%, HitCoverage=32%, E-value=1e-42, Identity=74%"; Hit description =Palmitoyl protein thioesterase containing protein, expressed
MTLPLDEMLALQSILLIGIFCVLADTLIKGEVYSSYIQEHLAPSGYLKLPNAIPDYLENCRFLPVLNNEIPDKRNSTYKERFSSLQNLVLIMLEHDTVLIPRETSWFGYYPDGYFKPVLPPQSI

SEQ ID NO: 182578 - protein, 47 aa, Glycine max
  Coding DNA Sequence Number=SeqID_65800
MTSVDHDTTYSTAGSRSGTHSDDVPNDLSRMPRSRDSPLLRILQCQW

SEQ ID NO: 182579 - protein, 158 aa, Glycine max
  Coding DNA Sequence Number=SeqID_65801
  Homolog annotation: Hit_ID=Q9SHG8; Match level="QueryCoverage=86%, HitCoverage=60%, E-value=1e-40, Identity=55%"; Hit description =Similar to SOUL Protein
  Pfam annotation: Domain name=SOUL; Domain location=1-150; Score =167.1; E_value=4.5e-47; Accession=PF04832.3; Description=SOUL heme -binding protein
MYKFSPYKSSCLALLFDYIQGKNNYKQKIEMTAPVITEVSPSDGPFCKSSFVVSFFVPKLNQANPPPAKGLHVQRWNNMYVAARQFGGHVNDSNVAVEAAVLRASIEGTKWSGAIDKNQKAGHASVYTVAQYNDPFEYQNRVNEIWFLFEMESERHAI

SEQ ID NO: 182580 - protein, 118 aa, Glycine max
  Coding DNA Sequence Number=SeqID_65802
MIFIVLDSRKEKDLRGKFFHVIVTLKNSSHVIVIRKISWIELKGGAEASNSNHRKDKAGLVGNLIHLRIYLQSRNTVRMNERQGPEFTRESRDERTQGEKIGPIIELSSNSEFLLLGA

SEQ ID NO: 182581 - protein, 944 aa, Glycine max
  Coding DNA Sequence Number=SeqID_65803
  Gene Ontology: Mol. function=metal ion binding; Cellular component =nucleus; Biological process=response to stimulus
  Homolog annotation: Hit_ID=Q84JU6; Match level="QueryCoverage=87%, HitCoverage=96%, E-value=1e-158, Identity=47%"; Hit description=E3 ubiquitin-protein ligase HOS1
  Subcellular localization annotation: CTP_CleavageSite=35; ConfidenceScore=5.62e-01
MDVRMKKKKNKKAFQKPSNSNLYGVFPSTRHRVVPSTNKSAPFNNLAPHFSVLDQICLSSPFGYYFSVMDRRLNGPTVSSSSNGGPAVGRSSPTLQPNYSSRLVQEALEHLASIDLIELCKEAKVERCRATRDLRSCGRYVHHVLNSCRHASLCEECSQRCDICPICRIPISKSGAKVHLRLYYECIEAGLISKRCDERFQEREDGEKDLTADGISNVLDILESSFKGTLSAQLHDLQNLQESIMKTKQHMDVIIWCTRHQFLEGVRSRFTDGSSWSSVVRIRKSEAIRRAWPDAINQSVESQGHDGSLFIEDALNNLDLEEGFRNEIVEGLEIASLQKDSASFLGSNTDQMLGYYPFKNLRSAVDLLFLHGGSDMVVAKQAIFLYYLYDRHWTIPEEEWRYILEDFAATFSVNRHSLLESLTFYLLDDHTEEALQEACRLLPEITGSTSHPKIAEVLLERGIPDTALMVLRWAGRDGGPHLTSLRDGVTAVRVRVECGLLTEAFMHQRVLCTRVKEKNFNKTASGNTSEKQKGQFSNWVEWVEVLVTEICCLCIRRNLVDRMLELPWNSEEEKYIHKCLLDYAIEDPLRTSGNLLVVYYFQRHRYSEAYQVHIKLEKVEQDCISKGSISQENLPILEKAIHIRGNLINRCLELLPEVEQQQLRSGNLTEGVVTCCAEVEIPDKFDVPQIQDFLSTSLLIPSSANSSLTLHKDHPTGLLSSSTLGRSAKIGMSFPTTGTELGNFGSFSYHHDGLFTNNERVPSHLSKIGKNLRNDNTPTPRNHRIRFMNGSPLKGFNRTSPSNSQENRPDKILPEVEQNLHFGHNQTTSPMYSWKATVNPVTRSTLSYPKEFANDLSNISSRNVQSHKDDRSWNMGSTNDPMDVSQSLVEKKLNTEVNINGGPRWRSDDASDEEDDLDLGRAMDIAYYASPPIRTTRRSRVSRR

SEQ ID NO: 182582 - protein, 93 aa, Glycine max
  Coding DNA Sequence Number=SeqID_65804
MDFVVWCPYGRHIGVRPFPQEALFSGFIRCKTNMLPYLPERMLRQFDHVQCTPAIIVASHDRLWMASGAMQSLLDLKIMPDGTSHHQTIHQAL

SEQ ID NO: 182583 - protein, 196 aa, Glycine max
  Coding DNA Sequence Number=SeqID_65805
  Gene Ontology: Mol. function=oxidoreductase activity; Cellular component=integral to membrane; Biological process=protein amino acid phosphorylation
  Homolog annotation: Hit_ID=Q1S1K8; Match level="QueryCoverage=93%, HitCoverage=62%, E-value=5e-62, Identity=61%"; Hit description =Oxidoreductase, 2OG-Fe(II) oxygenase family, putative
MNLPIIDLSSPDPLSTAISIRQACIEYGFFYLVNHGVENDLVKAFDESKRFFSLPPGEKMKLARKEFRGYTPQDPTLGLHGDSKESYYIGPMADSASVKLNQWPSEVVIAVFVCHSEAGKKLYSLIALSLNMDEDFFDKIGAVDKPSAFLRLLRYPGEMGPHQEICSAHSDTGALTLLMTDGVPGLQVLTSLLVQL

SEQ ID NO: 182584 - protein, 277 aa, Glycine max
  Coding DNA Sequence Number=SeqID_65806
  Gene Ontology: Mol. function=oxidoreductase activity; Cellular component=integral to membrane; Biological process=protein amino acid phosphorylation
  Homolog annotation: Hit_ID=Q1S1K8; Match level="QueryCoverage=57%, HitCoverage=54%, E-value=1e-47, Identity=58%"; Hit description =Oxidoreductase, 2OG-Fe(II) oxygenase family, putative
IESSLGIEEMNLPIIDFYSAESDRLSTAISIRQACIEYGFFYLVNHGVENDLVRAFDESKRFFSLPLEDKMKLAYKEFRGYTPPDPSLGLQGDSKESYYIGPLSDSTSANLNQWPSQGTLAPCGVGKKLLSLIALSLNMDEDFFEKIGAEDKPAAFLRLLHYPGDETKDRMEGNPLQFIPSNSIPACRARRRCLRMSFWFMRRRRVVEGAYGLARGWGEVALVHFDDELPCTSNWRILAMVSMRRGGGEGDAVELEGGVVVLQEELRDQFDVAFVAR

SEQ ID NO: 182585 - protein, 272 aa, Glycine max
  Coding DNA Sequence Number=SeqID_65807
  Subcellular localization annotation: CTP_CleavageSite=52; ConfidenceScore=5.25e-01
MTELSKKRKCSTSTTTAAGQHYHDTSGDSPTPPNPSLSSPCSLTLFSSNDQRQSQGVHFEDTLVDEWKHIYSSHDARKMVCKENVDMTGRLHAGSFTFECRIMHYILCRVLLPCSKNLARAYEEDLILLWAFQIGRQIDWAHLVRYRMHKALQANAPLPYPHLATLFLQHFNIPLDDESFVKVKQSFAIGAAVVASFGYRKDMDGQWVRKQDLPPTAPNERTPSPPPQRNPFSSLLNDVLHELRDFRAFVGDRFDAMDSRITCLEDDMSFIR

SEQ ID NO: 182586 - protein, 91 aa, Glycine max
  Coding DNA Sequence Number=SeqID_65808
MEHRSGVDVEGHVELHLSVRGAGIAIHHMMEVLAGTEGLGHAGELFDILRPIRSFLLLVLLDFTPFIISSLLLNEFVVECSGVRRRVSISL

SEQ ID NO: 182587 - protein, 193 aa, Glycine max
  Coding DNA Sequence Number=SeqID_65809
  Subcellular localization annotation: CTP_CleavageSite=41; ConfidenceScore=5.32e-01
MDRGWKDPTLFTTANGQASFWRRMAAPGSDGGGGGTAKATVAKQISQVVQSTSNLLQLMQHSSLAQAQLVKLPKNLLTKVPTIKNTEQVLEQLPGVISSLDAHMENGLQKSEPSLCSTSKDCGSGTFKYGKYPAYLAILTPSSPEVKFNIWSVCSDGRKLGTGRLDDQVFLVCLMLYKMNSALPGKKRKEERI

SEQ ID NO: 182588 - protein, 66 aa, Glycine max
  Coding DNA Sequence Number=SeqID_65810
MIKIEDKDDDNTFECLKAPDNGGLASHCHEKLYTLGAEMDRRRRRMDKERDGENGYRRRVSPIREA

SEQ ID NO: 182589 - protein, 197 aa, Glycine max
  Coding DNA Sequence Number=SeqID_65811
  Gene Ontology: Mol. function=transcription factor activity; Cellular component=nucleus; Biological process=regulation of transcription, DNA-dependent
  Homolog annotation: Hit_ID=Q1S1K2; Match level="QueryCoverage=79%, HitCoverage=63%, E-value=2e-37, Identity=48%"; Hit description =Transcription factor-like protein-Arabidopsis thaliana
  Pfam annotation: Domain name=AP2; Domain location=41-105; Score =145.4; E_value=1.5e-40; Accession=PF00847.10; Description=AP2 domain
MEEEDNQVHNLTEEKKKSENEEVSVESNDKKKKKRSSDGKHPTYRGVRMRKWGKWVSEIREPKKKSRIWLGSFSTPEMAARAHDVAALTIKGTSAFLNFPELASHLPRPLTTSPKDIQAAAAKAAALNFEAQVEAQAQAQLSIPSSSSEVEFPDLLLDSSHSAGEFDYSAPWLVAEAEHLDLAFRLDDPPFPAWGSY

SEQ ID NO: 182590 - protein, 58 aa, Glycine max
  Coding DNA Sequence Number=SeqID_65812
  Homolog annotation: Hit_ID=Q8GTR3; Match level="QueryCoverage=64%, HitCoverage=6%, E-value=2e-08, Identity=81%"; Hit description =Phosphate transporter PHT2-1
MCVWMKVQRDAVLCFMESLDGYMQDLSASFMSFADGGYHVSNGIGPLAGALAILQGAS

SEQ ID NO: 182591 - protein, 710 aa, Glycine max
  Coding DNA Sequence Number=SeqID_65813
  Gene Ontology: Mol. function=protein binding; Cellular component =membrane; Biological process=defense response
  Homolog annotation: Hit_ID=Q1T5C8; Match level="QueryCoverage=99%, HitCoverage=81%, E-value=1e-111, Identity=34%"; Hit description =Disease resistance protein; AAA ATPase
  Pfam annotation: Domain name=LRR_1; Domain location=366-388; Score =14.5; E_value=0.39; Accession=PF00560.23; Description=Leucine Rich Repeat
  Pfam annotation: Domain name=LRR_1; Domain location=389-411; Score =13.0; E_value=1; Accession=PF00560.23; Description=Leucine Rich Repeat
  Pfam annotation: Domain name=LRR_1; Domain location=413-434; Score =14.7; E_value=0.33; Accession=PF00560.23; Description=Leucine Rich Repeat
  Pfam annotation: Domain name=LRR_1; Domain location=543-564; Score =7.7; E_value=10; Accession=PF00560.23; Description=Leucine Rich Repeat
  Pfam annotation: Domain name=LRR_1; Domain location=601-624; Score =7.3; E_value=12; Accession=PF00560.23; Description=Leucine Rich Repeat
  Pfam annotation: Domain name=NB-ARC; Domain location=89-360; Score =34.8; E_value=1.7e-12; Accession=PF00931.13; Description=NB-ARC domain
  Pfam module annotation: Pfam domain module=LRR_1::LRR_1::LRR_1::LRR _1::LRR_1::NB-ARC; Domain location=366-388::389-411::413-434::543 -564::601-624::89-360
KLDVSVLDELKTKLLTLNTVLNDAEEKQIDNVALKEWLGELKGVVLDAEDLLDEINTNALRCKLEAISRRLEHFETDILGLQSVTRRVSYKIVTDSLVDSVVVAREDDKEKLLNMLLSDDDSMSNDIDVITILDMGAWVSDDFDIPKVTKKIVESLTSKDCHITNLDVLCVELKNSLKDKKFLLVLDDLWNEKYNDRHHLIAPLNSGKNGSKIVVTTRRQRVAQVTDTFPIYELKPLKDENCWRILARHAFGNEGHDKYSSLEEIGRKIARKCNGLPLAAKTLGGLLRLNDDAGKWNRLLNSNLWAHDDVFPASQISFLQQIDREKALESVGITWLVAKTKIMRALSFSKYRNIPELSDSIGNLLHLRYLDLSYTSIESLPDETFMLYNLQTLILSDCEFLIQLPPQIGNLVNLRHLDISDTNLQEMPAQICRLQDLRTLTVFILGRQLRIKDLRKLPYLHGKLSILNLQNVINPADAFQADLKKKEQIEELMLEWGSDPQDPQIGNNVLENLQPSTILKKLNIRCYGGTSFPNWTGDSSFSNIIVLSISDCNHCLSLPPFGQLPSLKELAIKRMKMVKDMSEWQEWLPFEGEGRNFPFPCLKRLHLYKCPKLRGTLPNRLPSLTDVSFSECNRLVTKSSDLHWNMSIEIIHMREGQEGLLSLLENFSYGKLLTEKCDSLQSLPRIILGANCLQELTLTNIPSLISFPAD

SEQ ID NO: 182592 - protein, 183 aa, Glycine max
  Coding DNA Sequence Number=SeqID_65814
  Gene Ontology: Mol. function=DNA binding; Cellular component=nucleus; Biological process=regulation of transcription, DNA-dependent
  Homolog annotation: Hit_ID=Q52MQ4; Match level="QueryCoverage=63%, HitCoverage=59%, E-value=3e-48, Identity=77%"; Hit description=Myb family transcription factor 2
  Pfam annotation: Domain name=Myb_DNA-binding; Domain location=16-63; Score=57.9; E_value=3.2e-14; Accession=PF00249.21; Description=Myb -like DNA-binding domain
  Pfam annotation: Domain name=Myb_DNA-binding; Domain location=69-114; Score=47.8; E_value=3.6e-11; Accession=PF00249.21; Description=Myb -like DNA-binding domain
  Pfam module annotation: Pfam domain module=Myb_DNA-binding::Myb_DNA -binding; Domain location=16-63::69-114
MAPPRNVETAKKTNNRGAWTAEEDQKLAQCIEIHGAKKWKTVAIKSGLNRCGKSCRLRWLNYLRPNIKRGNISVEEEDLIIRLHKLLGNRWSLIAKRLPGRTDNEIKNYWNTCLCKKVNHKKVKPETSTAQTTHTTQNTEERAAVENKEGTDDGSGDSEVNFDVNEFFNFSIESGPFALDWMI

SEQ ID NO: 182593 - protein, 565 aa, Glycine max
  Coding DNA Sequence Number=SeqID_65815
  Gene Ontology: Mol. function=mismatched DNA binding; Cellular component=nucleus; Biological process=mismatch repair
  Homolog annotation: Hit_ID=Q6DTM5; Match level="QueryCoverage=99%, HitCoverage=67%, E-value=0.0, Identity=68%"; Hit description=MSH4
  Pfam annotation: Domain name=MutS_III; Domain location=144-510; Score= 32.2; E_value=7.5e-10; Accession=PF05192.9; Description=MutS domain III
  Pfam annotation: Domain name=MutS_IV; Domain location=357-464; Score =14.8; E_value=0.018; Accession=PF05190.8; Description=MutS family domain IV
  Pfam module annotation: Pfam domain module=MutS_III::MutS_IV; Domain location=144-510::357-464
MYTEVGLAAFDLRSASLHLSQYIETSSSYQNTKTLLHFYDPIVIIIPPNKLASNSTAGVTELVDRFYGSVKQVMLARGCFDDTKGAILIKNLAAKEPSALGLDTYYKQYYLCLAAAAATLKWTEAEKGVVVTNHSLSVTFNGSFDHMNIDSTSIQNLEIIEPFHSTLLGTSNKKRSLFHMLKTTKTIGGSRLLRANLLQPLKDIETINARLDCLDELMSNEQLFFGLCQILRKFPKETDRVLCHFCFKAKKVTAEALAVDRAKKSQVLVSSVILLKTALDALPLLSKVPLSHTHTRIRQVLKDVKSSLLSNIYKSVCENEKYDLIRKRIGEVIDEDVLHARVPFVACTQQCFAVKAGIDGLLDISRRAFCETSEAYHICVLKAFGVTFTAIHNLANNYREDFKLPNLKLTYKNRQGFHFVIPQKNIQGKLPSKFIQVVKHGNNIRCSSLELASLNARNKSAAAECYTRTEKKITELMDDIRENVSVLTLLAEVLCLLDMIVNSFAHMISTKPVDRYTRPEFTENGPLAIDSGRHPILESIHNDFVANNIFLTEASNMAIVMGPNM

SEQ ID NO: 182594 - protein, 92 aa, Glycine max
  Coding DNA Sequence Number=SeqID_65816
MRKFFGNSLLLVITLFEVLTTIMENIIDSSLLRCEGDLETTRPPKITLSMEDSSPHVGAKIGVILWCMWKNRNSKLWEGNIMPPRVALSVAM

SEQ ID NO: 182595 - protein, 219 aa, Glycine max
  Coding DNA Sequence Number=SeqID_65817
  Gene Ontology: Mol. function=structural constituent of ribosome; Cellular component=intracellular; Biological process=translation
  Homolog annotation: Hit_ID=Q1S7P5; Match level="QueryCoverage=91%, HitCoverage=99%, E-value=9e-93, Identity=82%"; Hit description =Ribosomal protein L15e
  Pfam annotation: Domain name=Ribosomal_L15e; Domain location=17-208; Score=467.6; E_value=1.6e-137; Accession=PF00827.8; Description =Ribosomal L15
MAFGRSGGIICVTCVGSAYKYVSELWRKKQSDVMRFLQRVRCWEYRQQPSIVRLTRSTRPDKARRLGFKAKQGYVIYRVRVRRGGRKRPVPKGIVYGKPTNQGVTQLKFQRSKRSVAEERAGRKLGGLRVLNSYWVNEDSTYKYFEVILVDVAHAAIRNDPRINWLANPVHKHRELRGLTSAGKSNRGLRGRGHLYHKARPSRRATWKRNNTLSLRRYR

SEQ ID NO: 182596 - protein, 259 aa, Glycine max
  Coding DNA Sequence Number=SeqID_65818
  Homolog annotation: Hit_ID=Q1SSC7; Match level="QueryCoverage=96%, HitCoverage=64%, E-value=3e-62, Identity=56%"; Hit description=TRNA -binding arm; Pleckstrin homology-type
  Pfam annotation: Domain name=DUF828; Domain location=37-247; Score =354.3; E_value=1.9e-103; Accession=PF05703.2; Description=Plant protein of unknown function (DUF828)
MEGGFFPPWKNGSWQELGSEDVQESEQFKSFPPLAEPPTPREPMEFLSRSWSLSASEISKALSEKQKQTFLDNKTSDTLPEPISAPQLAGGKMIVSGNCRRMGAIGKWLHQKQYGNTNVSVKKKDRARVENARVHSALSIAGLASAVAAVAATEDPRGGSRSKLDVALASATQLLASYCVEMAEVAGADRERVASTVRSAVDIQTPGDLMTLTAAAATALRGEAALTARMPKEAKKNASISLYDKVIAETQWLRAFDGQ

SEQ ID NO: 182597 - protein, 190 aa, Glycine max
  Coding DNA Sequence Number=SeqID_65819
  Gene Ontology: Mol. function=phosphatidylserine decarboxylase activity; Cellular component=nuclear envelope; Biological process =phospholipid biosynthetic process
  Homolog annotation: Hit_ID=Q1SSC6; Match level="QueryCoverage=92%, HitCoverage=40%, E-value=4e-84, Identity=84%"; Hit description =Phosphatidylserine decarboxylase
  Pfam annotation: Domain name=PS_Dcarbxylase; Domain location=3-186; Score=-8.5; E_value=1.9e-06; Accession=PF02666.6; Description =Phosphatidylserine decarboxylase
MPDNPCFENFHFSPKKGLFYCVVYLNPGDYHRIHSPADWNILVRRHFSGRLYPLNERAIRTIRNLYIENERVILEGLWLEGFMALAAIGDTNIGSIELFIEPELHTNRPRKKFLHSEPPEERIYECEGLGRMLKKGDELGAFNMGSTVVLVFQAPISKLHEGDSFQEFRFCVGRGDRIRVGEALGRWHSS

SEQ ID NO: 182598 - protein, 469 aa, Glycine max
  Coding DNA Sequence Number=SeqID_65820
  Gene Ontology: Mol. function=transporter activity; Cellular component= integral to membrane; Biological process=transport
  Homolog annotation: Hit_ID=UPI000016287F; Match level="QueryCoverage =59%, HitCoverage=69%, E-value=7e-28, Identity=27%"; Hit description =protein binding
  Pfam annotation: Domain name=Ank; Domain location=116-148; Score =19.5; E_value=0.012; Accession=PF00023.20; Description=Ankyrin repeat
  Pfam annotation: Domain name=Ank; Domain location=12-44; Score=3.0; E_ value=11; Accession=PF00023.20; Description=Ankyrin repeat
  Pfam annotation: Domain name=Ank; Domain location=169-204; Score =13.4; E_value=0.36; Accession=PF00023.20; Description=Ankyrin repeat
  Pfam annotation: Domain name=Ank; Domain location=48-80; Score=22.6; E_value=0.0014; Accession=PF00023.20; Description=Ankyrin repeat
  Pfam annotation: Domain name=Ank; Domain location=82-114; Score=30.4; E_value=6.5e-06; Accession=PF00023.20; Description=Ankyrin repeat
  Pfam module annotation: Pfam domain module=Ank::Ank::Ank::Ank::Ank; Domain location=116-148::12-44::169-204::48-80::82-114
MEVEVTPTLENDTITTLYEASLNGSVSTLNTLIQRNPLILHRVSLSPFSETPLHIASLLGHLEFCEALLKRKPSLASEVDSERRSPLHLACAEGHTEVVKALLHTNPDVCLAMDKDEMLPLHLAVMRGHIGVIKELTRARPGSIQQNTIDDGSVLHLNQQQFLLARDKEGDTVLHLAVRLKQIKTIKHLLMLPEMRTAVSALNKAGLTALEMLVRCPRDFISLKIEKMLLEAGVQTGTAQQGSPSPRIATQPSHQSKRSNIWETLWLRYLKYQSNWIEEKRGTLMVVATVIATMTFQSAINPPGGVWQEDTITGGLNCTTYGICKAGTAVLAYDLPHGFLKFMTFNTTSFFSSLAVVLLLISGFRLENKLMMWILTMAMTSAITFMGLTYFWAQSLVTPDHIVDKVNRMGIPLSIVWVIMLLVVEVCKEVEAEAAAWLKVIALVGKEVCKEVEAEAAAWLKVIARELVQ

SEQ ID NO: 182599 - protein, 147 aa, Glycine max
  Coding DNA Sequence Number=SeqID_65821
  Gene Ontology: Mol. function=receptor activity; Cellular component =intracellular; Biological process=regulation of transcription, DNA -dependent
  Homolog annotation: Hit_ID=Q4SLE7; Match level="QueryCoverage=85%, HitCoverage=94%, E-value=7e-15, Identity=33%"; Hit description =Chromosome 7 SCAF14557, whole genome shotgun sequence
  Pfam annotation: Domain name=zf-HIT; Domain location=2-32; Score =32.4; E_value=1.6e-06; Accession=PF04438.6; Description=HIT zinc finger
MGPRQCQVCNQTQSKYKCPSCYLPYCSLVCFKKHKESPCVKPQPSETKATAVSESFVEKPLVADESSEVLQKFQLEAIASSSEIRDALNDEALQELICRIDGSSNAENELDKAMAEEAFRLFTDKLCPVIQLLMYDKFCIFIEALYW

SEQ ID NO: 182600 - protein, 1093 aa, Glycine max
  Coding DNA Sequence Number=SeqID_65822
  Gene Ontology: Mol. function=aminoacyl-tRNA ligase activity; Cellular component=cytoplasm; Biological process=tRNA aminoacylation for protein translation
  Homolog annotation: Hit_ID=Q01B72; Match level="QueryCoverage=95%, HitCoverage=95%, E-value=0.0, Identity=55%"; Hit description=[J] KOG0437 Leucyl-tRNA synthetase
  Pfam annotation: Domain name=Anticodon_1; Domain location=802-944; Score=49.2; E_value=1.4e-11; Accession=PF08264.3; Description =Anticodon-binding domain
  Pfam annotation: Domain name=tRNA-synt_1; Domain location=22-764; Score=-316.5; E_value=4e-06; Accession=PF00133.12; Description=tRNA synthetases class I (I, L, M and V)
  Pfam annotation: Domain name=tRNA-synt_1g; Domain location=480-776; Score=-269.1; E_value=0.0019; Accession=PF09334.1; Description=tRNA synthetases class I (M)
  Pfam module annotation: Pfam domain module=Anticodon_1::tRNA-synt _1::tRNA-synt_1g; Domain location=802-944::22-764::480-776
MASEGGNKSFARRDRLREIESKVQKWWEEKDVFRAEPGEKPPSSPGEKFFGNFPFPYMNGYLHLGHAFSLSKLEFAAAYHRLCGANVLLPFAFHCTGMPIKASADKLTREIQRFGDPPVFPSEVEEQQQQQQQQQQEQEEPPSGDGAPPDKFKGKKSKAASKSTGQVYQWEIMRSVGISDAEISKFQDPYKWLSYFPPLAVEDLKAFGLGCDWRRSFVTTDMNPYFDSFVRWQMRKLKSMGKVVKDVRYTVFSPLDGQPCADHDRASGEGVQPQEYTIIKMELVAPFPEKFKALEGKKVFLAAATLRPETMYGQTNAWVLPDGKYGAFEINDSEVFVLAHRAALNLAYQNHSRVPEKPSCLLELTGRDLIGLPLKSPLSFNEVIYALPMLSILMDKGTGVVTSVPSDAPDDYMALHDLKAKPALREKYGVKDEWVLPFEIVPIIEVPQFGNKCAETVCLQMKIVSQNDKEKLVEAKKQTYLKGFTEGTMIVGEFAGRRVQEAKPLIRNKLLETGQAIIYSEPEKRVMSRSGDECVVALTDQWYITYGESEWKKLADECLSNMNLYSDETRHGFEHTLSWLNQWACSRSFGLGTRIPWDEQFLVESLSDSTIYMAYYTVAHHLQSGDMYGSGESAIKPHQLTDDVWDYIFCGGPYPKSTDISSSLLERMKQEFEYWYPFDLRVSGKDLIQNHLTFCIYNHTAIMAKHHWPRGFRCNGHIMLNSEKMSKSTGNFRTLRQAIEEFSADATRFSLADAGDGVDDANFVFETANAAILRLTKEIAWYEDNLAAESSMRTGPPSTYADRVFANEINIAVQTTEQNYTNYMFREALKTGFYDLQAARDEYRFSCGAGGCNRDLVWRFMDVQTRLIAPICPHYAEFIWRELLKKDGFVVNAGWPTADAPDLTLKSANKYLQDSIVLMRKLLQKQLSGSKKGNKKGPPAASLTDSKVTGLIYVNEQFDSWEAECLSILQKKFSRDTRTFAPESEILQALQQSSVGQSSNFKQVQKRCMPFLRFKKEEAIALGAQALDLRLPFGEIEVLKENLELIKRQIGLEDVEILSAADADSLARAGPLASLLNQNPPSPGKPTAIFVTL

SEQ ID NO: 182601 - protein, 296 aa, Glycine max
  Coding DNA Sequence Number=SeqID_65823
  Gene Ontology: Mol. function=kinase activity
  Homolog annotation: Hit_ID=Q1SSD6; Match level="QueryCoverage=95%, HitCoverage=58%, E-value=1e-106, Identity=61%"; Hit description =Protein kinase PKN/PRK1, effector
  Pfam annotation: Domain name=DUF547; Domain location=230-291; Score =1.1; E_value=2.5e-06; Accession=PF04784.5; Description=Protein of unknown function, DUF547
  Subcellular localization annotation: CTP_CleavageSite=7; ConfidenceScore=5.01e-01
ASPPSVRASRFSSPLHDNLTGNKKTFSNPRASLEKDVEQLQLRIQHEKSMRILLERAMGRASSTLSPGHRHFAAQTKDLIAEIELLEEEVTSREQHVLAMYRSIFENCVSWPPSEQNSGVASPAHPSYAPLSCGKGEVYFGKTCPDSTKVNEKFSTKEKTPVLRTLKYHLNQCPNRLSEEMVKSSTHAAQTRHGVGEDQDCSCKSVVEISWIATRKRHSSHASYAIDNFRVLVEQLERVNISQMENDGQIAFWINVHNALVMHAYLAYGIPQGSLKRLALFHKDFTFREALFPSQP

SEQ ID NO: 182602 - protein, 1070 aa, Glycine max
  Coding DNA Sequence Number=SeqID_65824
  Gene Ontology: Mol. function=binding; Cellular component=cytoplasmic microtubule; Biological process=negative regulation of microtubule depolymerization
  Homolog annotation: Hit_ID=Q1SA51; Match level="QueryCoverage=92%, HitCoverage=93%, E-value=0.0, Identity=72%"; Hit description=Mast C -terminus, putative
  Pfam annotation: Domain name=HEAT; Domain location=470-503; Score =0.9; E_value=33; Accession=PF02985.12; Description=HEAT repeat
  Pfam annotation: Domain name=HEAT; Domain location=512-547; Score =20.4; E_value=0.0065; Accession=PF02985.12; Description=HEAT repeat
  Pfam annotation: Domain name=HEAT; Domain location=552-588; Score =23.9; E_value=0.00058; Accession=PF02985.12; Description=HEAT repeat
  Pfam annotation: Domain name=HEAT; Domain location=638-670; Score =9.2; E_value=3.2; Accession=PF02985.12; Description=HEAT repeat
  Pfam annotation: Domain name=HEAT; Domain location=81-117; Score=1.5; E_value=28; Accession=PF02985.12; Description=HEAT repeat
  Pfam annotation: Domain name=HEAT; Domain location=912-948; Score =23.1; E_value=0.00099; Accession=PF02985.12; Description=HEAT repeat
  Pfam module annotation: Pfam domain module=HEAT::HEAT::HEAT::HEAT::HEA T::HEAT; Domain location=470-503::512-547::552-588::638-670::81 -117::912-948
  Subcellular localization annotation: CTP_CleavageSite=16; ConfidenceScore=5.35e-01
AQYTNRLSPRVGRFIKAAGSTGFPTGKRAVRATQLMWVSSLIRHPRLYTLCFRLQLVGPLSTQLSDRRSSIVKQDFLGDFEACAELLIPVLLKLVVITVLVIAESADNCIKTMLRNCKAARVLPRIADCAKNDRNAVLRARCCDYALLILEHWPDAAEVQRSADLYEDMISEHNSQLINEEDGGMHRRHASPSVRDRGALMPITSQASAPSNLTGYGTSAIIAMDRSSSLSSGTSIASGVLSQAKSLGKVTERSLESVLHASKQKVTAIESMLRGLDLSDKHGSSALRSSSLGLGVDPPSSRDPPFPAAVTASNHLTSSLTAESTAAGANKASNRHGGLGLSDIITQIQASKDSGRLSYNTNVGIEPLSAFSSFSSKRATEKLQERGSIDENSDMRETRRYMNPNIDRQYMDTHYRDGNYRDSQNSYVPNFQRPLLRKNVAGRVSAGSRRSFDDSQLSLGEMSNYADGPASLHEALSEGLSSGSDWSARVAAFNYLHSLFEQGQKGIQEVVQNFEKVMKLFFQHLDDPHHKVAQAALSTLADIILACRKPFEGYMERMLPHVFSRLIDPKELVRQACSMNLEVVSKTYSIDSLLPALLRSLDEQRSPKAKLAVIEFAISSFDKHAMNPEGTANIGILKLWLAKLVPLVHDKNTKLKEAAITCIISVYSHFDSSAVLNFILSLSVDEQNSLRRALKQRTPRIEVDLMNYLQNKKDRRSKSSYDPSDVVGASSEEGYAGLSRKAQYIGRYSAGSLDSDGGRNWSSQDSTLIKASLGQAATDETEEHTDSNSGAFGLKTKELAYTANSTGQNFGLQTSHGHVDSSINFEGLSSDLNVNGLMSSEHLNITEDFGHDKEHHSAEDVKVNYMTDNGPSIPQILHMICSGGDGSPISSKRTALQQLAEVSIANDHSVWTLYFNQILTVVLEVLDDSDSSIRELALSLIVEMLKNQKDAMENSVEIVVEKLLNVTKDIVPKVSNEAEHCLTIVLSQNDPFRCLSVIVPLLVTEDEKTLITCINCLTKEELMAQLPSFLPALFEAFGNQSADVRKYELPVAQVGWSSLAFLSLWIGGCY

SEQ ID NO: 182603 - protein, 55 aa, Glycine max
  Coding DNA Sequence Number=SeqID_65825
  Subcellular localization annotation: CTP_CleavageSite=17; ConfidenceScore=5.07e-01
MLDPSLAQPHNIDRKTKSSVAKGRNSAATMRERERGLVVEVEGKASFLLSGSRGV

SEQ ID NO: 182604 - protein, 1401 aa, Glycine max
  Coding DNA Sequence Number=SeqID_65826
  Gene Ontology: Mol. function=RNA binding
  Homolog annotation: Hit_ID=Q108Y7; Match level="QueryCoverage=93%, HitCoverage=62%, E-value=1e-115, Identity=28%"; Hit description =Agenet domain containing protein, expressed
  Pfam annotation: Domain name=Agenet; Domain location=904-976; Score =56.7; E_value=7.7e-14; Accession=PF05641.3; Description=Agenet domain
MNFAGNILCVNQVSISSAFVPDSYIEFCETGGGSHSLTEKENNQVEASPTQNPQVSEDLKENNTSKDERRSTPEVNSVNDLSKKGATADVGKMQPIPVTETVKTSLTSHIFPSSTLLLKAVEEGSPSTSGRGPSKIKSVGDVAHGASKATPERKTRRASNRSAGKESSRRGSHAKDTTLARQTDRGDKSTKVSLSPSPGFQMMQSNEVQQFGHIDSNSTKSFAVVNTSTSSLPDLNTSASPPILFHQPFTDQQQVQLRAQIFVYGALIMNPQSCIFFTYSLQKPCITSSPPCQGTVPDEAYMISAFGGSDGGRSLWENAWRTCMERQHGQKSHPANPETPLQSRSVARTSDLPHKQSAAQGKGISSPLGRTSSKATPPIVNPLIPLSSPLWSLSTLGLGSDSLQSSAIARGSVVDYPQAITPLHPYQTTPVRNFLGHNTPWMSQTPLRGPWIASPTPVTDNSPQISASPASDTIKLGSVKGSLPPSSGIKNVTSGVSTSSTGLQSIFTGTASLLDANNVTVSPAQHNSDPKPKKRKKVVVSEDLGQRALQSLAPGVGSHTSTPVAVVAPVGNVPITTIEKSVLSVSPLADQSKNDRNVEKRIMSDESLMKVKEARVHAEEASALSAAAVNHSLELWNQLDKHKNSGLMPDIEAKLASAAVAVAAAATIAKAAAAAANVASNAALQAKLMADEALLSSGYDNSSQSNQISLSEGTNNLGKATPASILKGANGINSPGSIIVAAKEAVKRRVEAASAATKRAENMDAIVRAAELAAEAVSQAGKIVTMGDPLPISQLVEAGPEGCLKATRESSQQVGLFKDINRDMVNNNVRDIPETSYTHNRDILSGGISAPIKINEKNSRGAKGHKVVSDLVKPIDVVPGSEPEIQAPPFTVSNGSENLVESSIKEGLLVEVFKDEEGFKAAWFSANILTLKDNKAYVGYTSLVAAEGAGPLKEWVSLECDGDKPPRIRAARPLNTLQYEGTRKRRRAAMGDYAWSVGDRVDAWIQESWQEGVITEKNKKDETTFTVHFPASGETLVVRAWHLRPSLIWKDGKWIESYKVGTNDSSTHEGDTPNEKRPKLGSHVVDVKGKDKMSKGIGAVESAKPDEMTLLNLAENDKVFNIGKSSKNGNKFDAHRMVRTGLQKEGSKVIFGVPKPGKKRKFMEVSKHYVAHENSKIGDRNDSVKLTNFLMPPSSGPRGWKNSSKNDAKEKHGADSKPKTSHTERIKDSSNLFKNAASKSESKVERAPHSASDGATGPFLFSSLATSVDAHPTKRASSSRASKGKLAPARVKSGKVEMEKALNDNPMKSASDMVEPRRSNRRIQPTSRLLEGLQSSLIISKIPSVSHNRNTKKVCSSNDNITRCSTLLYMPIAAFTSTFSSNCSSSHIFHNLSRICVNYDL

SEQ ID NO: 182605 - protein, 377 aa, Glycine max
  Coding DNA Sequence Number=SeqID_65827
  Gene Ontology: Mol. function=binding; Cellular component =cytoskeleton; Biological process=cell division
  Homolog annotation: Hit_ID=Q1SA53; Match level="QueryCoverage=94%, HitCoverage=93%, E-value=1e-125, Identity=68%"; Hit description=HEAT
  Pfam annotation: Domain name=HEAT; Domain location=47-83; Score=6.4; E_value=7; Accession=PF02985.12; Description=HEAT repeat
  Pfam annotation: Domain name=HEAT; Domain location=88-124; Score =18.8; E_value=0.019; Accession=PF02985.12; Description=HEAT repeat
  Pfam module annotation: Pfam domain module=HEAT::HEAT; Domain location=47-83::88-124
KPDLHPAAPDPMEEALELARAKDAKERMAGVERLHEVLEASRRSLSSGEVTSLVDCCLDLLKDSSFKVSQGALQALDSAAVRAGDHFKLHFNALVPAVVDRLGDAKQPVRDAARRLLLTLMEVSSPTIIVERAGSFAWTSKSWRVREEFARTVTSAIGLFSSTELPLQRAILPPLLNDLNPAVRETAILCIESEPAKLTRIVITTSVFGSCEEASESRIMRYRDQFKLKNDHATICIAEMYTQAGSQFRDELQRHNLPSSLVKAINARLEGIQPKVHSSDGISSGYNAGEIKPVGVNPKKSSPKAKSSSRETSLFGGEGDATEKVIDPIKVYSEKELIREIDKIASTLVPEKDWSIRIAAMQRIESLVLGGQEHLLL

SEQ ID NO: 182606 - protein, 157 aa, Glycine max
  Coding DNA Sequence Number=SeqID_65828
  Gene Ontology: Mol. function=metalloendopeptidase activity; Cellular component=proteinaceous extracellular matrix; Biological process =peptidoglycan metabolic process
  Homolog annotation: Hit_ID=Q1SSE4; Match level="QueryCoverage=99%, HitCoverage=53%, E-value=2e-65, Identity=76%"; Hit description =Peptidase M10A and M12B, matrixin and adamalysin; Peptidase, metallopeptidases
  Pfam annotation: Domain name=PG_binding_1; Domain location=2-62; Score=46.0; E_value=1.3e-10; Accession=PF01471.9; Description =Putative peptidoglycan binding domain
  Pfam annotation: Domain name=Peptidase_M10; Domain location=87-157; Score=-38.5; E_value=0.00027; Accession=PF00413.14; Description =Matrixin
  Pfam module annotation: Pfam domain module=PG_binding_1::Peptidase _M10; Domain location=2-62::87-157
MAELKKYFHRFGYLSLPETTPNFTDTFDSQFESALVRFQKRLGLPVTGKLDSDTISAIVAPRCGVSDAAPHGLHATRRFAYFNGKPRWTRGTPMTLTYAFSPYNMIDRVSLPEIRAVFERAFARWASVIPVSFQETPEYDRADITIGFYLGDHGDGE

SEQ ID NO: 182607 - protein, 260 aa, Glycine max
  Coding DNA Sequence Number=SeqID_65829
  Gene Ontology: Mol. function=carboxypeptidase activity; Cellular component=membrane; Biological process=auxin mediated signaling pathway
  Homolog annotation: Hit_ID=Q2A9S9; Match level="QueryCoverage=96%, HitCoverage=71%, E-value=2e-68, Identity=55%"; Hit description =Integral membrane protein, putative
  Pfam annotation: Domain name=DUF6; Domain location=23-156; Score =22.5; E_value=0.0015; Accession=PF00892.11; Description=Integral membrane protein DUF6
MEKMSGGAMEDVAIIGGLIGVQFIYAGNAVLMSYSMSLGFSSLTIIILTSLATFLILFPIAFFVERSNWPKHCSFRFIAQLFFLSFGGLIFQYLFLKGINLTSPAMGTAMPNIAPGLIFIIAWISGLEKVNLSNKYSKVKILGTLLCVLGALTMSIMQSISDPETVKNATVELTPPLPSGLAFDIQKILGCLYLVVAVFILSSNVVLQAFALGDFPAPMSLGAITSLIGAFLTAIFQFLEDNEMNWLLVRSGDLVGFFIL

SEQ ID NO: 182608 - protein, 104 aa, Glycine max
  Coding DNA Sequence Number=SeqID_65830
  Gene Ontology: Mol. function=molecular_function; Cellular component =membrane; Biological process=auxin mediated signaling pathway
  Homolog annotation: Hit_ID=Q9FGL0; Match level="QueryCoverage=87%, HitCoverage=25%, E-value=4e-28, Identity=63%"; Hit description =Nodulin-like protein
  Subcellular localization annotation: CTP_CleavageSite=45; ConfidenceScore=5.22e-01
MGVKGIKTLNAQAGAVSGICLSFNGWALKKKGPVYVSMFNPIGTVCSVVFSAVTLEDTISIGSLAGMFLMFTGLYLVLWAKGKEGHAGGDGLECECDAETPLLS

SEQ ID NO: 182609 - protein, 585 aa, Glycine max
  Coding DNA Sequence Number=SeqID_65831
  Gene Ontology: Mol. function=transferase activity; Cellular component= nucleus; Biological process=metabolic process
  Homolog annotation: Hit_ID=Q1SSE5; Match level="QueryCoverage=86%, HitCoverage=97%, E-value=0.0, Identity=69%"; Hit description =Tetratricopeptide-like helical
  Pfam annotation: Domain name=PPR; Domain location=133-167; Score =33.3; E_value=8.7e-07; Accession=PF01535.11; Description=PPR repeat
  Pfam annotation: Domain name=PPR; Domain location=168-201; Score=0.8; E_value=6; Accession=PF01535.11; Description=PPR repeat
  Pfam annotation: Domain name=PPR; Domain location=203-237; Score =11.2; E_value=0.35; Accession=PF01535.11; Description=PPR repeat
  Pfam annotation: Domain name=PPR; Domain location=296-330; Score =35.8; E_value=1.5e-07; Accession=PF01535.11; Description=PPR repeat
  Pfam annotation: Domain name=PPR; Domain location=398-432; Score =22.0; E_value=0.0021; Accession=PF01535.11; Description=PPR repeat
  Pfam annotation: Domain name=PPR; Domain location=471-505; Score=3.8; E_value=2.6; Accession=PF01535.11; Description=PPR repeat
  Pfam annotation: Domain name=PPR; Domain location=537-571; Score=8.1; E_value=0.81; Accession=PF01535.11; Description=PPR repeat
  Pfam module annotation: Pfam domain module=PPR::PPR::PPR::PPR::PPR::PP R::PPR; Domain location=133-167::168-201::203-237::296-330::398 -432::471-505::537-571
MRRFLFLYNEARKFHKPHIHLAFPSPLAYSNIGDSHFNLVDVSAQSGTNAELALFEASRRGIKPNSFALVNLLGLASNLNCPSFGQQLHSYVIRSGYFSHIHVSTSLIKLYVRTHSFSDAHKLFVEIAEPSVVTWNTLISGYVHTGQFRNALSFFTLLDRSHVCADAVSFTSALSACSLLSLFKLGSSIHCKIVKVGMADGTVVANCLIVMYGKCGSLERAVRIFSQTIEKDVISWNSVIAASANNGDIELAYKFLHLMPNPDTVSYNGLINGIAKFGNMDDAVQVLSSLPSPNSSSWNSVITGFVNRNRAREALDIFRKMHLRNVEMDEFTFSIILTGIAGLSALTWGMLIHCCTIKCGLDASVFVGSALIDMYSKCGQVKNAESIFVHALPNKNLVSWNAMLSGYARNGDSVRVIHLFQSLKMEREIKPDGITFLNLISVCSHSEIPFEVAIRYFESMIDEYKIAPSIEHCCSMIRLMGQKGELWRAERMIHELGFESCGVVWRALLGACGTQADLQVAEIAAAKVIELERDEDYVYVMMSNMYASCGRWEDVNAIRGFMSRKGIRKEAGSSWIEIDSSVSSL

SEQ ID NO: 182610 - protein, 46 aa, Glycine max
  Coding DNA Sequence Number=SeqID_65832
MLVLICRQALYYLNEFAALPHGTATDFPAQIAITKNSNNQVTDSRS

SEQ ID NO: 182611 - protein, 108 aa, Glycine max
  Coding DNA Sequence Number=SeqID_65833
MHSFRHGQRSSMRCTPVLLRQRMKTLRGCCVSSNNVHRIAGNICFELLHFGIEPRDPSRSASFATSLLSSASGVCAFTGGETPRCATAAGTANPNNHHYTYKLTTIYR

SEQ ID NO: 182612 - protein, 60 aa, Glycine max
  Coding DNA Sequence Number=SeqID_65834
MERMMGTSGMVEETLENSQKGFVCVVGMKKSKNKGRWEQEQPGICVVDKRGKYLSLILKL

SEQ ID NO: 182613 - protein, 297 aa, Glycine max
  Coding DNA Sequence Number=SeqID_65835
  Gene Ontology: Mol. function=protein kinase activity; Cellular component=mitochondrion; Biological process=protein amino acid phosphorylation
  Homolog annotation: Hit_ID=Q1SNH1; Match level="QueryCoverage=82%, HitCoverage=34%, E-value=6e-79, Identity=59%"; Hit description =Protein kinase
  Pfam annotation: Domain name=LRR_1; Domain location=122-144; Score =6.7; E_value=16; Accession=PF00560.23; Description=Leucine Rich Repeat
  Pfam annotation: Domain name=LRR_1; Domain location=146-168; Score =4.9; E_value=35; Accession=PF00560.23; Description=Leucine Rich Repeat
  Pfam annotation: Domain name=LRR_1; Domain location=170-192; Score =10.1; E_value=3.6; Accession=PF00560.23; Description=Leucine Rich Repeat
  Pfam annotation: Domain name=LRR_1; Domain location=194-216; Score =8.7; E_value=6.7; Accession=PF00560.23; Description=Leucine Rich Repeat
  Pfam annotation: Domain name=LRR_1; Domain location=218-239; Score =12.5; E_value=1.3; Accession=PF00560.23; Description=Leucine Rich Repeat
  Pfam annotation: Domain name=LRR_1; Domain location=241-260; Score =4.3; E_value=45; Accession=PF00560.23; Description=Leucine Rich Repeat
  Pfam annotation: Domain name=LRR_1; Domain location=262-284; Score =8.8; E_value=6.4; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=122-144::146-168::170 -192::194-216::218-239::241-260::262-284
MLRVGSMRYFYLYLVVLTWFLSIPSTHELQLAQTQVLLQLRKYLEYPTSLQMWENYNVDLCSLPPSAHVSLKCEGNSVTELKIMGDRAVKVDKFNGHAVPNQTLSLSFSIDSFVTTLTRLTNLRVLRLVSLGIWGPLPDKIHRLSLLEVLDMSLNFLYGSVPPKMSAMVKLHTLTLDGNYFNSTMPDWFDSLSNLSVLSLKSNHLKGSFPSTLCKIRSLVDISLSHNELSGGLPDLAALSGLHVLDLRENHLDSELPLMPKAVVTILLSKNSFSGEIPNHFSELSHLQHLDLSSNHL

SEQ ID NO: 182614 - protein, 300 aa, Glycine max
  Coding DNA Sequence Number=SeqID_65836
  Gene Ontology: Mol. function=protein kinase activity; Cellular component=mitochondrion; Biological process=protein amino acid phosphorylation
  Homolog annotation: Hit_ID=Q1SNH1; Match level="QueryCoverage=96%, HitCoverage=43%, E-value=1e-100, Identity=67%"; Hit description =Protein kinase
  Pfam annotation: Domain name=Pkinase; Domain location=121-297; Score=- 86.3; E_value=0.002; Accession=PF00069.15; Description=Protein kinase domain
  Pfam annotation: Domain name=Pkinase_Tyr; Domain location=121-297; Score=-141.2; E_value=0.00083; Accession=PF07714.7; Description =Protein tyrosine kinase
  Pfam module annotation: Pfam domain module=Pkinase::Pkinase_Tyr; Domain location=121-297::121-297
MVDFLLAWPIHRRRGTYCKVSSSGRKNFWKWKIAAAVAMIIVIVLVLSAFGVFFYRKYRSRKIYRHQMLSKAVQDNSITGVSSEVLASARFISQAAKLGTQATPIRRQFSIEELKEVTRNFDLSTYIGEGSLGKLYKGKLENGTYVVIRRVALSKKCSIQNLKAGLDLLSKLHHPNLVSLFGHCIDGDGQDDSSGLKLHLVYEYVPNGKYGTHLSEFSSDKALKWSDRLAILIGVAKAVHFLHTGVIPGCFRNQLKTNNILLDEHHIPKLSDYGMSIIAEEIEYLEAKGENLKSWYVYWW

SEQ ID NO: 182615 - protein, 288 aa, Glycine max
  Coding DNA Sequence Number=SeqID_65837
  Gene Ontology: Mol. function=nucleic acid binding; Cellular component= intracellular; Biological process=chromatin modification
  Homolog annotation: Hit_ID=Q4U315; Match level="QueryCoverage=97%, HitCoverage=98%, E-value=4e-42, Identity=38%"; Hit description =Cys2/His2 zinc-finger transcription factor
  Pfam annotation: Domain name=zf-C2H2; Domain location=194-216; Score =20.6; E_value=0.0055; Accession=PF00096.16; Description=Zinc finger, C2H2 type
  Pfam annotation: Domain name=zf-C2H2; Domain location=226-248; Score =20.5; E_value=0.0058; Accession=PF00096.16; Description=Zinc finger, C2H2 type
  Pfam annotation: Domain name=zf-C2H2; Domain location=4-26; Score =20.1; E_value=0.0082; Accession=PF00096.16; Description=Zinc finger, C2H2 type
  Pfam module annotation: Pfam domain module=zf-C2H2::zf-C2H2::zf-C2H2; Domain location=194-216::226-248::4-26
MERHKCKLCSRTFSNGRALGGHMKAHLATLPLPPKPPLSPSAASFSSNSSSEEATHDEKSLIYGLRENPKKCFRLADPEFNMASVVQDRESETESKNPTRRRSERTRRTVNSELKKAKLSFMESPEPVSSVSDTSPEEDVAMCLMMLSRDRWSKNNNNNIIIINNVVSNDDVVEEEEEGGRSVEIKLRRVRGKHKCQSCGKTFRSSRALGGHRSICEGSGNDSKTFQCPFCSKVFGSGQALGGHKRSHLMPSSSSTANNDSFRLKESFIDLNLPAPAEDDDLSVVSDA

SEQ ID NO: 182616 - protein, 124 aa, Glycine max
  Coding DNA Sequence Number=SeqID_65838
  Subcellular localization annotation: CTP_CleavageSite=42; ConfidenceScore=5.25e-01
MALQVSKTSASASRSYFLFFRSKGPPGSLQSYCYTHFCFIISTVAKQHRKIGVARWPTYYFQKKTCGRGILLLMRMILNWNPQSMGFSNVALLIECGKNVTIGFKFNPLCPFVRCVDPRHAQNV

SEQ ID NO: 182617 - protein, 67 aa, Glycine max
  Coding DNA Sequence Number=SeqID_65839
MATSGLGVAACNGASVRRQKGHVGSNLAVEAVRNVEGGWRECHGRKNSTLAVVKVSKGVMGTTTSSM

SEQ ID NO: 182618 - protein, 250 aa, Glycine max
  Coding DNA Sequence Number=SeqID_65840
  Gene Ontology: Mol. function=methyltransferase activity
  Homolog annotation: Hit_ID=Q1SSE9; Match level="QueryCoverage=99%, HitCoverage=18%, E-value=1e-54, Identity=49%"; Hit description=N-6 Adenine-specific DNA methylase
MASNPPFPMEDQTDEDFFDKLVEDDMEPVKSGHDEGYDSDEAKAFANLGINDVDAAAFENSNAAESGVEVKGEFSNVESDVGLEQEGNLMPVVSSVGFDGKVDPREDGIGMGSEVTSASASAVGTSDTAGSSGIKEVGWNSFHADLNGGGGLGSYSDFFSDLGDQSGDFTGNVYDNLSSEVKPDSAVQNDGLNASGNYVQYHEGQGYDGSLENRSNWQGDGLNASVYHVQYQEDQAYVASSEEHTNGQDL

SEQ ID NO: 182619 - protein, 358 aa, Glycine max
  Coding DNA Sequence Number=SeqID_65841
  Gene Ontology: Mol. function=pectinesterase activity; Cellular component=cell wall; Biological process=cell wall modification
  Homolog annotation: Hit_ID=Q8LQ65; Match level="QueryCoverage=82%, HitCoverage=77%, E-value=1e-85, Identity=50%"; Hit description =Pectin methyl esterase-like
  Pfam annotation: Domain name=Pectinesterase; Domain location=56-350; Score=230.8; E_value=3e-66; Accession=PF01095.10; Description =Pectinesterase
  Subcellular localization annotation: CTP_CleavageSite=22; ConfidenceScore=5.07e-01
MASSSLLVSLQVALVVFTCIFHAATVTCDRSFKIFSSMNNSSKSSHHWIGPIGHRKITVDVNGGGHYRSVQDAVNAVPDNNRKNVLVQINAGCYKEKVVVPVTKPYITFQGAGKEVTVIEWHDRASDPGPSGQQLRTYRTASVTVFATYFSARNISFKNTAPAPMPGMQGRQAVAFRISGDKAYFSGCGFYGAQDTLCDDAGRHYFKECYIEGSIDFIFGNGRSMYKDCELHSIATRFGSIAAHDRKEAEEKTGFAFVGCKVTGTGPLYVGRAMGQYSRIVYSYTYFDDIVAHGGWDDWDHADNKNKTVFFGVYKCWGPGAEAVRGVSWARDLNFESAHPFIRKSFVNGRHWIAPSDA

SEQ ID NO: 182620 - protein, 1512 aa, Glycine max
  Coding DNA Sequence Number=SeqID_65842
  Gene Ontology: Mol. function=methyltransferase activity
  Homolog annotation: Hit_ID=Q1SPB6; Match level="QueryCoverage=99%, HitCoverage=96%, E-value=0.0, Identity=61%"; Hit description=N-6 Adenine-specific DNA methylase
MASNPPFHMEDQTDEDFFNKLVEDDMEPHKSGHDEGDDSDEAKAFANLGINDVDAAAFDNSDAAVSGVEVKGGLGTVESDAGFEQEGNSLPSSSSAGFDSKVGPGEDGIGVGSEVRSASAVGTSNKVSSSEVKEVGWNSFHADLNGGGGFGSYSDFFSELGDQSGDFTGNVYDNLSSEVKQGNEVQNDGSNALGNYVQYHEGQGYDGSLESHTNRQGDGLNASVNHVQYQEGETYVASSEEHTNGQDLSSSQYWEDLYPGWKYDYKTGQWYQIDGYRATATTQQSSEANIAVDSSAASDGKTEISYMQQTAQSVAGTLAETGTTKNVSSWSQVSEGNHGYPEHMVFDPQYPGWYYDTIAQEWRSLETYNSTIQSSGHGHENGNASANTFSPNDHSLYSEYSQADNYGQRDVDNQAVDGSWSGLYGTNHKQGFEMYTTGSATIRGDNITSGGNQQINHSYGSSISVNEHQQNTSSSFGSVALYNRVNHDRGFANGTFKPQSFGPTGDTVQQFNYSTTKFSEQKVFSNDFTENEKPLSYSPQSIQGGHQYSHAPHVGRSSAGRPSHALVTFGFGGKLIIMKDPNLLSSSYGSQDSVQGSVSVLNLIEVVTGNMDSLSIRHNTSNYFHALSQQSFPGPLVGGSVGSKELYKWLDERIAHCESPDMDYKKGERLRLLLSLLKIGCQHYGKLRSPFGTDTILKESDTPESAVAKLFASAKMSGTQYGMPSHCLQNLPSEGQMRAMALEVQNLLVSGKKKEALQCAQEGQLWGPALVLASQLGEQFYVDTVKQMALRQLIAGSPLRTLCLLIAGQPAEVFSTDTSISEHPGASNMAQQSSQVGSNGMLDDWEENLAVITANRTKDDELVIIHLGDCLWKERSEITAAHICYLVAEANFESYSDSARLCLIGADHWKCPRTYASPEAIQRTELYEYSKVVGNSQFTLHPFQPYKLIYAFLLAEVGKVSDSLKYCQALLKSLKTGRAPEVESWKQLALSLEERIRIHQQGGYAANLAPAKLVGKLLNFFDSTAHRVVGGLPPPAPSSSAGTVHGSEKQYQNMAPRVSSSQSTMSLAPSASMEPISEWTADNNRMGKPNRSVSEPDFGRTPRQETTSPDAQEKPQASGGTSRFSRFGFGSQLLQKTVGLVLKPRSGRQAKLGDKNKFYYDEKLKRWVEEGAEVPAEEAAALTPPPTTAAFQNGSTEYNLRSALKTESSPPIEGSSIRTSSLELSPGMPLIPPSANQFSARGRLGVRSSVTFPFPFPFPFHFPFTFSGLHSDQLPHLPIVPQSSPPSPGSPVTRALAPKGHHGGCATMLHHPNVRSEAKAKPQMPIQSRDKNVDPERRCEQRRRSEAEMYVDTFNQGGGTSANLFRSPSVPSVKPAVAANAKFFIPSAAPSSNEQTMEAIVESKQEDSATNEDPSTSATNEWWSYQSPKQVSSTTIQRFPSLGNISNQRATEGSNSHLPHSRRTSSWSGSFNDSFTPPKMGMPSSRFMPDESLMRTHVKSSSYAEDLQEVEL

SEQ ID NO: 182621 - protein, 72 aa, Glycine max
  Coding DNA Sequence Number=SeqID_65843
MEQQQQRIVAGEGSKRKTKLNGRKKKMNERKKKLERLREKVERLHCGNNDSPFTPVVGCPSKNAGSPKQHPR

SEQ ID NO: 182622 - protein, 988 aa, Glycine max
  Coding DNA Sequence Number=SeqID_65844
  Gene Ontology: Mol. function=methyltransferase activity
  Homolog annotation: Hit_ID=Q1SSE9; Match level="QueryCoverage=99%, HitCoverage=64%, E-value=0.0, Identity=70%"; Hit description=N-6 Adenine-specific DNA methylase
  Subcellular localization annotation: CTP_CleavageSite=71; ConfidenceScore=5.13e-01
MYTTGSATTRGDSITSGGNQQINHSYGSSISVNEHQQNTSSSFGSVALYNRVNHDRGLANGTFEPQSFGPTGDTVQQFNYSTTKFSEQKVFSNDFTENQKPFSYSPQSIQGGHQYSHAPHVGRSSAGRPSHALVTFGFGGKLIIMKDPNLLSSSYGSQNSVQGSVSVLNLIEVVMGNMDSLSIGDNTSNYFHALSQQSFPGPLVGGSVGSKELYKWLDERIAHCESPDMDYKKGERLRLLLSLLKIGCQHYGKLRSPFGTDTILKEYDTPESAVAKLFASAKTSGTQYGMPSHCLQNLPSEGQIRAMALEVQNLLVSGKKKEALQCAQEGQLWGPALVLASQLGEQFYVDTVKQMALRQLVAGSPLRTLCLLIAGQQAEIFSTDTSISGHPGASDMSQQSPQVGSDGMLDDWEENLAVITANRTKSDELVIIHLGDCLWKERSEITAAHICYLVAEANFESYSDSARLCLIGADHWKCPRTYASPEAIQRTELYEYSKVVGNSQFTLHPFQPYKLIYAFMLAEVGKVPDSLKYCQALLKSLKTGRAPEVESWKQLALSLEERIRIHQQGGYAANLAPAKLVGKLLNFFDSTAHRVVGGLPPPAPLPSQGTIHGSEQQYQNMAPRVSSSQSTMSLAPSASMEPISEWTADNNRMAKPNRSVSEPDIGRIPRQETTSPDAQGKAQASGGTSRFSRFGFGSQLLQKTVGLVLKPRSGRQAKLGEKNKFYYDEKLKRWVEEGAEVPAEEASALPPPPTTAAFQNGSTEYNSRFALKTESSPPIEGSNIRTASPELSPGMPPIPPSANQFLARGRLGVRSRYVDTFNQGGGTSANLFQSPSVPSVKPALAANAKFFVPTPAPSSNEQAMDAIAEGKQEDSATNEYPSTSATNDWSYRSPKHVSSTAIQRFPSMGNISKQGATEGSNSHLPHSRRTASWSGSFNDSFTPQKMGNMKPLGEALGMPLSRYSPDESSMHKPVKSSSYGEDLHEVEL

SEQ ID NO: 182623 - protein, 268 aa, Glycine max
  Coding DNA Sequence Number=SeqID_65845
  Gene Ontology: Mol. function=nucleotide kinase activity; Cellular component=chloroplast; Biological process=nucleobase, nucleoside, nucleotide and nucleic acid metabolic process
  Homolog annotation: Hit_ID=Q38HW2; Match level="QueryCoverage=99%, HitCoverage=99%, E-value=2e-66, Identity=50%"; Hit description =Adenylate kinase family-like protein
  Pfam annotation: Domain name=ADK; Domain location=79-231; Score=13.4; E_value=6.9e-09; Accession=PF00406.12; Description=Adenylate kinase
MASIARLRSAVPPLKAFLRPERGFGSAAAVQCHYYDDDDDDVEEECAPRGMLDAQGCTPERGVQWVMIGEPGAKRHLFAQRLSKLLEVPHISMATLLSQDLNPRSSLYQQIAHSLDHGKLVPEDIIFGLLSKRLEDGYSRGETGFILDGFPRTRIQAEILDHIAHVDLVVNFKCSEEELMKKNLGTRKFNAYQEYILMTSSRSTKQLQDDHDQSHAEECKLLEDYYRKQKKLLNFEVAGGHGETWKGLLAALHLQHINALSSSQKLTA

SEQ ID NO: 182624 - protein, 125 aa, Glycine max
  Coding DNA Sequence Number=SeqID_65846
MKIFFGFCITGGGNGKWGCTWWLWPCSTCKLPDSVGPVVAWTICPIALELLLSLWVFQEEALYSARLFFFRLRQIVFNRNINGTRLERAFRLMLQTLTSTTTASTTQQEEQLNQDTFNTPLTLTL

SEQ ID NO: 182625 - protein, 107 aa, Glycine max
  Coding DNA Sequence Number=SeqID_65847
  Gene Ontology: Mol. function=hydrolase activity
  Homolog annotation: Hit_ID=Q28BZ2; Match level="QueryCoverage=70%, HitCoverage=48%, E-value=4e-12, Identity=47%"; Hit description =Histidine triad nucleotide binding protein 3
MAGATPSCVFCAIAAKSTSSNTLLYSDDKVVAFQDINPSAFRHYLVVPVAHIPTVKYLQRKTDDYSLVSHMLEVGKTLLNRDAPQSQQYRITGTTYMDALLYAAIQY

SEQ ID NO: 182626 - protein, 286 aa, Glycine max
  Coding DNA Sequence Number=SeqID_65848
  Gene Ontology: Mol. function=transferase activity, transferring hexosyl groups; Cellular component=soluble fraction; Biological process=carbohydrate biosynthetic process
  Homolog annotation: Hit_ID=Q1SPA8; Match level="QueryCoverage=87%, HitCoverage=54%, E-value=1e-138, Identity=89%"; Hit description =Glycosyl transferase, family 8
  Pfam annotation: Domain name=Glyco_transf_8; Domain location=50-268; Score=-4.0; E_value=3.4e-06; Accession=PF01501.10; Description =Glycosyl transferase family 8
  Subcellular localization annotation: CTP_CleavageSite=27; ConfidenceScore=5.05e-01
MGRNAAAAAASLRWSTTLLLLLLGLVVGTKATSYRRNAYATMMYVGTPRDYEFYVAVRVLLKSLSKLNVEADLVVIASVDVPLREEEDGAKVVRVENMDNPYKRQDNFDKRFKLSLNKLYAWSLVDYDRVVMLDADNLFLQNTDELFQCGQFCAVFINPCVFHTGLFVLQPSMVVFKDMVRELQNGRENPDGADQGFIASYFPELLDKPMFHPPSNGTKVDGTYRLPLGYQMDASYYYLKLRWSVPCGPNSVITFPGAPWLKPWYWWSWPVLPLGLQWHEQRRQTL

SEQ ID NO: 182627 - protein, 388 aa, Glycine max
  Coding DNA Sequence Number=SeqID_65849
  Gene Ontology: Mol. function=heat shock protein binding; Cellular component=integral to membrane; Biological process=protein folding
  Homolog annotation: Hit_ID=Q39079; Match level="QueryCoverage=96%, HitCoverage=97%, E-value=1e-66, Identity=54%"; Hit description =Chaperone protein dnaJ 13
  Pfam annotation: Domain name=DnaJ; Domain location=12-72; Score=46.3; E_value=1e-10; Accession=PF00226.21; Description=DnaJ domain
MDEPNEAQDHRELYALLNLSPEASDEEIRRAYRQWAQVYHPDKYQAPHMKDIATENFQRICEALTSGLELGPKLNGAEEIKAELERLKRMKEREKVAAHFQSSGTILANMSLPRYLNGNGLLRGMAMTSEIQSQLSKHNAVTIGGNLAVNGDEGGGAATAVFRHQLSEVSSVEVVASAGLRALIGVQTTRNLSSHSAATMGIAMSLKDGSLNLSNLWTRQLSETASGHKLFIKPYYLRRNKQKALEEEEKTSAQVKEARAAAEKAQKLQQTVANRKRNKQLETGGLVIMRALYGNQRIVNNLKSSSETSFESTSEVIDVTIPLNFLVNDSGQLKLHEGVKKSGIMGFCDPYPGSPKELYVEYVYAGNQYKVWAGDYEELQIPQGSHRI

SEQ ID NO: 182628 - protein, 197 aa, Glycine max
  Coding DNA Sequence Number=SeqID_65850
  Gene Ontology: Mol. function=transporter activity; Cellular component= intracellular; Biological process=transport
  Homolog annotation: Hit_ID=Q2A9T2; Match level="QueryCoverage=87%, HitCoverage=41%, E-value=6e-65, Identity=67%"; Hit description =CRAL/TRIO domain containing protein
  Pfam annotation: Domain name=CRAL_TRIO; Domain location=33-197; Score= 71.3; E_value=3.1e-18; Accession=PF00650.10; Description=CRALTRIO domain
MAQGFSSRRASKDMMSCKEFNFTEYDEVKKCYPHGYHGVDRYGRPVYIERIGMVDLNNLGQVTTFERFIKHHVSEQEKTLKVRFPACSLAAKRHIASTTSILDVNGVGMSNFSKPARYLFMEIQKIDSCYYPETLNQLFIINAGSGFRMLWKAVKAFLDVRTMAKIHVLGSNYLSVLLEAIDPRLETVTFWKENGFS

SEQ ID NO: 182629 - protein, 281 aa, Glycine max
  Coding DNA Sequence Number=SeqID_65851
  Gene Ontology: Mol. function=pepsin A activity; Cellular component =cellulose and pectin-containing cell wall; Biological process =proteolysis
  Homolog annotation: Hit_ID=Q1SPA3; Match level="QueryCoverage=99%, HitCoverage=59%, E-value=1e-108, Identity=68%"; Hit description =Peptidase aspartic, active site
  Pfam annotation: Domain name=Asp; Domain location=7-267; Score= -183.0; E_value=0.0085; Accession=PF00026.14; Description=Eukaryotic aspartyl protease
  Subcellular localization annotation: CTP_CleavageSite=53; ConfidenceScore=5.07e-01
MSQLFLKNFTFGCAHTALAEPTGVAGFGRGLLSLPAQLATLSPNLGNRFSYCLVSHSFDKERVRKPSPLILGHYDDYSSERVEFVYTSMLRNPKHSYFYCVGLTGISVGKRTILAPEMLRRVDRRGDGGVVVDSGTTFTMLPASLYNSVVAEFDRRVGRVHKRASEVEEKTGLGPCYFLEGLVEVPTVTWHFLGNNSNVMLPRMNYFYEFLDGEDEARRKVGCLMLMNGGDDTELSGGPGAILGNYQQQGFEVVYDLENQRVGFAKRQCASLWDSLNRDKN

SEQ ID NO: 182630 - protein, 119 aa, Glycine max
  Coding DNA Sequence Number=SeqID_65852
VVNLREEINGKCEDGDVDIEDSSMPKMVDMQNKDGNIMNLLEEAACPGSDSACSCRLVLQKIDCLEASLGDIKNKIKTLEDALQDTKMIKVQQTLLYQYPEMVVVQDSTKELLSYKKKK

SEQ ID NO: 182631 - protein, 51 aa, Glycine max
  Coding DNA Sequence Number=SeqID_65853
DERRHARSMLGPAEHNDEETVVTKTSDTEEDIVEMDYAQPHRKPPIHNEKP

SEQ ID NO: 182632 - protein, 176 aa, Glycine max
  Coding DNA Sequence Number=SeqID_65854
  Gene Ontology: Mol. function=L-lactate dehydrogenase activity; Cellular component=cytoplasm; Biological process=tricarboxylic acid cycle intermediate metabolic process
  Homolog annotation: Hit_ID=Q96569; Match level="QueryCoverage=97%, HitCoverage=61%, E-value=2e-54, Identity=58%"; Hit description=L -lactate dehydrogenase
  Pfam annotation: Domain name=Ldh_1_N; Domain location=40-138; Score =16.5; E_value=2.4e-07; Accession=PF00056.13; Description =lactatemalate dehydrogenase, NAD bind
  Subcellular localization annotation: CTP_CleavageSite=76; ConfidenceScore=5.28e-01
MAMHKRSSGSALGPGGLDLTQALFKSIMNAAPSSPTKDHNKISVVGAGNVGMAIAQTISLRISPTTMRFLTNTTVRCWTSSTPRPSSPAISTLFEKIIPPLVRYSPDTILLIVSNPVDVLTYVAWKLSGFPSNHVIGYGTNLDSSRFRFLIADHLDVNAQDVQAFIVGEHGDSSVV

SEQ ID NO: 182633 - protein, 185 aa, Glycine max
  Coding DNA Sequence Number=SeqID_65855
  Gene Ontology: Biological process=steroid metabolic process
  Homolog annotation: Hit_ID=Q9SU36; Match level="QueryCoverage=59%, HitCoverage=15%, E-value=6e-30, Identity=59%"; Hit description =Putative SWH1 protein
MRVKEMHPLCCISLESPGIGKHSPEREPAALFRTSSLPAAGSHGNAAQGSETTVAGVLYKWTNYGKGWRSRWFLLRNGVLSYAKIRCPENLNLLIPSDDVRLIGEISTNRLARVDGAATVTRRKHRKTSSSSGVVHLKSGSHQPVAEGGYGRLRLDVGGHNHIIAAPVLPLVVGGCISSFQLYSY

SEQ ID NO: 182634 - protein, 586 aa, Glycine max
  Coding DNA Sequence Number=SeqID_65856
  Gene Ontology: Mol. function=transporter activity; Cellular component= integral to membrane; Biological process=oligopeptide transport
  Homolog annotation: Hit_ID=Q7XAK5; Match level="QueryCoverage=99%, HitCoverage=99%, E-value=0.0, Identity=66%"; Hit description=Nitrate transporter
  Pfam annotation: Domain name=MFS_1; Domain location=37-518; Score =19.1; E_value=4.2e-05; Accession=PF07690.6; Description=Major Facilitator Superfamily
  Pfam annotation: Domain name=PTR2; Domain location=99-502; Score =465.6; E_value=6e-137; Accession=PF00854.12; Description=POT family
  Pfam module annotation: Pfam domain module=MFS_1::PTR2; Domain location=37-518::99-502
MSNLPTTQGKAIPDASDYKGRPAERSKTGGWTASAMILGGEVMERLTTLGIAVNLVTYLTGTMHLGNAASANVVTNFLGTSFMLCLLGGFLADTFLGRYRTIAIFAAVQATGVTILTISTIIPSLHPPKCNGDTVPPCVRANEKQLTVLYLALYVTALGTGGLKSSVSGFGSDQFDDSDDDEKKQMIKFFNWFYFFVSIGSLAATTVLVYVQDNIGRGWGYGICAGAIVVALLVFLSGTRKYRFKKLVGSPLTQFAEVFVAALRKRNMELPSDSSLLFNDYDPKKQTLPHSKQFRFLDKAAIMDSSECGGGMKRKWYLCTLTDVEEVKMILRMLPIWATTIMFWTIHAQMTTFSVSQATTMDRHIGKTFQMPAASMTVFLIGTILLTVPFYDRFIVPVAKKVLKNPHGFTPLQRIGVGLVLSVVSMVVGALIEIKRLRYAQSHGLVDKPEAKIPMTVFWLIPQNLFVGAGEAFMYMGQLDFFLRECPKGMKTMSTGLFLSTLSLGFFFSTLLVSIVNKMTAHGRPWLADNLNQGRLYDFYWLLAILSAINVVLYLVCAKWYVYKEKRLAEECIELEEADAAAFHGH

SEQ ID NO: 182635 - protein, 50 aa, Glycine max
  Coding DNA Sequence Number=SeqID_65857
MYFNTVGKAKGCEVGTANCTTAPVPNLNLYSEFKLGEKVVEYGSGLLGGN

SEQ ID NO: 182636 - protein, 669 aa, Glycine max
  Coding DNA Sequence Number=SeqID_65858
  Gene Ontology: Mol. function=protein binding; Cellular component =cytoplasm; Biological process=steroid metabolic process
  Homolog annotation: Hit_ID=Q9SU36; Match level="QueryCoverage=97%, HitCoverage=83%, E-value=0.0, Identity=65%"; Hit description =Putative SWH1 protein
  Pfam annotation: Domain name=Oxysterol_BP; Domain location=232-645; Score=200.4; E_value=4.3e-57; Accession=PF01237.9; Description =Oxysterol-binding protein
MAHWFGGPKPGGPISSFRESKSDDRRFYIFTATKTFHLRTDSRKDRVAWIQALVSTRGLYPLQPLNDHLLLAPNNISLSTERLKIRLLEEGTGENLVKECEQILLTEFSEMQGQLEVLCQERSNLLDTIRQLEFCQTHEYMSKAANTEPEAAAIHNGEYQLTKNEFSSLGRGKYSECSTTESSDDIEKQEMEEVSDEDEISYYDTRECFTEPDCKCESAGAMNQVDRCREPNTLYTDTENIHPEKMVCNYKHPQIARRKKLPDPVEKEKGVSLWSMIKDNLGKDLTRVCLPVYFNEPISSLQKCCEDLEYSYLLDQAYEYGKSGNGLLRALYVAAFAVSGYASSEGRNCKPFNPLLGETYEADYPDKGIRFFSEKTQLWCGLNNDDEEVSHHPTLIACHCEGRGWKFWADTNIHSKFWGRSIQLDPVGVLTLEFSDGEIFQWSKVTTTIYNLILGKIYCDHHGNMDIRGNRTYSCRLKFKEQTILDRNPRQVHGFIEDVTGKKVATLFGKWDDSMYYMNGNVNVKPKDFTSSNASLLWKRTMPSPNLTRYNLTPFAITLNELTPGLKEKLPPTDSRLRPDQRDLENGEYERANLEKQRLEKRQRMLVAYYSRKIQESGWKPRWFRREGENGTFRYVGGYWEAREHGRWDGCPNTFGEFNEDSTDPLGAS

SEQ ID NO: 182637 - protein, 820 aa, Glycine max
  Coding DNA Sequence Number=SeqID_65859
  Gene Ontology: Mol. function=protein kinase activity; Biological process=protein amino acid phosphorylation
  Homolog annotation: Hit_ID=Q9SYX2; Match level="QueryCoverage=92%, HitCoverage=74%, E-value=1e-132, Identity=40%"; Hit description =Phytochrome A supressor spa1
  Pfam annotation: Domain name=Pkinase; Domain location=174-494; Score=- 67.8; E_value=0.00016; Accession=PF00069.15; Description=Protein kinase domain
  Pfam annotation: Domain name=Pkinase_Tyr; Domain location=174-494; Score=-169.3; E_value=0.044; Accession=PF07714.7; Description =Protein tyrosine kinase
  Pfam annotation: Domain name=WD40; Domain location=682-720; Score =8.0; E_value=4.3; Accession=PF00400.22; Description=WD domain, G -beta repeat
  Pfam annotation: Domain name=WD40; Domain location=731-770; Score =18.2; E_value=0.03; Accession=PF00400.22; Description=WD domain, G -beta repeat
  Pfam annotation: Domain name=WD40; Domain location=774-813; Score =37.1; E_value=6.2e-08; Accession=PF00400.22; Description=WD domain, G-beta repeat
  Pfam module annotation: Pfam domain module=Pkinase::Pkinase _Tyr::WD40::WD40::WD40; Domain location=174-494::174-494::682 -720::731-770::774-813
MPRSPRLCTPIRKEWPEESLPNDNVIGLNSYVTSLAGSGPPSSSFCSTIDSEHIVEELPVRNYENQNINLVNHPHNSRQARNQLTIESKYNILSREVVPKVEEQMPLRLSKGLKGIDSEFWGLKSLAGKSVNRDSLKVSEDISSMGKAIISNNAHLISSITQSTSSAYNYPQLIVKQTRKGKGVICEDLNKSFSIGGALKSQEDEKLGFAAKFQSETLVRSNVDENNKPLLEGTFMSGCNGLNLRDWLKFKGHKMNKSGRIHIFKQVLELVDFEHSQGLVLLDFRPSCFTLLPSSKIKYIGSFGQQELDYEVMTCNVTRKRPLEQNTCACQSLSTKQKKLCEETGSSRQQHHCTSIHGCQTTVNQTDSDTNRPVESRSKESLCQNNSTCTEEKQFMSVLNKLEEKWYCSPEVLNDGVCTFSSNIYSLGVLLFELLCNIESWETHSTAMLDLCHRILPPKFLAENPKEAGFCLWLLHPEPSSRPNARMILDSEVIRESKESNSVDDVGISDDEAETEQLLDFLILFKEEKKKREAKLKEELNLLNEDMKEVERSYSFVTDSVFPLVQINNPELRGDSLHFQDSSGSDISRSIRRLFGYEERYMSNINQLENSYFSSRFRVLPKEASSVSINDKNVMESRWRLPQVENVNKESRRIQSSVGCLGSFFEGLCKFARYSKFEECGRLRNRDLLSSANVMCALSFDRDEDHIAAGGVSKKIKIFDLNAISSDSVDIQYPVVEMSNKSKLSCVCWNPYIKNHLASTDYDGVVQMWDADTGQPLSQYMEHQKRAWSVHFSLSDPKMFASGSDDCSVKLWNISEACFF

SEQ ID NO: 182638 - protein, 285 aa, Glycine max
  Coding DNA Sequence Number=SeqID_65860
  Gene Ontology: Mol. function=nucleic acid binding; Cellular component= intracellular; Biological process=chromatin modification
  Homolog annotation: Hit_ID=Q109A0; Match level="QueryCoverage=65%, HitCoverage=100%, E-value=1e-29, Identity=43%"; Hit description =Expressed protein
MASGWMKSLQCKSRAYQDVYHPNSKYLIPSSSCRKTIKDVVVDTTKPRPKPNPKPEKPLQKHPSSRYPSSAAKPDFETTINRSRSVTATRHADPRFPSLTELTEGHPSRNVVEIIFHTSWGPKPFSGLVEMIFKVHNGPRTVSRFEEYREAVKVRAGTGPAHDYEENARCVADGNEVMRFHCLGPTSGGAPYGGACALSFPGGKGAAICTFSGSGGAHESSGGGRGRRAMLVCRVIAGRISKQIGFVESLLDGRVGFDSVSGDNGELLVFDSRAVLPCFLIIYKL

SEQ ID NO: 182639 - protein, 138 aa, Glycine max
  Coding DNA Sequence Number=SeqID_65861
  Gene Ontology: Mol. function=transporter activity; Cellular component= integral to membrane; Biological process=transport
  Homolog annotation: Hit_ID=Q6KAW0; Match level="QueryCoverage=59%, HitCoverage=30%, E-value=8e-32, Identity=79%"; Hit description=Nod26- like major intrinsic protein
  Pfam annotation: Domain name=MIP; Domain location=41-138; Score= -104.9; E_value=0.006; Accession=PF00230.10; Description=Major intrinsic protein
  Subcellular localization annotation: CTP_CleavageSite=52; ConfidenceScore=5.29e-01
MEGTSSQSTFAFIPSTIETPSPSIPEISSSSSPGSLARIAQSYPPGFPRKVLAEIIGTFLLVFVGSGSAGLSKIDERMVSKLGASLAGGLIVTVMIYSIGHISGAHMNPAVSLAFTAVRHLPWPQSNGTWVGYQVNEF

SEQ ID NO: 182640 - protein, 32 aa, Glycine max
  Coding DNA Sequence Number=SeqID_65862
MNNCLTHETGNVGYAAYMGDKEISVPWSGLML

SEQ ID NO: 182641 - protein, 278 aa, Glycine max
  Coding DNA Sequence Number=SeqID_65863
  Homolog annotation: Hit_ID=Q47522; Match level="QueryCoverage=15%, HitCoverage=53%, E-value=8e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDHQRKILKQALGETFHQRLQFEGGHDVKYSHKFLLYLDFLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 182642 - protein, 215 aa, Glycine max
  Coding DNA Sequence Number=SeqID_65864
  Gene Ontology: Mol. function=helicase activity; Biological process =viral genome replication
  Homolog annotation: Hit_ID=Q2R1R7; Match level="QueryCoverage=98%, HitCoverage=13%, E-value=4e-48, Identity=48%"; Hit description=AT hook motif-containing protein, putative
MWYNERISKDKNTTSPKFSLCCGDVKVELPLLQTPPKYLEQLLFDDYATDSKNYQHNIQTYNMMFAFTSIGIKLDKSINETRGPPTVRIQGQPCVRIGSLLPMPEKQPKFAQLYIFDTQNEIENRINIMSQHATIQPDIILTLSQMLDDHNVHAKSFRMARDRLADSQLDNVKLRLIAGREKDGRTYNLPNVSEVASLIVGDFDADSRRDIIVET

SEQ ID NO: 182643 - protein, 157 aa, Glycine max
  Coding DNA Sequence Number=SeqID_65865
MNSTSFQGDRAKLDPFTLSAFIFSVDFNVELAKYICALSEKFDEFKAELKRRNWHKKLTNFMDGSIDVAIVKEFYANLYDPEDNSPKQVRVRGHLIKFDADALNTFLKTPVIIEEEEELPSYSRWVALENPEEEFDHSCSDMERSFILQPGPYFSPF

SEQ ID NO: 182644 - protein, 79 aa, Glycine max
  Coding DNA Sequence Number=SeqID_65866
MQAQGSINQTFIQLKLGAREKSFMHMVSFLARWLFTIKHGLHHPQIHALIPYFKDSCKNHYPMLVVFLTIKITLSPGYS

SEQ ID NO: 182645 - protein, 149 aa, Glycine max
  Coding DNA Sequence Number=SeqID_65867
MTQELVTRGDTLRLSAPRHSVTPSVIDEQRLIWSFAPFPEMSAFSDGDFPSLTNYLELRRGGGPDDTRRYLTVIRTLVSSRGGGPDDTRKYLTVTRTLVSSRGSGPDDMRRYLTVIRTLVSSRGGGPDDTRRYLTVIRTLLSSRGRRAR

SEQ ID NO: 182646 - protein, 152 aa, Glycine max
  Coding DNA Sequence Number=SeqID_65868
MEDAPVSPRVALLALPSRRRMKVDMEAMKEQMATMMEAMMSMKKIMETNAVAVAATSAVAKVNPMPPFDLNQMNHPTLDMVGKDLGSTDGPMMCKFKMSAPSRHMACLPTIHHPMWHTLPIRMSITSLRYSLKANNLNPIMHMCLKPWGRHM

SEQ ID NO: 182647 - protein, 128 aa, Glycine max
  Coding DNA Sequence Number=SeqID_65869
MSHHSSSVNGEGKERVEITQDEKEQIREEERRKILKELRKEKHGSYSSHDSCKSPSEELHEYYEGRNRSHFRPHSHRREKERKPQEANINLPYFHGKDNVEAYLDWEIRVEQQLKRKSTSRHLRGGIF

SEQ ID NO: 182648 - protein, 123 aa, Glycine max
  Coding DNA Sequence Number=SeqID_65870
MRSLPVEVPVGLCRHNIGIVPTRHLVDSEEPNRTLGFPALVTGLDQSYRVPVPPARSCHCDIECPSPPSKVIRHPTNQAFIEKYCAPRQAQGETPQQPGDGRQRATDAPPPPLEFTSAHPQKG

SEQ ID NO: 182649 - protein, 97 aa, Glycine max
  Coding DNA Sequence Number=SeqID_65871
MLAIMNLWTLLPGNGAKFDRGVPESNKHENAAPHTPVSPSSIKHERKLGSEGKLPGNHITSETSKRVGLRPQKETTPKNLAFHGFKQKTQMKHEAET

SEQ ID NO: 182650 - protein, 124 aa, Glycine max
  Coding DNA Sequence Number=SeqID_65872
MRLPGKESLLMKSPITINEILDVSISFLNDHLEETLGSTKIEEIHSKCINLAQGKDYGESGFWLKVCRMARHDTCRGLVWLKDKRDAPHYFHDTNAKMMIWKLYAKLVMHASTRTLKCQLFMVM

SEQ ID NO: 182651 - protein, 90 aa, Glycine max
  Coding DNA Sequence Number=SeqID_65873
  Gene Ontology: Mol. function=nucleic acid binding
  Homolog annotation: Hit_ID=Q1S9I4; Match level="QueryCoverage=71%, HitCoverage=6%, E-value=1e-10, Identity=44%"; Hit description =Integrase, catalytic region; Zinc finger, CCHC-type
MAYLDSLSFKSIFRNRLLKDDDGDQVNMCLMTKSSENNKEDSIRKKWYIDSGCSKHMTGDVSKFTTISPKKSGHVTYGDNNKGKLLESKV

SEQ ID NO: 182652 - protein, 77 aa, Glycine max
  Coding DNA Sequence Number=SeqID_65874
ACGWWCWVFDAVLVVGGVGCLTQCLWLVVLGGGSDVGLVDGGGSADGGGSRRRRVAVLCRLGCSGALTVRIHSSDTH

SEQ ID NO: 182653 - protein, 123 aa, Glycine max
  Coding DNA Sequence Number=SeqID_65875
  Homolog annotation: Hit_ID=Q2R581; Match level="QueryCoverage=76%, HitCoverage=31%, E-value=2e-12, Identity=39%"; Hit description =Expressed protein
WEGQGAYDRSRGNRRNWILVWEDGFCNFAASAAPEINSGDCSTPPAYGNCEFQPYQGLQPELFFKMSHEIYNYGEGLIGKVAADHSHKWIYKEPNDQEINFLTAWHNSADSVRKKNPTYILQR

SEQ ID NO: 182654 - protein, 293 aa, Glycine max
  Coding DNA Sequence Number=SeqID_65876
  Gene Ontology: Mol. function=hydrolase activity; Cellular component =integral to membrane; Biological process=lipid metabolic process
  Homolog annotation: Hit_ID=Q8YB65; Match level="QueryCoverage=96%, HitCoverage=97%, E-value=1e-121, Identity=75%"; Hit description =SERINE PROTEASE
  Pfam annotation: Domain name=Patatin; Domain location=15-189; Score =127.4; E_value=4.1e-35; Accession=PF01734.12; Description=Patatin -like phospholipase
GRLEKAVPSSPRIAVAFGGGGARGIAHLQIVEVLDELGIKPVAIAGSSIGSIVGAGMASGMTGHEIHKYMAAIFNRRSEVAKRMWQTRPARWVELLKGGLRVSQFNIEKVLDVFLPESLPANVEELKIPMSITAADFHAAQEIHIRDGDLHSAIAASCAIPPVFAPVRREGRILVDGGLFNPVPFDLLFDKADIVIGIDVVGTPVGPDDYMPTTFEAVIGANQLTMCSIIENKFRIRPPHIFIRPNVERIGLLDFLKFEQILSQSASVRDELKRAIELTIEGKAAPIASTLAN

SEQ ID NO: 182655 - protein, 182 aa, Glycine max
  Coding DNA Sequence Number=SeqID_65877
  Subcellular localization annotation: CTP_CleavageSite=56; ConfidenceScore=5.14e-01
MMSESMLVRFPLKASTWFRLQDFAWTAAGRRVWIMRTSMTTLTQTWMTLLLSNVLPSDHNSDLPLPKCQLVYAILTRISVHVAQVIVDAIYLFAGMPPTRHPLDPDKSNRALGFPALITGLCQSFGVPVTPSKVIRPPITRAFIEKYCTPRQAQSDAHQAADTPPPPRQADPAGSLGMERYL

SEQ ID NO: 182656 - protein, 127 aa, Glycine max
  Coding DNA Sequence Number=SeqID_65878
  Gene Ontology: Mol. function=ribonuclease H activity; Biological process=DNA integration
MNGAVEEANKNIKKIIQKMTVSYKDWHEMLPFVLHSYRTSARTSTGATPFSLVYGMEVGTRRFSEGDLVLKKVSEALKDNRGKWAPNYEGPFVVKKAFSGGALVLTNMDGEELPSPVNSDVVKRYYA

SEQ ID NO: 182657 - protein, 100 aa, Glycine max
  Coding DNA Sequence Number=SeqID_65879
  Homolog annotation: Hit_ID=O65809; Match level="QueryCoverage=34%, HitCoverage=26%, E-value=6e-10, Identity=85%"; Hit description =Profilin-1
MVVTFFPRLTASGFTLDDHIFGATKIQSYWSKRSRLVKVIHDGSYILSYKYISFFLHWEEAAGNKQLMKFSTVGTRMPTYKDQEGLWLGTIWRDSRRHQP

SEQ ID NO: 182658 - protein, 270 aa, Glycine max
  Coding DNA Sequence Number=SeqID_65880
  Homolog annotation: Hit_ID=Q1EPJ1; Match level="QueryCoverage=32%, HitCoverage=31%, E-value=2e-09, Identity=38%"; Hit description=6 -phosphogluconate dehydrogenase NAD-binding domain-containing protein
  Pfam annotation: Domain name=NAD_binding_2; Domain location=13-132; Score=-84.1; E_value=0.068; Accession=PF03446.5; Description=NAD binding domain of 6-phosphogluconate dehydrogenase
MAMETSSKPTMEAANNGPTTPRSPLLNTHVIAAHSDVIFLFVLLHPFSGTLFVVRLGGVLIDVKTSKPSLTQNLRCRRIKGCHSINASIYKDNCGAKNGTLAIFASGEESMVKRLKPLFRRAKVVVEGLVGSGGEWAKFLHGVTFRNIFPKWSPCKSQERMALSLRTRQLAMVSPFTMACCRGWTRQSNWRVEGADFEAPSSMAFCLAKGASTSSDSRCLSCLNPPLRRPFHTRKRKEKRRSVLCLRKNEGVLLCCLYLSKPLLLFFILS

SEQ ID NO: 182659 - protein, 104 aa, Glycine max
  Coding DNA Sequence Number=SeqID_65881
  Homolog annotation: Hit_ID=Q5VMB6; Match level="QueryCoverage=65%, HitCoverage=20%, E-value=4e-17, Identity=68%"; Hit description=SF16 protein-like
WNGVVVLKPRRKSFQGYIKEKKQQSRGKEPWHMPCLIRASSSQGLGNYELGKASWSWSWNDRWIAALPVDHHVTEMIVGQDLVEWQILVAIGEDLPLSQSHTFI

SEQ ID NO: 182660 - protein, 94 aa, Glycine max
  Coding DNA Sequence Number=SeqID_65882
MPHQNNFVGYAFTEINPKKFDIPKGCSIDQLKDLIKQVAPKGNPPHGIHESQVVRHLFYRQPSHLEYSEKVLEFEIIELKCDHDVLKVLVESNY

SEQ ID NO: 182661 - protein, 127 aa, Glycine max
  Coding DNA Sequence Number=SeqID_65883
MDNPSTSRDLFNFSNLSMPPRRLIYSSYYLANSLSKWLCTNDHESLPIPEILIPGDRCRTGCHDITLQNMQFMCVRMNRLNKVPSRWLTKDSSPKNSQTNSSIPDLVQNSCSLHDYIAVYDSGLQVP

SEQ ID NO: 182662 - protein, 72 aa, Glycine max
  Coding DNA Sequence Number=SeqID_65884
  Homolog annotation: Hit_ID=Q1SG00; Match level="QueryCoverage=52%, HitCoverage=17%, E-value=7e-11, Identity=86%"; Hit description =Fibronectin, type III-like fold
  Subcellular localization annotation: CTP_CleavageSite=36; ConfidenceScore=5.25e-01
MIPASFSIQLKRNKSDVVLNNNRRLFNTEKLIFKTNSNQASNTQNLSELSLNGPVGQVYALVVNNDMLFAGT

SEQ ID NO: 182663 - protein, 198 aa, Glycine max
  Coding DNA Sequence Number=SeqID_65885
  Homolog annotation: Hit_ID=Q1T493; Match level="QueryCoverage=98%, HitCoverage=39%, E-value=9e-30, Identity=35%"; Hit description =Nucleic acid-binding, OB-fold, subgroup
MARAPDNIKSINGSKETLKLVVRITDLWFVGTFNRSEQAEMVITDSHGDAIYVVCKQDQLKSWKTNLMENCTYVMHNFKVMKNDGQFRICDHQKSDLEDLPFKKYKFADFTNIIVGLFQPKLLVDIIGVVDEVVYRHVGSKSTRVVFKLKDLSGQILSCTLWDSYCLQFLDYLNESENDVPIIIILTHARIKEGQGTT

SEQ ID NO: 182664 - protein, 166 aa, Glycine max
  Coding DNA Sequence Number=SeqID_65886
  Homolog annotation: Hit_ID=Q1T493; Match level="QueryCoverage=66%, HitCoverage=20%, E-value=4e-11, Identity=28%"; Hit description =Nucleic acid-binding, OB-fold, subgroup
  Subcellular localization annotation: CTP_CleavageSite=62; ConfidenceScore=5.22e-01
MKLCLKFKNSGRGIQVRSVLTPGGQGSSQVSGSSQLSSKDAFLSKAEAKTISEISNISEEIVCVTTGSINRIVMDNHSWCYSACSYCYKKTDVETTAFTCACGKHNDQPVLRYRLEVMVNYKEESTKFLLWDCECTELIGPSANEVNKLKIEVPNQIIIRWFLTFE

SEQ ID NO: 182665 - protein, 200 aa, Glycine max
  Coding DNA Sequence Number=SeqID_65887
  Gene Ontology: Cellular component=cytoskeleton; Biological process =regulation of actin filament polymerization
MEVKVKDNGNVCQRHDSAEKPLEIDHPLYEFGSVEYHIQSQASNPQVAYLSISMSPLCHGVLPNELSYYTIEMVKGLCPNVVEIAEPAKEGYQLALKLNLNQIPRNKDYDKVIMEISTIHSVILSSQLKEILWNVNSDDALQGMYKPIKLLYHPKDLFVLIRQPQRIIAVFPIRFKEKSDVIIATNFFQISLLAVLKAIG

SEQ ID NO: 182666 - protein, 58 aa, Glycine max
  Coding DNA Sequence Number=SeqID_65888
MDFILGILAEQNNRRERKPKYVVQKETHNFGNPDDDESELMVVPVEVEDESELMLAVV

SEQ ID NO: 182667 - protein, 149 aa, Glycine max
  Coding DNA Sequence Number=SeqID_65889
  Subcellular localization annotation: CTP_CleavageSite=72; ConfidenceScore=5.44e-01
MACTMNKKCIKATPLKISSLRSHCTSTLSFPKKVIFPHPFNPKTSVYKENPTCNNQVPLNTNPQDNKNSAKNAKEKVNTPEGQKRHWLVEEGEFVSGVVAREGEEEGKLGKGEDGVGDKQSVEIKGLPLWVGEVPKFGVEVRGVVKVEE

SEQ ID NO: 182668 - protein, 41 aa, Glycine max
  Coding DNA Sequence Number=SeqID_65890
MTSNTIVVPSFYHQQWAPEYPDFVHFRYDGTAYQIRLRQHR

SEQ ID NO: 182669 - protein, 94 aa, Glycine max
  Coding DNA Sequence Number=SeqID_65891
  Homolog annotation: Hit_ID=Q1SK64; Match level="QueryCoverage=85%, HitCoverage=10%, E-value=6e-08, Identity=33%"; Hit description =Transposase
VDTQDVVRDILWSHLDSIKFLNSFSIVLIYDSIYKMNKYRRLSLLEIVEVQGLFVEDDVLPQVIVTNRDLALMNALKSVFPSSTASYVNPILLR

SEQ ID NO: 182670 - protein, 108 aa, Glycine max
  Coding DNA Sequence Number=SeqID_65892
MREIEERLRAIEGGGDHAFADMAELYLVPDVVIPSKFKVPDFDKYKGTTCPKNHLKVYYKKMEAYAKDEKLLMHFFQESLTGAAVTWYTNLESSRVHSWKDLMVAFVR

SEQ ID NO: 182671 - protein, 113 aa, Glycine max
  Coding DNA Sequence Number=SeqID_65893
  Homolog annotation: Hit_ID=Q2QYE5; Match level="QueryCoverage=52%, HitCoverage=20%, E-value=7e-09, Identity=50%"; Hit description =Pentatricopeptide, putative, expressed
LFKGLEAFDRKPRDKSIIQKVANAYEVLGLVKEKERVLEKYNHLFTETGPTKRHKRNSFEAKKHVHPTKEKRHQKQSRKASSEEKYKSVDQSASMFKYSANLCGKPIKARSAA

SEQ ID NO: 182672 - protein, 327 aa, Glycine max
  Coding DNA Sequence Number=SeqID_65894
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8PCF4; Match level="QueryCoverage=71%, HitCoverage=55%, E-value=2e-84, Identity=67%"; Hit description=Two -component system sensor protein
RADQGRPGQAAQYRFHRRLHTHARHRWPAGCVAVPRGHAAHDPGRLCDLDQGAGAEGQLQLRDCGRRRGATRTPSGRCQPWLASTEAAGAASAEDHRGLGALAWLAGQADLPAEAVAQPAHDRQAQAGALRTARLGTVERLEGPRQRVGRHADTGIAHHHPVVVHMHVDAPFVGVAAGVAHQVADHHLQHPRRRMQLHRAIAVQVHRHRARTQQFVGVVHFIADDVVDVEQLDLGLDVGLACQDQEGIDHRLHVTACTLDALQAAAQARLQAVIAQCHVAGHADDGQRCAQIMAGVAGDIALARHMRADPVGQRMQCGRQLPGLALH

SEQ ID NO: 182673 - protein, 129 aa, Glycine max
  Coding DNA Sequence Number=SeqID_65895
MEGKKQTLGREMARAQHAVTMQGVDMAAENSMTATTTLHQVAPTKRLLRHAVHIEEGEKEILDLSLGKRSKKVDESEGENKLHKLRWSSFVRGLVNDRDTGKKEVWDHMERHRSGVHSLRRKHLTLRLD

SEQ ID NO: 182674 - protein, 254 aa, Glycine max
  Coding DNA Sequence Number=SeqID_65896
  Gene Ontology: Mol. function=translation initiation factor activity; Cellular component=cytoplasm; Biological process=translational initiation
  Homolog annotation: Hit_ID=Q4PZB3; Match level="QueryCoverage=67%, HitCoverage=68%, E-value=4e-61, Identity=69%"; Hit description =Eukaryotic initiation factor 4E
  Pfam annotation: Domain name=IF4E; Domain location=1-231; Score =207.1; E_value=4e-59; Accession=PF01652.9; Description=Eukaryotic initiation factor 4E
MATSEEVVAAAPEAAALEAGLKHKLERKWTFWCDNQSKPKQGAAWGTSLRKVYTFDTVEEFWWYKFSLPPPFFCSTIFIFLISEKGNLSMQSQILLWVFKPSKLQINADFHLFKTGIEPKWEDPECANGGKWSVTSNSGRKANLDNMWLETMMALIGEQFEDAEDICGVVASVRQWQDKLSLWTKTAANEAAQRLNLKGLKDILTLILNTLYGCCCHFNLSRRLISNMIELKNESLSLILSYSLNELDGCQGFY

SEQ ID NO: 182675 - protein, 243 aa, Glycine max
  Coding DNA Sequence Number=SeqID_65897
  Gene Ontology: Mol. function=zinc ion binding; Cellular component =intracellular
  Homolog annotation: Hit_ID=Q6H517; Match level="QueryCoverage=54%, HitCoverage=54%, E-value=3e-44, Identity=62%"; Hit description =Putative zinc-binding protein
  Pfam annotation: Domain name=PLATZ; Domain location=23-133; Score =206.7; E_value=5.2e-59; Accession=PF04640.4; Description=PLATZ transcription factor
MVGFNSVPNWLLILKEEKFFTRCLIHHSVKKNEKNIFCLDCCTSICLHCLPFHRSHVLLQIRRYMYNDVLRLGDAQTLLNCSLVQPYTTNKTKVVFLKQRPPTGSHRGSSNICITCDRNLQDPYIFCSVSCKVHQHVLLITKSTSIKDTWNKHEFSVLLDKERSSENHQEIEDSQITTDSVLDSHSPTSTSLCTVSGSTSTNSGSVTENESLKKKRGSVDMVPEIWYTMVNRRKGVPHRSPFY

SEQ ID NO: 182676 - protein, 129 aa, Glycine max
  Coding DNA Sequence Number=SeqID_65898
MQVIKSEIDGSKINLTFMNQDMQGSFERKEKALENLVVSNEVNLLLLENHALKSSNVGDLKLMGIRTMQVSRSEPLMATHQKSLRNLKAAKKEIEKQELVTWCLNEELEKLVTYGFNGDKYLLARKTLD

SEQ ID NO: 182677 - protein, 86 aa, Glycine max
  Coding DNA Sequence Number=SeqID_65899
MGMPRQCRLDIARYCRERLQTVGSVSCVDPLLSSYFPSLQQEKQGRRGQKIEERELKVEIKNRKEEKIERQEKVEERCCWRGCESD

SEQ ID NO: 182678 - protein, 214 aa, Glycine max
  Coding DNA Sequence Number=SeqID_65900
  Gene Ontology: Mol. function=hydrolase activity, acting on ester bonds; Cellular component=cellulose and pectin-containing cell wall; Biological process=lipid metabolic process
  Homolog annotation: Hit_ID=Q6ESR5; Match level="QueryCoverage=99%, HitCoverage=58%, E-value=2e-37, Identity=38%"; Hit description =Putative anter-specific proline-rich protein APG
  Pfam annotation: Domain name=Lipase_GDSL; Domain location=1-212; Score=25.9; E_value=1.3e-05; Accession=PF00657.12; Description=GDSL -like LipaseAcylhydrolase
MADQIQQFATVHGNILQYLNDTAEATINKSLFLISAGSNDIFDFLLYNVSKNPNFNITREVQEFFNLLRTTYHTHLKNLHNLGARKFGILSVPPVGCVPIVTNGTGHCVNDINTLAALFHIEIGDVLENLSSEFPGMKYSLGNSYAITYDMINNPDPLHLSNVTSACCGNETVIDGVPCGSDTQVCENRSQFLFWDQYHPTEHASRIAAHKLYS

SEQ ID NO: 182679 - protein, 148 aa, Glycine max
  Coding DNA Sequence Number=SeqID_65901
MGEVEELQEQMKADMEAMKEQMATMMEAMMSMKKIMEANAIAVAATRAVAKVNLMPPSDLNQMNHPTSYMVGKDLGSTDDPMICKYKTSTPSRHMACLPTIRHPMWRTLPMRMSITPLLYPLRANNPKLIMHISLKPWGRHMKFPTTI

SEQ ID NO: 182680 - protein, 181 aa, Glycine max
  Coding DNA Sequence Number=SeqID_65902
  Gene Ontology: Mol. function=nucleic acid binding; Biological process= DNA integration
  Homolog annotation: Hit_ID=Q0ZCC5; Match level="QueryCoverage=86%, HitCoverage=9%, E-value=8e-31, Identity=46%"; Hit description=CCHC -type integrase
MGNVSVKDYSGRLMDVVNQMGLVGEASFTNHKVFEKIMVLAPDKFEAKISKIEESCDLQTLTIAKLTSKLHAQEQRVSMGSDEDNEGAFPAKHNGRSSNNNKGRVHGSSRKDFFCLVLIAKEPTMLKKILEQQPEQQAKLIEEDSIEDEHLFMGPDSLGSMKVGKDWALLTAPPALLTILP

SEQ ID NO: 182681 - protein, 496 aa, Glycine max
  Coding DNA Sequence Number=SeqID_65903
MERRHEEELTKLKADHDQAEARVSRPQGDEQSAHTLPERTQGESHPRHIGNTADDLSLSHMHRLAVRTIHQHAFVDHIMEAAIPLGWKPLNLELSHYMTLTALASLQQSDDESLRKFMHRFGSISVWIKNLNPEVALHSMLLALRPDKFIDSLCKKPLGSMDELCERAKGYIQMEEMSRFRNEVRQVGQKHNKHKANIKTNSHKSDKWHKLDKHQPLSKGPNIQSGGTHLATPDETSEDGVRCNQVLQVSPLYWAMKNKIKELIHAGKEQDLKDIKRSSTGVGKQTGEEQKIEADRDNIHNGASDHLHQNKNPPSTSEQSLPPITFMDRDFRGINPVNQDNHVVISIIIANLKSQDQRLHGLDEHLQSWKTLNELRAILSTPHLAMKFLTLAREIVSVKVDQKQACYCYAEILKVAPYPPIWESIMPHPTTDEATQVMTVEEGSLSNCNSDQNWGSARGLAGTSPFMSIDALPMCYAEMRIYLPDKHLTCWGSILA

SEQ ID NO: 182682 - protein, 57 aa, Glycine max
  Coding DNA Sequence Number=SeqID_65904
MSRNFTDNLTMSVKFLEEVERRLYDIKQWSPDEIRRDHHAKMRRHLSVSGLKYKYMK

SEQ ID NO: 182683 - protein, 127 aa, Glycine max
  Coding DNA Sequence Number=SeqID_65905
  Gene Ontology: Mol. function=chromatin binding; Cellular component =chromatin; Biological process=chromatin assembly or disassembly
  Pfam annotation: Domain name=Chromo; Domain location=13-64; Score =25.9; E_value=0.00014; Accession=PF00385.14; Description='chromo' (CHRromatin Organisation MOdifier
MLPESAEDNHPLVTPLTILDSKWSGSGDDCQLLVLVQWSGLLPEDTSWEPWRILKDTYNLEDKVVFNAHGNVITRDMKQQEAETEPISELKPTAMQEKEPKATTGTSKEETKREITMPQYLKDFVAK

SEQ ID NO: 182684 - protein, 439 aa, Glycine max
  Coding DNA Sequence Number=SeqID_65906
  Gene Ontology: Mol. function=helicase activity; Cellular component =membrane; Biological process=viral genome replication
  Homolog annotation: Hit_ID=Q2R1R7; Match level="QueryCoverage=99%, HitCoverage=27%, E-value=1e-125, Identity=51%"; Hit description=AT hook motif-containing protein, putative
  Pfam annotation: Domain name=DUF889; Domain location=123-374; Score =424.5; E_value=1.5e-124; Accession=PF05970.5; Description=Eukaryotic protein of unknown function (DUF889)
MFFLYEFGGIGKTFIWRTLASSLRAENQIVIIVASSGITSLLVPGGRTAHSRFKIPIPIFEDSTCNIHQGTELAELLNQTSLIIWDEVAMAHKFCFEALDQSLRDIITNKSNSNQIFGGKVIVFGGDFCQILPVIPRGTRSDIVNAAINSSYLWDSYEILTLTKNMRLHSNLESVDEQETATFAKWILDIGDGIIDDENDGYATIQVPAHQLITQYDDPISAIVKSTFPDLDQHHNNPEFFKSKAILASTNETVEQINHYVLSFIPGDHMEYLSSYSVDKSETNEDLYFQSITTEFLNSLNTSGLPTHSIKLKIGSPIMLLRNLDQNQGLCNGTRLVVTKMAKHVIAAEIISGKNIGLAVYIPRMSMSPSQSPWPFKLLRRQFPIMLSHAMTINKSQGQSLSMVGLYLPKPVFTHGQLYVAYSRVNSAKGLKILIHDDE

SEQ ID NO: 182685 - protein, 262 aa, Glycine max
  Coding DNA Sequence Number=SeqID_65907
PPSSETVCGQKRLSSVVRDYPVMREFVEEGDDFVKPPSLDKCCPVSTMVALTNVRVAGRCGFSSPPSLDMCCPGCFCQIVRDGRVFGGSGACDMRNNLGYVLHAEWAHTGVMVLLSTTMSFFCLISPSDWATMIPGASNSESPSSKRVKTLRRTGGGTSRPRGGALPFAATGEPVLVTVILPPSIFRGVRRGTGNGDVRVPPHAQHTLSVGSPSSTPVVAGCEWVRDDSMATSKYLTALRAYGSGPSMFNPHMAKGQGELRL

SEQ ID NO: 182686 - protein, 224 aa, Glycine max
  Coding DNA Sequence Number=SeqID_65908
  Gene Ontology: Mol. function=RNA-directed DNA polymerase activity; Cellular component=chromatin; Biological process=chromatin assembly or disassembly
MADEQRIPIRDETSWGTVELTRDFHEHSGNSEGCIVGRPTMKSRDRSSQGLAGTGNGHSSLTNRDEEFDVLPHRWPNKVLSDAFRGLCNAHVAPSGCIVKFSDDSECLEYDDDSPERSVAALGYDCLDNASIAVFAQPALYWMDYELVTKEILAPFFNDRRDGGELPDINGGAKEGGAEWLAKEGDGVISLGEYRTHVDTEGVCFHEKGVKGAAMEEYPLMNLL

SEQ ID NO: 182687 - protein, 686 aa, Glycine max
  Coding DNA Sequence Number=SeqID_65909
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=491-660::63-146
  Subcellular localization annotation: CTP_CleavageSite=51; ConfidenceScore=5.56e-01
MPSLNSQPLKSTLPKSLKIYSFESPTSNKPAPTPTHPPPLQPTLHLQTPFFASHSTPDSKRLTIASFYMEGPALAWFQWLMCNHQLTTWQSFLEALDARFSHSPYEDPTGLLFKLTQTGTVTEYLSQFEAIANRIVGEEKLVDTRRPSRHRGTPSPHPYLSPNPPTIPLSSTPPLTLTLLPPPPKPPSIPLKHLTPAEMASRRERGLCFNCDEKFMRGHRCASRFFVLIADLEPPDETPQPNLSNTNPNPDPNPQPDDPTRPEPPQAQISFYALSGHSASKTLRLLGHIGCQLVVILVDVGSMPNFMKARLVCHLGLTAIPTPPLRVLVGNGNELECHKLCYATSIRIQGHTFKTDLHVLPISGADVVLVIHWLKSLGPILTDYNTLTMKFVHNGTIIELSGDSSRDHQAISPPQLRRMLQTDGVSKFFHIRIDTSIPDSPHTPPEIQSLINTFSLLFQTPHTLPPSRPTNHRIHLHPSATPSGIIRPSTSLFSSPVFLVKKRHGSWRFCMDYRALNALTIKDRFPIPTIDELLDELGGEKWFSKLDLMQGYHQILMAESDIEKIAFRTHQGHYEFLVMPFGLCNAPSTFQATMNSTFGPCLRKFVIIFFDGILIYSQSFPEHLEHLRTTFEVLHTHQLFLKLSKCIFAVTEVKYLGHIVSQHGVALVPAKITTILWKKSFMMNQR

SEQ ID NO: 182688 - protein, 77 aa, Glycine max
  Coding DNA Sequence Number=SeqID_65910
MRRGERRRHSLENKPWKEKLNHQESSLDKKLSKEASLDEENERECENIPRICQRHLSIFPLDATSMKGVTLAHGKLP

SEQ ID NO: 182689 - protein, 76 aa, Glycine max
  Coding DNA Sequence Number=SeqID_65911
  Subcellular localization annotation: CTP_CleavageSite=57; ConfidenceScore=5.34e-01
MSPPPLGPHNHSQTHLKLSGRLPLQALPNSGSLSQSCAQPEKGWLNQSCAQPEKNVSANHVFSQSCAQPEKDGSAN

SEQ ID NO: 182690 - protein, 65 aa, Glycine max
  Coding DNA Sequence Number=SeqID_65912
MTLGGNFKAEAEVEVETASMAEDATVRGGARKIWWCGEEGAWLRRIQGLRRRTRVWWRQKVRGEG

SEQ ID NO: 182691 - protein, 75 aa, Glycine max
  Coding DNA Sequence Number=SeqID_65913
MDSNLIVNVRILLMNNLSKYLCQCLVSLEAYSYPALLVVMGIGFKRSKMHMQWRCNKWKNSCLQASPDALQGQLA

SEQ ID NO: 182692 - protein, 43 aa, Glycine max
  Coding DNA Sequence Number=SeqID_65914
MTARCKEDFAVKIEGKNDATVHCVNVVMAFIWHLSLPSETKKE

SEQ ID NO: 182693 - protein, 158 aa, Glycine max
  Coding DNA Sequence Number=SeqID_65915
MAQPIMRSAREGWLSQSCVQPEKDGSANHALSQRRMAQPIRWKTEVAEGVAAYPNVDCVESSEIIIIGEDGEAASSLEEDGSATRDGGSAGTASTISHNRRSSSMPGQLLKELLYILWELWASGPADADGGAGVDDEGMSSALALQIKAEINYERLAE

SEQ ID NO: 182694 - protein, 89 aa, Glycine max
  Coding DNA Sequence Number=SeqID_65916
MPLARARAKYTFIFQEGGNCRLLKKKEIDSRRSSCGRKRWSVSEGVLGRKQCKKKKHSREAAMTRAMLLVLFPQDNKAKFNFPSPSKSL

SEQ ID NO: 182695 - protein, 181 aa, Glycine max
  Coding DNA Sequence Number=SeqID_65917
  Gene Ontology: Mol. function=nucleotide binding; Cellular component =nucleus; Biological process=small GTPase mediated signal transduction
  Homolog annotation: Hit_ID=Q9C6I8; Match level="QueryCoverage=87%, HitCoverage=23%, E-value=5e-74, Identity=83%"; Hit description =Probable nucleolar GTP-binding protein 1
  Pfam annotation: Domain name=MMR_HSR1; Domain location=83-181; Score =45.9; E_value=1.4e-10; Accession=PF01926.13; Description=GTPase of unknown function
  Pfam annotation: Domain name=NOG1; Domain location=149-181; Score =23.3; E_value=1.5e-05; Accession=PF06858.4; Description=Nucleolar GTP-binding protein 1 (NOG1)
  Pfam module annotation: Pfam domain module=MMR_HSR1::NOG1; Domain location=83-181::149-181
MVGVLIRICQITYVLDTSLKIIVTKNYVKLFKYGDSLYRCKCLKVAALGRLCTMIKRVGLSLAYLEQVRQYMARLSSIDPNTRIILIYGYPNVGKSSFINKITRVDVDVQPYAFTTKSLFVGHTDYKYLRYQVIDTPGILDWPFEDCNIIEMCSITALAYLRAAILFFLDVSRSCGYSIAQ

SEQ ID NO: 182696 - protein, 46 aa, Glycine max
  Coding DNA Sequence Number=SeqID_65918
MANTCCPIELEPRTLNQVKFTQAREVVVKVVQKLQPREASIVFIEV

SEQ ID NO: 182697 - protein, 236 aa, Glycine max
  Coding DNA Sequence Number=SeqID_65919
  Gene Ontology: Mol. function=protein binding; Cellular component =membrane; Biological process=defense response
  Homolog annotation: Hit_ID=Q2L360; Match level="QueryCoverage=91%, HitCoverage=30%, E-value=6e-31, Identity=38%"; Hit description =Putative CC-NBS-LRR resistance protein
MYLEDVGLYTGHWHIEKQNMAEYFVFDIAESLLRKLASSVYEEASRAYDLYEDVKGIKDTLSIVKGVLLDAEEKKEHKHGLREWLGQIQNVCLDAEDILGGFECQNLRKQVVKALGSTRMKVGHFFSSFNSLVFRLRIAHQIKNVRRRLYKIAADGNKFGLERIDVDHRLVQRTEMTYSHVDASGVIGRDNDKDEIIKLLMQPHPNCDGDGDKSLCYSHSGYWRLREDHTCKVGVQ

SEQ ID NO: 182698 - protein, 67 aa, Glycine max
  Coding DNA Sequence Number=SeqID_65920
MAPLVKCCIVIKKREGTAKHLVILGIGIGQLQQGAMLQRTFTQHLRRWYNSGWHLLEEETFTGTSSV

SEQ ID NO: 182699 - protein, 61 aa, Glycine max
  Coding DNA Sequence Number=SeqID_65921
  Subcellular localization annotation: CTP_CleavageSite=24; ConfidenceScore=5.12e-01
MGWTKSYGGTTPPSSMKKMSFPALQAKEWKKSMDTTVALLRMKGWVRDGRREHVNERWSCL

SEQ ID NO: 182700 - protein, 117 aa, Glycine max
  Coding DNA Sequence Number=SeqID_65922
MGFPSVREKEKRLEPSFQSQCLGVCEKKRVPSKEHFSHYKHYLAYPSGGDVQKCVPNLVFKFYNGPTVNESGIVVLLRHVWVYARKREGFERERRKNRFERGEKRVCEKLPNMSLSI

SEQ ID NO: 182701 - protein, 124 aa, Glycine max
  Coding DNA Sequence Number=SeqID_65923
MGRPTLLVTTDEWSLPFSGKNNCAYYRCFKFVSLLVFTKEILQPKDTTVKLFMQIASMNSATLRHATRGCVASATGDSTDVATCNGVLAMQGGVAGQTSASPRVSGTAFAGEPAFAVQLKTPGP

SEQ ID NO: 182702 - protein, 79 aa, Glycine max
  Coding DNA Sequence Number=SeqID_65924
MLVQKARDWKLRGMLFATASSRARFIHLSIGLCEGGFTMDKFIIGLGAINKILKSKKLQCVRKSHIACLSSWGAAYISV

SEQ ID NO: 182703 - protein, 143 aa, Glycine max
  Coding DNA Sequence Number=SeqID_65925
  Homolog annotation: Hit_ID=Q1T4Z8; Match level="QueryCoverage=49%, HitCoverage=15%, E-value=4e-09, Identity=40%"; Hit description =Ribonuclease H
MVDIHDAGLKVRYLWGVMGRNSEMLYTNLLQNITQDLTPVKPCLVEGIPDMWIWNHSVSGVYTTKSAYAWLSNVQVGDGVLSHRGMSVQENCPIGIPRNLILEAFAGPLGFAVIMASETSYAILTPRQLLTWAEQHSAVSFVQ

SEQ ID NO: 182704 - protein, 129 aa, Glycine max
  Coding DNA Sequence Number=SeqID_65926
  Gene Ontology: Mol. function=aminoacyl-tRNA ligase activity; Biological process=tRNA aminoacylation for protein translation
  Homolog annotation: Hit_ID=Q9M876; Match level="QueryCoverage=79%, HitCoverage=21%, E-value=2e-20, Identity=54%"; Hit description =Putative tyrosyl-tRNA synthetase
MNGVRDTQLVPLQGFNVKFGSFAGFPGGVADTRGGAVDEHESAVAATTKLGEEDEAKEVVEVEGLRSGVEATVDLEGWRCQAHAAERVTGDGLDQTALFDVWNERACGSVAGSCGCVGGNNGRWDRRGG

SEQ ID NO: 182705 - protein, 80 aa, Glycine max
  Coding DNA Sequence Number=SeqID_65927
MVVALAIMAVGGVADQIWLLTVVWWRAGARWALIGGRAHGEDVKSFVGQQHTCMAQIIFDVREGQQSNGAWWDTRTTEIN

SEQ ID NO: 182706 - protein, 133 aa, Glycine max
  Coding DNA Sequence Number=SeqID_65928
MAATHIASERCGLLTRMLGGVAPLNLYERDKHCNFFTSAYEKFKNHFFLKSLGEFVVMRIMSLLISGIEQKHHQDGSSEGEGIYAFTADAFVFVIMVIKNFLWHHIGHMHGRDNEQLQLVWFDSHQTDNLSSV

SEQ ID NO: 182707 - protein, 55 aa, Glycine max
  Coding DNA Sequence Number=SeqID_65929
MSVNIGRLGVHDKTDHTLGDQLGSSYFARMLQPCEIDTGLKEHLNRVYLPPRRRL

SEQ ID NO: 182708 - protein, 54 aa, Glycine max
  Coding DNA Sequence Number=SeqID_65930
MAFGRPGCQALSIKNASRLRLLLVKCGWQWWTLTEAGGASFLPCHAFSFCPSQS

SEQ ID NO: 182709 - protein, 725 aa, Glycine max
  Coding DNA Sequence Number=SeqID_65931
  Gene Ontology: Mol. function=DNA-directed RNA polymerase activity; Cellular component=nucleus; Biological process=transcription
  Homolog annotation: Hit_ID=Q1SWK4; Match level="QueryCoverage=82%, HitCoverage=94%, E-value=1e-162, Identity=47%"; Hit description=Zinc finger, PMZ-type
  Pfam annotation: Domain name=FAR1; Domain location=127-305; Score =87.5; E_value=4.2e-23; Accession=PF03101.5; Description=FAR1 family
  Pfam annotation: Domain name=SWIM; Domain location=594-625; Score =27.4; E_value=4.9e-05; Accession=PF04434.8; Description=SWIM zinc finger
  Pfam module annotation: Pfam domain module=FAR1::SWIM; Domain location=127-305::594-625
  Subcellular localization annotation: CTP_CleavageSite=56; ConfidenceScore=5.17e-01
MMKCENIIKHRMWVGSPNIMNLKRCVKSSPPPRTKNTAYRRTGIALQRKSRVTLIRAQNKQHFELWEMGELCHSRAPLDINSSGSEENLVSISPEEIKLEPISFDGNDACPVPRPGMVFSSEAEARLYYTKYANQMGFGIMTRTSKKGRDGKVKYLILVCSGITRSDAARKQYCAARINLTLRKDGTYRINSATLGHSHELGSHHLLSSDIDTRGKRTLDQEVVDMGVKRISDKNECRYYLQKERHLIGENGDGEALQKYLVRMQEQDRNFFYVIDLDDFFCVRNVFWADGKSRAAYESFGDVVIVDTTCLSNRYKVPLVTFVGVNHHGQSVLFGCGLLSYEDSESFAWLFQSLLHCMSDVPPQGIITDHCCKTMQKAVETVYPSTRHRWCLSNIMEKLPQLIHGYANYKSLRDHLQNVVYDTPTISEFEQKWKKIVEDFDLKDNKWLKELFLERHRWAPSFVRGEFWAGMSINPHNESMHAFFDGYVSRLTTLKQFVDQYDNALQYKAEKEYVADIHSSSNSQACVTKSPIERQFQAAYTHAKFLEVQHEFVGKADCNVSVASDDGSIFHYNVIEDGIIDDKPKESVVEVIYNRVDCDVKCSCHLFEFRGILCRHSLAVLSQERVKEVPCKYILDRWRKNIRRKYAYIKTSYGVQHFEPHVQRLELLCNQFNSIAAVAAEFEDTSSFVKDNLCNLKEKLEAWTTLLRNSSQVDVEKCNYMMDWE

SEQ ID NO: 182710 - protein, 585 aa, Glycine max
  Coding DNA Sequence Number=SeqID_65932
  Homolog annotation: Hit_ID=Q10S09; Match level="QueryCoverage=49%, HitCoverage=52%, E-value=4e-37, Identity=35%"; Hit description =Expressed protein
  Pfam annotation: Domain name=Ribosomal_L14; Domain location=453-555; Score=67.2; E_value=5.4e-17; Accession=PF00238.10; Description =Ribosomal protein L14pL23e
MASADEMYLRHCLESVHNSALKASQHNKSVSLEANNLWTSEKSLNTDKFIGEAECDSSELVLGHSVASITENLVVSTNASDNWTLGTVMGTKSMINILNSPLLQQVGVSERDDNLNSMNFTDAKNMICYDFMDSPSSSYKLEMEKPMVQSHKYGSISVSQGMLQCTWKQGVPHFVFSADDQKEVYVAKLSKADTTHYADLDYVYLFHLNKGREIPDRDLQLVGKMNVSTCYTLSPDNCRVMETRFILFGNDKFYDKEMYTSRHSHMKNKGMAKKASRSSPSPIHRTLSKFSRSKAIRESCPLDKQSCGLDGTNLIETNVPTNFELAAILVKDHLLSHSLDKVGGWGLKFLNKSGVNHTTLQSESCNQNTGDCSSSISILVPAGLHGGPRTTHGGPSSLVDRWKSGGCCDCGGWDEGCPLTVLQRRTINEEILSHADTQGECKSVDLVTQDVTGFASGSCGELCDNTGAKNLYIISVKGIKGRLNRLPYACVGDLVMATVKKGKPNLRKKVLPAVIVRQRNPWRRKDGAYMYFEAKITGSVVKCHGRLFANCHRQFVKGGSRACLYGGILAFRHVPPYAIDNTDYW

SEQ ID NO: 182711 - protein, 67 aa, Glycine max
  Coding DNA Sequence Number=SeqID_65933
MIVVNSKRAMVNIMNIVISLQRPKMSQLPTIVTDNHEGPCHFKTSQALTQNFNNGPGGYHHGRSENN

SEQ ID NO: 182712 - protein, 74 aa, Glycine max
  Coding DNA Sequence Number=SeqID_65934
MGFTTKGAALPDIPRMPPFRAYLTCLQLLWVFSLLSHDAISGPPRPALSPKPHSIHIPSTKYSLPAQLRQSAYR

SEQ ID NO: 182713 - protein, 336 aa, Glycine max
  Coding DNA Sequence Number=SeqID_65935
  Gene Ontology: Mol. function=RNA-directed DNA polymerase activity; Biological process=RNA-dependent DNA replication
MEDANTCGGEEGNQISKRERRSLLSNTQKTKEEDEPFWKEKNETKEEEACGEVAGKFIQLLGAPSNSPTIEGVALWLRVMLDLDRGGVSVVVLEDGVGSHNNVRGWGWSRAWKEVSVSSLARLRSDHNPILVKFDTKMRNVRRKERLYRFQQMWQNESECDDVVSHSCKKGGNLIANIDRIGANLEMKASQRRKINTIDYLKDDEGVLYDDEEEIADVLTGYLISLFKTSNPTEKVVVALKQMHPTKGPSPNGTPALFYKHSWEIVGKDVTDLVLHILNGEGDPTCINKTQTVWIPKVKNPIHAGEALRYAKVWGRDVVRSLTLAYAKRLFPDSNP

SEQ ID NO: 182714 - protein, 220 aa, Glycine max
  Coding DNA Sequence Number=SeqID_65936
  Homolog annotation: Hit_ID=Q1SKM8; Match level="QueryCoverage=27%, HitCoverage=7%, E-value=6e-25, Identity=88%"; Hit description =Adenosine/AMP deaminase active site
YDGVFEVLQWLLFLSAVPPVQLLTGWCVTAKAPPDISAGKCSGRVPFAIQAAQLLGRAIGAGLFAITPAGERGMCCKAIKLGNARVFPHYFEMRDGVIHVYPDRDAKEELFPVADATTFFTDLHHILRVIAAGNIRTLCHHRLNLLEQVHIEFIKLIDTVDLEGGPVGKPVVPAALMNRPTRGERRFAYWALAECILAYYVGTDEGVSEVLHVAGEKRLH

SEQ ID NO: 182715 - protein, 63 aa, Glycine max
  Coding DNA Sequence Number=SeqID_65937
MGDDCGYVVIDLYMHKFTMDGDYGYKLTRVSPNGRVMDYDKGFDCIDHSTSEYLYGVMSAYSA

SEQ ID NO: 182716 - protein, 506 aa, Glycine max
  Coding DNA Sequence Number=SeqID_65938
  Homolog annotation: Hit_ID=Q1PFY7; Match level="QueryCoverage=77%, HitCoverage=77%, E-value=9e-37, Identity=47%"; Hit description=Zinc finger CONSTANS-like protein
  Pfam annotation: Domain name=AT_hook; Domain location=395-407; Score =14.9; E_value=0.061; Accession=PF02178.9; Description=AT hook motif
  Pfam annotation: Domain name=CCT; Domain location=329-375; Score =22.7; E_value=0.001; Accession=PF06203.4; Description=CCT motif
  Pfam annotation: Domain name=CCT; Domain location=431-453; Score =27.2; E_value=6e-05; Accession=PF06203.4; Description=CCT motif
  Pfam module annotation: Pfam domain module=AT_hook::CCT::CCT; Domain location=395-407::329-375::431-453
MLFTMLICHHSLQDEISGPISARIFELCDPDFFPHTLQNSEVTSSSNCCHEEKSSYATTISPPLDVVDNNKFNINSNSSNIVTTTSSSTTTTSTTTNNNNNATNGNNLSIFFDTQDEIDNDISASIDFSSSPSFVVPPLLPISTQQDQFDFPSAQPQVQLSTAAGSILTGLSHYPTDPVIAPLIGAPLPSVFDDDCISSIPSYVPLNPSSPSCSYLSPGIGVYMPPPGSLNTALSADSSGLFGGNILLGSELQAHELDYQGENGGMYCTDSIQRVFNSPDLQALGNESQKLVAGAGSSATLAPEISHLEDSTLKVGKLSVEQRKEKIHRYMKKRNERNFSKKIKYACRKIRERVGVAPIVEKMVENRLRWFGHVERRPVDSVVRRVDQMERRQTIRGRGRPKKTIREVIKKDLEINGLDRSMALLLLLLLYACRKTLADSRPRVRGRFAKNDDFGESHKQGSSNHEDDDEEIIVKEDDDMVDSSDIFAHISGVNSFKCNYSIQSLI

SEQ ID NO: 182717 - protein, 74 aa, Glycine max
  Coding DNA Sequence Number=SeqID_65939
MAWRQAYFSGGDRSCRYLRSCPRRWRKKLKRIGSDHSCFDSYLLDPETKSKGMAKWSFSQDFRHPFAQASNQLA

SEQ ID NO: 182718 - protein, 138 aa, Glycine max
  Coding DNA Sequence Number=SeqID_65940
  Subcellular localization annotation: CTP_CleavageSite=31; ConfidenceScore=5.33e-01
MDWPLRLTPTPPPPPFHHCCALTPLPQTSLYCLKPRSPSNLTVLPQTSLSLKPHCIASNLALPQTSVSLNRSPSNLPQLLSLKQHSLKVPRNVTLWPTFLCSGAYNRTVGTHSEVAPAVTCLPSRRSVSAVRRRSLYQ

SEQ ID NO: 182719 - protein, 73 aa, Glycine max
  Coding DNA Sequence Number=SeqID_65941
MANRGRMFVESWKWEDNKSFQGQTDSKCPKKLYSANLKVIMTVRKYSSNGIYNVKSGYHLARMNFEPIESSSN

SEQ ID NO: 182720 - protein, 142 aa, Glycine max
  Coding DNA Sequence Number=SeqID_65942
  Gene Ontology: Mol. function=ribonuclease H activity; Biological process=RNA-dependent DNA replication
  Homolog annotation: Hit_ID=Q1SZM6; Match level="QueryCoverage=97%, HitCoverage=45%, E-value=6e-23, Identity=45%"; Hit description =Ribonuclease H
MWMEALSEILVRRASVECCAILLVSGLLVSRDIVDLLLTFMLSSWQSCMVFKLPGVEVSRKLSESDALNALDLVFDDNLMSHILINLSSTIFFSSITLIGRLYMSLSILIEKAIKLHIDLLKMELQPASICSFGHLALILSL

SEQ ID NO: 182721 - protein, 155 aa, Glycine max
  Coding DNA Sequence Number=SeqID_65943
MILVFKYNGWRGLGQGPRKLYFSTWWADLRRQTIEQWIFVINIQQRHTFDGFLGSLKAKHNGLPKSSPTLFGTRFFPSFLRPAKVSKYSNEERLMLKPKVVPQKISARHELHKHELDNVVAVTEAQSSLRQTPTQAEGETTRTPWEYPFRDSFLS

SEQ ID NO: 182722 - protein, 267 aa, Glycine max
  Coding DNA Sequence Number=SeqID_65944
  Homolog annotation: Hit_ID=Q10QL7; Match level="QueryCoverage=37%, HitCoverage=26%, E-value=1e-33, Identity=66%"; Hit description =Expressed protein
  Pfam annotation: Domain name=DUF966; Domain location=34-261; Score= -6.9; E_value=4.6e-12; Accession=PF06136.4; Description=Domain of unknown function (DUF966)
MDVVRSQRGSSRNTSPDRAKICRMNKKVKPFRKVQVVYYLSRNGLLEHPHFMELTLLSNQPLRLKDVFDRLMALRGSGMPLQYSWSSKRNYKSGYVWYDLGLKDIIHPAEGGEYVLKGSELVEGCSERFNVSNKQQGIHQQAEAEAEANYNYNYDSRSKALGVCNKQQQQQKEREELEEYEEQEKEYEEGEKTSYTSSTTTPHSRCSRGVSTEELVYDEEENKNATKVNAEGTNKNKKNKGEKVKRRDGEGSVSSRYSALLQLIACG

SEQ ID NO: 182723 - protein, 61 aa, Glycine max
  Coding DNA Sequence Number=SeqID_65945
MDHPGRSQVNIEDNTGSIVHLVILNTSDLVSIETSGIASLEELHKSLVSSGKQQLPILVGK

SEQ ID NO: 182724 - protein, 74 aa, Glycine max
  Coding DNA Sequence Number=SeqID_65946
MARSKRIQEDFKEREGFSTKAIDNALTKKDQTLEKDEVHIDGNSMLKKKEKTTPPQEKRLLLKRAKRQTRRMRR

SEQ ID NO: 182725 - protein, 127 aa, Glycine max
  Coding DNA Sequence Number=SeqID_65947
MASRKHKSIGSRPTTQYDTRRFSSLDAWNRYTDNVLGRNILPKRKVELYHTELDDFKTELERRNFHKRLTNFIDASIDLALEKEFYANLYSSKGPSPKQSRRVRLYPHTPDTTGCPQITKRLRLPYA

SEQ ID NO: 182726 - protein, 102 aa, Glycine max
  Coding DNA Sequence Number=SeqID_65948
MISSVGNEKNMLNETNHNLKKELPSLIFDFEEKLKEQQKIEGSLRSEVETLKVEVVEKSVLQSQLEEIEGKLAQAESRLNEEVGSVQVAASTMESQPFQVGR

SEQ ID NO: 182727 - protein, 151 aa, Glycine max
  Coding DNA Sequence Number=SeqID_65949
MGSNPETASLHMQGIENEREREYSFFEGRCLLKAKIGPRNVELYKTAVVERSVGTCWVVIGVAETKSVRRRLPGRMVNHGDGNKQVGPVLDGGIENEREREYSFFEGRKAKTTYDISSSLNLNSRKTKLPVSDSWSPSADNAVKLNVDGSS

SEQ ID NO: 182728 - protein, 84 aa, Glycine max
  Coding DNA Sequence Number=SeqID_65950
MLTIAEESVDLLGGGVGVRHCKMRVHCYQASWRPSMTTDSPPLLMFPWTRRQGYMLILCFRKSTLTNKKQRGLFKALDLKTIFK

SEQ ID NO: 182729 - protein, 281 aa, Glycine max
  Coding DNA Sequence Number=SeqID_65951
  Gene Ontology: Mol. function=carboxypeptidase activity; Cellular component=membrane; Biological process=auxin mediated signaling pathway
  Homolog annotation: Hit_ID=Q5ZFS7; Match level="QueryCoverage=71%, HitCoverage=64%, E-value=7e-53, Identity=60%"; Hit description =Nodulin-like protein
MTKLKTTLSPETKAVAPKWIEVKQQFSAAIVPPSLALQQLTEQMKCPQSLDGCLVEAPDFQFPQTCVVMCDKQHAPCYDICHGWYFQDGEVNVTKVRCQPKVIGTVVTVAGAMLMTLYKGQVISFFVSKYMHHPTNYEPENNTDSGEKDWFKGSVLLVLATLSWASSSFRQALTLSKYPGQLSLTALVCGLGNNIIRYHLLCSRDCHAEKRACFRYCFQPFDDDYRSHHGCLHPCRKNISWRAKYFNDGRKLNPSLYSYLPTTTGARDTDVDILANNVGPF

SEQ ID NO: 182730 - protein, 200 aa, Glycine max
  Coding DNA Sequence Number=SeqID_65952
  Homolog annotation: Hit_ID=Q1S8Y1; Match level="QueryCoverage=97%, HitCoverage=64%, E-value=7e-40, Identity=48%"; Hit description=TLD, putative
  Subcellular localization annotation: CTP_CleavageSite=31; ConfidenceScore=5.14e-01
MDMRMHANNYSRKGKSMSSYWSYIFPSVGFKGSKISNHQSVSVRSNCENFDKDGDRSDKYVDSSPMSNGKDLLKGKSNDKDQATRNSSRSSEVFEEVNEQHSPNIPKRPLPNFTDGSTVIYLELNEFFESCLPNIVKGCQRVLLYSTLKHGISLRTLLRNSDKLSGPGLLIVGDMHLAEFGGLLDYPLQPTAKRKHQGTN

SEQ ID NO: 182731 - protein, 148 aa, Glycine max
  Coding DNA Sequence Number=SeqID_65953
  Homolog annotation: Hit_ID=Q9M3I5; Match level="QueryCoverage=46%, HitCoverage=17%, E-value=3e-30, Identity=85%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=6-148; Score=-119.4; E_value=0.00014; Accession=PF00346.9; Description =Respiratory-chain NADH dehydrogenase,
MNQQQCLGRQWYGVEAALAWESRCERRWSAPPLMVATMRWCLNFRCFLLNGLLALHNAAPHMRSGMTCNNAITYKCYEEFDWEVQWQKEGDSLARYLVRIGEMMESIKIIQQALEGIPGGPYENLEIRCFDREKEPEWNEFETNESIF

SEQ ID NO: 182732 - protein, 187 aa, Glycine max
  Coding DNA Sequence Number=SeqID_65954
  Gene Ontology: Mol. function=membrane alanyl aminopeptidase activity; Biological process=proteolysis
  Homolog annotation: Hit_ID=Q1SLQ6; Match level="QueryCoverage=48%, HitCoverage=10%, E-value=5e-19, Identity=55%"; Hit description =Peptidase M, neutral zinc metallopeptidases, zinc-binding site
MIIMKGTNRQIGWDSISGEDHSISLLRGEVFQALATFDHDKTQQKALRRFQILLDGRNTSLPPANIRRIPDQDIIYVLAGISNEGSETAWRWLKLSKLLEEATARNQTEGNKDLNHNEKDYLLPKVVEFSEENRHGGKDTSKVELSANEGLNSNKAYRNKSLMTEKWNLGTRGIIPPCLLPLVCNPW

SEQ ID NO: 182733 - protein, 1230 aa, Glycine max
  Coding DNA Sequence Number=SeqID_65955
  Gene Ontology: Mol. function=protein binding; Cellular component =integral to membrane; Biological process=xylan catabolic process
  Homolog annotation: Hit_ID=Q1T435; Match level="QueryCoverage=98%, HitCoverage=91%, E-value=1e-152, Identity=34%"; Hit description =Leucine-rich repeat; Leucine-rich repeat, cysteine-containing type
  Pfam annotation: Domain name=LRRNT_2; Domain location=19-57; Score =60.8; E_value=4.6e-15; Accession=PF08263.3; Description=Leucine rich repeat N-terminal domain
  Pfam annotation: Domain name=LRR_1; Domain location=1044-1066; Score =13.4; E_value=0.8; Accession=PF00560.23; Description=Leucine Rich Repeat
  Pfam annotation: Domain name=LRR_1; Domain location=1068-1090; Score =13.2; E_value=0.95; Accession=PF00560.23; Description=Leucine Rich Repeat
  Pfam annotation: Domain name=LRR_1; Domain location=1092-1114; Score =16.6; E_value=0.093; Accession=PF00560.23; Description=Leucine Rich Repeat
  Pfam annotation: Domain name=LRR_1; Domain location=1116-1137; Score =9.1; E_value=5.7; Accession=PF00560.23; Description=Leucine Rich Repeat
  Pfam annotation: Domain name=LRR_1; Domain location=118-140; Score =14.3; E_value=0.44; Accession=PF00560.23; Description=Leucine Rich Repeat
  Pfam annotation: Domain name=LRR_1; Domain location=142-164; Score =19.4; E_value=0.013; Accession=PF00560.23; Description=Leucine Rich Repeat
  Pfam annotation: Domain name=LRR_1; Domain location=166-188; Score =17.1; E_value=0.063; Accession=PF00560.23; Description=Leucine Rich Repeat
  Pfam annotation: Domain name=LRR_1; Domain location=190-212; Score =13.0; E_value=1.1; Accession=PF00560.23; Description=Leucine Rich Repeat
  Pfam annotation: Domain name=LRR_1; Domain location=214-236; Score =21.3; E_value=0.0035; Accession=PF00560.23; Description=Leucine Rich Repeat
  Pfam annotation: Domain name=LRR_1; Domain location=238-268; Score =1.8; E_value=1.3e+02; Accession=PF00560.23; Description=Leucine Rich Repeat
  Pfam annotation: Domain name=LRR_1; Domain location=297-321; Score =5.0; E_value=33; Accession=PF00560.23; Description=Leucine Rich Repeat
  Pfam annotation: Domain name=LRR_1; Domain location=326-349; Score =9.4; E_value=5.1; Accession=PF00560.23; Description=Leucine Rich Repeat
  Pfam annotation: Domain name=LRR_1; Domain location=352-374; Score =11.6; E_value=1.9; Accession=PF00560.23; Description=Leucine Rich Repeat
  Pfam annotation: Domain name=LRR_1; Domain location=377-399; Score =9.5; E_value=4.8; Accession=PF00560.23; Description=Leucine Rich Repeat
  Pfam annotation: Domain name=LRR_1; Domain location=401-423; Score =7.7; E_value=11; Accession=PF00560.23; Description=Leucine Rich Repeat
  Pfam annotation: Domain name=LRR_1; Domain location=431-452; Score =15.7; E_value=0.17; Accession=PF00560.23; Description=Leucine Rich Repeat
  Pfam annotation: Domain name=LRR_1; Domain location=454-476; Score =5.6; E_value=26; Accession=PF00560.23; Description=Leucine Rich Repeat
  Pfam annotation: Domain name=LRR_1; Domain location=478-500; Score =13.7; E_value=0.66; Accession=PF00560.23; Description=Leucine Rich Repeat
  Pfam annotation: Domain name=LRR_1; Domain location=502-524; Score =10.6; E_value=2.9; Accession=PF00560.23; Description=Leucine Rich Repeat
  Pfam annotation: Domain name=LRR_1; Domain location=531-552; Score =16.1; E_value=0.13; Accession=PF00560.23; Description=Leucine Rich Repeat
  Pfam annotation: Domain name=LRR_1; Domain location=554-573; Score =9.1; E_value=5.6; Accession=PF00560.23; Description=Leucine Rich Repeat
  Pfam annotation: Domain name=LRR_1; Domain location=578-600; Score =11.3; E_value=2.2; Accession=PF00560.23; Description=Leucine Rich Repeat
  Pfam annotation: Domain name=LRR_1; Domain location=602-624; Score =10.0; E_value=3.8; Accession=PF00560.23; Description=Leucine Rich Repeat
  Pfam annotation: Domain name=LRR_1; Domain location=631-652; Score =6.3; E_value=19; Accession=PF00560.23; Description=Leucine Rich Repeat
  Pfam annotation: Domain name=LRR_1; Domain location=654-676; Score =11.9; E_value=1.7; Accession=PF00560.23; Description=Leucine Rich Repeat
  Pfam annotation: Domain name=LRR_1; Domain location=678-701; Score =9.3; E_value=5.1; Accession=PF00560.23; Description=Leucine Rich Repeat
  Pfam annotation: Domain name=LRR_1; Domain location=703-723; Score =5.4; E_value=28; Accession=PF00560.23; Description=Leucine Rich Repeat
  Pfam annotation: Domain name=LRR_1; Domain location=728-750; Score =2.0; E_value=1.2e+02; Accession=PF00560.23; Description=Leucine Rich Repeat
  Pfam annotation: Domain name=LRR_1; Domain location=752-775; Score =1.9; E_value=1.2e+02; Accession=PF00560.23; Description=Leucine Rich Repeat
  Pfam annotation: Domain name=LRR_1; Domain location=823-844; Score =2.1; E_value=1.2e+02; Accession=PF00560.23; Description=Leucine Rich Repeat
  Pfam annotation: Domain name=LRR_1; Domain location=849-871; Score =13.1; E_value=1; Accession=PF00560.23; Description=Leucine Rich Repeat
  Pfam annotation: Domain name=LRR_1; Domain location=873-895; Score =17.2; E_value=0.058; Accession=PF00560.23; Description=Leucine Rich Repeat
  Pfam annotation: Domain name=LRR_1; Domain location=897-919; Score =14.2; E_value=0.49; Accession=PF00560.23; Description=Leucine Rich Repeat
  Pfam annotation: Domain name=LRR_1; Domain location=921-944; Score =10.3; E_value=3.3; Accession=PF00560.23; Description=Leucine Rich Repeat
  Pfam annotation: Domain name=LRR_1; Domain location=93-116; Score =12.4; E_value=1.4; Accession=PF00560.23; Description=Leucine Rich Repeat
  Pfam annotation: Domain name=LRR_1; Domain location=946-968; Score =9.1; E_value=5.7; Accession=PF00560.23; Description=Leucine Rich Repeat
  Pfam annotation: Domain name=LRR_1; Domain location=970-992; Score =8.9; E_value=6.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=19-57::1044-1066::1068-1090::1092-1114::1116 -1137::118-140::142-164::...
  Pfam module annotation: Domain location=166-188::190-212::214 -236::238-268::297-321::326-349::352-374::377-399::401-423::431 -452::454-476::478-500::502-524::531-552::554-573::578-600::602 -624::631-652::654-676::678-701::...
  Pfam module annotation: Domain location=703-723::728-750::752 -775::823-844::849-871::873-895::897-919::921-944::93-116::946 -968::970-992
MAIGTAKVLVSAQDQIMCIQTEREALLQFKAALVDDYGMLSSWTTSDCCQWQGIRCSNLTGHVLMLDLHRDVNEEQVRYISGEIHKSLMELQQLNYLNLSCNSFQRKGIPEFLGSLSNLRYLDLSYSQFGGKIPTQFGSLSHLKYLNLAGNSLEGSIPRQLGNLSQLQHLDLWGNQLEGNIPSQIVNLSQLQHLDLSVNRFEGNIPSQIGNPSQLQHLDLSYNSFEGSIPSQLGNLSNLQKLYLGGSHYDDDGGALKIDDGDHWLSNLISLTHLSLLSISNLNTSHSYPQMIAKLPKLRELSLIDCSLSDQFILSVRLSKFNFSSSLSILDLSSNNFTSSMILQWLSNVTFNLVELDLSYNLLEGSTLNHFGRVMNSLEHLDLSYNIFKGEDLKSLANICTLHSLYMPANNLTEDLPSILHNLSSGCVRHSLQDLDLTYNQITGSLPDISVFSSLKTLALDMNQLSGNIPEGLRLPLHLKSLSIQSNSLEGGIPKSLGNACALRSLDMSDNSLSEEFPMIIHHLSGCARFSLQELNLEGNQINGTFPDLSVFSALKRLDLSENQLNGKIPERNKLPSLLESLSIESNSLEGGIPKSFGNACALRSLYMSNNSLSEEFPMIIHHLSGCARYSLEQLYLGMNQINGTLPDLSIFSSLRELYLYGNKLKGEISKDIKFPPQLKRLDMQSNSLKGVLTDYHFANMSNLDLLELSDNSLLALAFSQNWVPPFQLSHIGLRSCKLGPVFPKWLETQNQIWDIDISNAGIAGMVPKWFWANLAFREWISMNISYNNLHGIIPNFPIKNLYTSIILGSNQFDDPIPPFLRGSVFLDLSKNKFSDSLSFLCVNDTVENLYQLDLSNNHFSGKIPDCWIHFKSLSYLDLSHNNFSGRIPTSMGSLLHLQALLLRNNNLTDEIPFSLRSCTNLVMLDIAENRLSGLIPAWIGSELQELQFLSLGRNNFHGSLPLKICYLSKIQLLDLSLNSMSGQIPKCIKNFTSMTQKTSSRDYQGHSYFVKLNYSSSPQPYDLNALLMWKGSEQIFKNNGLLLLKIIDLSSNHFSGEIPLEIENLFGLVSLNLSRNNLIGIIPSKIGKLTSLESLDLSRNQLVGSIAPSLTQIYGLGVLDLSHNYLTGKIPTSTQLQSFNASSYEDNLDLCGPPLEKLCIDKGLAQEPNVEVPEDEYSLFSREFYMSMTFGFVISFWVVFGSILFKRSWRHAYFKFLKNLSDNIYVKVA

SEQ ID NO: 182734 - protein, 124 aa, Glycine max
  Coding DNA Sequence Number=SeqID_65956
  Gene Ontology: Mol. function=ubiquitin-protein ligase activity; Cellular component=ubiquitin ligase complex; Biological process =protein ubiquitination
MPRRGTLLRGKERESGVLRGRELVRAMRERARAFDERESARAHGADAGKDNPEDLQPRDGVCRWCAALAVLGVGVVLARGGGDGRADLASASHAERLHGESEEEGADAAKASSGFVAARFRRKL

SEQ ID NO: 182735 - protein, 87 aa, Glycine max
  Coding DNA Sequence Number=SeqID_65957
MAIDIDHFPKLDINMVSHEQPTAKRKMKQVSNMSLDEEDLWQWRCDPSQSFSVASAYKLISTSNRVEWDNSLLDGVFKNFGQSIVPP

SEQ ID NO: 182736 - protein, 92 aa, Glycine max
  Coding DNA Sequence Number=SeqID_65958
MEVDDHVASSRKTGGGRLKSIVWNHFDKIKIIDGKTRPNANTTKNFSREHQRMEQSICMPIWKNAFKKGHMTKGRKGGNYIRYVDYKQPKEK

SEQ ID NO: 182737 - protein, 95 aa, Glycine max
  Coding DNA Sequence Number=SeqID_65959
  Subcellular localization annotation: CTP_CleavageSite=61; ConfidenceScore=5.53e-01
MNRGKQQVLPPTLTLTLTSDLGSSSSSSFRFIHTVSYITGFGADYYYRVSPLSRISSNVFVATNNRGTIVDSGTTLAYLVQEAYNPFIKAHYSLL

SEQ ID NO: 182738 - protein, 99 aa, Glycine max
  Coding DNA Sequence Number=SeqID_65960
  Homolog annotation: Hit_ID=Q70YJ5; Match level="QueryCoverage=37%, HitCoverage=17%, E-value=2e-08, Identity=70%"; Hit description =Putative Cf2/Cf5 disease resistance protein
MGGEVAAANSFPLAAISSGPRREHAIAIQKGSLELEEFFPLPLNAHYFLFSTNNLQLSGGGKDVSACGGTTVDGKGEVVDGDCGAGGGASRKGGADWAV

SEQ ID NO: 182739 - protein, 69 aa, Glycine max
  Coding DNA Sequence Number=SeqID_65961
  Gene Ontology: Mol. function=kinase activity
  Homolog annotation: Hit_ID=Q6UC87; Match level="QueryCoverage=64%, HitCoverage=13%, E-value=2e-14, Identity=88%"; Hit description =Putative calcium-dependent protein kinase CPK1 adapter protein 2
MQKEAEVQKLMEENVRLSALLDKKEAQLLALNEQCKMMALSASNISSLLTAGVFIVKLYWIKKHPWRAP

SEQ ID NO: 182740 - protein, 67 aa, Glycine max
  Coding DNA Sequence Number=SeqID_65962
  Subcellular localization annotation: CTP_CleavageSite=27; ConfidenceScore=5.26e-01
MMHDHDVFGKTVVVCTSFSHVTSLVTSVSVYTYLHPLRATLTPITLFVTHTFTPARRSIAVVIVQAS

SEQ ID NO: 182741 - protein, 102 aa, Glycine max
  Coding DNA Sequence Number=SeqID_65963
  Subcellular localization annotation: CTP_CleavageSite=41; ConfidenceScore=5.84e-01
MRRNSPASSSDTSFLPQPSFFSGRPFTGISSFGVRFVLSFCSSTIFAFLSYPNFVQGGHLFVGIRPSFDHFEEVPPEGGAFWRKQPNSPGRVGWQAPPSFPL

SEQ ID NO: 182742 - protein, 376 aa, Glycine max
  Coding DNA Sequence Number=SeqID_65964
  Gene Ontology: Mol. function=nucleic acid binding; Cellular component= nucleus; Biological process=defense response
  Pfam annotation: Domain name=rve; Domain location=243-375; Score =43.1; E_value=9.5e-10; Accession=PF00665.16; Description=Integrase core domain
MALIGNLSSELTNKKFDWSRPIRDHVTEMANLVAKLNSMGMQMSESFLVQFILNSLPTEFGQFQVNYNALKEKWNFQEIKAMLNQEKWRLKKMKENSIHLMTHDGASTSKSKSGKKDKEIKGFILIQTIRGTKKFRCIGNKMKARIKGIGTYRLIVDTRCHVVLEGCLYVLGYARNLVSVAKMDELGFSFKIGNNIRSYIKRKDNEISDNEILPQLDFSDWDICLDSIKGKKTKQISKNFATRSNELLRLIHIDICGSFDIPSWDSEKYFNTFIDEFSHYCYLYLLHEKSQLVDALKVFIDEVERQMDKKVTVVRFDIGGEFYGKYNESEQCPGQFTKFLESRGIYAQYTMPNKLQQNGVAERWNRTLMNMVSVTP

SEQ ID NO: 182743 - protein, 80 aa, Glycine max
  Coding DNA Sequence Number=SeqID_65965
MAPKKHSTKRSRRDAQGESSSVSVEFDTHGGGSSRYALVSKGSVDSLWHRCPQPVPGPPTDLGGGPSVRIQPEEGLGLRL

SEQ ID NO: 182744 - protein, 101 aa, Glycine max
  Coding DNA Sequence Number=SeqID_65966
MESQVRRPWSCSSALSQVTEQVGHILIHVGFLRFAWGSCGSGSLLSGPISRPHDLSPELLWGRAYKRRGALPLLAEAGTVEALMQLHLPAVVGRLLANHMP

SEQ ID NO: 182745 - protein, 125 aa, Glycine max
  Coding DNA Sequence Number=SeqID_65967
  Gene Ontology: Mol. function=hydrolase activity; Cellular component =cytosol
  Homolog annotation: Hit_ID=Q45NN8; Match level="QueryCoverage=76%, HitCoverage=56%, E-value=3e-42, Identity=83%"; Hit description =Hydroxyacylglutathione hydrolase
  Pfam annotation: Domain name=Lactamase_B; Domain location=10-124; Score=5.4; E_value=0.056; Accession=PF00753.17; Description=Metallo -beta-lactamase superfamily
MNESSEWRRIVDESTKEAAAVDPVEPEKVLEVASSHGLTLKFVLTTHHHWDHAGGNDKIKQLVPGIKVYGGSIENVKGCTDKVENGDKVSLGAEITILALHTPWYSMPYPYAIVNCFQLVYTNFG

SEQ ID NO: 182746 - protein, 265 aa, Glycine max
  Coding DNA Sequence Number=SeqID_65968
  Gene Ontology: Mol. function=structural molecule activity; Biological process=response to gibberellin stimulus
  Homolog annotation: Hit_ID=Q2HTV7; Match level="QueryCoverage=99%, HitCoverage=100%, E-value=6e-56, Identity=49%"; Hit description =Major sperm protein
  Pfam annotation: Domain name=Motile_Sperm; Domain location=83-190; Score=32.7; E_value=1.2e-06; Accession=PF00635.16; Description=MSP (Major sperm protein) domain
  Subcellular localization annotation: CTP_CleavageSite=70; ConfidenceScore=5.55e-01
MAVESDKVGSDGKVWSFCSMPFWQTTHASSSSSSTTTTIPTTSSMHHSVHHQSQILQSLDRSTHQPSTTVSSVAKSLLPTRRRLRLDPPNKLYFPCMSLIINLFAFFLASMNLFQTTAPKSCYMRPPGGILAPGESIIATVFKFVEPPENNEKPIDQKSRVKFKIMSLKVKGEMDYVPELFDEQRDHVADEQILRVIFLDPERPSPALDKLKRQLAEAEAALEARKKPPEETGPRVAGEGLVIDEWKERRERYLARQQVEVVDSV

SEQ ID NO: 182747 - protein, 88 aa, Glycine max
  Coding DNA Sequence Number=SeqID_65969
  Gene Ontology: Mol. function=oxidoreductase activity; Biological process=response to oxidative stress
  Homolog annotation: Hit_ID=Q9ZNZ6; Match level="QueryCoverage=76%, HitCoverage=19%, E-value=7e-28, Identity=86%"; Hit description =Peroxidase precursor
MGNNLRFLSLCLLAWIASTHAQLQLGFYANNCPKAEQIVLKFVHDHIHNASSLPTALIRMHFHDCFVRIKVKELTKMKHFRDEMHQSF

SEQ ID NO: 182748 - protein, 283 aa, Glycine max
  Coding DNA Sequence Number=SeqID_65970
  Gene Ontology: Mol. function=oxidoreductase activity; Cellular component=chloroplast
  Homolog annotation: Hit_ID=Q9ZUC1; Match level="QueryCoverage=84%, HitCoverage=59%, E-value=9e-92, Identity=72%"; Hit description =Quinone oxidoreductase-like protein At1g23740, chloroplast precursor
  Pfam annotation: Domain name=ADH_N; Domain location=1-85; Score=6.0; E_value=0.00016; Accession=PF08240.2; Description=Alcohol dehydrogenase GroES-like domain
  Pfam annotation: Domain name=ADH_zinc_N; Domain location=115-270; Score=29.1; E_value=1.5e-05; Accession=PF00107.16; Description=Zinc -binding dehydrogenase
  Pfam module annotation: Pfam domain module=ADH_N::ADH_zinc_N; Domain location=1-85::115-270
MVGVQLKIGTLIQLFLVHEKRINSKKTVPGYDVAGVVVKVGSQVKDFKVGDEVYGDVNEKALEGPKQFGSLAEYTAVEEKLLASKPKNLDFAQAAALPLAIETAYEGLERTGFSPGKSILVLNGSGGVGSLVIQFYNRDAGILAKQVFGASRVAATSSTRNLDLLKSLGADLAIDYTKENFEDLPEKFDVVYDAIGQCDRAVKAVKEGGSVVALTGAVTPPGFRFVVTSNGAVLRKLNPYLESGKVKPIVDPKGPFSFDKLAEAFSYLETNRATGKVVIHPIP

SEQ ID NO: 182749 - protein, 144 aa, Glycine max
  Coding DNA Sequence Number=SeqID_65971
  Subcellular localization annotation: CTP_CleavageSite=15; ConfidenceScore=5.32e-01
MEPLAMRSSNHQGVVQAGISTTSTTPTSAAVNTLVVSKTTTTNQLDFILEDCEDNEGEVPNNMVPILEMAQEENAVTINERHAMTYSIPKIQPLVIGPMTGVEAFGPPPVQFGTVQMVGCSPNVSSTIGFDGNLLVELLWRLDL

SEQ ID NO: 182750 - protein, 500 aa, Glycine max
  Coding DNA Sequence Number=SeqID_65972
  Gene Ontology: Mol. function=ATP-dependent helicase activity; Biological process=ripening
  Homolog annotation: Hit_ID=P92982; Match level="QueryCoverage=99%, HitCoverage=85%, E-value=1e-163, Identity=55%"; Hit description =Probable polygalacturonase non-catalytic subunit JP630 precursor
  Pfam annotation: Domain name=BURP; Domain location=322-499; Score =250.9; E_value=2.6e-72; Accession=PF03181.6; Description=BURP domain
  Subcellular localization annotation: CTP_CleavageSite=74; ConfidenceScore=5.75e-01
CQSSAPPPTSSASRRSSSASRNTPKNVDFQTYDNSQNFSNYGTSRPGGTDSFRSYATTFSSRPDNSFRRYSRRSAGHVDSFVRYGGSIGDIYQTFNTYGTSSAGGAGEFKQYATESNFPELDFTTYSDSSGGRRQSFSSYGENGNSGGQNFTSYGKNSAGAGNEFSSYGTSSNVEASNFTNYGARGTSPNDTFTNYGVLQNIPEVNFQSYAEGTVGGTESFSNYRVQANVGDDSFQSYAKNTKEGTKVDFRNYAISANPSSDTFKGYAKGAEGDHKVGFTSYGNDTNTTFKDYVKQGVSFASYNVPSSSASKTVSDSFVKTGKFFRESMIKEGTVMPMPDIRDKMPPRSFLPRYILSKLPFSSSKIYELKRVFKVSDNSSMDKMIMDSFGECERAPSVGETKRCVGMKGGKVTKSVSCHQSLFPYLLYYCHSVPKVRVYEADLLNPESKAKINHGVAICHLDTTAWSPTHGAFVALGSGPGRIEVCHWIFENDMTWTIAD

SEQ ID NO: 182751 - protein, 92 aa, Glycine max
  Coding DNA Sequence Number=SeqID_65973
AVRLSSTLKSYPEPHELLVIHASSTIESGAPRIDCLAAVRLSSTIKGEDGRNQCFIFAFPLISGKRYLTPFVAQYVKFRDMPEIKRKHCYAI

SEQ ID NO: 182752 - protein, 176 aa, Glycine max
  Coding DNA Sequence Number=SeqID_65974
MAQSNSSRLGFPALITTLCIARGVVPDSLTFESLSPAINLAYIRKNCWNPDDPTITFSGTLPPAPPVPVPSDTSAQSLDAMVPILQSLHQGLCLVMQSIHNLAQHQPIIIKEEFIAQVAWPGVQPSPVEEGEAPTAQGLQPKPKATPEATSEETPEITPAATPAEDTNYAVDMAVA

SEQ ID NO: 182753 - protein, 111 aa, Glycine max
  Coding DNA Sequence Number=SeqID_65975
  Gene Ontology: Mol. function=carbonate dehydratase activity; Cellular component=chloroplast; Biological process=carbon utilization
  Homolog annotation: Hit_ID=Q1PG92; Match level="QueryCoverage=98%, HitCoverage=58%, E-value=2e-28, Identity=60%"; Hit description =Carbonic anhydrase
  Pfam annotation: Domain name=Pro_CA; Domain location=1-100; Score= -34.4; E_value=0.00072; Accession=PF00484.9; Description=Carbonic anhydrase
MSSYSEFIEHWVQICTPAKSKVKTEASTLEFSEQCTNCEKAIMPSRIEVFFLTAMQEAVNVSLGNLLTYPFVRDAVVKKKTLALKGAHYNFVKGTFELWDLDFKISNSVSV

SEQ ID NO: 182754 - protein, 192 aa, Glycine max
  Coding DNA Sequence Number=SeqID_65976
  Gene Ontology: Mol. function=ribonuclease H activity; Biological process=DNA integration
MDLIGKIHPSSSKCHSYIIVATNYFTKWVEAQLMVSVTQNDIIKFIQNQIAYRFGIPEAIMDDQGLVIGDWKYSDKTSFGMEGFLSIGVESANPAVIAKGGRWWFTIKETSIILTRKSATNPGNKNFRDLIRLRRGVQTDREMDGAAKNLGDGLDQTKLPRKIVRKPNWTKIGVVLSVAIFKVVENMDNAPV

SEQ ID NO: 182755 - protein, 195 aa, Glycine max
  Coding DNA Sequence Number=SeqID_65977
  Homolog annotation: Hit_ID=Q1SDG1; Match level="QueryCoverage=31%, HitCoverage=5%, E-value=8e-09, Identity=47%"; Hit description =Integrase, catalytic region; Zinc finger, CCHC-type
MIAHFESIHINPWDVVENANRIPYDVELNEVPQSQWMKEQKQRFLLNSKARNALLCVLFKDEYTKVQSFRSAKIDVGHTAYNIWMDNIGKEERAKSPHTKTYDNYDHIDKILRSLSRKLRPQSMNKNFNKMKESIRENLFLLTLKVRQAPTSKESTSRSSSKSVSKALSVDNSSDDEFEEESNENNELAFIARKM

SEQ ID NO: 182756 - protein, 97 aa, Glycine max
  Coding DNA Sequence Number=SeqID_65978
  Gene Ontology: Mol. function=carbonate dehydratase activity; Cellular component=chloroplast; Biological process=carbon utilization
  Homolog annotation: Hit_ID=Q5NE21; Match level="QueryCoverage=86%, HitCoverage=31%, E-value=2e-40, Identity=89%"; Hit description =Carbonic anhydrase
  Pfam annotation: Domain name=Pro_CA; Domain location=2-96; Score =84.8; E_value=2.6e-22; Accession=PF00484.9; Description=Carbonic anhydrase
MLHFPHLQFMVFACSDSRVCPSHILDFNPGEAFVVRNIANMVPPYDKTKYSGTGAAIEYAVVHLKVENIVVIGHSCCGGIKGLMSIPDDGTTARISN

SEQ ID NO: 182757 - protein, 53 aa, Glycine max
  Coding DNA Sequence Number=SeqID_65979
MPRHGLPVSNYLWPYGKSTDPTDSQMGNYGNKVTAESNNVADLWTLAFGKFAI

SEQ ID NO: 182758 - protein, 91 aa, Glycine max
  Coding DNA Sequence Number=SeqID_65980
MARTCSPLKARTCSPLKIDCPFERGDNSCNLILSFANLSGNSLREGTYWVRTSNLPLGSLEAHARCPSLPQCKAFEVPIIVLFSRPRSEEE

SEQ ID NO: 182759 - protein, 160 aa, Glycine max
  Coding DNA Sequence Number=SeqID_65981
MERSMIDAASHGALGDMTPVEARNLIEKMASNSQQFSARNDVIVLRGVHDVATDSSTSAENKKLEGKLDALVNLLSGVNEQLEAHVANIYNRLPQQQNQQQQNNYDLSNNRYNPGWRNHPNLRWENPPQQQQQQQQQFVPPFQNVVGPSRPYVPPPMQQQ

SEQ ID NO: 182760 - protein, 136 aa, Glycine max
  Coding DNA Sequence Number=SeqID_65982
  Subcellular localization annotation: CTP_CleavageSite=52; ConfidenceScore=5.41e-01
MSSLSARGALSEFTLAQRLYTAHPSSRFFCALSRRMVHLADGSPSTWRGSVLLAEASNFLLASKKYIHVQQSHGRRYLWKMTMHNGLPSVVQPWCEYLTDNDLMPEDKVVFYYNFKQHVWEVIFRKQLIWDDVDSS

SEQ ID NO: 182761 - protein, 79 aa, Glycine max
  Coding DNA Sequence Number=SeqID_65983
MSLTRKPSCGALDEILRDCERVSAKRNTPGLSARKTLKEDELYKCSILDSYHFILLVQFGALAESQTHAYRVTQHWEMV

SEQ ID NO: 182762 - protein, 186 aa, Glycine max
  Coding DNA Sequence Number=SeqID_65984
  Gene Ontology: Mol. function=protein binding; Cellular component =ribonucleoprotein complex; Biological process=mRNA metabolic process
  Homolog annotation: Hit_ID=O22247; Match level="QueryCoverage=54%, HitCoverage=92%, E-value=9e-40, Identity=88%"; Hit description=Small nuclear ribonucleoprotein-like protein
  Pfam annotation: Domain name=LSM; Domain location=37-90; Score=22.1; E_value=0.00073; Accession=PF01423.12; Description=LSM domain
MEEDICLQCFAKLTYFILLTAGKNEEEEFNTEPLFVLMMSVKNNTQVLINCQNNKKLLGRVRAFDRNCNMVLENVREIWTEVWCQRLVKERKTPSQSTRIDSSAKCFSVEILSPLFLGTPNEILLSTSTSCNRNPPLSPFVKAYPSRGVDLAIEAEPVAAITVTEISQAMIEELSLNLLVVGGVTA

SEQ ID NO: 182763 - protein, 155 aa, Glycine max
  Coding DNA Sequence Number=SeqID_65985
MQDLTLKIETVMRAQAQAQVPIITPPFPTYDRCRIVHGMAECTVDDELVANIDENNFVGGRNNTFNQYPNNFNQGLGFRKNQGMQSSNLPSQPKRNPKKEDANALMTRSKRFKRTLRRMKIFPQKLQIVSLLRRTKYLRKLRLGRRRKWMKRRRY

SEQ ID NO: 182764 - protein, 62 aa, Glycine max
  Coding DNA Sequence Number=SeqID_65986
MYTYIHSISFPQGRGKEVDNYLVPDNDARNLIHKVCKACRRASVPYTVVTMDSKVRISNPKD

SEQ ID NO: 182765 - protein, 57 aa, Glycine max
  Coding DNA Sequence Number=SeqID_65987
MEASLCIPGKGFILNTEGQPWNLLRKGLTTLAQTWSVFSYSNLVPTSRTSNLNTDRA

SEQ ID NO: 182766 - protein, 209 aa, Glycine max
  Coding DNA Sequence Number=SeqID_65988
  Gene Ontology: Mol. function=oxidoreductase activity; Cellular component=vacuole; Biological process=response to oxidative stress
  Homolog annotation: Hit_ID=O24081; Match level="QueryCoverage=81%, HitCoverage=48%, E-value=8e-75, Identity=82%"; Hit description =Peroxidase1A precursor
  Pfam annotation: Domain name=peroxidase; Domain location=42-205; Score=224.7; E_value=2e-64; Accession=PF00141.13; Description =Peroxidase
MSSLRLALCCVVVVLGALPHFSYAQLDPSFYDSTCSNVTSIVREVLSNVSQSDPRILASLIRLHFHDCFVQGCDASILLNDTDTIVSEQSAVPNNNSIRGLDVVNQIKTAVENACPGIVSCADILALAAQISSDLANGPVWQVPLGRRDSLTANQTLANQNLPAPTFTIDQLIESFGNQSLNITDLVALSGYFLLITIRLELVRDPNLV

SEQ ID NO: 182767 - protein, 106 aa, Glycine max
  Coding DNA Sequence Number=SeqID_65989
  Homolog annotation: Hit_ID=Q9LIQ2; Match level="QueryCoverage=98%, HitCoverage=72%, E-value=2e-31, Identity=59%"; Hit description =Arabidopsis thaliana genomic DNA, chromosome 3, BAC clone:F14O13
  Pfam annotation: Domain name=Self-incomp_S1; Domain location=8-105; Score=75.0; E_value=2.4e-19; Accession=PF05938.2; Description=Plant self-incompatibility protein S1
LLFATNEYYVRVINGFSDNSSVPLVIWCASEEMDLGGRALQEHDDFSWVMRPNFWSSNRMKCTMKWGNTRKSFEAFKASRDTDRCGLHRMCSWMVTQNGFYFSNDE

SEQ ID NO: 182768 - protein, 72 aa, Glycine max
  Coding DNA Sequence Number=SeqID_65990
MKCKSLTEKNIIKPEEKNAKLQATKQARLEQQTMDDTTRINKMKYLKCPSTASNAIKADEVIPTGSSKPTSK

SEQ ID NO: 182769 - protein, 89 aa, Glycine max
  Coding DNA Sequence Number=SeqID_65991
MLRCGEYRAEQKDEMKGECLSVLRVETPRFPLLFIADIIYKILNKRAFGHCLVPPQHVKVQRSSAFQNPRKVRGLGVGVCWVVMSHRIC

SEQ ID NO: 182770 - protein, 79 aa, Glycine max
  Coding DNA Sequence Number=SeqID_65992
MKNNVEVDYGRNSVAPRPYFSLLSSFSLNFSQCKTLEPITQPPARLFIAKDGIRGHGRSPRRVGYFTPKLFGGPGEPGF

SEQ ID NO: 182771 - protein, 173 aa, Glycine max
  Coding DNA Sequence Number=SeqID_65993
  Gene Ontology: Mol. function=DNA binding
  Homolog annotation: Hit_ID=Q1S0F5; Match level="QueryCoverage=81%, HitCoverage=26%, E-value=4e-11, Identity=37%"; Hit description=IMP dehydrogenase/GMP reductase
MGSSQAPSLKKRFYQVKAAINAFLAFHDRKESPVVAILADLYDTFDRRCEKSSARIVCCTPALYIWLVSHLFCQEVRHACPLECHRSCTEEKEASWDQLLASKEGASVNWLPRWKEVKNRDSYFVRRISKCSLDGDKGLHQLPSRPRYKITWLPFEKGTTRGRPHTYYCTRFQ

SEQ ID NO: 182772 - protein, 82 aa, Glycine max
  Coding DNA Sequence Number=SeqID_65994
MAFLGETSSQTIVNSRLAFIFPNGSIIHNDIGVYFQTSTPVPIRVPNSCDFASLKTIIHNTLKLSDKQFLDEIHYQKPFTDT

SEQ ID NO: 182773 - protein, 46 aa, Glycine max
  Coding DNA Sequence Number=SeqID_65995
MVAAQRDWSSKPSGNRLQAIVIDYRLSVLVKSITLNGNQLPEHKLG

SEQ ID NO: 182774 - protein, 137 aa, Glycine max
  Coding DNA Sequence Number=SeqID_65996
MTEGCGEGFCLANLPGDAFSLWGNFFEAKKQMMADANRWLKFCPRSTSWFLPVVGLARVGGAGLWPRAKFRIGWPPPPPREGRIKATRAESQWIVAARPLCHLQYPVAYLSRLQRILPAARWELRFKASRRANPPHE

SEQ ID NO: 182775 - protein, 265 aa, Glycine max
  Coding DNA Sequence Number=SeqID_65997
  Gene Ontology: Mol. function=protein-tyrosine kinase activity; Cellular component=integral to membrane; Biological process=protein amino acid phosphorylation
  Homolog annotation: Hit_ID=Q5VQM7; Match level="QueryCoverage=40%, HitCoverage=48%, E-value=1e-22, Identity=40%"; Hit description =Putative receptor-like protein kinase INRPK1
VPPVQLLTGWCVTAKAPPDISAGKCSGHAARRVPFAIQAAQLLGRAIGAGLFAITPAGERGMCCKAIKLGNARVFPVTTLNSIERWNLPRESVIIQFQLLQAGEVANIRRKFTYQRIHRKIYDSKACTVSHTFWNGSSEIILPQKYLSEACHGTQFRRNVSRKLVFIEKQLLQGYQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 182776 - protein, 40 aa, Glycine max
  Coding DNA Sequence Number=SeqID_65998
MAHLALSQMAVTVPVGSDLSLRRSAVKIQLSGESVVMLDV

SEQ ID NO: 182777 - protein, 80 aa, Glycine max
  Coding DNA Sequence Number=SeqID_65999
MGTQRGVNGLFFCLPLLCVMIMESPSMPIAFLLEEEEIWDSETPPLGQGPCMIRGVKVPGCLDKENEHDRMLMNAISAPY

SEQ ID NO: 182778 - protein, 525 aa, Glycine max
  Coding DNA Sequence Number=SeqID_66000
  Gene Ontology: Mol. function=protein dimerization activity; Cellular component=nucleus; Biological process=regulation of transcription, DNA-dependent
  Homolog annotation: Hit_ID=Q5D1M3; Match level="QueryCoverage=98%, HitCoverage=61%, E-value=0.0, Identity=81%"; Hit description=Class III HD-Zip protein 4
  Pfam annotation: Domain name=Homeobox; Domain location=16-76; Score =68.0; E_value=3e-17; Accession=PF00046.19; Description=Homeobox domain
  Pfam annotation: Domain name=START; Domain location=166-376; Score =218.5; E_value=1.5e-62; Accession=PF01852.10; Description=START domain
  Pfam annotation: Domain name=bZIP_1; Domain location=57-117; Score =8.7; E_value=0.017; Accession=PF00170.11; Description=bZIP transcription factor
  Pfam module annotation: Pfam domain module=Homeobox::START::bZIP_1; Domain location=16-76::166-376::57-117
MALSMHKDSANNQMDSSKYVRYTPEQVEALERVYAECPKPSSLRRQQLIRECPILSNIEPKQIKVWFQNRRCREKQRKEASRLQTVNRKLTAMNKLLMEENDRLQKQVSHLVYENGYMKQQIHTASAGTTTDNSCESVVMSGQNQQQNPTPQHPNRDANNPAGLLAIAEETLAEFLSKATGTAVDWVQMIGMKPGPDSIGIVAVSRNCSGVAARACGLVSLEPTKVAEILKDRQSWYRDCRCVDVLSIVPTGNGGTIELLYMQTYAPTTLAAARDFWTLRYTTSLEDGSLVICERSLTSSTGGPTGPPSTTFVRAEMLPSGFLVRPCEGGGSIIHIVDHIDLDVWSVPEVLRPLYESSKFLAQKLTIATFLTMPKIKSEYSGGRQPAVLRTFSQRLCRGFNDAVNGFVDDGWSLMGTDGVEDVTIAINSSPNKFLGSNYNASMFPAFGGGVLCAKASMLLQNVPPALLVRFLREHRSEWADYGVDAYSAACLKASPYAVPCARPGGFPSTQSFYPLLILLSTRRY

SEQ ID NO: 182779 - protein, 118 aa, Glycine max
  Coding DNA Sequence Number=SeqID_66001
  Homolog annotation: Hit_ID=UPI0000E478AA; Match level="QueryCoverage =71%, HitCoverage=25%, E-value=1e-09, Identity=37%"; Hit description =PREDICTED: similar to cortical granule protein with LDL-receptor -like repeats
HILTFRGIHVLDFRGLHVLTIRGLYVLAFRGLHVLTSIGLLASRGLYILAFRGLHVLDFRGLHVLTFRGLHVLAYGGLHVLASIGLLIRQVCEVLIFTLSLSQSTGLASHPLSATLLD

SEQ ID NO: 182780 - protein, 42 aa, Glycine max
  Coding DNA Sequence Number=SeqID_66002
MAEFEIHRQKTNDARKKVVTDIIFLSFRLSNVSHWSRFKFIK

SEQ ID NO: 182781 - protein, 86 aa, Glycine max
  Coding DNA Sequence Number=SeqID_66003
  Gene Ontology: Mol. function=hydrolase activity, hydrolyzing O -glycosyl compounds; Cellular component=membrane; Biological process =carbohydrate metabolic process
  Homolog annotation: Hit_ID=Q6NKW9; Match level="QueryCoverage=93%, HitCoverage=16%, E-value=5e-18, Identity=64%"; Hit description =Putative glucan endo-1,3-beta-glucosidase 8 precursor (EC 3.2.1.39) ((1->3)-beta-glucan ...
  Homolog annotation: Hit description=endohydrolase 8) ((1->3)-beta -glucanase 8)
MEKNWVLRWSFVVGLMCLSVEGIGMNWGTQATHKWPQHTVVQMLKDNGIKKVKLFDSDDSTMSALAGTGIEVMKSWWLSLIISLPR

SEQ ID NO: 182782 - protein, 277 aa, Glycine max
  Coding DNA Sequence Number=SeqID_66004
  Gene Ontology: Mol. function=ferredoxin-NADP+ reductase activity; Cellular component=thylakoid membrane; Biological process=electron transport
  Homolog annotation: Hit_ID=Q41014; Match level="QueryCoverage=99%, HitCoverage=67%, E-value=1e-136, Identity=91%"; Hit description =Ferredoxin--NADP reductase, root isozyme, chloroplast precursor
  Pfam annotation: Domain name=FAD_binding_6; Domain location=49-119; Score=-18.6; E_value=0.039; Accession=PF00970.14; Description =Oxidoreductase FAD-binding domain
  Pfam annotation: Domain name=NAD_binding_1; Domain location=130-246; Score=130.0; E_value=6.6e-36; Accession=PF00175.11; Description =Oxidoreductase NAD-binding domain
  Pfam module annotation: Pfam domain module=FAD_binding_6::NAD_binding_ 1; Domain location=49-119::130-246
MVEMFPTGKDRVMVLFHRFHQNLSRFCLPSPPSISKLMGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFLESVPTYKFGGLAWLFLGVANTDSLLYDEEFSKYLNDYSDNFRYDRALSREQKNKNGGKMYVQDKIEEYSDEIFKLLDNGAHIYFCGLKGMMPGIQDTLKKVAEQRGESWEEKLSQLKKNKQWHVEVY

SEQ ID NO: 182783 - protein, 297 aa, Glycine max
  Coding DNA Sequence Number=SeqID_66005
  Gene Ontology: Biological process=regulation of GTPase activity
  Homolog annotation: Hit_ID=Q1RV25; Match level="QueryCoverage=88%, HitCoverage=75%, E-value=1e-103, Identity=72%"; Hit description=C2; Arf GTPase activating protein
  Pfam annotation: Domain name=ArfGap; Domain location=17-105; Score= -8.2; E_value=0.00013; Accession=PF01412.9; Description=Putative GTPase activating protein for Arf
  Pfam annotation: Domain name=C2; Domain location=143-222; Score =107.7; E_value=3.4e-29; Accession=PF00168.20; Description=C2 domain
  Pfam module annotation: Pfam domain module=ArfGap::C2; Domain location=17-105::143-222
MIDTFSTGSFFCSLFLNFLMVSFQNEITLKFGMKVLSVTLDDWSEDEIDAMIEVGGNVSANSIYEAYIPEGYTKPGPDAGHEQRSKFIRSKYELQEFLKPSLRIVSGKSSLQSSSAKSSFMDSFKSTSSSQRMEGMVEFIGMLKVKVIKGTNLAIRDIKSSDPYVVLSLGQQTVQTTIIRSNLNPVWNEEYMLSVPEHYGQIKLKVFDHDTFSADDIMGEADIDLQSLITSAMAFGDAGMFGDMQIGKWLKSDDNALIEDSTVNIVDGKVKQMMSLKLQDVESGELDLELEWIPLEQ

SEQ ID NO: 182784 - protein, 156 aa, Glycine max
  Coding DNA Sequence Number=SeqID_66006
  Subcellular localization annotation: CTP_CleavageSite=99; ConfidenceScore=5.36e-01
MPSLSGLATAILIAIALLLAGTSSSGRDLRPSEHGLVFQASPPANSSPEMKSFFSTSKGSSSSSSDADTSPRNTTESLPPPWWGVNGGGGGGGGSHVGRALMIASLVCGITGGVLLVASALLYLFKHRRKPHQNEPFRACNNNANKLQLVPVVRNR

SEQ ID NO: 182785 - protein, 531 aa, Glycine max
  Coding DNA Sequence Number=SeqID_66007
  Gene Ontology: Mol. function=catalytic activity; Cellular component =integral to membrane; Biological process=metabolic process
  Homolog annotation: Hit_ID=Q5P603; Match level="QueryCoverage=86%, HitCoverage=87%, E-value=3e-52, Identity=33%"; Hit description =Putative ADP-producing CoA ligase,similar to feruloyl-CoA synthetase
  Pfam annotation: Domain name=AMP-binding; Domain location=34-465; Score=305.1; E_value=1.3e-88; Accession=PF00501.18; Description=AMP -binding enzyme
MANYSHSHICQCLSGLLNFRRHFSVIIAEKRHKTGQELAEEVLSLAQGLLHLGLTPGQVVAISAYNSERYLEWLLAIAFVGGIAAPLNYRWSFEEARLAINAVNPLMLVTDESSYARYSKLQQNDVPSLKWHILLDSPSSDFTKWNVLTAEMLKRHPVKLLPFDYSWAPEGAVIICFTSGTTGKPKGVTLSHGALIIQSLAKIAIVGYNEDDVYLHTAPLFHIGGLSSAMTMLMVGGCHVLMPKFDAESAVDAIEQYAVTSFITVPAIMASLISIIRHKETWQGGDTVKKILNGGGSLSHELIKDTSIFFHKAKLISAYGMTETCSSLTFLTLYEPMHETTSQSLQAFGVAGSKLIHQQQGVCVGKAAPHIELKISADASGHIGRILTRGPHIMLRYWDQTLTNPLNPNNEAWLDTGDIGSIDHYGNLWLLGRTNGRIKSGGENIYPEEVEAILQQHPGIASVVVVGIPDAHLTEMVAACIQLRENWQWFKIPKTFIVWRKPFQLTTTGKIRRDQVRKEVMSQLQSLHSNL

SEQ ID NO: 182786 - protein, 68 aa, Glycine max
  Coding DNA Sequence Number=SeqID_66008
MSFFFLFFVQLFFSGSVWWCREKVAMESSAAMEGGDRIYDNGKDDASVGDHFDILKDMTPFWRTSMSG

SEQ ID NO: 182787 - protein, 100 aa, Glycine max
  Coding DNA Sequence Number=SeqID_66009
  Subcellular localization annotation: CTP_CleavageSite=22; ConfidenceScore=5.24e-01
MFATQFRAFSPLGISISAFFFPAETQSCLGKTTIPVSLTVGLLLNLDMLFEIQFRTLPPLGFARQYSCREKKESYEDSTSGGFNLFSVSLTFGNSIGAVG

SEQ ID NO: 182788 - protein, 472 aa, Glycine max
  Coding DNA Sequence Number=SeqID_66010
  Homolog annotation: Hit_ID=Q5BQN5; Match level="QueryCoverage=91%, HitCoverage=50%, E-value=6e-48, Identity=31%"; Hit description=WPP domain associated protein
MRNLKDRLDFLQSENHQLKDTLSDKKKEFKSLSSQLSASVEKLSQQQLTQKNLLQTIQKLKDDIEDAHTQVSIIQDVYKCFFEDIVSEFRCSTEELHMENSFMQEIYEVIFKEASHSAQASSGLGIEEAEMESTILQGQLDINHIIFKETLVNAGEALKLESAEKEKLKYEMLMMKSVVEEKEKLIQGIVDALVLEKQKTESASEQRNSLRAEIVQQHKLIAEKSKELDVTKGNLVAALKEIEQDKEQVQELRQNLEQRMIKLKETDEEKRVLCALTQKQQEALKLIEAKERESRKQMESTINLIHKLLAMITDFEARVNKDISRNCLRLENMRSEFHWIKNKANVLKTMGMVYKQKLETKSSDLSKAEAEGSKKLLERSCNPRALMGKKKSHGWFKWVVLVDLLGDEVDTLLSLLEKIYIALDHYSPILQHYPGVRICPFLHICSLYIIELGLGMGVFLFITYMGIPHSMK

SEQ ID NO: 182789 - protein, 771 aa, Glycine max
  Coding DNA Sequence Number=SeqID_66011
  Gene Ontology: Mol. function=protein serine/threonine kinase activity; Cellular component=membrane; Biological process=protein amino acid phosphorylation
  Homolog annotation: Hit_ID=Q6ZF70; Match level="QueryCoverage=94%, HitCoverage=85%, E-value=0.0, Identity=56%"; Hit description =Putative PTH-2, resistance gene (PTO kinase) homologs
  Pfam annotation: Domain name=APH; Domain location=527-702; Score= -16.8; E_value=0.091; Accession=PF01636.13; Description =Phosphotransferase enzyme family
  Pfam annotation: Domain name=Pkinase; Domain location=524-766; Score =112.1; E_value=1.6e-30; Accession=PF00069.15; Description=Protein kinase domain
  Pfam annotation: Domain name=Pkinase_Tyr; Domain location=524-756; Score=100.6; E_value=4.7e-27; Accession=PF07714.7; Description =Protein tyrosine kinase
  Pfam module annotation: Pfam domain module=APH::Pkinase::Pkinase_Tyr; Domain location=527-702::524-766::524-756
MGSVLGEGHFVVLLLVMVSLTVSTVNGQPKSILLNCGSDSSVNVDGRRWVGDMATDNNVTLSSPSVVVSTSTSSGSSIYDSLYKTARIFNSPLNYTFKDVQGNYFVRFHFCPFETDDYNVNESSFGVVVNSLKLLSEFDVPGKISHKNMNLLNSGRNASSLFLVKEYIVAVNGDMLLIEFVPTRSSFGFINAIEIVPVAGELFAGSVSRVGGSGGNMNLPGRGMETMYRLNVGGPEIQSNQDHDLWRTWEVDSGYMITENAGSGIKNSSNITYASVNDTAVAPLLVYETARAMSNTEVLDKRFNMSWKFEVDPDFDYLVRLHFCELVYDKANERIFRIYINNKTAADNVDVFVRAGGMNKAYHQDYFDPVSPRIDTVWVQLGPDTAAGAAGTDALLNGLEVFKLSRNGNLAYVERFDLGGNSGNKSKARAIWVGVGAGVASVAIVALIVGLVFCFCNGRKKQSSDTKNNPQGWRPLFLYGGAAVNSTVGAKGSAGTQKPYGSVGSTRVGKKFTLAEINAATNNFDDSLVIGVGGFGKVYKGEVEDGVPVAIKRANPQSEQGLAEFETEIEMLSKLRHRHLVSLIGFCEEKNEMILVYEYMANGTLRSHLFGSDLPPLSWKQRLEVCIGAARGLHYLHTGADRGIIHRDVKTTNILLDENFVAKMADFGLSKDGPAFEHTHVSTAVKGSFGYLDPEYFRRQQLTEKSDVYSFGVVLFEVVCARAVINPTLPKDQINLAEWAMRWQRQRSLETIIDSLLRGTIVRNHWQSMER

SEQ ID NO: 182790 - protein, 55 aa, Glycine max
  Coding DNA Sequence Number=SeqID_66012
  Gene Ontology: Mol. function=oxidoreductase activity; Biological process=response to oxidative stress
  Homolog annotation: Hit_ID=O24081; Match level="QueryCoverage=73%, HitCoverage=11%, E-value=2e-12, Identity=82%"; Hit description =Peroxidase1A precursor
MGNIGVLTGSQGEIRSQCNSVNGNSSGLTTTATKESSQDSMHYIVETVENIFIGI

SEQ ID NO: 182791 - protein, 311 aa, Glycine max
  Coding DNA Sequence Number=SeqID_66013
  Gene Ontology: Mol. function=RNA-directed DNA polymerase activity; Cellular component=intracellular; Biological process=RNA-dependent DNA replication
HGLKINPKANENPKAFPWIFGPIYLESSIQCPCRVKVGMGMATFIHDKLVTLLRDYQDIFAWSYQDMLGLNADIVQHKLPLNLGCSPVKQKLRRIRPEMSLKIKEEVKKQFNVGFLAVARYPKWVANIVPVPKKDEKVRMCMDNQDLNRASPKDNFPLSHIDVLVDNKARTFCYKVMSFGLKNAGPTYQQAMVALFHNMMHREIEVYVDDMIAKSKTEEEHLINLRKLFERLRKYQLRLNPVKCTFRVKSGKLLGFVVSQKGIEVGPEKVKAILEISQLPTSRSSSSFTRISPFAGTMTVKRQLEESNSAS

SEQ ID NO: 182792 - protein, 151 aa, Glycine max
  Coding DNA Sequence Number=SeqID_66014
  Gene Ontology: Mol. function=DNA binding; Biological process=DNA integration
  Homolog annotation: Hit_ID=Q1RSZ9; Match level="QueryCoverage=98%, HitCoverage=10%, E-value=1e-59, Identity=72%"; Hit description =Polynucleotidyl transferase, Ribonuclease H fold
MASNKTSFHPALAVSNIRNHVSIVLEMENVQYSTWTELFKIHARSTKVLDHIIPPANGTGMIPSTEEERELWSTLDATVFSWIYATISSDLLHTIIELDSTAMEAWDRLRDIFQDNQHSRAITLEQEFSATSMENFPNVFSYCLRLKSLAD

SEQ ID NO: 182793 - protein, 264 aa, Glycine max
  Coding DNA Sequence Number=SeqID_66015
  Homolog annotation: Hit_ID=Q1RSZ9; Match level="QueryCoverage=31%, HitCoverage=6%, E-value=8e-10, Identity=45%"; Hit description =Polynucleotidyl transferase, Ribonuclease H fold
MMTKVMNKKLKRSKNNSSESKNISSESRTSQEFKNQEEFKTQEESLSKNNSRYIYLGLTENKRGYISCGSVLVEGTCTRVSKRTREGRHGLLQNQYKNSCVFVSFFPTLLLSTATRSNTSVSDSRLVLQLVGGLTQLYRGVGALIRQSNPLPPFYKARSMLTLEEAGMAKEAATESAMIASSINDGSPQLTKLGHSKGKNGAQHSGGGQRNNGGGRKNVGSGGGQNSTGGKGGGRGQSSGGHDETTPPQWQQRQPFSWGWYNPT

SEQ ID NO: 182794 - protein, 492 aa, Glycine max
  Coding DNA Sequence Number=SeqID_66016
  Gene Ontology: Mol. function=DNA binding; Cellular component =chromatin; Biological process=DNA integration
  Homolog annotation: Hit_ID=Q1SAI8; Match level="QueryCoverage=99%, HitCoverage=39%, E-value=1e-173, Identity=55%"; Hit description =Integrase, catalytic region
  Pfam annotation: Domain name=rve; Domain location=155-306; Score =47.7; E_value=3.9e-11; Accession=PF00665.16; Description=Integrase core domain
MHTMSLNQPDPSWYMDTGATSHMTSSTGNLLSYFNLNNHPNTNIIVGNGHTIPILGYGHTNLSSPCQSLSLNNVLYAPKLIKNLVSVRKFTKDNSVSVEFDPFGFSVKDYRTGMSIMRCDSRRDLYPISYSLNNQASSSTFAAISPKLWHDRLGHPVSPIFDVLWKNKSIDCNKLSSSSICGSCVLGQKSDVYDIFLTFKAHISTQFECNIKNVQCDNGREFANNSFWHFCQTDGMSLRLSCPHTSSQNGKAECKIQTINNMSHTLLAHASLPPSFWHHALQMVTYLLNVLPSKLLGNKSSLEVLYTRVPSYDHIRVFGCLCYPLIPSTTINKLQPRSTPCVFLGYPTHHRGYKCYDLSSHKIIICRHVLFDEHTFPFASLHSPKSHTYDFIDEGLSPYVIHHLHQLTPTPSSQPNVPSEPNSSPPDPISSQITPAQTQIDPFPTNSPIQQSRVVTHSQHGIYKPNKKYSMHTTVERSPLPRNPITALRDPN

SEQ ID NO: 182795 - protein, 119 aa, Glycine max
  Coding DNA Sequence Number=SeqID_66017
MKKILIWMSMGESLFALHNLLKQLKWVTGDSLDVPRKTGNEAISHRKKNLVNGCEDQKWRLKGWFREPVMNLPPDNTHGRAESAEERGKEKLGTNDPRNVGVRKGSRVLLANSRLRDFG

SEQ ID NO: 182796 - protein, 495 aa, Glycine max
  Coding DNA Sequence Number=SeqID_66018
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=33%, E-value=1e-112, Identity=43%"; Hit description =Chromo
MHHMQLAKESKFNRITEALTTLLQRQTPPPDSSHVGSNSPKPSFQVRSVKLDFPRFDGKNVRDWVFRVEQFFDYYETPDYDRLTIALVHLDQDVIPWFKMMQRANPFPFWRVFTRALKMDFGPSVHECPKSTLFKLMQTGTVNSIWNLQPLLTEWTFKVNICSDVRAMSPTTLPKAAALAKLFEEWYEPNSKPKFSNSQARTSNTNQPYPKYSYNPIKADVPNTNPKANQSPLLRTPNSKPLNQTQNKPKIKYISQAEMQVRRDKGLSYWCDDKFSFSLKCPNKQLMMLQLTDDSDLNEEIKPPDIDIATAEMPRGAHHLSLNAMKGFHGVGTIRFTGNIGNIRVQILVDGDNSESFLQPRIAMFLKLPIEPEPHFRVLVGNGQIMETEGWVKQLAVDIQGQKLLVPVYLLPVSGADLILGSPWLATLGPHVADYAALTLKFFYHGNFLTLQGEVSSTPTQAHLHQLKRLHDTSAISNSFAIHMMQHDNPDDILT

SEQ ID NO: 182797 - protein, 128 aa, Glycine max
  Coding DNA Sequence Number=SeqID_66019
MKEVIYDEEQNNNATKVNVAGTNNNNKNNGEKVKRRDVDSVWGWEHGRATAGEYLKGLRLSDVGTKEREREKKALFWEEAMSEVLVGLGSSSSMDFASWKMNGSGMEKEEREETPLQGEDEYRRSSPP

SEQ ID NO: 182798 - protein, 99 aa, Glycine max
  Coding DNA Sequence Number=SeqID_66020
MDLASFSHMVWTLILVNVLSIIFLNKKTAMCKYFSTISGYLSSPAPGTSVFWPLNDILVLYNSNINFYVRGDRKPIGVEGPVIVGAGPSRLAAAACVKQ

SEQ ID NO: 182799 - protein, 204 aa, Glycine max
  Coding DNA Sequence Number=SeqID_66021
  Homolog annotation: Hit_ID=Q10RR9; Match level="QueryCoverage=89%, HitCoverage=51%, E-value=1e-29, Identity=41%"; Hit description =Expressed protein
  Subcellular localization annotation: CTP_CleavageSite=27; ConfidenceScore=5.11e-01
MIMIHLTEFSNFLNPFGASSSPSARIRATQCQCSDLQKRLESSRDKARAKLQLVARLKCGSACLFVVITASFVVILVTHGFAMIVAVSGLASMNLASERKLAKVTSQLDAATKGTYIVNKDLETTSRLVARLNDELEYMKTTMRFWLERKKDKFQADGEVMRLLKKNQCSFSDQLDELEEHLFLCFMTINRARDLVLNQITNST

SEQ ID NO: 182800 - protein, 148 aa, Glycine max
  Coding DNA Sequence Number=SeqID_66022
MGEVKEAQEQMEADMEAMKEQMTTMMEAMMSMKKIMEADAVAVSATSAVARVNPMPPYDLNQMNHPTLDMVGKDLGSTDDPMMCKFKMSMPSCHMTYLPTIRHPMWRTLPMRMSITPLLYPLRANNPKLIMHMSLKPWGRRMKFPTTI

SEQ ID NO: 182801 - protein, 124 aa, Glycine max
  Coding DNA Sequence Number=SeqID_66023
MEKHSTLNEGKPEASGSKKRKTRGNKKRKTREEIGSKAYLPGKETNAAMEALAGTRRRRHRTAEEVFFWLLMGCDARVYVVGRVQPEVSSYSTASGDGGGDGHRVAPESYAHACPVRVRRGTRR

SEQ ID NO: 182802 - protein, 77 aa, Glycine max
  Coding DNA Sequence Number=SeqID_66024
MILPFPWVPRCSRSKVRAHLLKMTGKGVRVCQKVTVAKLIDLKKIDNEATLRVERSKQCVIASGFYSTPNGYKHSWC

SEQ ID NO: 182803 - protein, 60 aa, Glycine max
  Coding DNA Sequence Number=SeqID_66025
MAWLQWIVSQLLFSLDLATFIAIAGSLATFFRDMVEEKANALTPTAPTPSPKAGVVSGHS

SEQ ID NO: 182804 - protein, 117 aa, Glycine max
  Coding DNA Sequence Number=SeqID_66026
  Homolog annotation: Hit_ID=O04098; Match level="QueryCoverage=97%, HitCoverage=21%, E-value=2e-08, Identity=32%"; Hit description =Receptor-kinase isolog, 5' partial; 115640-113643
MESGTPKTFDWTSRLGIATTIAEALSFLHQELCHHGIVRGNLKSSNILLNKNMEPCISEYGVMGMDDQRGSLFASPIDSGALDIFKEDVYGFGVILLELLTGKLVKGNGIDLTDWVQ

SEQ ID NO: 182805 - protein, 100 aa, Glycine max
  Coding DNA Sequence Number=SeqID_66027
  Gene Ontology: Mol. function=RNA-directed DNA polymerase activity; Biological process=RNA-dependent DNA replication
MGRVGQRRNKLLVKDPRQDHQGKHTASCMTPKFRNREALEEFGSSRGNRQGDPISPYLFVLCMERLSHIISVAVDNNMWKPIQLGRNGPKLSHLAFVWFT

SEQ ID NO: 182806 - protein, 202 aa, Glycine max
  Coding DNA Sequence Number=SeqID_66028
MELYHETFLRRAGAMIGIVLKIDKLTLIHSRGKFARICVEGLHFCFKFGQYGHKAAQCVDGMAAEGKKEPEVQAAKEGESVRADVISNNGVINVEVPNMVTGEVNMVMTSNPNDFEPWMIAMARVGLRIAGLVVPGAGGMGLILLSIPSPQKQTLSSRSYAACNSGQRSKVASSGGVPGPRMDLPRGVGAVEDDRQLHRGAL

SEQ ID NO: 182807 - protein, 421 aa, Glycine max
  Coding DNA Sequence Number=SeqID_66029
  Gene Ontology: Mol. function=RNA-directed DNA polymerase activity; Cellular component=chromatin; Biological process=chromatin assembly or disassembly
  Pfam annotation: Domain name=rve; Domain location=231-387; Score =109.0; E_value=1.4e-29; Accession=PF00665.16; Description=Integrase core domain
MLGCATLGVMIVISGPFLQHRPIAFFSKQLCPRLQKASTYVREHHAITTAVCKWCHYLLGHHFVILTDHRSLKELMTQYKPRPSNVVDDALSRISASTSSLMILSVPHNLFLDQLKQMFVQDQTYQTLLQQVLTSPQDHPGFTSKSHLLYFNNKIWLPAGHDLTKVLMDEFHQTPLGGHMGVTKTLDSIQQHFSWPHMCADVSHYVAQCTTCPQIKSETRKPAGLLQPLPQPSSLWADLSMDFITGLPPSHGYTTIMVVVDRFSKGTHFGPLPTHYTAHKVVLLFFNLVCKIHGFPRSIISDRDLIFLSAFWRELFRVSGTKLRFSTAYHPQSDGQIEAINRVLEQYLRAFVHDRPRQWFNYLSLAEWSYNSSVHSGTGFSPFEVMFGKPPPTLPLYAAGDSPVEAVDTLLTLRHDIHLTL

SEQ ID NO: 182808 - protein, 98 aa, Glycine max
  Coding DNA Sequence Number=SeqID_66030
MSVEGERCITNRTMEWRLQSFLLLSNIWKPYQSSQRDLRNLRKPLEMPLLLSQYTREPLRVVSYELLNHTIVRSFKSDEYCYGIHCRNPASLITSTTS

SEQ ID NO: 182809 - protein, 71 aa, Glycine max
  Coding DNA Sequence Number=SeqID_66031
  Gene Ontology: Mol. function=RNA-directed DNA polymerase activity; Biological process=RNA-dependent DNA replication
MAPKDMEKTNFVTLWRTFYYKVMSFGLKNVGATYQRAMVVLFHDMMHKEIEVYVDDMIAKSKTEEEHLVNL

SEQ ID NO: 182810 - protein, 127 aa, Glycine max
  Coding DNA Sequence Number=SeqID_66032
MSTSYSRDFFLSHTFVTLTREVKWQAEIPEWLSVQRQLLLILTREVRWQAEIPKWLSVQRQLLLIPTREVRWKAEIPQVVIRTNTLLLILTRGVRWQTEIPQVVIRTHTVLLPRPVRSQVARGDALY

SEQ ID NO: 182811 - protein, 92 aa, Glycine max
  Coding DNA Sequence Number=SeqID_66033
MASKKRKAPSTPIQTRFDRSRFTSLEAWERYTNIVVLRKLLPERNVVVYYTEFDEFKEELERRHWDEKLTGFSDSSIDIDIVKEFYANLYDP

SEQ ID NO: 182812 - protein, 38 aa, Glycine max
  Coding DNA Sequence Number=SeqID_66034
  Homolog annotation: Hit_ID=O64438; Match level="QueryCoverage=69%, HitCoverage=11%, E-value=6e-08, Identity=96%"; Hit description=ARG10
MFCLFQHITRSFYSTGVGGLRCYENPKNKITAVPAEEE

SEQ ID NO: 182813 - protein, 204 aa, Glycine max
  Coding DNA Sequence Number=SeqID_66035
  Gene Ontology: Mol. function=nucleoside-triphosphatase activity; Cellular component=integral to membrane; Biological process=transport
  Homolog annotation: Hit_ID=Q1SFG2; Match level="QueryCoverage=56%, HitCoverage=18%, E-value=2e-44, Identity=76%"; Hit description =Glycoside hydrolase, family 10; AAA ATPase
MEGSDISRVDSARASGYNIWRNNSMDVFSTSEREDDEEALKWAAIERLPTYLRIRRSILNNEDGKGREVDIKQLGLTERKFLMERLVKIAEEDNERFLLKLRERMDRSAYEAIVVERHKPLSKNNIASIQYQCFYKKTEHATIFPPSLLQKGQSIVSRRLLKAIHLVICSPEHKVQDHHRIQTQTTHRKWVITFLTNGEKQDNM

SEQ ID NO: 182814 - protein, 64 aa, Glycine max
  Coding DNA Sequence Number=SeqID_66036
MAGLLGYRSLPPKAKNLVVVGGLTTFVFGAYFYTMRVVGGTDELQTLPLVDGVDSTKQKHDEKE

SEQ ID NO: 182815 - protein, 147 aa, Glycine max
  Coding DNA Sequence Number=SeqID_66037
  Gene Ontology: Mol. function=prephenate dehydratase activity; Biological process=L-phenylalanine biosynthetic process
  Homolog annotation: Hit_ID=Q6JJ29; Match level="QueryCoverage=79%, HitCoverage=20%, E-value=1e-33, Identity=65%"; Hit description =Prephenate dehydratase
MAELYGLNMMADGIQDDPSNVTRFVMLVREPIIPRTDRPFKTSIVFAHDKGTDGSLLPNLLGVFYPMPLRDRIASGTSVLFKVLSVFTFRNFSLTKTESRPHQNRPIRLVDDANASVAKVKTVEKCEMKRVVGREEGKTLGGELERL

SEQ ID NO: 182816 - protein, 550 aa, Glycine max
  Coding DNA Sequence Number=SeqID_66038
  Gene Ontology: Mol. function=DNA binding; Cellular component=nucleus; Biological process=multicellular organismal development
  Homolog annotation: Hit_ID=Q6H976; Match level="QueryCoverage=99%, HitCoverage=57%, E-value=1e-176, Identity=62%"; Hit description =STYLOSA protein
  Pfam annotation: Domain name=WD40; Domain location=255-293; Score =23.4; E_value=0.00083; Accession=PF00400.22; Description=WD domain, G-beta repeat
  Pfam annotation: Domain name=WD40; Domain location=297-335; Score =49.4; E_value=1.2e-11; Accession=PF00400.22; Description=WD domain, G-beta repeat
  Pfam annotation: Domain name=WD40; Domain location=340-379; Score =40.1; E_value=7.7e-09; Accession=PF00400.22; Description=WD domain, G-beta repeat
  Pfam annotation: Domain name=WD40; Domain location=422-459; Score =36.0; E_value=1.3e-07; Accession=PF00400.22; Description=WD domain, G-beta repeat
  Pfam annotation: Domain name=WD40; Domain location=512-550; Score =29.3; E_value=1.3e-05; Accession=PF00400.22; Description=WD domain, G-beta repeat
  Pfam module annotation: Pfam domain module=WD40::WD40::WD40::WD40::WD4 0; Domain location=255-293::297-335::340-379::422-459::512-550
MGVTKDGLSNPVGDIVSNVGSPLQAGGPAFPRSDTDMLMKLKLAQLQHQQQQNANPPQQQLQQHTLSNQQSQTSNHSMHQQDKMGGGGGSSVNVDGSMSNSFRGNDQVSKNQTGRKRKQPASSGPANSSGTANTAGPSPSSAPSTPSTHTPGDVMSMPVLPHSGSSSKPLMMFSADGAGTLTSPSNQLWDDKDLELQADVDRFVEDGSLDDNVESFLSPDDTDLRDTVGRCMDFSIIRLACSKKLSIVEFQSFTFSEINSVRASTTKVGCCHFSSDGKLLASGGHDKKAVLWFTDSLKQKATLEEHASLITDVRFSPSMPRLATSSHDKTVRVWDVENPGYSLRTFTGHSSPVMSLDFHPNKDDLICSCDADGEIRYWSINNGNCARVSKGGAVQMRFQPRLGRYLAAAAENVVSILDVETQASRYSLKGHTKSIRSVCWDPSGEFLASVSEDSVRVWTLGSGSEGECVHELSYDSREGLRMSLVEGENRRGASVINNSILFVSLELWNMTENKTMTLSAHEGLIAALAVSTVNGLVASASHDKFVKLWK

SEQ ID NO: 182817 - protein, 59 aa, Glycine max
  Coding DNA Sequence Number=SeqID_66039
QDRGLSQCWHVPPKRIAEWGRGVSPARMAGLDEAVSPILKASPTWPVSPMQKATLSSPT

SEQ ID NO: 182818 - protein, 129 aa, Glycine max
  Coding DNA Sequence Number=SeqID_66040
  Gene Ontology: Mol. function=transcription regulator activity
  Homolog annotation: Hit_ID=Q1SFF6; Match level="QueryCoverage=61%, HitCoverage=8%, E-value=5e-41, Identity=100%"; Hit description =Lissencephaly type-1-like homology motif; Single-stranded DNA -binding protein, SSDP; WD40-like
  Pfam annotation: Domain name=LisH; Domain location=10-36; Score=34.9; E_value=2.9e-07; Accession=PF08513.1; Description=LisH
MSQTNWEADKMLDVYIHDYLVKRDLKASAQAFQAEGKVSSDPVAIDAPGGFLFEWWSVFWDIFIARTNEKHSEVAASYIEGAGWVTGKCCGYGLIGGSPVTLQFAVASGVALIAAAIVAIMTATDPIFI

SEQ ID NO: 182819 - protein, 259 aa, Glycine max
  Coding DNA Sequence Number=SeqID_66041
  Gene Ontology: Mol. function=DNA binding; Cellular component=nucleus; Biological process=multicellular organismal development
  Homolog annotation: Hit_ID=Q1SFF6; Match level="QueryCoverage=58%, HitCoverage=17%, E-value=2e-64, Identity=83%"; Hit description =Lissencephaly type-1-like homology motif; Single-stranded DNA -binding protein, SSDP; WD40-like
  Pfam annotation: Domain name=SSDP; Domain location=13-259; Score =86.0; E_value=1.2e-22; Accession=PF04503.4; Description=Single -stranded DNA binding protein, SSDP
MKGLPREKKLRHCLKFMAREQQQQQQQQQQQQQQGQQQPQPQKLQHQQQQQQQQHMQMQQILLQRAQQQQQQQQQQQQQQQQPQQQQQQQQPQQQHQQQQQPQQQGRDRAHLLNGGTNGLVGNPSTANALATKMYEERLKLPLQRDSLEDAAMKQRFGDQILDPNHASILKSSAATGQPSGQVLHGAAGAMSPQVQARSQQLPGSTPDIKSEINPVLNPRAAGPEGSLIAMPGSNQGSNNLTLKGWPLTPLSSGRNSLP

SEQ ID NO: 182820 - protein, 194 aa, Glycine max
  Coding DNA Sequence Number=SeqID_66042
MQFIFIIRQPEYLPTFIAASSKEDEPYPYPAVVVAAAADAAVVVAAAAAVVVVAAAAAAVVVAAAAAAEPFVIGFVASACVVVAAAVVDVATSEVVAAAALVAVAVAVAVAAADVNRETPDNNVPECGLDRNPTAVPWVNRKLHQSIMGWSETPLECHGLARCAAGSCRPDGCIEERREETAVIKPLKGVRMGK

SEQ ID NO: 182821 - protein, 61 aa, Glycine max
  Coding DNA Sequence Number=SeqID_66043
MSELMNGTGSVFLWVPPLKMARKFGTANEDGDIAAYVEGVAHGPGETPPRWIRQWSWRYGA

SEQ ID NO: 182822 - protein, 149 aa, Glycine max
  Coding DNA Sequence Number=SeqID_66044
MEESMMMRHGCSSKWYTREEKEVAKILLGLQQQEHSKPPSLNWGRKRKRSAIQDVFLHHNKTQNNPSSPDTPLSFLPSTESHQNPKKRSPQKKKLKEEFFLGSIEDLKKQKVLLEEELYNVKLFYNKAKAYNLKLKAKEQIIDEFLLLL

SEQ ID NO: 182823 - protein, 301 aa, Glycine max
  Coding DNA Sequence Number=SeqID_66045
  Gene Ontology: Mol. function=heat shock protein binding; Cellular component=integral to membrane; Biological process=protein folding
MNRGLRDANGSLSKQNVERIILPQLNAKTKFPKTYSHYLSRMKWFRNQYNMMSTLMRNNSGFGWDPIGKTFTAHEDVWKDYLKSHPSHSKLRGKSMVDYEYLKIVVGGGVSSGNNSISVDPDDTDATTFEPENRTVGIEEFSYDPNSDTFITSNNYEPAYQPPSPSQPSPSSHPPSPLDSEVPIEKQNCHKRRRSEYGGSSSAVGINNQGNVLENLSVGIGTIAVNFEKISNMMEKREKDRDRDRELEGIIWDVIKEIPNLDDITRFKTTELLNTKAKKDFFLKMSPEERSSWINFKLGNN

SEQ ID NO: 182824 - protein, 233 aa, Glycine max
  Coding DNA Sequence Number=SeqID_66046
  Gene Ontology: Mol. function=zinc ion binding
  Homolog annotation: Hit_ID=Q1SIQ2; Match level="QueryCoverage=80%, HitCoverage=72%, E-value=1e-54, Identity=52%"; Hit description=Zinc finger, RING-type; Zinc finger, FYVE/PHD-type
  Pfam annotation: Domain name=FYVE; Domain location=138-195; Score= -10.4; E_value=0.012; Accession=PF01363.12; Description=FYVE zinc finger
MGEHMNKAMQEKPILIGLEDLYQGIPDESVNLTFQHLAEVKTSDKRKLTTTPSRSIAKLPSLDFTKGLQASNQQHHLQDFGHGESPLGHSGHFISDASGGAQRQSPRLKPSGDDDHLGHGMSFDGVSVASGRGSRRRRPGIPHSKICAICNTYVYIFRTRCLVCGRVYCRQCAERGMGEMIEGRKCIECLGLRFSQRCNSFSYNERTYVVTLIQISELNQITTTVKAHKLPYT

SEQ ID NO: 182825 - protein, 158 aa, Glycine max
  Coding DNA Sequence Number=SeqID_66047
MYHVAPLHLTQHLNNKISVCFQFQLIESQRGALDKFVIIHKNDAEASSIGENVIEQPLINHTDNEENVIEQPPIDNTDNGVEQPPRDDTDNGENVIEQPPINNTDNTNSHNFNQELEENILEIGVEGNVEHNNTSSEVPTNIYDPELWKNIDGKFIEI

SEQ ID NO: 182826 - protein, 215 aa, Glycine max
  Coding DNA Sequence Number=SeqID_66048
  Gene Ontology: Mol. function=ATP binding; Cellular component=cytosol; Biological process=positive regulation of transcription from RNA polymerase II promoter by pheromones
  Homolog annotation: Hit_ID=Q1T1A4; Match level="QueryCoverage=99%, HitCoverage=100%, E-value=1e-82, Identity=70%"; Hit description =Thioredoxin domain 2
MDPNAVKSTLSNLAFGNVMAAAARDYQKELHAQEKTHASSSVHQEVDLDELMDKEAEKREEWKKKGHGEFREVTEGDFLGEVTGSEKVICHFYHKEFYRCKIMDKHLKSLAPKHIDTKFIKLDAENAPFFVTKLAIKTLPCVILFRQGVAVDRLVGFQDVGGKDDFTTRTLEALLIKKGIIEVKKAEDDEDDEYQDSTRRVVRSSMIAGSDSDSD

SEQ ID NO: 182827 - protein, 146 aa, Glycine max
  Coding DNA Sequence Number=SeqID_66049
  Subcellular localization annotation: CTP_CleavageSite=67; ConfidenceScore=5.22e-01
MLIYRQKSEDYKKPTLAMQSVHVNGSVRSSDSSKAQNATKQRQPQKEMMNLMIPFGNGPTQSERFIVSAHPTTSLQVPSSSSSNGLGHEAQAVLPDLNMSPKEFSQLNSSQPLNVASAIRDLKRFNAAEARRRRIMLMRQPQKTTL

SEQ ID NO: 182828 - protein, 93 aa, Glycine max
  Coding DNA Sequence Number=SeqID_66050
  Gene Ontology: Mol. function=receptor activity; Cellular component =mitochondrion
  Homolog annotation: Hit_ID=Q5Z9P3; Match level="QueryCoverage=92%, HitCoverage=14%, E-value=5e-21, Identity=52%"; Hit description =Receptor-like protein kinase-like
EEFNVFSREVVRFGNLCKDPQWHSLEQYFSRLHLDIWDNMQPTVEAEMTMQELTTIAQNTAELYHELTSLEHFEQDYQHKLKEMESLNLPLNG

SEQ ID NO: 182829 - protein, 263 aa, Glycine max
  Coding DNA Sequence Number=SeqID_66051
  Gene Ontology: Mol. function=receptor activity; Cellular component =mitochondrion
  Homolog annotation: Hit_ID=Q5Z9P3; Match level="QueryCoverage=95%, HitCoverage=44%, E-value=2e-51, Identity=43%"; Hit description =Receptor-like protein kinase-like
  Pfam annotation: Domain name=DUF668; Domain location=12-97; Score =138.5; E_value=1.9e-38; Accession=PF05003.3; Description=Protein of unknown function (DUF668)
ATAVKHCNGSERLGEAGLSLHYANIINQISMIASRPTVLPPNLRDTLYHGLPNYIKSALPSRLQNIDAMKELSITQVKAEMDKTLQWLTPFATNTIKAHQGFGWVGEWANTSNEFGENTTKESNLIRLQTLYYAEKHKIDFYIIELLTQIHYLVTFVRYRHNTMKPMPKRTSPRRLDFQSKFISIDSINKPLGSKLSQEDKRLLEEVTMRRRSPGVSKSEDLAVTKKRSAKVWHHSNSVGSSPVTREGLDHQRSNVLDIIDGL

SEQ ID NO: 182830 - protein, 200 aa, Glycine max
  Coding DNA Sequence Number=SeqID_66052
  Gene Ontology: Mol. function=zinc ion binding; Cellular component =mitochondrion; Biological process=regulation of transcription, DNA -dependent
  Homolog annotation: Hit_ID=Q1SIQ1; Match level="QueryCoverage=74%, HitCoverage=21%, E-value=7e-38, Identity=50%"; Hit description =Transcriptional factor B3
MLVSEAIKVGDLWVDEFPCLLESYCGRSLSSASEEMSSRELENILVTSKDTKKRRIMEKPESIQEHESVGLDDHIDPTDSSAGATTKHPRHRSGCTCIVCIQPPSGKGRHRPTCTCLACMTVRRRFKTLMMRKKQRESDATQKDQIHHSDEGDTNGGASRDGAIASNLENEGSLNRMDELGAGQIDLNSHPDHEDMQVAM

SEQ ID NO: 182831 - protein, 134 aa, Glycine max
  Coding DNA Sequence Number=SeqID_66053
  Gene Ontology: Mol. function=zinc ion binding; Cellular component =mitochondrion; Biological process=regulation of transcription, DNA -dependent
  Homolog annotation: Hit_ID=Q1SIQ1; Match level="QueryCoverage=91%, HitCoverage=20%, E-value=3e-27, Identity=45%"; Hit description =Transcriptional factor B3
MFSRIDPGGKFVMGSRRASDSIDTQVEASTFSHSNDFATKEATFSGATANLHSGNSYPDLLRTTKGNGEPYLNRYSEHLRFSTETANCLQTENDMELRVTWEEAQDLLHPPPCVKPSVETIEDKEFEEFEENMD

SEQ ID NO: 182832 - protein, 221 aa, Glycine max
  Coding DNA Sequence Number=SeqID_66054
  Pfam annotation: Domain name=DUF1723; Domain location=118-164; Score =12.3; E_value=0.018; Accession=PF08330.1; Description=Protein of unknown function (DUF1723)
MVRTRGLGRSLGHAIGKVLGRRDESDDDAPRRRRRPTASACRQRQQQVVLEDPSTAEEELVDIQAEAPIDEGDADVEGFPCRLHDTSVLSDFENHIALRVWNGELKLSYHGRKMTKLGRPAPEIEGLVHKETSSFHLPIGEVTITLDDVAALLLFLVVGAFHSFEQLNVDDVVDLLMELLEVSAGDARVETIRCNGSYVRLSWLRDMYELKIEACAWIIAA

SEQ ID NO: 182833 - protein, 120 aa, Glycine max
  Coding DNA Sequence Number=SeqID_66055
MTGRSERITNLEATGRPTTKWRQEEKPPTPTLTITEEDERSPEDEEPRAGEGPLCLFTMSAGCPSKKFWVHQELRYFKQKKVQETTFKQHPFFLRSKKKVHHRSCQRRHLHHILTKNLNV

SEQ ID NO: 182834 - protein, 59 aa, Glycine max
  Coding DNA Sequence Number=SeqID_66056
MMEGDFIKLAQARKNIADYIIIPFLTYGMLRNLTNCATMLPFEFRHVTELHELSNEGCQ

SEQ ID NO: 182835 - protein, 146 aa, Glycine max
  Coding DNA Sequence Number=SeqID_66057
  Homolog annotation: Hit_ID=Q66CQ0; Match level="QueryCoverage=26%, HitCoverage=9%, E-value=3e-07, Identity=65%"; Hit description=HAAAP family serine transporter (Serine:H+ symporter), sdaC
  Subcellular localization annotation: CTP_CleavageSite=23; ConfidenceScore=5.48e-01
TPAPIAVPYRPSIHTVSLLRQPVAAASTVPRVPVCELSICLSKIVSNAAGTTAKNSRRPAACGRFTKRAYATRFCPAWIAATQDMHHKGGVQDTARSGRERENEVRGCCQQQSAVKETPPAASLGQCSTSPEDNAGRIENQNARIL

SEQ ID NO: 182836 - protein, 422 aa, Glycine max
  Coding DNA Sequence Number=SeqID_66058
  Gene Ontology: Mol. function=transferase activity
  Homolog annotation: Hit_ID=Q9X4C7; Match level="QueryCoverage=39%, HitCoverage=40%, E-value=6e-22, Identity=35%"; Hit description =Repeat unit exporter Wzx
  Pfam annotation: Domain name=Glycos_transf_2; Domain location=122 -277; Score=-0.4; E_value=0.0016; Accession=PF00535.16; Description =Glycosyl transferase
  Pfam annotation: Domain name=MASE1; Domain location=8-184; Score= -55.6; E_value=0.043; Accession=PF05231.5; Description=MASE1 domain
  Pfam module annotation: Pfam domain module=Glycos_transf_2::MASE1; Domain location=122-277::8-184
IAVALYTRVNQISVSYFLGVKEAGIFSVALTLSTAWVFLPSALLASFYPAFFAERNDQQAIVKAQKLHLLVIGVSAAVIVAIWLLSGWFIRDFYGEQYLDAVAPTLLLSLGAMCAVLSSVMDRFIIKYNGYRYLVKKTFAVLVICLLSSLLLVPHFGLTGAAMSVVTVLNQINAGVSAARNSGLQQASGEYVLFLDADDWVDDNFLMSFKLNLNAWPAEAVDLMVGNLNDNRIGKVSQAGFFSQQDIPYVLGELEMSDNIGYLHNKCYRRQIIDDLHLRFMEGVSMSEDLLFNLKFFSCVSNFLITPGAAYHYEDVAGSLSKRKVQYSELKVRKQSLTDLYDSIVEKYASGNLDHFLKAISKRVLALDMQIVTAMYHASFSPADIAQEINQIKRGKYSKECGRSDFQFSRRYPLATCCIARG

SEQ ID NO: 182837 - protein, 352 aa, Glycine max
  Coding DNA Sequence Number=SeqID_66059
  Gene Ontology: Mol. function=zinc ion binding; Cellular component =mitochondrion; Biological process=regulation of transcription, DNA -dependent
  Homolog annotation: Hit_ID=Q1SIQ1; Match level="QueryCoverage=93%, HitCoverage=43%, E-value=1e-115, Identity=65%"; Hit description =Transcriptional factor B3
  Pfam annotation: Domain name=B3; Domain location=272-352; Score=42.2; E_value=1.8e-09; Accession=PF02362.12; Description=B3 DNA binding domain
MSTTQGNREYEISILDLEKKTTLHCGCIASSSMFEYLDYGGIGCVTCVKTSQLNLIRDTENTIGSVRSIKNNASDRHTEHMDSRLLVDGAGKGNLMQLRRHVEASESSRWQRAERDGIDSCIGPNRQDDRRFSNVMKLSGHSLTFTTLDNNRPTWETQTMHKSSSQNMSLGTSSGNSVLPSALDIAERRLEGKTSFCPFHQGQRLFSISKPLMDGIAINLEASKGVISQERVARPPANGKTKNLLLSRYWPRITDQELEKLSGDLKSTIVPLFEKVLSASDAGRIGRLVLPKSCAEAYFPPISQSEGLPLQFKDVKGNDWTFQFRFWPNNNSRMYVLEGVTPCMQAMQLNAG

SEQ ID NO: 182838 - protein, 358 aa, Glycine max
  Coding DNA Sequence Number=SeqID_66060
  Gene Ontology: Mol. function=exonuclease activity; Cellular component= intracellular
  Homolog annotation: Hit_ID=Q1S1E2; Match level="QueryCoverage=67%, HitCoverage=27%, E-value=5e-65, Identity=54%"; Hit description=Zinc finger, CCHC-type; Putative 5-3 exonuclease
  Pfam annotation: Domain name=Extensin_2; Domain location=52-356; Score=-141.2; E_value=0.088; Accession=PF04554.4; Description =Extensin-like region
MCSMADQNVVLGSGAFCRQDTCSGGMNGYISLCGGEPCPPIFRSPIASMEDIMDNHVICAIYRLPDAHKHITRPPQGVKFPKKIVEIGDLKPEPVLWHEDSGRRHHSENGSIWSSSYLKLTGAPFFYIRKNPPGSISGRELGDAAHRLIVNSLQAKVDTNGYRHPHNGPPISYPAPMGHYRQPVPSYGYESSPGYVAMPPPISAPSLQGRPQFAPYNAAPTAQQYGCNQPYPPPPVVYNHPRQQSNSYERNDYQHARSNHYERNHHQGSGGSSRHGYQSSGNNHNARFNNSHGSYGSHHHEVSHHNQNFQPSRAHQNWTPPNNPSGHRDYGHHSSNQYSLLDRRGNRNPMPPPGYSRK

SEQ ID NO: 182839 - protein, 312 aa, Glycine max
  Coding DNA Sequence Number=SeqID_66061
  Gene Ontology: Mol. function=oxidoreductase activity; Cellular component=mitochondrial outer membrane translocase complex; Biological process=electron transport
  Homolog annotation: Hit_ID=Q1SFF8; Match level="QueryCoverage=99%, HitCoverage=77%, E-value=1e-150, Identity=80%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=1-311; Score= -449.2; E_value=0.0052; Accession=PF00743.9; Description=Flavin -binding monooxygenase-like
MESYASHFNIHPIFNQTVESADFDKGSKVWVVKTQEVDYSSRWLVVATGENAEPVVPRIHGMELFNGDVAHTSVYKSGSEYRNKKVLVIGCGNSGMEVCLDLCRHNAKPYMVARNTVHVLPREMFGFSTFGVAMALYKWFPIKLVDKIILLATNFILGNTNHYGIKRPKTGPIELKLATGKTPVLDVGQVAQIKCGNIKVMEGVKEITRNGAKFMDGQEKEFDAIILATGYKSNVPTWLKGCDFFTEDGMPKTPFPHGWKGEQGLYTVGFTRRGLQGTSCDAIKIAEDIAEQWRTVEDKSHCDSHIILLNNS

SEQ ID NO: 182840 - protein, 1060 aa, Glycine max
  Coding DNA Sequence Number=SeqID_66062
  Gene Ontology: Mol. function=DNA binding; Cellular component=nucleus; Biological process=transcription
  Homolog annotation: Hit_ID=Q53J12; Match level="QueryCoverage=97%, HitCoverage=82%, E-value=1e-21, Identity=22%"; Hit description=BAH domain-containing protein, putative
MTLEDFFTLTEMKDGLTAPSRVQELVSVMKKEQDCVVKNAGDATRQWAAVASTIAATENKDCLDLFIQLDGLGFINKWLKDAQNLGADNTNDGFIEESITAMLRAVEKLYLDSEKSISSGISVTVSNLLGHHSSKVQDKARVLFDRWKGGGDGDAEPTDNSDLGRINNVSDEIVWEKGQPSSVNEAGNEDDHASQPAGGEKSLLGGSDSQLQEKVSSIQIQNADNALQSSVSLDCEDAKERSNHVDIVLASVQEVANISEGGTCNLSVNKQGSFKGQQDDLKLNDLSKNEKQDQNVNGSPEELRASDISSASGEPDLEPVSIGDSEAKALESVEEEPALEHNVESNENIICPKINVSGSMRTPASDGMSVGDDVRAINSSNPQLPKSSENDDCCSQALQDLSVTGSHLEKPEMSYLKTEYVGAVKESKGQDDDTPNGSDSSNQGKGPTSPNIIDKNSDMELEYGIVDALEVARLVAQEVERECVSPIKEGNDQVSNEVNSTTNGSDSFKWGNGPKSPNVIDKSSDIELEYGIVDALEVARQVAQEVEKEVCSSSSDKISEGGIRQAASLDLGRKDEVTHALPEEVSSRQSNSAEVCSEQAEHMSVSDNIEAGQDDLESSQVTEAARDPGGNSEKSLCTFDLNEEVGSDDMDVSVNAMSTMPIPVVSASKPAQTSRLPMAPLQFEGTLGWKGSAATSAFRPASPRKNSDNEKNVSVGGNSEISKQKHDCFDFDLNVAEDEEGLVKQIGESSGLPSGQSSVELGPKRSSRFELDLNSIGADDDAQPSDQRMEGALFSGRNGYWSPSPASSSSSMQPLVRNIDLNDRPFFQTDLVDQGHSKSSSIIEAYKRSKSDAPVISILGAKVEVGRREYIPQTLSLPNGKAIEPAMDLPLSGAGSILGMGPTLPYNHSTAFGYNRLTSVPALSFSSAMYGSSGGPIPYMVDSRGTPVVPQVEGSSSTVLSSYSQPPFIVSMTGTQLGLNGVGSSRPNFDLNSGFTIDGGNRDMLTARQFFFPAQGRAMEEHVRTLPQSSSSGVSVKRKEPDGGWDRDTYAFSYKHQQPP

SEQ ID NO: 182841 - protein, 92 aa, Glycine max
  Coding DNA Sequence Number=SeqID_66063
MDNNTNIKILKGWHGSRQGGQCWCGTTFLDLCWWRDATGLGAGCEVVGEGGYDGFGSGLGGVGLGVAWQCWRIEMGWHGILMNGSLKGARIW

SEQ ID NO: 182842 - protein, 88 aa, Glycine max
  Coding DNA Sequence Number=SeqID_66064
MEKFAMSCNIYMTVSKKLQGEKEDVGSIVGSKMAHGVEVEVHRYIEKEDRRGVKDDQYFITHSIRKVISPTMHAVVADPNFFAHYENY

SEQ ID NO: 182843 - protein, 427 aa, Glycine max
  Coding DNA Sequence Number=SeqID_66065
  Gene Ontology: Mol. function=kinase activity; Cellular component =integral to membrane; Biological process=transport
  Homolog annotation: Hit_ID=Q1T680; Match level="QueryCoverage=99%, HitCoverage=75%, E-value=1e-173, Identity=71%"; Hit description=C2
  Pfam annotation: Domain name=C2; Domain location=136-220; Score =112.1; E_value=1.7e-30; Accession=PF00168.20; Description=C2 domain
MAGMKVYVTDEKELIMEPSVKWAGNPNIIVAVKAFGLRATVQVVDLQVFAAPRITLKPLVPSFPCFANIYVSLMEKPHVDFGLKLLGADAMSIPGLYRIVQEIIKDQVAKMYLWPKALEVQIMDPTKAMKVPVGILHVKVVRAEKLKKKDLLGASDPYVKLKLTEEKLPSKKTTVKYKNLNPEWNEEFNIVVKDPESQVLELTVYDWEQIGKHDKMGMNVIPLKEITPDEPKAVTLNLLKTMDPNDPENAKSRGQLTVEVLYKPFKEDELPQSAEDSNAIEKAPEGTPASGGLLVIIVHEAEDVEGKHHTNPYVRLLFKGEERKTKRINLTLDSEVLTRAKNKGSRNENVELDEWILKKAYISVKFDYGSPQPYSMSRKIEIQDGESLGYVDIKLSDVVTNKRINEKYHLIDSRNGRIQIELQWRTP

SEQ ID NO: 182844 - protein, 203 aa, Glycine max
  Coding DNA Sequence Number=SeqID_66066
  Gene Ontology: Mol. function=transcription regulator activity; Cellular component=transcription factor complex; Biological process =regulation of transcription, DNA-dependent
  Homolog annotation: Hit_ID=Q9SS44; Match level="QueryCoverage=91%, HitCoverage=59%, E-value=4e-93, Identity=91%"; Hit description =Transcription initiation factor IIB-2
  Pfam annotation: Domain name=TFIIB; Domain location=104-172; Score =37.6; E_value=4.2e-08; Accession=PF00382.10; Description =Transcription factor TFIIB repeat
  Pfam annotation: Domain name=TFIIB; Domain location=7-74; Score=51.5; E_value=2.8e-12; Accession=PF00382.10; Description=Transcription factor TFIIB repeat
  Pfam module annotation: Pfam domain module=TFIIB::TFIIB; Domain location=104-172::7-74
MANCFLLCSANTFFLNEDRANEIYKRVEDQKSSRGRNQDALLAACLYIACRQEDKPRTVKEICSVANGATKKEIGRAKEYIVKQLGLENGNAVEMGTIHAGDFMRRFCSNLCMNNQAVKAAQEAVHKSEEFDIRRSPISIAAAVIYIITQLSDDKKPLKDISLATGVAEGTIRNSYKDLYPHVSKIIPNWYAKEEDLKNLCSP

SEQ ID NO: 182845 - protein, 135 aa, Glycine max
  Coding DNA Sequence Number=SeqID_66067
  Gene Ontology: Mol. function=transcription regulator activity; Cellular component=transcription factor complex; Biological process =regulation of transcription, DNA-dependent
  Homolog annotation: Hit_ID=Q9SS44; Match level="QueryCoverage=87%, HitCoverage=37%, E-value=1e-54, Identity=87%"; Hit description =Transcription initiation factor IIB-2
MAHNTTSASLARKVRNGPVGHGGDGLEGDDEGAIRVGAAVLPATEGGGEELAATSAAVGLGDDGGEAAVGEEGVGGPADTIGIVVTGLVGEGTPLRGLVDRVGLQYEAALRAHRVAGRVVKHHLRLPLAVAAERV

SEQ ID NO: 182846 - protein, 1098 aa, Glycine max
  Coding DNA Sequence Number=SeqID_66068
  Gene Ontology: Mol. function=RNA-directed DNA polymerase activity; Cellular component=chromatin; Biological process=chromatin assembly or disassembly
  Pfam annotation: Domain name=RVP_2; Domain location=362-451; Score= -53.8; E_value=0.016; Accession=PF08284.2; Description=Retroviral aspartyl protease
  Pfam annotation: Domain name=rve; Domain location=811-962; Score= -2.9; E_value=0.01; Accession=PF00665.16; Description=Integrase core domain
  Pfam module annotation: Pfam domain module=RVP_2::rve; Domain location=362-451::811-962
QVEGTSTWLFKENKGGYIPCGSLLVKVFTRLKEISRTGGCLGTGCRHGGGGKPAAESALDARVENVKGDLKIMKLMMEAIQAEEKEAKENQSKFLELVTKSLMMNVNNEEEGEGSHGRGRKAKTNREHDGKRLNLTSAGWIWKSLEGEALDEFQQSIKKVELPSFTSKDPADWISRAKIYFQNENLMWEELKYELMQRYAGKGTMYEQLSALQQTGSVDDYIQRLHAANLLTRSHLMNTTRVIEIEMASKNKAWVGRGDTPIESRSGTGSGQRNHLVATGRTGSRNSGGNGTDGLGPNTRGDGGMCFKCGGPYGPLHQCLMKQLRLILADDELWVECEEEDAFEDAQEEGMDDGKTRSHSTMKLQGKISGILILLLVDSGATHNFISRKLVEALGWTWEETKSMNILMGDGHTTETSDIDVILGMSWLKTLGVMTVDWNSQIMKFETELGTRTLRGVNQEEPLFATLCGGLPPVREEHAINLKPGHDPMNVRPYRYPYHQKNEIERQVKELLEIGHVRPSQSEYSSPIILVKKKNNKWKMCVDYRSLSKATILDKFPIPMIEELLDELHGSTYFSNIECLGHVISKQGVKVGPNKVKSVLDWPVLTNVKGVREFLGITGYYRKFIKDYGKIGRPLTELTKKDGFGWNDHAQKAFEELKKKITSALKPVAYFSKALSSKNVTKSAYEKELMVVALAIQHWCPYLIGRKFTVYSDQKSLKQLLQQRITTGSQQNWLAKLLGMGEMELKSLAYIPVWLDCQNLITEVHESSTWRKVIEDLKQGQGKHLSFEYKQGVLFFKDRHLASNLFWKGMKGDIMRFVQNYDVCQHQKYLTTTPKGFETILVVVDRVSKYSHFIPLRHLHRARAIAKIFVKKVIRLHGIPNSVVSDRDPLFMSLFWKEFFKLQGNCKIGMKLRQLKNHLARAQERMKTQADKYRKERNFEIADLVFLKLKQHRQHSVAARISLKLSTRYYGPLEVIERIEEVAYKLKLPTSSKIHPIFHVSLLKKAHGDYKVEITLPSGLEDDREGEIEPELVLATRSIMQRGEKVNQWLDKTLLQGEGVDRNQTLNGPLEPLAYEMKKGSREFLVYFRRKKRRVEKE

SEQ ID NO: 182847 - protein, 162 aa, Glycine max
  Coding DNA Sequence Number=SeqID_66069
  Subcellular localization annotation: CTP_CleavageSite=30; ConfidenceScore=5.00e-01
MDGVLKPYQAGEQRGSSYKQNKMKNSRNNVATYASGLMNPLALRSSFYYHQQNQLPPLLPLPSVSLSPSTTVKSRKNRTRKSKQMQEEEAYKKKPTAGLLTSPGVCTSSFRSTAIGGNGFGFGTENVDFASWVFDLSPPPSSLPVPKFCMRRSKLSCNAETN

SEQ ID NO: 182848 - protein, 136 aa, Glycine max
  Coding DNA Sequence Number=SeqID_66070
MKHKRQICVDTTLKQLWPFSRRMRNYEKATNVNAQQDTHPGDEYIGEAVATIQEPFCPRHLEVIVAFNWKSLTIEKFMCPVFSGKMSGHRIRHRGSCSFNASLDFYLALYSNSSILGQDVRTLYPTSWILQLQFFT

SEQ ID NO: 182849 - protein, 1193 aa, Glycine max
  Coding DNA Sequence Number=SeqID_66071
  Gene Ontology: Mol. function=ATPase activity, coupled to transmembrane movement of substances; Cellular component=integral to membrane; Biological process=transport
  Homolog annotation: Hit_ID=Q9C7F2; Match level="QueryCoverage=94%, HitCoverage=91%, E-value=0.0, Identity=66%"; Hit description =Multidrug resistance protein 12
  Pfam annotation: Domain name=ABC_membrane; Domain location=4-266; Score=104.1; E_value=4.2e-28; Accession=PF00664.13; Description=ABC transporter transmembrane region
  Pfam annotation: Domain name=ABC_membrane; Domain location=623-902; Score=161.4; E_value=2.4e-45; Accession=PF00664.13; Description=ABC transporter transmembrane region
  Pfam annotation: Domain name=ABC_tran; Domain location=340-524; Score= 237.8; E_value=2.3e-68; Accession=PF00005.17; Description=ABC transporter
  Pfam annotation: Domain name=ABC_tran; Domain location=974-1158; Score=223.5; E_value=4.6e-64; Accession=PF00005.17; Description=ABC transporter
  Pfam annotation: Domain name=SMC_N; Domain location=955-1162; Score= -121.9; E_value=0.011; Accession=PF02463.9; Description=RecFRecNSMC N terminal domain
  Pfam module annotation: Pfam domain module=ABC_membrane::ABC _membrane::ABC_tran::ABC_tran::SMC_N; Domain location=4-266::623 -902::340-524::974-1158::955-1162
MAEVELAPDSLIEQNVTSKTVQQSKTDSVSFFGLFAAADATDCVLMFLGSVGVAFWMQTGERQTARLRLKYLQAVLKKDINFFDNEARDANIIFHISSDAILVQDAIGDKTGHAIRYLSQFIVGFAIGFTSVWQLTLLTLAVVPLIAVAGGAYTIIMSTLSEKGEAAYAEAGKVAEEVISQVRTVYSFVGEEKAAGSYSKSLDNALKLGKKGGFAKGVGVGFTYGLLFCAWALLLWYASILVRHHKTNGGKAFTTIINVIFSGFALGQAAPNLGSIAKGRVAAANIMNMIASASRNSKKLDDGNIVPQVAGEIEFCEVCFAYPSRSNMIFEKLSFSVSAGKTIAVVGPSGSGKSTIVSLIQRFYDPTSGKILLDGYDLKNLQLKWLREQMGLVSQEPALFATTIAGNILFGKEDADMDKVIQAAMAANAHSFIQGLPDGYQTQVGEGGTQLSGGQKQRIAIARAVLRNPKVLLLDEATSALDAESELIVQQALEKIMSNRTTIVVAHRLSTIRDVDTIVVLKNGQVVESGTHLELMSNNGEYVNLVSLQASQSLTNSRSISCSESSRNSSFREPSDNLTLEEPLKLDTAAELQSRDQHLPSKTTSTPSILDLLKLNAPEWPYAILGSVGAILAGMEAPLFALGITHILTAFYSPQGSKIKQEVDWVAFIFLGVAVITIPIYLLLHYFYTLMGERLTARVRLLMFSAILNNEVAWFDMDEHNTGSLTAMLAADATLVRSALADRLSTIVQNVALTVTAFVIGFTLSWKLTAVVVACLPLLIGASITEQLFLKGFGGDYGHAYSRATSLAREAIANIRTVAAFGAEDRISIQFASELNKPNKQALLRGHISGFGYGITQLLAFCSYALGLWYASVLIKKNESNFGDIMKSFMVLIITSLAIAETLALTPDIVKGSQALGSVFGIIQRRTAITPNDPNSKMITDVKGEIEFRNVSFKYPMRPDITIFQNLNLIVPAGKSLAVVGQSGSGKSTVISLVMRFYDPDLGSVLIDECDIKSLNLRSLRLRIGLVQQEPALFSTTVYENIKYGKEEASEIEVMKAAKAANAHEFISRMPEGYKTEVGERGAQLSGGQKQRVAIARAILKDPSILLLDEATSALDTVSERLVQEALDKLMEGRTTILVAHRLSTVRDADSIAVLQNGRVAEMGSHERLMAKPASIYKQLVSLQHETRDQQDH

SEQ ID NO: 182850 - protein, 553 aa, Glycine max
  Coding DNA Sequence Number=SeqID_66072
  Gene Ontology: Mol. function=protein binding; Cellular component =membrane; Biological process=retrograde transport, endosome to Golgi
  Homolog annotation: Hit_ID=Q0WRZ0; Match level="QueryCoverage=96%, HitCoverage=66%, E-value=0.0, Identity=76%"; Hit description =Putative vacuolar sorting protein 35
  Pfam annotation: Domain name=Vps35; Domain location=50-553; Score =567.8; E_value=1e-167; Accession=PF03635.7; Description=Vacuolar protein sorting-associated protein 35
MLAQGFEDEEKWLAEGIAGIQHNAFFMHRALDDNNLRDALKYSAQMLSELRTSRLSPHKYYQLYMRAFDELRRLEIFFKDESRHGVSIVDLYELVQHAGNILPRLYLLCTVGSVYLRCKDAPVKDVLKDLVEMCRAVQHPIRGLFLRSYLSQVSKDKLPDIGYEYEEGESNSVMDAVEFVLQNFTEMNKLWVRLQLQHQGPAQIREKREKERNELRDLVGKNLHVLSQIEGVDLEMYKDTVLPSVLEQVVNCKDELAQFYLMECIIQVFPDEYHLQTLETLLGACPQLQPTVDIKTVLSQLMDRLSNYAASSTEVLPEFLQVEAFTKLSTAIGRVIEAQVDMPIVGAIALHVSLLTFTLRVHPDRLDYVDQVLGSCVKKLYGKPKLDDNRATKQVVALLSAPLDKYNDIVTALTLSNYPRVMDHLDHETNKVMAMVIIQSIMKNNTCICTADKVEVLFELIKGLIMDLDGTTVDEVDEEDFNEEQNSVARLIHMFHNDESEEMFKIICTVTKHIMSGGPRRLPFTVPSLIFSALRVSFFLDDDILSMFYLQYL

SEQ ID NO: 182851 - protein, 73 aa, Glycine max
  Coding DNA Sequence Number=SeqID_66073
MGAYAKDEKLLIHSFQESLTGTKWLPSLGSVSIMASDRMQLQNMCKKGAQIFQRICPKVEGSGSPSVSLNDEE

SEQ ID NO: 182852 - protein, 68 aa, Glycine max
  Coding DNA Sequence Number=SeqID_66074
MQGMSNYVSGSCMSEHNMQTMKVLSVTMHHQKRKTLDDTSLLSSESETQHDHRSTSTPYGSHKLEYRA

SEQ ID NO: 182853 - protein, 147 aa, Glycine max
  Coding DNA Sequence Number=SeqID_66075
  Gene Ontology: Mol. function=lysine decarboxylase activity
  Homolog annotation: Hit_ID=Q9FNH8; Match level="QueryCoverage=78%, HitCoverage=53%, E-value=7e-35, Identity=65%"; Hit description =Lysine decarboxylase-like protein
  Pfam annotation: Domain name=Lysine_decarbox; Domain location=61-147; Score=-3.4; E_value=0.00017; Accession=PF03641.4; Description=Lysine decarboxylase family
MEIEQQAMKMMKSSRFRRICVFCDTSHGKNPSYQHAAIQLAKQLVERNIDLVYGGGSIGLMGLISQVVFDGGRHVLGVIPTTLMPIEITGESVGEVRAVSGMHQRKAEMAREADAFIALPDIKRNLKEIKLNVALVTSAEFELFMYN

SEQ ID NO: 182854 - protein, 173 aa, Glycine max
  Coding DNA Sequence Number=SeqID_66076
  Subcellular localization annotation: CTP_CleavageSite=50; ConfidenceScore=5.33e-01
MSFLGETSSQTITNSRLSFIFPNGSISYNQTGVYFQSLIPTPMRVPNNCSFDTLKRRMHNTLQLTNDQLLDEIYYRQPFIDAELLCTIIRTPDAILNLLQSTITPTHDAIMYYNGKWNIPRQGEFLGYSFTGTNPIRFSIPSGCGMEKLKDLIKQVTPTGVPPNGIHGSQLVS

SEQ ID NO: 182855 - protein, 129 aa, Glycine max
  Coding DNA Sequence Number=SeqID_66077
NWTSPSALHFIRISLHLSPTSYSFNPSIRPSHQHQLQHLQSYDDGAEIIFHSMITGGQSVVVMLLLPCDDGDEQGCESGVQKFRVKMLAESGGQSTVDVLCQVLGIYSAASFRLNCTCMLVDSKLGNAG

SEQ ID NO: 182856 - protein, 66 aa, Glycine max
  Coding DNA Sequence Number=SeqID_66078
MTIKGHLRVDYPSFKKRMERSERKTFNDKKANKDYITWEDNNMDSSEDSENEVMNLSLMAKNYESE

SEQ ID NO: 182857 - protein, 55 aa, Glycine max
  Coding DNA Sequence Number=SeqID_66079
MWKWRMYRWWGESSLAFSRMDKRFEKVMQDGWSFLNIQGSGAYVLKEKLKGLKVC

SEQ ID NO: 182858 - protein, 170 aa, Glycine max
  Coding DNA Sequence Number=SeqID_66080
  Subcellular localization annotation: CTP_CleavageSite=12; ConfidenceScore=5.09e-01
MTSSPPPKLATSQSTVKRTKQSTQLRRLTIRRLDEEEHFEISNARRKIILLVRMRWRSFKSKLTTHKAFAKGKVMTRLLVKSMYFIEIVSNVSQDIRKDGSDNPEKEHQHHIFFVGVITFLRKKTWMRSKRDNRSKHPSLGVKQLLTLHSSFTKSGVKVGLYKTIWVDDI

SEQ ID NO: 182859 - protein, 347 aa, Glycine max
  Coding DNA Sequence Number=SeqID_66081
  Gene Ontology: Mol. function=DNA binding; Cellular component=nucleus; Biological process=regulation of transcription
  Homolog annotation: Hit_ID=Q6K539; Match level="QueryCoverage=93%, HitCoverage=99%, E-value=4e-83, Identity=49%"; Hit description =Putative OsNAC7 protein
  Pfam annotation: Domain name=NAM; Domain location=29-159; Score =299.9; E_value=4.6e-87; Accession=PF02365.6; Description=No apical meristem (NAM) protein
MSPIMHGEGSRVKNTAEYKMMPGNGQLTVPPGFRFHPTDEELLYYYLRKKVSYEAIDLDVIREVDLNKLEPWDLNDKCRIGSGPQNEWYFFSHKDKKYPTGTRTNRATTAGFWKATGRDKAIYHTNSKRIGMRKTLVFYTGRAPHGQKTDWIMHEYRLDEDDADIQEDGWVVCRVFKKKSQNRGFQQEIEEEEHLTTHMRASGHCQVLEPKHHHMQQGLYDHYNFDGTMHLPQLFSQESAVAPPTNSSLASSMNAMDILQCSQNLLRLTTTTGCGLNLMQQQQQQGERFSGDWSFLDKLLASHHGMDQSKCNPPTHHQGASVGTSAQKFPFHYLGCDTTHDIMKFSK

SEQ ID NO: 182860 - protein, 592 aa, Glycine max
  Coding DNA Sequence Number=SeqID_66082
  Gene Ontology: Mol. function=motor activity; Cellular component =myosin complex; Biological process=protein amino acid phosphorylation
  Homolog annotation: Hit_ID=Q9SKB0; Match level="QueryCoverage=98%, HitCoverage=39%, E-value=1e-161, Identity=53%"; Hit description =Putative unconventional myosin
  Pfam annotation: Domain name=DIL; Domain location=404-511; Score =199.5; E_value=7.7e-57; Accession=PF01843.9; Description=DIL domain
LKDQIANLESENESLRRQTAAVAFEQKVHPEKIESDHSAASLEQKVQPEKIEPGHSATALEQKVNPEKIEPVHSATALEQKVHPEKIEPDHSAAALEQKVHPEKIEPDHEVAVAEKMQVQPRVIADNMTSQIKNLDNGSSTEEEWQARKEPRAPVFLLTKQRSLTDRQQESHDALLKCLTEDKRFEKNRPAVACIVYKSLLHWRSLEAEKTHIFDKITHAIRSSIESQEGIHDLAYWLSTTSTLLFYLQCTMKASNTTKAVSRNRNSPASLFGKMAQGLRSSSMGLGISSGYSGMVDKTNGQSKVEAKYPAILFKQHLTAYVEKIYGMIRDSLKKEISPFLNLCIQAPRSIRTRSIRGSSRNIHSNIVAKQQALHMYWKGIVDKLDTALRILSDNYVPPIITRKIFSQVFSFMNVQLFNSLLLRRECCSFSNGEYLKAGLHELELWCLKATDQFAGSSWDELKHIRQAVGFLVLHQKTQKSLEEITNELCPVLSIPQIYRIGTMFWDDKYGAHGLSAEVISRMRVIMTEDSINIHNSSFLLEVDSSIPFLMEEMFRSMSDIRLSDMDVDPPPILRQRSDFQFLLQQMDSDSQ

SEQ ID NO: 182861 - protein, 67 aa, Glycine max
  Coding DNA Sequence Number=SeqID_66083
MNEHRHHNRYHHRSDDHVGGNDSDHGVGGDGDSNNNNNYVSDCSHDTCDENDHDNDDDYSDDIFEIF

SEQ ID NO: 182862 - protein, 1036 aa, Glycine max
  Coding DNA Sequence Number=SeqID_66084
  Gene Ontology: Mol. function=motor activity; Cellular component =myosin complex; Biological process=signal transduction
  Homolog annotation: Hit_ID=Q6UAL3; Match level="QueryCoverage=98%, HitCoverage=68%, E-value=0.0, Identity=74%"; Hit description=Myosin heavy chain class XI E1 protein
  Pfam annotation: Domain name=IQ; Domain location=707-727; Score=23.3; E_value=0.00087; Accession=PF00612.17; Description=IQ calmodulin -binding motif
  Pfam annotation: Domain name=IQ; Domain location=730-750; Score=26.9; E_value=7.2e-05; Accession=PF00612.17; Description=IQ calmodulin -binding motif
  Pfam annotation: Domain name=IQ; Domain location=755-775; Score=23.5; E_value=0.00075; Accession=PF00612.17; Description=IQ calmodulin -binding motif
  Pfam annotation: Domain name=IQ; Domain location=778-798; Score=21.3; E_value=0.0034; Accession=PF00612.17; Description=IQ calmodulin -binding motif
  Pfam annotation: Domain name=IQ; Domain location=803-823; Score=14.8; E_value=0.32; Accession=PF00612.17; Description=IQ calmodulin-binding motif
  Pfam annotation: Domain name=IQ; Domain location=826-846; Score=22.6; E_value=0.0014; Accession=PF00612.17; Description=IQ calmodulin -binding motif
  Pfam annotation: Domain name=Myosin_N; Domain location=10-51; Score =33.4; E_value=7.8e-07; Accession=PF02736.9; Description=Myosin N -terminal SH3-like domain
  Pfam annotation: Domain name=Myosin_head; Domain location=64-691; Score=893.6; E_value=8.8e-266; Accession=PF00063.11; Description =Myosin head (motor domain)
  Pfam annotation: Domain name=Prefoldin_2; Domain location=895-986; Score=-7.8; E_value=0.072; Accession=PF01920.10; Description =Prefoldin subunit
  Pfam module annotation: Pfam domain module=IQ::IQ::IQ::IQ::IQ::IQ::Myo sin_N::Myosin_head::Prefoldin_2; Domain location=707-727::730 -750::755-775::778-798::803-823::826-846::10-51::64-691::895-986
MGTPVNIIVGSQVWVEDPEDAWIDGEVTQIKGKNATIIATNGKTVVAEISSIYPKDTEAPPAGVDDMTKLAYLHEPGVLHNLATRFSLNEIYTYTGNILIAVNPFRRLPHLYDIHMMEQYKGAAFGELSPHLFAVADTCYRAMINENGSQSILVSGESGAGKTETTKMLMRYLAFMGGRSATEGRTVEQQVLEVYAVTFSLLQSNPVLEAFGNAKTVKNNNSSRFGKFVEIQFDKNGKISGAAIRTYLLERSRVCQVSDPERNYHCFYMLCAAPPEDVKKYKLGDPRQFHYLNQSNCYQVSNVDDAKEYLETRNAMDIVGISQEEQDAIFRVVAAILHLGNVDFVKGKEVDSSKLKDDKSLFHLQTAADLFMCDAKALEDSLCERVIVTPDGNITKPLDPDAAALSRDALAKTVYSKLFDWIVDKINSSIGQDSNAHVFKMEQEEYTKEEINWSYVEFVDNQDVLDLIEKKPGGIIALLDEACMFPKSTHETFAQKMYQTYKGHKRFSKPKLSRTNFTINHYAGDVTYQADYFLDKNKDYVVAEHQALLCASKCSFVANIFPPLPEETSKQSKFSSIGSQFKQQLQSLMETLNTTEPHYIRCVKPNTVLQPGIFENFNVLNQLRCGGVLEAIRISCAGYPTKRTFEEFLDRFGMLVPDVLDGSDEKKASMAICDKMGLKGYQMGKTKVFLRAGQMAELDARRAEVLAKAAKLIQRQIRTHLTRKEFITLRKATIHIQKIWRAKLARKLYENMRREAASIRIQKHVRAHRARMNYTTLQASAIVIQSGLRALAARNEYRYRRRTKASTKIQTQWRRAQALSGYKQQKKATVALQCLWRAKVARKELRKLRMAARETGALKEAKDKLEKRVEELTWRLDIEKHMRTDLEEAKGQEIAKLQNALQEMQGQLDEAHAAIIHEREAAKIAIEQAPPVIKEVPVVDNTKLDLLTNKNEELETEVEELKNKIKDFEERFSEVENENQERLKEAEEAQLKATQLQETIERLELSLSNLESENQVLCQKALEESKNEELFEEIKM

SEQ ID NO: 182863 - protein, 366 aa, Glycine max
  Coding DNA Sequence Number=SeqID_66085
  Gene Ontology: Mol. function=hydrolase activity, acting on ester bonds; Cellular component=cellulose and pectin-containing cell wall; Biological process=lipid metabolic process
  Homolog annotation: Hit_ID=Q1S8F6; Match level="QueryCoverage=91%, HitCoverage=91%, E-value=1e-121, Identity=63%"; Hit description =Lipolytic enzyme, G-D-S-L
  Pfam annotation: Domain name=Lipase_GDSL; Domain location=45-357; Score=205.2; E_value=1.5e-58; Accession=PF00657.12; Description=GDSL- like LipaseAcylhydrolase
MEESGSYRNDMCTGLRCHTTNNNTFHDVHLRAVVKLPPNVSVPAVLVFGDSIVDTGNNNNNLGTTARCNYPPYGKDFEGGKPTGRFSNGKVPSDFIAEELGIKEYVPAYLDPHLQPGELATGVCFASGGAGYDPLTSQSASAISLSGQLDLFKEYLGKLRGVVGEDRTNFILANSLYVVVFGSNDISNTYFLSRVRQLQYDFPTYADFLLSSASNFFKELYGLGARRIAVFSAPPLGCLPSQRTLAGGLERKIVVNINDAAKLFNNKLSKELDSLNHNFQDSRIVYIDVYNPLFDIIINYKKYGYKVGDKGCCGTGTIEVVLLCNRFTPLCPNDLEYVFWDSFHPTESVYRRLIASLLGKYLDKFL

SEQ ID NO: 182864 - protein, 74 aa, Glycine max
  Coding DNA Sequence Number=SeqID_66086
MDQMVSGAEVPLPMIIHYHNGLVSKELLPNDLSHVDGVHVAVEEIVVAIMKAQFFGVGMIVQEEISRHDHIVSL

SEQ ID NO: 182865 - protein, 452 aa, Glycine max
  Coding DNA Sequence Number=SeqID_66087
  Gene Ontology: Mol. function=hydrolase activity, acting on carbon -nitrogen (but not peptide) bonds; Cellular component=cytosol; Biological process=nitrogen compound metabolic process
  Homolog annotation: Hit_ID=Q667W7; Match level="QueryCoverage=97%, HitCoverage=81%, E-value=0.0, Identity=88%"; Hit description =Putative glutamine-dependent NAD
  Pfam annotation: Domain name=CN_hydrolase; Domain location=16-183; Score=88.4; E_value=2.2e-23; Accession=PF00795.12; Description =Carbon-nitrogen hydrolase
  Pfam annotation: Domain name=ExsB; Domain location=292-443; Score= -98.7; E_value=0.023; Accession=PF06508.3; Description=ExsB
  Pfam annotation: Domain name=NAD_synthase; Domain location=273-450; Score=129.2; E_value=1.1e-35; Accession=PF02540.7; Description=NAD synthase
  Pfam module annotation: Pfam domain module=CN_hydrolase::ExsB::NAD _synthase; Domain location=16-183::292-443::273-450
MERIKRDRTQMSRSLSIALAQLNLLVGDIEGNTERMLQIVQEQQKAGADLVMFSELALSGYPPEDLLYRNDFYQRCDAQLLRLQQASAETAILVGHPWREGDKLYNALSLFAEGRLLTRYFKQQLPNYGVFDEKRYFHAGNDTCVVELKGYRLGLLICEDLWFPEPIDAAKAAGAEIILSINASPYNREKPYIRKTLMAGHCQRTQLPLVYLNQVGGQDELIFDGCSKVFDAAGTMTHRLAAFDEQVTRLEFNELAVVPMADPAAELPQLAQVYQALVLAVRDYVTKNGFKGAVLGLSGGIDSALTLAIAVDALGKDKVQALMMPFRYTADISIADAKEEAEILGVEFDIVSIEPMFDAFMGQLSPMFAGTERDTTEENLQARCRGVVLMALSNKRRSIVLTTGNKSEMAVGYATLYGDMAGGFDVLKDVPKTLVFKLSEYRNTVSYVIPQR

SEQ ID NO: 182866 - protein, 83 aa, Glycine max
  Coding DNA Sequence Number=SeqID_66088
MAKFGRHAPEIEGLVASSRLNFVKGILQESGNLKRVAWGLDVGTGRGRTSIKTEFAFSLPLKLLFSLLFIFCFKEVYFELSFE

SEQ ID NO: 182867 - protein, 67 aa, Glycine max
  Coding DNA Sequence Number=SeqID_66089
MEVGSGSYRKLEVGSGSYCKLKVKNGNWKWKLLEVEVGSGSCVIDYKTLLFRSNCVIGYIIMVINYK

SEQ ID NO: 182868 - protein, 117 aa, Glycine max
  Coding DNA Sequence Number=SeqID_66090
MSEIEEVQEQMKVDMKAMKEKMTTMMEAMISMRKMMEVNTTTVVATSTATEVDLTHPPGFNQGGKALGSASGPHFVQVQNKHSFPPYGLPPNYTPPNVAHTPDENVNNSPPIPIESQ

SEQ ID NO: 182869 - protein, 300 aa, Glycine max
  Coding DNA Sequence Number=SeqID_66091
HLLKIDADNLNAFLETAVVLAEGETLPAYSRYCRLPTDYREIEGHPGKILKKDLTTLAQVWSVLSYSNLAPTSHTSDLIVERARLIFGLVSHMDMNIGALISGQMTSTAQSNTSRLGFPALITALCRSRGVVSDSLTFERLSPVINLAYIRKNCWNPKALTISIRGVRRVRARPAELPSTFAAPTPASMSVVAPLGSIPSVEQFKEMVVWSRNQPSLHKEDKGPTAQVPQNMEDEFSEATIPEPFTAGEEAGDTQMTQVATATSERSLEATSEPPASAVDLPSPQHATDPSTPVLEIPKD

SEQ ID NO: 182870 - protein, 73 aa, Glycine max
  Coding DNA Sequence Number=SeqID_66092
MWIWHGELTDMQSGSQSEPFDVEIGDRLEDMICDLEQESFQQAHAFIYDTLQTDSKKSLYPGCKNSLTLLSAV

SEQ ID NO: 182871 - protein, 289 aa, Glycine max
  Coding DNA Sequence Number=SeqID_66093
  Gene Ontology: Mol. function=hydrolase activity, acting on ester bonds; Cellular component=nucleus; Biological process=lipid metabolic process
  Homolog annotation: Hit_ID=Q1S8F9; Match level="QueryCoverage=92%, HitCoverage=83%, E-value=1e-124, Identity=80%"; Hit description =Lipolytic enzyme, G-D-S-L
  Pfam annotation: Domain name=Lipase_GDSL; Domain location=2-273; Score=99.7; E_value=8.9e-27; Accession=PF00657.12; Description=GDSL -like LipaseAcylhydrolase
MVRQRVTYVIWRAEQLGIKEYLPAYLDPNLKSSDLVTGVCFASGASGYDPLTPKITSVLSLSTQLDMFREYIGKLKGIVGESRTNYILSNSLYLVVAGSDDIANTYFVAHARILQYDIPSYTDLMVNSASNFVKELYNLGARRVAVLGAPPIGCVPSQRTLAGGLTRKCSEKYNYAARLFNSKLSKELDSLGHNLSDTRIVYIDVYTPLLDIIENYQKYGYKVMDRGCCGTGKLEVAVLCNPLDATCSNASEYVFWDSYHPTEGVYRKLVNYVLEKCLNMIFDDFTGWK

SEQ ID NO: 182872 - protein, 63 aa, Glycine max
  Coding DNA Sequence Number=SeqID_66094
  Gene Ontology: Mol. function=hydrolase activity, acting on ester bonds; Biological process=lipid metabolic process
  Homolog annotation: Hit_ID=Q1S8F8; Match level="QueryCoverage=89%, HitCoverage=67%, E-value=7e-20, Identity=70%"; Hit description =Lipolytic enzyme, G-D-S-L
MAVNGTIPALFSFGDSILDTGNNNNLQTLTKCNFPPYGIDFQGGIPTGRCCNGKTPTDLIVEI

SEQ ID NO: 182873 - protein, 189 aa, Glycine max
  Coding DNA Sequence Number=SeqID_66095
  Gene Ontology: Mol. function=sodium:dicarboxylate symporter activity; Cellular component=integral to membrane; Biological process =dicarboxylic acid transport
  Homolog annotation: Hit_ID=Q0X0X3; Match level="QueryCoverage=98%, HitCoverage=43%, E-value=1e-80, Identity=80%"; Hit description=TRAP dicarboxylate transporter-DctM subunit precursor
  Pfam annotation: Domain name=DctM; Domain location=7-189; Score= -147.0; E_value=2.5e-05; Accession=PF06808.2; Description=DctM-like transporters
MALTLLSFTFMGYLMIGVPVAFAIGLSSITAIMYEDLPLAVAFQQMTSGMNAFSFLAIPFFIFTGELMLYGGIADRIVAFAKSLVGHVRGGLGMSNVVACTLFGGVSGSPVADVSAMGSVMIPMMKREGYHADYAVNVTTHAALVGALMPTSHNIIIYTLAAGGKVSIAALIAAGVVPALILTLCNLAA

SEQ ID NO: 182874 - protein, 227 aa, Glycine max
  Coding DNA Sequence Number=SeqID_66096
  Gene Ontology: Mol. function=hydrolase activity, acting on ester bonds; Cellular component=cellulose and pectin-containing cell wall; Biological process=lipid metabolic process
  Homolog annotation: Hit_ID=Q1S8H0; Match level="QueryCoverage=90%, HitCoverage=55%, E-value=1e-60, Identity=51%"; Hit description =Lipolytic enzyme, G-D-S-L
  Pfam annotation: Domain name=Lipase_GDSL; Domain location=7-204; Score=41.3; E_value=3.2e-09; Accession=PF00657.12; Description=GDSL -like LipaseAcylhydrolase
MFREYIGKLTALVGQQRAANIISNSVYLVSAGNNDIAITYSQILATTQPFPLYATRLIDTTSNFLKSLYELGARRVWVLSTLPLGCLPGGRTVAGGPLRICAPFANLFAQTFNGQLSSAVNSIRTTLPNYDIRFIDVYTPLFNLINNPQPEGFVDVSEGCCGTAPFGVSGICSLFSLCPNPSSYVFWDSAHPTERAYKFVVSTILQSHTNNVSSSFAFAPFNSSLSN

SEQ ID NO: 182875 - protein, 358 aa, Glycine max
  Coding DNA Sequence Number=SeqID_66097
  Gene Ontology: Mol. function=RNA binding; Cellular component =ribonucleoprotein complex; Biological process=RNA processing
  Homolog annotation: Hit_ID=Q1S8H3; Match level="QueryCoverage=77%, HitCoverage=54%, E-value=8e-73, Identity=50%"; Hit description=RNA -binding protein Lupus La
  Pfam annotation: Domain name=Extensin_2; Domain location=1-287; Score= -142.5; E_value=0.1; Accession=PF04554.4; Description=Extensin-like region
  Pfam annotation: Domain name=La; Domain location=228-285; Score =115.4; E_value=1.6e-31; Accession=PF05383.7; Description=La domain
  Pfam module annotation: Pfam domain module=Extensin_2::La; Domain location=1-287::228-285
  Subcellular localization annotation: CTP_CleavageSite=71; ConfidenceScore=5.91e-01
MTSQSPQKQATTIAKPSSAPNYNVPSRQRSMKRVGGSSTGSGPSQSNFSNPPPTPPPPPPFPVYQLPPVSYGNMVPGVPDHAPRDHYRNNNWDARPLVGGFVPAMNEYRGSSRRGYFGPHPRGDGSYHNSYGSRRDHQDRGNYVNARDAFLPQPRMPPRGLLRHPPPNTAAFVGPQPIGPFANPISFPEFYYYQPVTVEQFTGMPFFTHSPPPTPFFSAAESPLSNMIVYQIEYYFSDANLVKDAFLRSKMDEQGWVPVTLIADFPRVKNLTTNIQLILDSLRTSTVVEVQGDKLRRLNEWMRWLPSAQRRSNSGSISPSGSTHNNLTANFQTIILEETTADESPTQPNGGDATKSSI

SEQ ID NO: 182876 - protein, 166 aa, Glycine max
  Coding DNA Sequence Number=SeqID_66098
  Gene Ontology: Mol. function=nucleic acid binding; Cellular component= nucleus; Biological process=DNA integration
MPKGTVVMGNNASCKIASIGTIQIKMFDGVIHIHGDVMHVLDLKRNLISLCTLDSKGYKYTSEGGVMKCSGCDERYAKQKRFKFKKGTHNPKETPYYLHSDLWGLAKVPSLEANYMLTIIDGTSGVKDARYKERLVAKGYRQIPELKELDVKIAFLHGELHEDIYM

SEQ ID NO: 182877 - protein, 178 aa, Glycine max
  Coding DNA Sequence Number=SeqID_66099
  Gene Ontology: Mol. function=DNA binding; Biological process=DNA integration
MKELGATKKILGMEILRDRATGRLYLSQKGYIEKVLCRFNMQKAKPVTTPLAVQFRLPSPLRPQIVDDIDFMSQVSYSSTVDSFMYAMIFRETLIKEDLLHGTSSQLGVVLSVERLSTKASKEVIWLKGLFGELSGDLQFSSLELLCGKGGDGSFVARELEFVVSSLHYGIHVKVEIC

SEQ ID NO: 182878 - protein, 144 aa, Glycine max
  Coding DNA Sequence Number=SeqID_66100
MTQKLVTCGDTLRLSAPRHSVTPSVIDEQRPIWSSAPFPEMSASSGGDFFKSHKLSRTTSKSIAFIGHPTRSVILTLRSCDMRRQNLVIPHPFAIQTQSCPMARRDKNWSFCTLCHPEAAGPMTCGDKIWSFRTPFPFRHSRVR

SEQ ID NO: 182879 - protein, 191 aa, Glycine max
  Coding DNA Sequence Number=SeqID_66101
  Gene Ontology: Mol. function=nucleic acid binding; Biological process= DNA integration
  Pfam annotation: Domain name=zf-CCHC; Domain location=133-150; Score =19.3; E_value=0.00065; Accession=PF00098.13; Description=Zinc knuckle
MAKSLTNKLHSKHRLYSHRMAEAMSIEGHLTMFKDIIVDLEVMEVKYDEGDLGLILLCSLPSSYATFRDTILYSCDTLTLDEVFDALFSKEKMKQLVSGYEAQGEGLFVHGRPQEQGFGNPQMAGSKFRNAEKTCNYCKQKGHIKTNCYKLKNKKKRMVSKQGKPQKNMVKLVLWTQITLMENYWLLLMVT

SEQ ID NO: 182880 - protein, 169 aa, Glycine max
  Coding DNA Sequence Number=SeqID_66102
  Homolog annotation: Hit_ID=Q9C942; Match level="QueryCoverage=44%, HitCoverage=22%, E-value=7e-31, Identity=82%"; Hit description =Putative lipase; 20450-21648
MYPAGFHVLGNHEEWRGEHQARPRVRFRFEVHEERGESSHGLAEEECREVFVGVAIADVEEEGEGGGGDFVHVAENQGITQERTCEQKASKRPGTVKRPRCWRFSIGSAPLTSITKIDAQVRGGETRQDYKDTRRFPLEAPSCALLFRPLPLTRIPVRLSPFGKRGAFS

SEQ ID NO: 182881 - protein, 370 aa, Glycine max
  Coding DNA Sequence Number=SeqID_66103
  Gene Ontology: Mol. function=hydrolase activity; Cellular component =mitochondrial outer membrane; Biological process=aromatic compound metabolic process
  Homolog annotation: Hit_ID=Q9C942; Match level="QueryCoverage=59%, HitCoverage=66%, E-value=1e-107, Identity=83%"; Hit description =Putative lipase; 20450-21648
ATLPEGRKPDRYPGKRQGSEQESARGSFQGETPGIFIVLSGFATSDLSVDFCDARQGGGAYGKTPATRPFYGSWPFAGLLLTCSFLRYPLILWITVLPPLSELIPLAAAERPSAASHWHDRFPDWKAGSERNAINETAMTMITNSSSVPRSDGLQCYLGDMDKIAATSLSFFLHVRNSHPYKNLPAFLFGESMGGLATLLMYFKSEPDTWTGLMFSAPLFVIPEDMKPSRVHLFMYGLLFGLADTWAAMPDNKMVGKAIRDPEKLKVIASNPRRYTGPPRVGTMRELLRVTQYVQDNFSKVTTPFFTAHGTSDGVTCPSSSKLLYEKGSSEDKTLKLYDGMYHSLIQGEPDESANLVLGDMREWIDERVR

SEQ ID NO: 182882 - protein, 1008 aa, Glycine max
  Coding DNA Sequence Number=SeqID_66104
  Gene Ontology: Mol. function=protein binding; Biological process =protein metabolic process
  Homolog annotation: Hit_ID=Q9LU73; Match level="QueryCoverage=99%, HitCoverage=99%, E-value=0.0, Identity=39%"; Hit description =Arabidopsis thaliana genomic DNA, chromosome 5, P1 clone:MUL3
  Subcellular localization annotation: CTP_CleavageSite=48; ConfidenceScore=5.14e-01
MRSGVCALQQTLTAEAASVLKHSLGLARRRGHAQLTPLHVAATLLSLRGSSLRRACLKSQPHQTSHHPLQCRALELCFNVALNRLQTTPSPLIHTQPSLSNALIAALKRAQAHQRRGCIEHQQQQPLLTIKVELEHLIISILDDPSVSRVMREAGFSSTAVKNNIEDSSPHSVFQCYNSSGGVFSSPCSPSASENNNHRETATNPTNFRHPHHYLTSYASSEFHPSLLFSPPKNNSPVCSITGAASSSKDDVRLVLDILLRKKKKNTVIVGDSLSLTEGLVAELMGRLERSEVPDELKSTHFIKFQISHDSLSCMKRDEVEMKLLELKRKVESIASGGGGGGIFYIGDLKWTVKEASFSEKEEGSPNGEVSGYNPVDHLVSEIGKLFSDCGTSNNAKVWLMATASYQTYMRCQMRQPPLEKQWALQAVPIPSGGLGLSLHAPSVLHSKMIVSHNQSHVPETNPFGNMEQENKLNCCEECASNYEKEAQFLRPDQKKMLPLWLQSHSTEDSKKDELVQLKRKWNRLCHCLHQSKQPQNQWSWNHNSYNSPSSISFANNATHGSTSKLVPRFQRQQLCIIEFNFGNKREATEPVLDSLESMDGKKVKTILALGNGGSGESTVGDITDTTLQQAHICKLLQENVPWQSETVPSIAEALIDSKSAKQNNNITWLLVQGNDTIGKRRLALAIAESVFGSTDVLLHFDMLKRETSIAPFSEMLEGALKTHHQLVILIENVDFADAQFKKFLSDGFEKGKFGNFTEENSSQVIFILTNGGCGSTSNEEQNDNLVMRLLWQVSETKPNSETPSVATRIAEPCLGHKRRAELDLFSNTNSSQGSKKKQFSRQTSFNTLDLNMKADEEDKAGESSPISSDLTGETIADPLNQNGFLDSNVNRFEFNTNPVKDREMAELFLCKFKGSFEEVCGKQCWENLSVDERVIEDVSVGCGYFTNSLFEKWLKDVFQSSLETVNFGGKEGILLRLSWEGKGDRKSDSGFMSSSLPKSIQVNYFIE

SEQ ID NO: 182883 - protein, 36 aa, Glycine max
  Coding DNA Sequence Number=SeqID_66105
MGAPVFSEQSIYLVPIKDKAPLSRFSTKPESKPRVH

SEQ ID NO: 182884 - protein, 153 aa, Glycine max
  Coding DNA Sequence Number=SeqID_66106
  Gene Ontology: Mol. function=DNA binding
  Homolog annotation: Hit_ID=Q1SWX1; Match level="QueryCoverage=85%, HitCoverage=26%, E-value=1e-12, Identity=29%"; Hit description=IMP dehydrogenase/GMP reductase
MGLNQAPSFKKRFYHVKIKSLEVANLQELGQWMDQLQRQAFRKAYGKIWDLAMIEVSVEAIASLTQYYDQSLRCFTFGDFQLAPTVEEFEGILGCPLGGRKPYLFSGLYPSMARVAKVVKISVQELDQVKQNRNGVVGIPRKHLEEKAKALAG

SEQ ID NO: 182885 - protein, 86 aa, Glycine max
  Coding DNA Sequence Number=SeqID_66107
QTANHRVHVQTHDSLYQLSLSLQSQGFASFPCPTPDQFRAEVAWPGDWLEAQAGEASAEAPDEADEAHEDEEMTDLLDFLGGSGAT

SEQ ID NO: 182886 - protein, 130 aa, Glycine max
  Coding DNA Sequence Number=SeqID_66108
MNGRNGTTPTMVSPPSQHSSCGSTEPNQEDNNNNNNDNNNDDNNHNNNDDDNNNNNNNNNNGNNNNNNNNNGDNNNNNNNNNGDNHLEAPSLVLVGFPRCLMYQMISEDNLKRVISNWAWIRNWDEPAWT

SEQ ID NO: 182887 - protein, 141 aa, Glycine max
  Coding DNA Sequence Number=SeqID_66109
  Gene Ontology: Mol. function=mannosyl-oligosaccharide 1,2-alpha -mannosidase activity; Cellular component=membrane; Biological process=metabolic process
  Homolog annotation: Hit_ID=Q9LJB6; Match level="QueryCoverage=81%, HitCoverage=27%, E-value=3e-34, Identity=50%"; Hit description=Alpha 1,2-mannosidase-like protein
MPQSRNGVDSFGGMGATLVDSLDTLFIMGLDVQFKRATEVLGGLLNAYDLCGIPYNRINLAYGNTNNPTWARENSILVDSGSEQLEFIALSQRTNDPKYKEKAEKVIKGLYETFPEDVASYKHQSTYWNKIKWSSYIWCHG

SEQ ID NO: 182888 - protein, 378 aa, Glycine max
  Coding DNA Sequence Number=SeqID_66110
  Homolog annotation: Hit_ID=Q10RR9; Match level="QueryCoverage=88%, HitCoverage=88%, E-value=5e-13, Identity=22%"; Hit description =Expressed protein
  Pfam annotation: Domain name=DUF677; Domain location=55-371; Score= -75.7; E_value=7.5e-07; Accession=PF05055.3; Description=Protein of unknown function (DUF677)
MTCTGWICSLRRTGRSRKECNEDRWYKKQSVNEEYLEAFRTKSYIEICNKAQEGIEKTSTKMLTSSSSSIPLCMQLTEYLLEPRQEMIANIAQRLKLHHLLVDYFEASLEACRCCDTILEAIHSMRLAYRRITRVVKLSKTVLDDEDDDNDDKIHNKYVIYRELASFAMQKNPLSVVISTVKFRDIHDRHVELLQRLKSTRREIRRRLTLKRVCKKVLGIALITAHSVVLVALLVFAFHSIVGLVAAPSIVCGLVGLFVKRGRERFRSSYCDDEKLCEQLDVAAKGVYVLSNDLDTMSRMVKRLHDEVEHRKVVAEVCVRNEKSEILLKQVMRDFHEHESSFLEQLEELEGHIYLCFLTTNRSRRLVVQEITDKKVKH

SEQ ID NO: 182889 - protein, 200 aa, Glycine max
  Coding DNA Sequence Number=SeqID_66111
  Gene Ontology: Mol. function=mannosyl-oligosaccharide 1,2-alpha -mannosidase activity; Cellular component=membrane; Biological process=metabolic process
  Homolog annotation: Hit_ID=Q9C512; Match level="QueryCoverage=82%, HitCoverage=26%, E-value=3e-29, Identity=46%"; Hit description =Mannosyl-oligosaccharide 1,2-alpha-mannosidase, putative; 8615-12432
MWEKSMKGLQSLIWRSTPSFTCLVKGLEMQPLTRCYFEKEVYFSLSRMDELACFVPGMLALGSSNYGLGEAEKFMALAEELAWTCYNFYQLTPTKLAGESYYFSNGQVNTGAKDNMMQSYFLSETLKYLYLLFSPPSVISLNEWVFNTEAHILRIMTRSAHEESGEQEEGTTCFALPTELGCLSMVNNTWKLGLLVYLVG

SEQ ID NO: 182890 - protein, 303 aa, Glycine max
  Coding DNA Sequence Number=SeqID_66112
  Homolog annotation: Hit_ID=Q1SR99; Match level="QueryCoverage=36%, HitCoverage=42%, E-value=3e-33, Identity=69%"; Hit description=Alba, DNA binding
  Pfam annotation: Domain name=Alba; Domain location=36-114; Score =53.1; E_value=9.1e-13; Accession=PF01918.11; Description=Alba
  Subcellular localization annotation: CTP_CleavageSite=4; ConfidenceScore=5.19e-01
MRFSASALSVAKFPNKGTLYLPFPSVFSILWGHWEKVDVMSPTFVSRGSLTCLSVLTDCLVITLEQQKEKGSNEIVFKAMGRAINKTVTIVELIKRRIVGLHQNTAIGSTDITDTWEPLEEGLLPLETTRHVSMITITLSKKELDTSSVGEFNRLLFFRYQPPLPADQVKAATDFDYEGGRYTCRRVHLMVVFVVVVAEAGEGAEVMALFQLIMRMEVGIAIGEMLGAGVEEEDVAFVVVEGEGTMGPMLTCKMEDTTKMYLKAVVVAVAGGDIVEGVVASDRMGQSKQLPEATSRPPLVQCR

SEQ ID NO: 182891 - protein, 134 aa, Glycine max
  Coding DNA Sequence Number=SeqID_66113
  Pfam annotation: Domain name=DASH_Duo1; Domain location=7-89; Score= -2.2; E_value=0.0045; Accession=PF08651.1; Description=DASH complex subunit Duo1
MEWDEMASLQEELKGVKDKIYENQKVEEALTTTTTELSTLQEEILSKSKLLELAKRLHSRDSFNQGIKPDKDFRSTTKGRHLLSNAELEQKMKSFEDLHIEYGSAKGVLNLRDMFRLITVAEEEKAQLRELEVY

SEQ ID NO: 182892 - protein, 123 aa, Glycine max
  Coding DNA Sequence Number=SeqID_66114
MAPILGQWSPLLGLALDSAASCFAIGGTWSLYMELVRERIDAGSIGSEYPVLDLSNGTGTGEAIGLIGRVSPTGMWSSRSGLAASSADSLVAALASASSGAESDALSARFETLWKRKCFAQEF

SEQ ID NO: 182893 - protein, 90 aa, Glycine max
  Coding DNA Sequence Number=SeqID_66115
MNQSISPKLANIRISPQVWKLTGVEVATDSYPRSLNSPNLVSCQERRAELLFPGHLHLIHLAKRGASSEATVHSNRDSSSEKDPSGTGLR

SEQ ID NO: 182894 - protein, 139 aa, Glycine max
  Coding DNA Sequence Number=SeqID_66116
  Subcellular localization annotation: CTP_CleavageSite=63; ConfidenceScore=5.75e-01
RIFGCFVLDPCGSACWATSLNQTSPRRSSTRSTALAASCPVASYSAGSPSKQVSAPETHPSPRAGAPTVPAPASTLAPFGLEDHQEVVHFTRLWDRHVPKSVLPPSGLESTFALPDAVAAYTDALYPYSARALLIDSKA

SEQ ID NO: 182895 - protein, 191 aa, Glycine max
  Coding DNA Sequence Number=SeqID_66117
  Subcellular localization annotation: CTP_CleavageSite=34; ConfidenceScore=5.02e-01
SFSGLSTSISSPPDLPPNLKIISGRRLLPKVLPLCFAPAKETEKDPVEVQSIEDEYMEAPMKKEEAYISGLFFSPVTSAKERRLPRVEIDPGASINVMPLRALADLGMNSYEPAKSDQGYYSGNEKYQMGETRYFNEIYYLTKMAVSPSASGLGVTAYTSSGSLSVADLLPGRLAWRTGKEIKDGMEYAKG

SEQ ID NO: 182896 - protein, 68 aa, Glycine max
  Coding DNA Sequence Number=SeqID_66118
MKTALMPRHGKKSARSTESSMSSLRVEREQMMKIFKTSEVRIMVKNDNEKEEGRVWGMVCVWLFALRR

SEQ ID NO: 182897 - protein, 73 aa, Glycine max
  Coding DNA Sequence Number=SeqID_66119
AFSGGALVLTSMDDEELPSPGFLSSVIFSSQSFKERGIGGSLFRSSLCALKDADMIALSDGQIPRQIQDRDES

SEQ ID NO: 182898 - protein, 350 aa, Glycine max
  Coding DNA Sequence Number=SeqID_66120
  Gene Ontology: Mol. function=DNA-directed DNA polymerase activity; Cellular component=intracellular; Biological process=DNA replication
  Homolog annotation: Hit_ID=Q1H4F8; Match level="QueryCoverage=99%, HitCoverage=37%, E-value=1e-118, Identity=62%"; Hit description=DNA polymerase I
  Pfam annotation: Domain name=5_3_exonuc; Domain location=153-252; Score=135.7; E_value=1.3e-37; Accession=PF01367.11; Description=5' -3' exonuclease, C-terminal SAM fold
  Pfam annotation: Domain name=5_3_exonuc_N; Domain location=1-151; Score=187.3; E_value=3.7e-53; Accession=PF02739.7; Description=5'-3' exonuclease, N-terminal resolvase-like domain
  Pfam module annotation: Pfam domain module=5_3_exonuc::5_3_exonuc_N; Domain location=153-252::1-151
MPDLRNSANEPVGAIQGVLNMLRRLHKDYPSDYSACVFDAKGKTFRDDLYPEYKANRASMPDDLRAQIEPLYETIRAMGWPLIIEEGVEADDVIGALAKQAEKEGIRTIISTGDKDITQLVNEHITVVNTMRDAFRKTDDVLDIAGVENKFGIPPERIIDYLILVGDTADNVPGVEKVGPKTAVKWLTEYGTLDNIIANADNIKGVVGENLRKALPWLPTARELITIRCDIGVCESFDDLIQQAPDKEKLLGLFDHFEFRTWKRELDKLGDGAPSTSPNTTSETVAAPVSQRTEYTPDTRRQYQAIFTEIELDNWLPRLQQAELLCFDTETTSLDPMQAKIVGVSFSVTP

SEQ ID NO: 182899 - protein, 120 aa, Glycine max
  Coding DNA Sequence Number=SeqID_66121
  Homolog annotation: Hit_ID=Q62DV2; Match level="QueryCoverage=68%, HitCoverage=33%, E-value=8e-26, Identity=69%"; Hit description =Decarboxylase family protein
MKGAIQDRCMTSPKLPSMVQPELLDGDDVTHESWRAFEIMAEFVGATESLKAIMPAVSIFGSARTKPDHPYYMLTEEIARLLSDSGFSVLSGGGPGIMEAANKGAFPGRGASVGLISTPV

SEQ ID NO: 182900 - protein, 111 aa, Glycine max
  Coding DNA Sequence Number=SeqID_66122
MSEIEEVQEQMKANIEAMKEQMTTMMEAMTSMRKMMEVNTTTVVATSTPTKVDPTHPSGLNQENCPVLNMVQSKHFFPPYDLPPNYTPPNDTHAPYENVDNVEAKTLTLVF

SEQ ID NO: 182901 - protein, 90 aa, Glycine max
  Coding DNA Sequence Number=SeqID_66123
  Gene Ontology: Mol. function=ribonuclease H activity
  Homolog annotation: Hit_ID=Q1SZM6; Match level="QueryCoverage=87%, HitCoverage=26%, E-value=1e-09, Identity=40%"; Hit description =Ribonuclease H
MLETKKSYDYTTSLCIELCGILNGLKLVWESGYRYLIYESDSQCVMDMINQGVNSSQTHAPLIQAIKGLVVEALIVSIRHTFHEGNFCVD

SEQ ID NO: 182902 - protein, 74 aa, Glycine max
  Coding DNA Sequence Number=SeqID_66124
  Gene Ontology: Mol. function=protein serine/threonine kinase activity; Cellular component=cytoplasm; Biological process=protein amino acid phosphorylation
  Homolog annotation: Hit_ID=Q9C6P3; Match level="QueryCoverage=89%, HitCoverage=17%, E-value=5e-18, Identity=56%"; Hit description =Calcium-dependent protein kinase
MNWSTSETEKGMFDAILEGMLDMDNEPWPSISESAKDLEGGEASDKHPDSAVLIRMKWFRAMNQMKKLALKVES

SEQ ID NO: 182903 - protein, 250 aa, Glycine max
  Coding DNA Sequence Number=SeqID_66125
  Gene Ontology: Mol. function=protein serine/threonine kinase activity; Cellular component=cytoplasm; Biological process=protein amino acid phosphorylation
  Homolog annotation: Hit_ID=Q8RW36; Match level="QueryCoverage=80%, HitCoverage=37%, E-value=6e-67, Identity=60%"; Hit description =Calcium-dependent protein kinase
  Pfam annotation: Domain name=Pkinase; Domain location=75-250; Score =66.0; E_value=1.2e-16; Accession=PF00069.15; Description=Protein kinase domain
  Pfam annotation: Domain name=Pkinase_Tyr; Domain location=75-250; Score=-108.1; E_value=7.7e-06; Accession=PF07714.7; Description =Protein tyrosine kinase
  Pfam module annotation: Pfam domain module=Pkinase::Pkinase_Tyr; Domain location=75-250::75-250
MGLGMFKALFCCSKPHEIDIADSWDSSPDHTPKQHSKPKPKPNAAPTHSNNKQTTTSTQIGAILGKPYVNIHQMYEMKKELGSGQSGVTYLCVEKTTKREYACKSISRSKLLSTQEIEDVRREVMILQHLSGQPNIVEFRGAYEDKQNVHLVMELCSGGELFDRIIAKGNYSEREAATVMRQIVNVVHVCHFMGVMHRDLKPENFLLATNHPDAAVKATDFGLSIFIEEELKSLNNKVQSGENTECRGPS

SEQ ID NO: 182904 - protein, 457 aa, Glycine max
  Coding DNA Sequence Number=SeqID_66126
  Gene Ontology: Mol. function=protein serine/threonine kinase activity; Cellular component=flagellin-based flagellum; Biological process=protein amino acid phosphorylation
  Homolog annotation: Hit_ID=Q2PEW3; Match level="QueryCoverage=95%, HitCoverage=72%, E-value=1e-141, Identity=61%"; Hit description =Putative calcium dependent protein kinase
  Pfam annotation: Domain name=Pkinase; Domain location=86-365; Score =329.2; E_value=6.9e-96; Accession=PF00069.15; Description=Protein kinase domain
  Pfam annotation: Domain name=Pkinase_Tyr; Domain location=86-363; Score=-43.7; E_value=8.7e-10; Accession=PF07714.7; Description =Protein tyrosine kinase
  Pfam annotation: Domain name=efhand; Domain location=412-440; Score =37.8; E_value=3.7e-08; Accession=PF00036.22; Description=EF hand
  Pfam module annotation: Pfam domain module=Pkinase::Pkinase _Tyr::efhand; Domain location=86-365::86-363::412-440
MGHCFSKPSTNEIPINYDYSPPPHHYQPRPHSHSDSRRTQQPQLQPQPGYPNRTPKSDPSPSSSSFGDQVAARILDKPYFDIKSLYNLERELGRGQFGITRLCTEKTTGRKYACKSIPKRKLSKKKHTDDVKREVLILQHLSGQPNIVEFKGAYEDWQHVHLVMELCLGGELFDRITAKGSYSESEAASIFRQIVNVVHACHFMGVMHRDLKPENFLLANKDPKAPLKATDFGLSVFIEEGIVYREIVGSAYYVAPEVLKRNYGKEIDVWSAGIILYILLSGVPPFWGEKLIQNIIWNSVATRAPLLWLKNERSIFEAILGGKLDLESAPWPSISAAAKDLIRKMLNNDPKKRITAAEALEHPWMKEGGEASDKPLDNAVLTRMKQFRAMNKMKKLALKVIAENLSEEEIKGLKQMFNNMDTDRSGTITFEELKSGLTKLGSKLSESEIKQLMDAVS

SEQ ID NO: 182905 - protein, 326 aa, Glycine max
  Coding DNA Sequence Number=SeqID_66127
  Gene Ontology: Mol. function=RNA-directed DNA polymerase activity; Cellular component=chromatin; Biological process=chromatin assembly or disassembly
MNYNTLRMQFFHDGRLVELVDDDASTFNLLTPKFCRLSRTQRTSLYCHISIIPEEIETTQNLPSTILDLLSKFHFLFNPHDTLPPERTTDHHIHLLPQSTPVNVHPYRYLHFQKCEIELQVEMMLQKGLIQPSTSPFPIPTIDELLDELGGATCFLKLDLLQGYHQIRMHSTDMPKTAFHTHHGHYKFRVMPFGLCNTPSSFQATMNKIFQPYLHQFVIFFFDDILIYSASFTDHLHLELTFQVLSTNQFFLKMTKCFFAQSQVKYLGHLVSHKGVEPLTSKIDAIQQWPTPPTTRVERSFLGLTGFYHRFIRGYASMAAPLVHPQ

SEQ ID NO: 182906 - protein, 309 aa, Glycine max
  Coding DNA Sequence Number=SeqID_66128
  Gene Ontology: Mol. function=glutamate-1-semialdehyde 2,1-aminomutase activity; Cellular component=chloroplast; Biological process =tetrapyrrole biosynthetic process
  Homolog annotation: Hit_ID=Q40147; Match level="QueryCoverage=100%, HitCoverage=71%, E-value=8e-98, Identity=57%"; Hit description =Glutamate-1-semialdehyde 2,1-aminomutase, chloroplast precursor
  Pfam annotation: Domain name=Aminotran_3; Domain location=1-287; Score=-12.7; E_value=5.8e-11; Accession=PF00202.11; Description =Aminotransferase class-III
MKKGTSVGAPCLLENTLAEMVISAVPSIEMIRSVNSGTEACMGALRLARAFTGKQKIIKFEGCSHAMLILFLLRQLTSNTLTALFNDILAIEKLFENHKGEIAALILEPAVGNSGFIVPKLEFLDTIRKIIKENNALLIFDEVMTGFQLSYGGAQEYFGIVPDLKTLGNIIVSGLPVGAYGEISVEGFKPVTSPPSLLPSPFSLHPYSTTESTLYLHQADTLSGNPLAMAAGIEAQKLIKEAGTYEYLDEVTGELVQGILQSDLAKFASFYRGMLEQGVYFASSQFEAGFTSLAHTTEDIKMTIAAAER

SEQ ID NO: 182907 - protein, 179 aa, Glycine max
  Coding DNA Sequence Number=SeqID_66129
  Gene Ontology: Mol. function=protein serine/threonine kinase activity; Cellular component=nucleus; Biological process=protein amino acid phosphorylation
  Homolog annotation: Hit_ID=Q9C6P3; Match level="QueryCoverage=55%, HitCoverage=21%, E-value=2e-23, Identity=61%"; Hit description =Calcium-dependent protein kinase
  Pfam annotation: Domain name=Pkinase; Domain location=2-154; Score= -103.4; E_value=0.021; Accession=PF00069.15; Description=Protein kinase domain
MYEMKEELGRGKFGVTNLCVEKATGRAYACKSIAKKKPQKVEDVRREVMILQHLSEQHNIVEFKGAYEDGKNMHLVMELCSGEGTTRSLKPPQSSDRFPRWSNSAQSNPTPKKKQQQTRWRQPVMIRNKEQQQNAAGSGVSKGCPSAAVQYNSVGIAFSLWNLPFAFPPRQYATTPLAK

SEQ ID NO: 182908 - protein, 383 aa, Glycine max
  Coding DNA Sequence Number=SeqID_66130
  Pfam annotation: Domain name=PPR; Domain location=154-187; Score =14.7; E_value=0.14; Accession=PF01535.11; Description=PPR repeat
  Pfam annotation: Domain name=PPR; Domain location=220-254; Score =19.2; E_value=0.015; Accession=PF01535.11; Description=PPR repeat
  Pfam module annotation: Pfam domain module=PPR::PPR; Domain location =154-187::220-254
MGRCILIDWTSLCHKGPGSTALDFKENKKLDYCMHPPLMYIPDSISASIEQQIICMGNKKVKSTELAGLNGQKHPLLKKALSWSFDDIIHGCAKQKNHMLARKLMLQIPLLFVSTSNMFLTWTPKPSLHLPDMCETLVVFLVYMKNLGLQPSRHTYNGIIKVVSHRSYGDAVRVLKKMQQKNLKPYDSTLASLSITCSKALQLDLAEAFLNQISECVYPNPYNALLASCNQLSQPERAIRLFAKIVQKKVLPNIRTCELLFSLFGVVNAHYEDSDAWSQVDAAKRINAIEKHMANNGIQHSHLSMNKLKWKSHAGRTRRLPRRRWSRAAQQASRGERARKKQSRVVQQHHHHAANNGEEATHAVGIAQKEKKKKSGLGGRKKK

SEQ ID NO: 182909 - protein, 101 aa, Glycine max
  Coding DNA Sequence Number=SeqID_66131
  Subcellular localization annotation: CTP_CleavageSite=76; ConfidenceScore=5.62e-01
MKIFMFGDAVGRASLVRVLPAVIPCLSSRASSSHPSLVRRGVAGFFGGLSSRATRSHPLPPYSHSSILSEDKIAVESAYFKSYVNTCGLIDSMEATLGAFS

SEQ ID NO: 182910 - protein, 465 aa, Glycine max
  Coding DNA Sequence Number=SeqID_66132
  Gene Ontology: Mol. function=translation initiation factor activity; Cellular component=nucleus; Biological process=regulation of translational initiation
  Homolog annotation: Hit_ID=O80846; Match level="QueryCoverage=98%, HitCoverage=95%, E-value=1e-145, Identity=59%"; Hit description =Expressed protein
  Pfam annotation: Domain name=Gcd10p; Domain location=6-360; Score =319.2; E_value=7.3e-93; Accession=PF04189.4; Description=Gcd10p family
MCESGSRVTWEGCSVLLDINDGDRLVFARLSPSAKLKIGNKNCSLQPLIGRPFGTAFQVDGPYLSPAQGTHAWCLSICDLVNGNNAEELRDVQVSVKSRDKVEDNYPEEERDVQANVDSRDNRELVDNNTAQRLTGEDIEAMRRQGAGGNEIIEALIANSVTFEKKTSFSQEKYRLKKQKKYAPKVLMRRPVARSICEAYFKKYPSKIGFLRVDTLSLLLSMGNVSSNSDILVVDMIGGLLTGAVAERLGGTGFVCNSYSGQAPYSMDIVRIFNLSDEICKRIVRSPISDLLSQKELPEQTLQHDDACNVESRSTDQMSASTSMEDNSHSLENGISDLGAENTEPAKVRKAPKAGERAHKEIIDLWKENGFSSLIIAAPELDTWALVRDVLPLLANSAPFAIYHQYLQPLATCMHNLQLEKMAIGLQITEPWLREYQVLPSRTHPCMQMSSFGGYILSGTKICST

SEQ ID NO: 182911 - protein, 466 aa, Glycine max
  Coding DNA Sequence Number=SeqID_66133
  Gene Ontology: Mol. function=oxidoreductase activity; Cellular component=mitochondrion; Biological process=electron transport
  Homolog annotation: Hit_ID=Q8W3L1; Match level="QueryCoverage=89%, HitCoverage=83%, E-value=1e-156, Identity=67%"; Hit description=MFDR
MDFEVYLKKYFKTSNFTFLGAGGFSTFFGESNTVELSLPENLQQIVINQFSRVAHHERCSFLGNVTLGSSISLSELRDLYHVVRLSGSGFYVLMVVLAYGAESDRSLGIPGENLKGIHSAREFVWWYNGHPDGRNLEPDLKSTDTAVILGQGNVALDVARILLRPTTELATTDIASHALATLEESSIRVVYLVGRRGPAQAACTAKELREILGIHNVDIFIQESDLLLTPVDEEELKSNRIQRRVHELLSKAATSKPKHACLNQRELHFVFFRKPNSFQESKDRAGHVSGMHFEKTVLQGVSPGKQIAVGAGEFEDIKCGMALKSIGYRSVPVDGLPFDHKKGVVPNDRGRVLSDPSDPSVLEKGLYVCGWLRRGPTGIIATNLYCAEETVSSISADLENGGLISSSTLPKPGRDGLLQLLHDRNVRVVSLSDWEKIDSEERRLGSSRNKPREKLASWDELYKTTS

SEQ ID NO: 182912 - protein, 78 aa, Glycine max
  Coding DNA Sequence Number=SeqID_66134
MKSRDVESCDEDVHGGATLREEHLNFHVTSCLVWAFALSMPLGFLVGLLHTKPEFSHLVRVHVKPGLRAKRAVQFFFF

SEQ ID NO: 182913 - protein, 141 aa, Glycine max
  Coding DNA Sequence Number=SeqID_66135
  Gene Ontology: Mol. function=RNA-directed DNA polymerase activity; Biological process=RNA-dependent DNA replication
MEKHAILIQEKVQGDLWQLVQVSHGGLKVQLVKQVLDSFVNASGLHVNLHNSRLFTSKHIRRAKVNKFRDILGFTPTTNIGKYLGFPILIWRVKKSNFGFILDRMNLHLMGCKSNLLGRVGRVVLTSLVLNTIPNYVMQNL

SEQ ID NO: 182914 - protein, 255 aa, Glycine max
  Coding DNA Sequence Number=SeqID_66136
TTNTNLVAKKATENVVKEGEALKGKVLQVQVEVVAIIAKVVNNAIVNEVLNDLTNTKVMEEEPTFSNGDKVDESRAKPSVPELSACHCGNCGAKRASLAKLPYFVLSGQFPAKPIMQKLWLLGNARVVVLCHRLKRNVEIYHTEYDEFKTKLERHNLHENLANIHEGSIDVSVVKEFYVNLYSPETKLPSVPVSDSREVEASLCIPGKGFILNVEGQPWKLLIKDLTTLAQTWSAFSYSNLAPSSYLPHLRFEHR

SEQ ID NO: 182915 - protein, 142 aa, Glycine max
  Coding DNA Sequence Number=SeqID_66137
  Homolog annotation: Hit_ID=P55737; Match level="QueryCoverage=44%, HitCoverage=9%, E-value=9e-09, Identity=51%"; Hit description=Heat shock protein 81-2
MSTSLWWGHHKIVCRILGSSIFVRAGSNYFLVYCAMHNVNNFNIKEMKRCPLTNKEDRLIGISVPHLRSASQANALPVIGVNLVESIILLLCDLLRLCHPNGLILLFVVVKTKSSKGFPLTKDFSFHSKLMFNLRMVTGRSE

SEQ ID NO: 182916 - protein, 98 aa, Glycine max
  Coding DNA Sequence Number=SeqID_66138
PEVLDLTQDDLIHNFAVGVYMLTYNDIANNTEHEPTTPETTTYQKGSSKDLIELPGLGSSSSMDSFASWKMNGSGMEKEEREETPLQGEDESRRSSPP

SEQ ID NO: 182917 - protein, 115 aa, Glycine max
  Coding DNA Sequence Number=SeqID_66139
  Subcellular localization annotation: CTP_CleavageSite=55; ConfidenceScore=5.50e-01
MKDCKNTSSEDVSFTSRISQSLPNSSQALKPAPASSSGLCISSHSLNRWPCSCSCASAIMDRLAHIGEFRLSACLSHLAMNRSGALSEMKRCALRTYTAHLLLESSLRLAHESCA

SEQ ID NO: 182918 - protein, 92 aa, Glycine max
  Coding DNA Sequence Number=SeqID_66140
MTEDIVIFEKVADDLNCLCRPIDLIILEAKENVIVSVKRHQSLRKEAYDLDCLYMPMDLVVSEAKKTVIVFEMIIARTLSPLKDERRGLWVL

SEQ ID NO: 182919 - protein, 85 aa, Glycine max
  Coding DNA Sequence Number=SeqID_66141
  Homolog annotation: Hit_ID=Q1SI44; Match level="QueryCoverage=73%, HitCoverage=8%, E-value=2e-07, Identity=41%"; Hit description =Leucine Rich Repeat, putative
MKCSQFCITKPTSLFRKIHHLFKAGDVRACDVVPLAWRGVVVVPVGESDDAGGIHDGLQSEKHDAVEGDRNRGTEIDEQSNDHLE

SEQ ID NO: 182920 - protein, 200 aa, Glycine max
  Coding DNA Sequence Number=SeqID_66142
  Homolog annotation: Hit_ID=Q40538; Match level="QueryCoverage=18%, HitCoverage=64%, E-value=5e-08, Identity=86%"; Hit description =Nicotiana tabacum (clone 5) activating factor DNA sequence
AVRLSCPLKSYPEPYELFVIHASSAIESGAPRIDCLALFIYLAPSTLSRSPMNCLSFMHHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 182921 - protein, 94 aa, Glycine max
  Coding DNA Sequence Number=SeqID_66143
  Gene Ontology: Mol. function=DNA binding; Biological process=DNA integration
  Homolog annotation: Hit_ID=Q1SIT1; Match level="QueryCoverage=88%, HitCoverage=32%, E-value=1e-09, Identity=39%"; Hit description =Integrase, catalytic region
AGEERKLQLCELDEIRLEGYENSHFYKEKTKKFHDSLIDKKDFVVGQPIEIKSESTDKGFKVNGHRLKPFLTNPSLVDVVVEETSLLHPTSLPP

SEQ ID NO: 182922 - protein, 51 aa, Glycine max
  Coding DNA Sequence Number=SeqID_66144
MSENAQRKYECTSLGVREKMQAMFRKFLAEGARRLANDRLLSTAMATMNWP

SEQ ID NO: 182923 - protein, 54 aa, Glycine max
  Coding DNA Sequence Number=SeqID_66145
MENWRTALGNNFAGLQAPLGNVFMGLRIKVENGELANSARQQIRGAPNSLVEDA

SEQ ID NO: 182924 - protein, 267 aa, Glycine max
  Coding DNA Sequence Number=SeqID_66146
  Gene Ontology: Mol. function=iron-sulfur cluster binding; Cellular component=membrane; Biological process=electron transport
  Homolog annotation: Hit_ID=Q0K1H6; Match level="QueryCoverage=76%, HitCoverage=55%, E-value=7e-24, Identity=31%"; Hit description =Phenylacetic acid degradation protein E,flavodoxin reductase
  Pfam annotation: Domain name=Fer2; Domain location=205-265; Score =28.4; E_value=2.6e-05; Accession=PF00111.17; Description=2Fe-2S iron- sulfur cluster binding domain
  Pfam annotation: Domain name=NAD_binding_1; Domain location=43-164; Score=51.2; E_value=3.6e-12; Accession=PF00175.11; Description =Oxidoreductase NAD-binding domain
  Pfam annotation: Domain name=NAD_binding_6; Domain location=39-167; Score=-33.9; E_value=0.048; Accession=PF08030.2; Description=Ferric reductase NAD binding domain
  Pfam module annotation: Pfam domain module=Fer2::NAD_binding_1::NAD _binding_6; Domain location=205-265::43-164::39-167
MTSAPYEKKISLGIKVNSPVGAQQNCLKIIRLEMNYCEFRTIVGFAAGIGITPVLSHFKNILHNEPRTRLFLFFGNKNSDELIYRDLLDNLARTYGDRLQIFYFFSQEKTPDQLFYGRLDAKKLNLIINQILHLDDTDEESTIWDAVDEVLICGKGDMIKTLANACYHHGIPKKNIHFELFEEFNDDIYPIEKEFPLIENVEIDFKILGKDYSTHLPDNKDKILQQLLVQKFPVPYSCKSGICGSCECYLEEGEVELLENEYLTEKE

SEQ ID NO: 182925 - protein, 62 aa, Glycine max
  Coding DNA Sequence Number=SeqID_66147
MGVVTNQQKNTKGGVISKKGVRIATRPTCAFQGIPTEGGAFWWKQPYSPRRAGRQPPPSFLL

SEQ ID NO: 182926 - protein, 206 aa, Glycine max
  Coding DNA Sequence Number=SeqID_66148
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=100%, E-value=1e-24, Identity=33%"; Hit description= UPI00006A17C9 related cluster
  Subcellular localization annotation: CTP_CleavageSite=37; ConfidenceScore=5.18e-01
MTTCLRLPKGWTLGYTPSPSEDYTTTRPCLQRTARPRLQRTAGPRVQRTTRLHALTFKGLHVLAFRGLCILAFKGLHALTFRGRHNLTFRGLHVLSLRGLHVLGFRGLHVLAFKGLHALTFRGLHVLTFKGLHAFTFSGLHVLGFRGLHVLAFRGLHTFTFRGPHILAFRGLHVLTFRGLHTLIFIGLHVLTFRGLHVLTFRGLHI

SEQ ID NO: 182927 - protein, 106 aa, Glycine max
  Coding DNA Sequence Number=SeqID_66149
  Subcellular localization annotation: CTP_CleavageSite=42; ConfidenceScore=5.29e-01
MKMKANKTRNELKVSDSKTYRLKSKERTKNGGKSSRNCSRKRLKSVTQAPWLGFSSQKRVFSLKIPEMHRVKGHDPLGQPPSPIYRRKGEEVATQLDAILPRKGIG

SEQ ID NO: 182928 - protein, 174 aa, Glycine max
  Coding DNA Sequence Number=SeqID_66150
  Homolog annotation: Hit_ID=Q1SKD7; Match level="QueryCoverage=57%, HitCoverage=26%, E-value=1e-08, Identity=34%"; Hit description =Ankyrin
MATKKLATTRAKKTNAGEGSYTSSLANFVCDGHKDRSEEYQCRFELIKDCSFLKERRVQLLEGDYPEFMEEITRRNWRQLAEPMPKYYLEVVLEFYANAWPTNEGVLDKHSNVWGQWIPYDRDAINQFSGNTLILEEVKKMMELTNQEGGELRKRLRYPTLKSFVNKSLRETCP

SEQ ID NO: 182929 - protein, 111 aa, Glycine max
  Coding DNA Sequence Number=SeqID_66151
MVDPLCLRCSLEEEFMMHTLVSYIKVQTFWFSSPLGLCIDVERFTDFQEWLASCIRSAKEEEKEEASRGSIDVFETPVIWKAPRAGMYKANFDASVRKGVGVGMRLILRDD

SEQ ID NO: 182930 - protein, 51 aa, Glycine max
  Coding DNA Sequence Number=SeqID_66152
MDVAIDAPQPCLHPVDPFVVVIVVVTIAHHVVVVAVVGCAHYTHNQSPDIE

SEQ ID NO: 182931 - protein, 92 aa, Glycine max
  Coding DNA Sequence Number=SeqID_66153
MTKIQGPKEGKSYSNIYKEEWTQPWPMGSEIYLEVHENLRAFFSSSSPILLESSIQYPWGGMRWEGLGHIRVREGEGGRRRSGVWERGKEER

SEQ ID NO: 182932 - protein, 63 aa, Glycine max
  Coding DNA Sequence Number=SeqID_66154
MEVVLHQGAIPCGRRKHHMIVMEVVLHQGAIPCGRRNWEDSSIQRTLWLLKPSLLENDMQINK

SEQ ID NO: 182933 - protein, 124 aa, Glycine max
  Coding DNA Sequence Number=SeqID_66155
MTQGYKMPTTLEILSSKLFTDGSQVLSVHIGRVMAYDFLGHARMSKREHPGCRVSSQKISIDYPTQEAQGGTSVEAMSSKIILMMPKNKESSKFQRIKSQASFKNQDQDSTKESRIKNQDSRFK

SEQ ID NO: 182934 - protein, 155 aa, Glycine max
  Coding DNA Sequence Number=SeqID_66156
  Gene Ontology: Biological process=metabolic process
  Homolog annotation: Hit_ID=Q93WZ8; Match level="QueryCoverage=52%, HitCoverage=2%, E-value=1e-16, Identity=63%"; Hit description=NADH glutamate synthase precursor
  Subcellular localization annotation: CTP_CleavageSite=31; ConfidenceScore=5.26e-01
MPLPKIVTHVHFLAFSLPKQQGPPPPPPPISLFHTKRDIVCLNKFWAFGGNVVAMNKDSCGVGFVAELSGESSRKTVNATTLVFACECEYEYGACGVTDALEMLVRMMHRGACSVKPTLEMEHGSWWVYLTSFTRRVAEALNANAKRWSSLKKET

SEQ ID NO: 182935 - protein, 125 aa, Glycine max
  Coding DNA Sequence Number=SeqID_66157
MVEAFSQNNMSLTGLPIILPSESDLTYHCVGDKEEDMVEVLIKYFQALFPRSNLIGVQKVAGGVGRRLTEEMLEVLNGSFTEDESLVSIFDNAIIASKCFHSMKKGKKGFMGLKLDMSKAYDSVE

SEQ ID NO: 182936 - protein, 108 aa, Glycine max
  Coding DNA Sequence Number=SeqID_66158
MMDNDALHQLRAHIIEMEHRHKEELRKLKADHDKLDSCVRRPYGDEHSAHTINECTQVCDEPVAPPDIRNLGKFMLVALHSMLLALRPGKFIDSLCKKPPSSMDKLHK

SEQ ID NO: 182937 - protein, 286 aa, Glycine max
  Coding DNA Sequence Number=SeqID_66159
  Homolog annotation: Hit_ID=Q9FN45; Match level="QueryCoverage=93%, HitCoverage=95%, E-value=4e-58, Identity=47%"; Hit description =Genomic DNA, chromosome 5, P1 clone:MYJ24
  Pfam annotation: Domain name=DUF617; Domain location=113-286; Score =355.1; E_value=1.1e-103; Accession=PF04759.4; Description=Protein of unknown function, DUF617
MAAKSPHDSSFSFSRRYFHWKKKALDESDDEEEILNFSSSSSHFPEEVDDNQEEHYHPHHLTLQMPQHGAISTKKKPYFSKKSKFKSALTVFTTRVPRLGLHHNKNSSSLGTRVVGTLFGHRRGHVHFAFQEDPKLGPAFLIELATPTSVLVREMASGLVRIALECEKKKKGDINYNASSSKVRLLEEPLWRTYCNGRKCGYANRRECGPEVWKILKAVEPISMGAGVLPVCVNGAAGSEEEAAGEVMYMRAKYERVVGSRDSEAFYMMNPDGSGGPELSIYLIRV

SEQ ID NO: 182938 - protein, 62 aa, Glycine max
  Coding DNA Sequence Number=SeqID_66160
MLIFVGSVFGWVDLFFDCVRVCDTKGQAKESDKRKVSSPNLPVGNKELEILREISELKSAAN

SEQ ID NO: 182939 - protein, 171 aa, Glycine max
  Coding DNA Sequence Number=SeqID_66161
MAKFDPEIVMEFYANAWPTEERVQDMRSWDFAQTAVGRRVRIMHTSMTTLTQIWMTSLFSNILLSDHNSDLPLSKCQLVYAIMTQVSVHVAQLISDAIYQPLPVLWSAGHPNKLIQPPINKAFIEKYCMPRQVQGQAPQQPEEGQQQAFVDAPPPPPESTSAHLQRLERCI

SEQ ID NO: 182940 - protein, 136 aa, Glycine max
  Coding DNA Sequence Number=SeqID_66162
MYRQQKSLYHPIYFSLSTTEWNAGERNRREGMTWREGKEGVWVELACGASMEAGSLSFNEEEGASPPRIALDKKLEEDALMEEKKERRGEHKIEGIKEGKKWNFEVYLIRLSFIKVTTSVTHASIYRLGSFLEKLS

SEQ ID NO: 182941 - protein, 114 aa, Glycine max
  Coding DNA Sequence Number=SeqID_66163
  Gene Ontology: Mol. function=catalytic activity
  Homolog annotation: Hit_ID=Q4ADY5; Match level="QueryCoverage=68%, HitCoverage=21%, E-value=1e-27, Identity=74%"; Hit description =Spermine synthase
MEDGVGRGLECPKTMDGKASNRNGLEKDIPSCCLKARAPIHESEVKCHSTVVSGWFSASQTCPEKFRKSVYFNNLMWPGLRPICKHMCYVLAIGNVICLSYYITIQSVQFLLCS

SEQ ID NO: 182942 - protein, 162 aa, Glycine max
  Coding DNA Sequence Number=SeqID_66164
MEKNEETTMEEKLAYESSMEDGSLSFNEPNPLEVNKDQCPNNEIEQAKMNDKLFGSAPGNLMYVQVMRYLQKTKDYILVYRRVDNLEDRKSTSGYIFMMAKGSKHLELKYLTVRDLVKDGSIVVKHVDTNSMLVDPLIKGLRPIVFKRHVENMGIVSSFDIL

SEQ ID NO: 182943 - protein, 802 aa, Glycine max
  Coding DNA Sequence Number=SeqID_66165
  Gene Ontology: Mol. function=RNA-directed DNA polymerase activity; Cellular component=chromatin; Biological process=chromatin assembly or disassembly
  Pfam annotation: Domain name=Chromo; Domain location=718-762; Score =25.9; E_value=0.00014; Accession=PF00385.14; Description='chromo' (CHRromatin Organisation MOdifier
  Pfam annotation: Domain name=rve; Domain location=413-569; Score =85.1; E_value=2.2e-22; Accession=PF00665.16; Description=Integrase core domain
  Pfam annotation: Domain name=zf-H2C2; Domain location=358-395; Score =26.2; E_value=0.00012; Accession=PF09337.1; Description=His(2) -Cys(2) zinc finger
  Pfam module annotation: Pfam domain module=Chromo::rve::zf-H2C2; Domain location=718-762::413-569::358-395
MANNWIVTWFVKPFPFTFSLHTFTLTYMSYLFPGDRDTSISSLSAIRRLGQTHRDVLYYHITFLADDAPSSPELLIATRKLLNKFTTLFQPLSTLPPVRDTDHRIHLLPLAAPVNVRPYRYPHYQKQEIEAQRFYVDYRALNALTVRDRFPIPTIDELLDELGDAIWAMQCSLLFPGHYEYALPTIPSKVEYLGHLVSPRGVEPLKSKIEAILQWHVPRTTKAVRSFLGLAGFYRRFIQKYATIAAPLALSTAPVLTLPNFNLPFTLEMDASGVGMGVDPSLTMLLSVPYLTFMEELRHQLEAHTGYVQQRTSITENPTHHPDFSIANNMILHRGRLWLPRDIPMISTLLKEYRVTPTGRHTGITKTVARISENFYWPGLRDDVTQFIATCLDCQFKKYETKKLAGLLYPLPVPHRLWEDLSLDFITGLPPYRGYSVILVVVDRFSKGIHLGMLPMAYTAYNVASLLSELVVKLHGVPRSLVSDRDPLFLSKFWQELFRLSGTQLKMSSAYHPQSDGQTEVLNCIVEQHLWSFVHHRPSHWGKFLAWAEYSHNTSWNSATGVTPYEVTYGRKPPSFPAYLVGTSNIDAVDTMITDKEEAFQFIQKKLLKAQASMKDQADVHRCDVSYQPGDWVLLKLRPYRQITTKGSQSFSGKLAKRFNGPFKVLARIDKVAYRLELPIEAKIHLIFHYSMLKLFHGNPDSKANELPGQFVNHQPVIIPMTILDYRRSNDAWEVLVQWQGLSPDDTSWEDWNQLQHDYHLGDKVTFQGPWSDREEGKTRTETKTHAEAIEVTKGATTSTAE

SEQ ID NO: 182944 - protein, 159 aa, Glycine max
  Coding DNA Sequence Number=SeqID_66166
MPDSAPSSSSDKLEQLLICLTNQQLSLTQKIDDLINHVSPSMVNPTMTSSIPRPLPNHAQTHRLKLDVPRFDRTDPLGWIFKINQFFEYHGTLEHDRLTIVSFYMEGRALSWFQWMTGNGQFTLRPVFLQALQTMFAPSQYEDPTGALFKLTHKGSVAT

SEQ ID NO: 182945 - protein, 152 aa, Glycine max
  Coding DNA Sequence Number=SeqID_66167
  Gene Ontology: Mol. function=nucleic acid binding
  Homolog annotation: Hit_ID=Q1SPB9; Match level="QueryCoverage=74%, HitCoverage=25%, E-value=1e-18, Identity=35%"; Hit description =Transposase
MDNFEWALSKLKGLFVKDNVLPQVIVSDRDLAFMNALETVFPSSTNLLCSLHITKNVTSPDEVSYNEHFKNFTTRCARYKTFVDYVQQTWLVPFKEKFVQAWANRVIHLGNTTTNRHYNVAPCRACRPWIFFINGVLYFLKINGSRMEKEEQ

SEQ ID NO: 182946 - protein, 58 aa, Glycine max
  Coding DNA Sequence Number=SeqID_66168
  Gene Ontology: Mol. function=thiosulfate sulfurtransferase activity; Cellular component=chloroplast
  Homolog annotation: Hit_ID=Q9M4Y8; Match level="QueryCoverage=86%, HitCoverage=34%, E-value=1e-12, Identity=72%"; Hit description=OP1
MDHILIVEGSSSAGEFGGCLSPNFGACACSIRTSSSWSSIFGCKDSRRVQCWTRSWRN

SEQ ID NO: 182947 - protein, 86 aa, Glycine max
  Coding DNA Sequence Number=SeqID_66169
  Gene Ontology: Mol. function=protein serine/threonine kinase activity; Biological process=protein amino acid phosphorylation
  Homolog annotation: Hit_ID=Q6RC06; Match level="QueryCoverage=63%, HitCoverage=11%, E-value=1e-15, Identity=78%"; Hit description =Serine/threonine protein kinase
MPEAAEVDGFDVAGADAAEEVEVAEGEGSLAEEGGRADGGVGEVGGAVRLDGETLRVGAGVGVCEDDDELRSGGIVTRHRFLWSIA

SEQ ID NO: 182948 - protein, 293 aa, Glycine max
  Coding DNA Sequence Number=SeqID_66170
  Gene Ontology: Biological process=ripening
  Homolog annotation: Hit_ID=O80760; Match level="QueryCoverage=97%, HitCoverage=83%, E-value=2e-33, Identity=40%"; Hit description =Probable polygalacturonase non-catalytic subunit At1g60390 precursor
  Pfam annotation: Domain name=BURP; Domain location=145-292; Score= -2.3; E_value=8.9e-09; Accession=PF03181.6; Description=BURP domain
  Subcellular localization annotation: CTP_CleavageSite=36; ConfidenceScore=5.70e-01
MTYGNIAATSPATVRASPAMVRASPTIVRTPTSPMRASTLMAPMLAATLHDNSDVQTFQSYRKNFVGSGNEFTGYGTNSNVATLGFTNYGKGDASPNNTFTNYDMEMNVPEVMFKSYTDGTHGGTKSFVNYRDQANVGDDSFQSYAKNTKEGTQVDFKNYGNSFNPGSNTFKGYAKGEEWDHKHVLHVSDNSSMDKIIMDSLRECERAPSMGETKRCIGDQIGVIPSDLVPLLALLLNPESKTKINHEVAIYHLDTTVWSPTHSAFVALVLGPGQIEMCHWIFENDLTWTIVD

SEQ ID NO: 182949 - protein, 191 aa, Glycine max
  Coding DNA Sequence Number=SeqID_66171
  Homolog annotation: Hit_ID=Q69QB4; Match level="QueryCoverage=48%, HitCoverage=22%, E-value=5e-38, Identity=77%"; Hit description =Putative ABA-responsive protein
  Pfam annotation: Domain name=GRAM; Domain location=118-180; Score =26.1; E_value=0.00013; Accession=PF02893.10; Description=GRAM domain
  Subcellular localization annotation: CTP_CleavageSite=17; ConfidenceScore=5.10e-01
MATLDSDVTVFPVGKASSSGGPSLSNKKLKRFKIKKWNVVSLWAWNIVVDNCAICRNHIMDLYKRVNSTYCLCVANEASAISEECTVAWVKTGPSFVDAAVGRIAQGTRVLAEGGYEKIFRQTFEIVPEEQLLKTYACYLSTSARPVMGVLYLSTAKLAFCSDNPLSYQVGDQTQWSYYKDTIVLPKLATV

SEQ ID NO: 182950 - protein, 148 aa, Glycine max
  Coding DNA Sequence Number=SeqID_66172
MATNDNDTNTVNQGKGPHKHESTMLRMLATGSSEIGNPTNVASPSRQDVDDHSIIIALQREMDTLPPNLSQKNDDLGLMYRWIVVKFKHQVQNPIPSILTVGNFKIMEKKELHEDSISGGFNLFSVSLTFRNSIGAVGGITEGISGNR

SEQ ID NO: 182951 - protein, 60 aa, Glycine max
  Coding DNA Sequence Number=SeqID_66173
MVVNVIDRESGFNVVGGGARWFGVGGAVFGPRFLAEEASSEKEMKRGGGVEEGNHMRGKG

SEQ ID NO: 182952 - protein, 531 aa, Glycine max
  Coding DNA Sequence Number=SeqID_66174
  Gene Ontology: Mol. function=nucleoside-triphosphatase activity; Cellular component=integral to membrane; Biological process=transport
  Homolog annotation: Hit_ID=Q9C6W5; Match level="QueryCoverage=98%, HitCoverage=84%, E-value=1e-169, Identity=55%"; Hit description =White-brown complex homolog protein 14
  Pfam annotation: Domain name=ABC2_membrane; Domain location=295-522; Score=142.0; E_value=1.6e-39; Accession=PF01061.14; Description=ABC -2 type transporter
  Pfam annotation: Domain name=ABC_tran; Domain location=1-188; Score =134.0; E_value=4.2e-37; Accession=PF00005.17; Description=ABC transporter
  Pfam module annotation: Pfam domain module=ABC2_membrane::ABC_tran; Domain location=295-522::1-188
MAMLGPSGSGKTTLLTALAGRLDGKLSGAITYNGHPFSSSMKRNIGFVSQDDVLYPHLTVLESLTYAAMLKLPKSLTREEKMEQVEMIIVDLGLSRCRNSPVGGGAALFRGISGGERKRVSIGQEMLVNPSLLLLDEPTSGLDSTTAQRIMAMLQSLAGAYRTVVTTIHQPSSRLYWMFDKVVVLSDGYPIFTGQTDQVMDYLESIGFVPVFNFVNPADFLLDLANGIVADAKQEEQIDHHEDQASIKQFLVSSYKKNLYPLLKQEIQQNHRELAFLTSGAPRSSENQWTTSWWEQFMVLLKRGLMERRHESYSRLRIFQVLSVSILSGLLWWHSDPSHIHDQVGLLFFFSIFWGFFPLFNAVFAFPLERPMLMKERSSGMYHLSSYYVARMVGDLPMEFVLPTIFVTISYWMGGLKPSLVTFVLTLLIMLFNVLVSQGIGLALGAILMDVKQATTLASVTMLVFLLAGGVQYSVNEVYQCRQGLHYRIRDFPAIKCLGLDSLWGDVAVLAVMLIGYRVVAYLALRMGLHH

SEQ ID NO: 182953 - protein, 79 aa, Glycine max
  Coding DNA Sequence Number=SeqID_66175
MAKVDEVQERIKADLEAMKEQMATMMEAMMSMKKIMKVNVAAVVATNVVAEMDSTPPSGLNQINHAISDMVGQRDKELG

SEQ ID NO: 182954 - protein, 135 aa, Glycine max
  Coding DNA Sequence Number=SeqID_66176
MEYSNVGQFHPCIQDSIENIIDAKVDSNCGYRAIVALLGMGEESWSLVRNHLHVELTSWSEKYINLLGGIEKFEDVATYPSAGGRRETRGMRVPRKEYVRSRHQRLFEENVGKTGKDAIYELFSERFGSCIYARG

SEQ ID NO: 182955 - protein, 67 aa, Glycine max
  Coding DNA Sequence Number=SeqID_66177
MYRIVTSKKEQKRNHDLGHMKQSPSLLPTESLCSCLCCVVPKGKQKRKRPKHSKPDSLPFQKGLIDP

SEQ ID NO: 182956 - protein, 80 aa, Glycine max
  Coding DNA Sequence Number=SeqID_66178
MLQCEGYFSLLGHIIEFPNGGNARNWVANVMLKFHDDPTVNESEIAIFLRQVRWLAGKREGFGRREKKQNCEAEEAEESV

SEQ ID NO: 182957 - protein, 54 aa, Glycine max
  Coding DNA Sequence Number=SeqID_66179
MVPVIWRIRGSTSGNNISLRFRERQKEGFLPNLFLLNPCFLKDLKKGLLELSTR

SEQ ID NO: 182958 - protein, 221 aa, Glycine max
  Coding DNA Sequence Number=SeqID_66180
  Gene Ontology: Mol. function=ferric iron binding; Biological process =aromatic compound metabolic process
  Homolog annotation: Hit_ID=Q9LHB1; Match level="QueryCoverage=95%, HitCoverage=33%, E-value=3e-52, Identity=49%"; Hit description =Transcription factor X1-like protein
  Pfam annotation: Domain name=XH; Domain location=162-221; Score=6.1; E_value=6.8e-07; Accession=PF03469.5; Description=XH domain
MELLEQYMQFKQEAEKDGKKNNLWKNASKNTSLQMAALEQMKADENVMKLAEDQKRQKEQLHAKIIQLQKQVDMKQELELEIQQLKGSLTVLKHMEDDKDAEILNKVDTLQKNLRDKEQSLQDLDALNQTLIIKKRESNDELQEARQALVDAIKELQSHGNIRFKRMGELDTRPFLEAMKQRYNEEDAEERASELCSLWKEYLKDPDWHPFKVIMVEGKEK

SEQ ID NO: 182959 - protein, 775 aa, Glycine max
  Coding DNA Sequence Number=SeqID_66181
  Gene Ontology: Mol. function=RNA-directed DNA polymerase activity; Cellular component=mitochondrion; Biological process=RNA-dependent DNA replication
  Homolog annotation: Hit_ID=Q9FJR9; Match level="QueryCoverage=85%, HitCoverage=90%, E-value=0.0, Identity=75%"; Hit description =Similarity to maturase-related protein
  Pfam annotation: Domain name=Intron_maturas2; Domain location=456 -604; Score=9.8; E_value=2.2e-06; Accession=PF01348.12; Description =Type II intron maturase
  Pfam module annotation: Pfam domain module=Intron_maturas2::RVT_1; Domain location=456-604::123-431
  Subcellular localization annotation: CTP_CleavageSite=40; ConfidenceScore=5.25e-01
MRRRLPLLAHSLLFKPTINNNPLRFLPILNHPPSAPRRFSSATPSKDDGVSLCCQMWIDNFRHPDRAVTNLSSFLRRFDLWVLAYQKVATDDTGSYTSRSSLHASTLQDLLALRNAVLDAKFKWGSRLKFFIKSPKDKTDYDSLSKRKIKTILTTTQPAPFQDRIVHEVLLMILEPIYEPRFSPKSYAFRPGRTPHTVLRVIRRSFAGYLWYIKGDFSVLLDGMKVGLVINSVMRDVRDKLVVDLIKDALVTPVVVTTVEKKEKKKKRKYQKKRVLAEDEPKPDPYWLDTFFGFAPEEAERVPNWGHCGVLSPLLANVCLDELDTWMEGKIKEFYVPSKSDVIWNSPEEEQGNTSWPEFVPTSGPDKTRKMDFVRYGGHVLIGVRGPRADAAALRKQLIEFCDQRFMLKLDNESLPIEHITKGIMFLDHVLCRRVVYPTLRYTATGGKIISEKGVGTLLSVTASLKQCIKQFRKLSFLKGDRDPDPQPCFRMFHATQAHTNAQMNKFLSTMVEWYRYADNRKKIVNFCSYIIRGSLAKLYAAKYKLRSRAKVYKIGARNLSRPLKEKKGQSPEYHNLLRMGLAESIDGLQYTRMSLVPETDYSLFPSNWRPDHEKLLLEYIKLEDPKTLEEQRDCIREQGLVSPQDYISMLVWNYKRNSLPMDQLSLVRSNESVVGNQHLLVGSNQDDQDHTNQEEENDGRMNAAQMTTSNDCLHCISDSDDATTFVDIMFHLSTMDACQRKDTITEEWRALTCWHPLRQNINTATLLVGTLTGL

SEQ ID NO: 182960 - protein, 445 aa, Glycine max
  Coding DNA Sequence Number=SeqID_66182
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q75Z80; Match level="QueryCoverage=95%, HitCoverage=62%, E-value=1e-164, Identity=69%"; Hit description=Exo -1,3-beta-glucanase
  Pfam annotation: Domain name=Glyco_hydro_3; Domain location=106-376; Score=255.0; E_value=1.6e-73; Accession=PF00933.12; Description =Glycosyl hydrolase family 3 N terminal domain
MSRALFHLLGVLWLCWCLTSIGEAQIEYLRYKDPKQSVQTRVRDLMSRMTLDEKIGQMVQIDRSVANANVMKTSFIGSVLSGGGSEPLPRATAEDWVNMINDFQKGALESRLGIPMIYGIDAVHGHNNVYNATIFPHNVGLGFAFIHLFGSNNLWIGAATALEVRATGIPYVFAPCIAVCRDPRWGRCYESYSEDPKIVQEMTEIIPGLQGSIPANSRKGFPYVGGKTKVAACAKHFVGDGGTTKGINENNTVIDWHGLLSIHMPAYSDSIIKGVSTVMVSYSSWNGVRMHANRDLVTGFLKNTLKFKPFFLPLSDPDLSNMVHIVDANNKFCSLIYQGFVISDWQGIDRLTSPPSSNYTYSVQASIEAGVDMVMVPFEYDKFIQDLTLLVKSNIIPMERIDDAVERILLVKFTMGLFENPLADTSLVNELGSQVSHPNRLVQSE

SEQ ID NO: 182961 - protein, 85 aa, Glycine max
  Coding DNA Sequence Number=SeqID_66183
MNDEERLKIFAKSLTETLRKHYGSASAWICFTETISLSNFNQIEEELATQLAQASQVASSRSNRLLGEESGRPKWVWLLFAPLFY

SEQ ID NO: 182962 - protein, 108 aa, Glycine max
  Coding DNA Sequence Number=SeqID_66184
MSSKVILMMPKNQELSKVSSQDSRIKFQDSRFKNNQDQDSRLKIQESREDSIKISTKFFFKTLSSTRSFHKIITKEFYSLVIDYQKVVIDYQCFKTLRFHISRVTTCV

SEQ ID NO: 182963 - protein, 71 aa, Glycine max; identical to SEQ ID NO: 146994
  Coding DNA Sequence Number=SeqID_66185
  Pfam annotation: Domain name=Rick_17kDa_Anti; Domain location=23-59; Score=11.2; E_value=0.013; Accession=PF05433.5; Description =Rickettsia 17 kDa surface antigen

SEQ ID NO: 182964 - protein, 260 aa, Glycine max
  Coding DNA Sequence Number=SeqID_66186
  Gene Ontology: Mol. function=oxidoreductase activity; Cellular component=chloroplast; Biological process=electron transport
  Homolog annotation: Hit_ID=Q5YUI9; Match level="QueryCoverage=78%, HitCoverage=56%, E-value=4e-39, Identity=41%"; Hit description =Putative monooxygenase
MDKPEIDRGELKNMLLSALLPQTMQWNHKLHYVDYGQQKAHGLVFRNGRRYEADIVIGADGAWSRVRRYLTPVRPVYTGITFFEGWIDHPSDQINSIAGNGTAFSFSGAQALVTQRNGGGRICVYAAMKRAPDVIDQRIASSGLTAWVRDSYRDWAASLQSVVNATGDYIRRPIYSLPADFGWVPRPGITLIGDAAHLMPPVGVGVNLAMLDAADLAQALCEAPHPQNGLRSAETLIMERAREMMPDAIAGFQNWFDEKA

SEQ ID NO: 182965 - protein, 130 aa, Glycine max
  Coding DNA Sequence Number=SeqID_66187
FEEVTKTHGLRKTPPFDFRHITEFSRIAVPSISKRPIKGCISSNNNPRTKLGYDTKESRFKQVPKNQESKSFKNQVSKNQDSRIIKSQDSIKFQESRFKNNQDQDSRLKIQESREDLIKISTKKVFQNIE

SEQ ID NO: 182966 - protein, 172 aa, Glycine max
  Coding DNA Sequence Number=SeqID_66188
DKDGVDDTVCEKYDINKEKWAQFCQTRRDPSWEDMRKKAQAIQKQNTAPHIITEGVIDPPSPTRRHVKWKMARTKKTGQVTSKAAKEIAQKIVSQGSFVPHGCQDVLTAAIGRPEHPGHVRSARVGFTIKQYFGSTPQTSRSSSSMPPEDLQQLTQQIRDQLEESITEKVTR

SEQ ID NO: 182967 - protein, 243 aa, Glycine max
  Coding DNA Sequence Number=SeqID_66189
  Homolog annotation: Hit_ID=O04892; Match level="QueryCoverage=29%, HitCoverage=13%, E-value=3e-23, Identity=76%"; Hit description =Cytochrome P450 like_TBP
MPERGEARGNSVSLRIAGARGRVLSGRCGCSVEPRHGIESSKWAIFGKQNWRCGMNRKLGYGAQLRANLDPTKGVGRLRQQDGGHGSRNPLRTPMSRRARRSLAKPQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQN

SEQ ID NO: 182968 - protein, 218 aa, Glycine max
  Coding DNA Sequence Number=SeqID_66190
MVDANRSRLNIQEVEQTLTRMINDSNTEMQLKLDQVTASLVELKSLFTQQPLNQPGSSMINNIERTQYGSRLNTQVFVGIPQTQSFPSQTHYSTRFSKVEFLRFDGMKVKEWLYKCKQFFALDNTPPKSKTRRVQEYLNEFELMLIQKNPPGPVMQQKRQRGELKDSIILFTPGHQLKHKRSQLLVIEIEDDELVDEGIEVIKENGVVTMTSNQGDRP

SEQ ID NO: 182969 - protein, 308 aa, Glycine max
  Coding DNA Sequence Number=SeqID_66191
  Gene Ontology: Mol. function=chitin binding; Cellular component =extracellular region; Biological process=chitin metabolic process
  Homolog annotation: Hit_ID=UPI00006A17C9; Match level="QueryCoverage =57%, HitCoverage=100%, E-value=1e-23, Identity=35%"; Hit description= UPI00006A17C9 related cluster
GLHILTFKGLQALSFRGLDDLTFRGLHALAFKGLHALAFRGLHILTFRGLHALAFRGLHVLSIRGLHVLTFGGLHTLAFRGLHVLTFRGLHALAFRRLHVVTFRGLHALAFSRTTHPHLQRATRPHLQRTTRPRLQRTTRAHLQRTTRPHLQRVAHPRLQKVARPQLQRDTRPHLLRAMRPHFNFLLSVPFPGPPPDIGGRQNMQAQPKREAIMQLLCILGQDFTRAAAKRRVRQHSAQQPQCRSPPAEVSVGLCRPDIGITPARHPVDSKKSNKVLGFPALVMGLWIAFARHPADPEKSNRVLGFQL

SEQ ID NO: 182970 - protein, 84 aa, Glycine max
  Coding DNA Sequence Number=SeqID_66192
MAAEWRRKRERRRYFKEKMSLEEAYHHRRPWIRAWRKKKMNEGREREDHEILCSKRALKSELWLSPQIQDSPLSVLRCHEACKA

SEQ ID NO: 182971 - protein, 275 aa, Glycine max
  Coding DNA Sequence Number=SeqID_66193
  Gene Ontology: Mol. function=electron carrier activity; Cellular component=formate dehydrogenase complex; Biological process=electron transport
  Homolog annotation: Hit_ID=Q1H4J9; Match level="QueryCoverage=99%, HitCoverage=19%, E-value=1e-128, Identity=78%"; Hit description =Molybdopterin oxidoreductase
  Pfam annotation: Domain name=Molydop_binding; Domain location=191 -275; Score=96.0; E_value=1.1e-25; Accession=PF01568.11; Description =Molydopterin dinucleotide binding domain
MANRNNVISALEKAELVIAQDAFLDTETNRYADILLPGALWAEAEGVMINSERNMTLMQQAAHPPGKAMADWQIIAKVACEMGFSEGFSYQSAAEVFAEITQTSNLKTGYDIRGVSHDKLRETPLQWPCPPESEADRHPIRYLNDGISQTLKVNEDGQAPRLAFATASGKAMFFARPHMDPQELPDEGFPFVLNTGRLQHQWHTLTKTGKIATLNKLNPGPFIELHPEDAAVLGIQDKDQVEISSRRGSAVLPAIVTDRVRAGNCFAPFHWNDVY

SEQ ID NO: 182972 - protein, 62 aa, Glycine max
  Coding DNA Sequence Number=SeqID_66194
MVPPGEYRLSAIAATLENGVGLRGESKLESFIDIVEHDMIILYGIRATPKSVLELMDVKDAL

SEQ ID NO: 182973 - protein, 75 aa, Glycine max
  Coding DNA Sequence Number=SeqID_66195
  Subcellular localization annotation: CTP_CleavageSite=47; ConfidenceScore=5.10e-01
MARACSPLKVRTCSPLKVRTHSPLKVRACSPLLARTCSPLKTRIDCPFEKGDNSCYLILSFCKSLRELPQSVCSF

SEQ ID NO: 182974 - protein, 57 aa, Glycine max
  Coding DNA Sequence Number=SeqID_66196
RAREAEGRLQGSEVEGIERREKEEEERRGNEAEALPNHDCDKSLRRSLFGVLRAIVD

SEQ ID NO: 182975 - protein, 148 aa, Glycine max
  Coding DNA Sequence Number=SeqID_66197
  Homolog annotation: Hit_ID=Q2AA34; Match level="QueryCoverage=41%, HitCoverage=12%, E-value=1e-13, Identity=53%"; Hit description =F7F22.15, related
MEEAEKEILETFRKVEVNIPLLDAIKQIPRYAKFLKELCTNKRKLKGSERISMGRNVSTLIGKSVPQIPEKCKDPAGVAAHDVQRYVKESDRAAQCTRQDKMSKEELKLQDPRCRIQCPGHPARKYWTHKSVISLTDCAGSTMSDTMS

SEQ ID NO: 182976 - protein, 388 aa, Glycine max
  Coding DNA Sequence Number=SeqID_66198
  Gene Ontology: Mol. function=transferase activity, transferring phosphorus-containing groups; Cellular component=membrane; Biological process=peptidyl-histidine phosphorylation
  Homolog annotation: Hit_ID=UPI00005F9129; Match level="QueryCoverage =99%, HitCoverage=86%, E-value=1e-111, Identity=56%"; Hit description= COG0642: Signal transduction histidine kinase
  Pfam annotation: Domain name=HAMP; Domain location=102-174; Score =47.0; E_value=6.5e-11; Accession=PF00672.15; Description=HAMP domain
  Pfam annotation: Domain name=HATPase_c; Domain location=287-385; Score=87.7; E_value=3.5e-23; Accession=PF02518.16; Description =Histidine kinase-, DNA gyrase B-, and HSP90-like ATPase
  Pfam annotation: Domain name=HisKA; Domain location=178-241; Score =62.3; E_value=1.6e-15; Accession=PF00512.15; Description=His Kinase A (phosphoacceptor) domain
  Pfam module annotation: Pfam domain module=HAMP::HATPase_c::HisKA; Domain location=102-174::287-385::178-241
MASAVSVLERGGPSSLDDMMADWEPNDRQFFSVIQHARPATTPDNAPPETFNQPFHGPFPQVIVRWVKGADGKEYELRYDVKGLREDSSMGGGGPRRILNIPEPMFTFAGALGLLFSLLLAWNLTRPMRQLREGFARVSRGDLSVRLYPVMRRRHDELSIVAQDFDAMVERLDTLVKAREELLHDISHELRSPLARLQLATGLARQTPESVASSLNRIDEEARRLDKMIGELLTLSRAEHESMPGEQYFDLTGLLHAVVTDVRYEAQIPGVHVDFLVDENADYTVRGNAELIRRGVENVLRNALRFSHQGQHISVQLQAENQWLAIRVRDQGPGVDDEKLSSIFDPFVRVNSPLMGKGYGLGLSIVRKVVLAHHGEVQAVNRPEGGLE

SEQ ID NO: 182977 - protein, 82 aa, Glycine max
  Coding DNA Sequence Number=SeqID_66199
MCSPLMARTYSPLKVIGTSTQGSTFMRKHEIDSSRGPVIQKDWTRDIDCPFEKGDNSCNLILSLANFSENSLRVYVLFDLVT

SEQ ID NO: 182978 - protein, 148 aa, Glycine max
  Coding DNA Sequence Number=SeqID_66200
MGETHEIPHHNLADFEPCLGYATEGQAVVDIPLQNTLEGPQYHPQPHPSHSTAKELFLVPNIITPPKFKVLDFDKYKGTTCPKNHLKMYCRKMGAYAKDEELLIHSFQESLTGVAFTWYTNLEPSRVHSWKDLMVAFVRQCQLILIWL

SEQ ID NO: 182979 - protein, 97 aa, Glycine max
  Coding DNA Sequence Number=SeqID_66201
TRVDEDQHGGHERANGLSDGGHDENEEDNTVAVAATSAVTKVNPMPPSGFNQMNHPTSAMIWEVWVAPIMCKFKMSTPSRHMAGLPTYTTQCGAHSQ

SEQ ID NO: 182980 - protein, 248 aa, Glycine max
  Coding DNA Sequence Number=SeqID_66202
  Pfam annotation: Domain name=DUF1631; Domain location=1-246; Score= -384.7; E_value=0.0023; Accession=PF07793.2; Description=Protein of unknown function (DUF1631)
MARSRAGAELDRRIGDATLPPAIAEFLRQPWQHHLTLALLREGEEGASVAEALSLADGLLEEVAEARRQIVGKPWLQAWQPVLAKVFASVGVHGDAATGAIDALHDTLQGIAESRPELQRALPELPQVALPAPPVAESPAVELGGQIDADDFDNADADRFRRMEIGNWLDFVDKDGKVQAGKLSWVSPISSRLLFVNRRGVRFCVASPEELAVMVRLGRLRAHVDDGAFDSAMQGVIDRLDPGSATLH

SEQ ID NO: 182981 - protein, 130 aa, Glycine max
  Coding DNA Sequence Number=SeqID_66203
  Gene Ontology: Mol. function=oxidoreductase activity; Biological process=electron transport
  Homolog annotation: Hit_ID=Q5GWN4; Match level="QueryCoverage=100%, HitCoverage=32%, E-value=3e-17, Identity=42%"; Hit description =Pyridine nucleotide transhydrogenase
  Pfam annotation: Domain name=AlaDh_PNT_N; Domain location=7-129; Score=73.6; E_value=6.2e-19; Accession=PF05222.5; Description =Alanine dehydrogenasePNT, N-terminal domain
MAVALLGIKETAPGERRVALTPETARRLGALGIAVWYEAGAGLAAGFTDAAYDDAGARVFDAGRWAEIDILLCVQPPPAAVLEQLKPGASVVGLLAPASDPALAALAADGRLQLFPLQQLPRTTRAQAMD

SEQ ID NO: 182982 - protein, 126 aa, Glycine max
  Coding DNA Sequence Number=SeqID_66204
MKHFLEQVAWPEAQLPLVRPNEAAPPEPTPVHVDPKPANPQSPVVNPLSSPECEVVPPSPPLIIIFDASSDEVAAPPDSPAGEIADLPTSPVGGISDLSDSSSGEVVALTMSAYSNSFLLVLFMGS

SEQ ID NO: 182983 - protein, 66 aa, Glycine max
  Coding DNA Sequence Number=SeqID_66205
MDRVTSLLRLLPNIFRTVDVPLTSGFTLTKIKEQALRCPYQTRARARVMGEVEEVQEQMKADMEAM

SEQ ID NO: 182984 - protein, 122 aa, Glycine max
  Coding DNA Sequence Number=SeqID_66206
MQVQPEEEAIMQLLCIPGQDFTCATAKKCVRIMRTNMTTITQIWMTLLLRYILLNDRNADLPLRKYRLGSRPQDTQWTQRSPTGVPITPNKVIRPRINRAFIKKYCAPRQAEGETPQQPGDG

SEQ ID NO: 182985 - protein, 214 aa, Glycine max
  Coding DNA Sequence Number=SeqID_66207
  Homolog annotation: Hit_ID=Q47522; Match level="QueryCoverage=24%, HitCoverage=66%, E-value=4e-20, Identity=87%"; Hit description=LacZ protein
  Pfam annotation: Domain name=PPR; Domain location=103-137; Score =30.0; E_value=8.3e-06; Accession=PF01535.11; Description=PPR repeat
DLPSQWLLFLSAVPPVQLLTGWCVTAKAPPDISAGKCSGRVPFAIQAAQLLGRAIGAGLFAITPAGERGMCCKAIKLGNARVFPEFDDNAQRVFKDMPQKNEASWNAMISALAAHGKAKEALSLFQHMSDEGGGLVDESSLSIPSTSRGGPVPAFVPFSEVGKPVVPAALMNRPTRGERRFAYWALAECILAYYVGTDEGVSEVLHVAGEKRLH

SEQ ID NO: 182986 - protein, 64 aa, Glycine max
  Coding DNA Sequence Number=SeqID_66208
MQSQGLALPPEPMAGPSGPRVITKERRFYEGSTVHNIPLLPGQVKVGVEEVKDALAPVPVPTDE

SEQ ID NO: 182987 - protein, 320 aa, Glycine max
  Coding DNA Sequence Number=SeqID_66209
  Gene Ontology: Mol. function=DNA binding
  Homolog annotation: Hit_ID=Q1SFS3; Match level="QueryCoverage=99%, HitCoverage=63%, E-value=1e-104, Identity=59%"; Hit description =Lambda repressor-like, DNA-binding
LVPTLEEYSYLVGLPVPDKIPFHGFEPTPKPSDIAAALHLKTSIIQANLTSKGGLQGLPTHFLYQQASIFAEAASMLAFHSILALLIHGLLLFPNIDNFIDINAIKIFLTKNPVPTLLADTYHSIHDRTQAGRGTISCCAPLLYQWFTFHLPQSRAFKTNDDKLSWPRRIMTLDPSDIVWYQAASDVGEIIVSCGEYPNVPLLGMRGGISYNPLLARRQFGYPIKTKPNNLALTNEFYLNHGDHSNKRERFAQAGALSAASTEVSWERNQTMCTNLIPSGLLIGPRALAYPAAYLDTYRPPSHHHPCLSHLTLRKRIKNS

SEQ ID NO: 182988 - protein, 273 aa, Glycine max
  Coding DNA Sequence Number=SeqID_66210
  Gene Ontology: Mol. function=RNA-directed DNA polymerase activity; Biological process=RNA-dependent DNA replication
MGEVEEVQEQMKVDTEALKEQMATMMEAMMSIKEIMEVNMAAVATVCTVSRMDPTPPSGLNLINRPTSDTSGPHFVQVLNKHVFLPYGLPPNYTPPNENVNNSTPILVESQQPQTDHAHVSQPMRETHEISHRNLVDFEPRLGYATEGQAVGDIPLQNTLEGPQYHLQPHPLHSTAGKNPPAMTEMGKLDHLEERLRAIEGGRDYAFVKELFLVPNIITLPKFKMLDFDKYKGTTCPKNHLKMYCWKMGAYAKDEKLLIHFFQESLTGVAVTW

SEQ ID NO: 182989 - protein, 65 aa, Glycine max
  Coding DNA Sequence Number=SeqID_66211
MEILILGQGLWWFDVLGQKACRTVGHDDHEQLGVSYYDLRNKGDQITSRDLKGTRLPPSSASLTS

SEQ ID NO: 182990 - protein, 89 aa, Glycine max
  Coding DNA Sequence Number=SeqID_66212
MGSSQKPSLKKRFYQVKIKSLEVTSLRELGQLMGQLQRQAFRKAYGASHLRDFQLVPTVEEFEEILGCPLGGRKPYLFFGSIPPRQELP

SEQ ID NO: 182991 - protein, 78 aa, Glycine max
  Coding DNA Sequence Number=SeqID_66213
LDDEPFVQVKRSFAIGAGAVTSFGYLLTELRGLRSYVGERFDSLDTRFAGMDIRLTQLEEDVGYIRQSFDLPPPPPPS

SEQ ID NO: 182992 - protein, 134 aa, Glycine max
  Coding DNA Sequence Number=SeqID_66214
MTLSGQNSKTSTSLPSGTLERWQRHSKRHDFGYVAVVGAAGPLRLQVLHGGKQNVRVVAGWSSRRDEVVQAIAVALGFWRDGVPTSTVFYDFHQNYNDGVIDKCRCTTNAPHKNLYNYVNVTVLTTTTGSSTLT

SEQ ID NO: 182993 - protein, 276 aa, Glycine max
  Coding DNA Sequence Number=SeqID_66215
  Homolog annotation: Hit_ID=Q0F1C7; Match level="QueryCoverage=48%, HitCoverage=75%, E-value=6e-33, Identity=49%"; Hit description =Predicted metal-sulfur cluster biosynthetic enzyme
LDAHVVDQDLAHAAARCGQGHLHVDLALAFVQVLDLDFVDQAQFDDVHRNFRVEAGAQLLPYQLFHLFIGGIGGQFQRCRRLLADGVAVLAGDAEQVALDKHRITAAQCLGDVPIAAGRQGHGVALRDHHGLAIAFEVDRFAATGIHGDRYGAVAGATQDGILAQPPCGRRCTAANHSRLDGGTDRPGTGVHAAHGYAGPGPVAHRAGRAGHPAGGRRGQLGHRQRLDGRLDRAGSVGRHDADGPAPGLDPDHLANGAIEWLWLGLGVAVGAWLAR

SEQ ID NO: 182994 - protein, 95 aa, Glycine max
  Coding DNA Sequence Number=SeqID_66216
MRVRELFTHREGGALAPTYPQAKSHFGAVKAHPGKLKLSPEGRSSPRRAACLAMKLFHGPGQPDVGLGELGSRKIKRRTFLPPFLGIFCFLDQKH

SEQ ID NO: 182995 - protein, 87 aa, Glycine max
  Coding DNA Sequence Number=SeqID_66217
MFVFAPTHGSVCRLAAGVSLSEACALSESHALSEALSSLSELGECGGESEKHLRAQRVFSSLSEAFFSSCAKRAQLTQRIFTTSRIL

SEQ ID NO: 182996 - protein, 355 aa, Glycine max
  Coding DNA Sequence Number=SeqID_66218
  Gene Ontology: Mol. function=transporter activity; Cellular component= membrane; Biological process=transport
  Homolog annotation: Hit_ID=Q88DG0; Match level="QueryCoverage=100%, HitCoverage=81%, E-value=1e-126, Identity=66%"; Hit description =Branched-chain amino acid ABC transporter, permease protein
  Pfam annotation: Domain name=BPD_transp_2; Domain location=62-348; Score=159.4; E_value=9.3e-45; Accession=PF02653.6; Description =Branched-chain amino acid transport system  permease component
MAGRLLLSLFLQTAPGRRVLARFDGGNDGVYVRPLGYKSNLRWLLPLMAAIALLFPFVATKYLLTVAILGLIYVLLGLGLNIVVGLAGLLDLGYVAFYAIGAYGLALGYQYLGLGFWAMLPLGALMAALAGALLGFPVLRMHGDYLAIVTLGFGEIIRLVLNNWMSLTGGPNGVSVPAPTVFGLEFGRRAKDGGVPIHEFLGIDYNPNLKFIFIYAVLFLVVLLVLYIKHRLTRMPIGRAWEALREDEIACRSLGLNHVLVKLSAFMLGASTAGLAGVFFATYQGFVNPTSFTFFESALILAIVVLGGMGSTLGVVLAAFVLTVAPELLRSFAEYRVLLFGVLMVAMMIWRPRGL

SEQ ID NO: 182997 - protein, 49 aa, Glycine max
  Coding DNA Sequence Number=SeqID_66219
EGEALTDSSECRPWGSSGFECSCKPVPIPHGWSILAKQRAPDWSPYDFT

SEQ ID NO: 182998 - protein, 111 aa, Glycine max
  Coding DNA Sequence Number=SeqID_66220
MARHKVTRTHTHTHSRRHKGEEGLGREGRIKATRAESQWIVAARPLCHLQYPVAYLSRLQRILPAARWELRFKASRRANPPHEGHQRHVPLGGPRPPTAGRQTDGGRTRRF

SEQ ID NO: 182999 - protein, 87 aa, Glycine max
  Coding DNA Sequence Number=SeqID_66221
  Subcellular localization annotation: CTP_CleavageSite=29; ConfidenceScore=5.07e-01
MASFNQLQSQMQSQGSLEPLVGPGPSGPRVSTKGSCVDPSGNDPETGDSDRCGLYIEADPARLVAVGRVYEGSTLVHNTPLFPGQVK

SEQ ID NO: 183000 - protein, 411 aa, Glycine max
  Coding DNA Sequence Number=SeqID_66222
  Homolog annotation: Hit_ID=P0ACR9; Match level="QueryCoverage=42%, HitCoverage=99%, E-value=1e-90, Identity=93%"; Hit description =Transcriptional repressor mprA
  Pfam annotation: Domain name=MFS_1; Domain location=7-328; Score= -20.6; E_value=0.0028; Accession=PF07690.6; Description=Major Facilitator Superfamily
  Pfam annotation: Domain name=MarR; Domain location=288-359; Score =96.6; E_value=7.5e-26; Accession=PF01047.13; Description=MarR family
  Pfam annotation: Domain name=TrmB; Domain location=283-351; Score= -11.5; E_value=0.057; Accession=PF01978.9; Description=Sugar-specific transcriptional regulat
  Pfam module annotation: Pfam domain module=MFS_1::MarR::TrmB; Domain location=7-328::288-359::283-351
DKLLRTRALLGCFTFANFSILWTSMAFLLAAPPFNYSEGVIGLFGLAGAAGALGARPAGGLADKGKSHLTTSAGLILLLLSWAAIWYGHVSVLALIVGILVLDLTVQGVHITNQTVIYRVKPEARNRLTAGYMTSYFIGGAAGSLISASAWQHAGWSGVCGIGAIVAALNLVAPQSVNVNVIIYPRNFNVGDIFTIGMNSSDPRPHILSSAGSHPTLSVLTGSRTYPALSDGYAQMDSSFTPIEQMLKFRASRHEDFPYQEILLTRLCMHMQGKLLENRNKMLKAQGINETLFMALITLESQENHSIQPSELSCALGSSRTNATRIADELEKRGWIERRESDNDRRCLHLQLTDKGHEFLREVLPPQHNCLHKLWSALSTAERDQLEHITRKLLTRLDQMDEDGAILEALR

SEQ ID NO: 183001 - protein, 172 aa, Glycine max
  Coding DNA Sequence Number=SeqID_66223
MELFLLRVRLREDEITSIARFLSGLNMEVRDKVKLFPYRDLDDLVQLCIRVEQQLKRKPTSKSYGSHSYPKKDQGQGILGAEPSKPKDDKRGEEETLEKQKKKKDSKALSSKAKGKEKEEKDSSNRIVKKENYFTTKGDIKRALLLEQSFYLLLSRETSLSTAIPLELEVIP

SEQ ID NO: 183002 - protein, 45 aa, Glycine max
  Coding DNA Sequence Number=SeqID_66224
STASFILPHYEIRSSHPIGSLLKVMTKGNDWYLKALHWGNEGHRA

SEQ ID NO: 183003 - protein, 191 aa, Glycine max
  Coding DNA Sequence Number=SeqID_66225
ITLLSEEEDRILEAHQDAPPSQPQFEHQQFNILQRSVETRGLGRRRQTVDAAPYSLPSMPEREHGMYYTPPVFTQEPSQMAPMYSYPHDFQPGYSMTGIFGSSPPSGGTPSFTQNNELPTPNAPLGGPWNVPGNIPDMNDLLGVDLRHDFSAEADEVDERGNLRRRNPDRAARNWDRPCGTSSRHHRHSHD

SEQ ID NO: 183004 - protein, 142 aa, Glycine max
  Coding DNA Sequence Number=SeqID_66226
  Gene Ontology: Mol. function=chitin binding; Cellular component =extracellular region; Biological process=chitin metabolic process
  Homolog annotation: Hit_ID=UPI0000612705; Match level="QueryCoverage =63%, HitCoverage=92%, E-value=5e-12, Identity=33%"; Hit description =UPI0000612705 related cluster
SSPSECCTPSPFGGLHVLTFIGLHVLAFRGLHVLAFRGLHAIAFKGLHVLAFKGLHVLAFRGLHVLAFRGLHALAFRGLDVLSFRGLHALDFRGLDVLAFRGLHKPRCFRNASVSDSVEILHHSSSFFIVLHSFFVVLHSST

SEQ ID NO: 183005 - protein, 40 aa, Glycine max
  Coding DNA Sequence Number=SeqID_66227
MDAKFTERCLPKSLLEWALKGFNNGQGSKSKVAARWIIVK

SEQ ID NO: 183006 - protein, 90 aa, Glycine max
  Coding DNA Sequence Number=SeqID_66228
  Gene Ontology: Mol. function=ribonuclease H activity; Biological process=DNA integration
MNGAVEATNKKIKKIIQKMTVTYKDWHEVLSFALHGITYSESLQGKWASNYEGPFVVKKAFSGGTLILRNMDGEELPSPVNSDVVKQYYA

SEQ ID NO: 183007 - protein, 163 aa, Glycine max
  Coding DNA Sequence Number=SeqID_66229
  Gene Ontology: Mol. function=RNA-directed DNA polymerase activity; Biological process=RNA-dependent DNA replication
DATEIPNVNFEMSINQTKEDEEKDWGLSPDLLRMVEQEEREIKPHQEETKLVNLGIDEEIKRSQDWHLYDMPGLEPEIMQHRLSLKHECSFVKQKLGKMKPEMSLKIKEEVMLLGLKNDGAIYPSAMPKKDRSGSRQSGSDPRDAKAMYREASPWIPRKIELH

SEQ ID NO: 183008 - protein, 327 aa, Glycine max
  Coding DNA Sequence Number=SeqID_66230
MDTLPVFYYEKMVGYMPSSFADLVFASKRIEVSLRRGKFDYVASAGSSNKRPRMSGGKKKDRETYVVTVVPTWPNFPLAPYNPIFGHFIEHCMALKHKEDNPNVQTNPLADHGSSSVNVIKNEEIWELKRRVEDVLTSKRFILKVLCKASMVDCEGDEEDRCPLHPKTLHDVEECLVFKELLQGLMNDDRIEIGHRRKKEGEVFMQLSDANMIAPSSFPYDNNKEVQWRYDVQVSKRRQDVSLVYDGHNTSTPKVTNIYGISGMMRSERVFTHPDLQAELKDKGKVKVNETKIEKIGLMVNEKVHSENPEGKKENSGQKEISAEEAT

SEQ ID NO: 183009 - protein, 243 aa, Glycine max
  Coding DNA Sequence Number=SeqID_66231
  Homolog annotation: Hit_ID=UPI0000510441; Match level="QueryCoverage =93%, HitCoverage=76%, E-value=5e-13, Identity=28%"; Hit description =COG0181: Porphobilinogen deaminase
MTATHTLTERYISATIQSLPPETQNDVRAELEASIADAIEARLDQGETPEEAERAVLTELGDPGVLAAGYADRPLYLIGPRFYLAWWRLLKLLLMIVPVCVLGAVALGQVISAAPVGEVISSSILATGGAILHICFWTTLVFVILDRSGSTSALQHWDVDPLPEPHAQGGAGGNELIASLAFLGIAVGALIWDRFRGFVLVDGEALPILNPGQWPWGIGVLLLIMAAEAVLAVVLFQKRRWTT

SEQ ID NO: 183010 - protein, 36 aa, Glycine max
  Coding DNA Sequence Number=SeqID_66232
MEDEIVGGIGVVYALEASWLRVPVDADEEFFESVDW

SEQ ID NO: 183011 - protein, 77 aa, Glycine max
  Coding DNA Sequence Number=SeqID_66233
MAFFLSYLDYKAQNAQVSNGLRNGNVAHITDIFSKIPTVRSWKWCYTKREISVLSAVVVFNQAQHTTSAKLKSTHSR

SEQ ID NO: 183012 - protein, 327 aa, Glycine max
  Coding DNA Sequence Number=SeqID_66234
  Gene Ontology: Mol. function=nucleoside-triphosphatase activity; Cellular component=intracellular; Biological process=protein transport
  Homolog annotation: Hit_ID=O48566; Match level="QueryCoverage=100%, HitCoverage=55%, E-value=1e-137, Identity=79%"; Hit description=CLP protease regulatory subunit CLPX precursor
  Pfam annotation: Domain name=AAA; Domain location=47-263; Score= -29.3; E_value=0.035; Accession=PF00004.19; Description=ATPase family associated with various cellular activities (AAA)
  Pfam annotation: Domain name=AAA_2; Domain location=43-252; Score =168.9; E_value=1.3e-47; Accession=PF07724.4; Description=ATPase family associated with various
  Pfam module annotation: Pfam domain module=AAA::AAA_2; Domain location=47-263::43-252
VLSVAVYNHYKRIFNETSLPKWPAGDSDNSVKVDAADDDRVELEKSNILLMGPTGSGVDIYANSEHREVEIYIQNISFYQIQSALKAGYVGEDVESILYKLLMVADYNVAAAQQGIVYIDEVDKITKKAESLNISRDVSGEGVQQALLKMLEGTVVNVPEKGARKHPRGDNIQIDTKNILFICGGAFVDLEKTISERRHDSSIGFGAPIRANMRTGKVTEAAVASSLLETVESSDLIAYGLIPEFVGRFPILVSLSALTENQLIQVLSEPKNALGKQYKKMFQMNGVKLHFTENALRSIARKAISKNTGARGLRSILENVLVDAMYE

SEQ ID NO: 183013 - protein, 196 aa, Glycine max
  Coding DNA Sequence Number=SeqID_66235
MIDPNFVVERSQFYRLRINAGDGMEVNMAFDGGGHFDGKKRKKKLWAMPWDNDHGFWARREGEKRLRTDLWNALHFLLHAPPNYMNGQNYPSPECPSTPTPSTNTLPSYEAFVHGWQDGVIWMMGGRLVVQCDVDDVVSFARPRKRIVDVGVGQLQQQCLGQQWYWPLGGGGNCLVEEAIACLLIDWVFDGIRSIS

SEQ ID NO: 183014 - protein, 83 aa, Glycine max
  Coding DNA Sequence Number=SeqID_66236
MKFNYNKKKADYLKYLAQSSSDATQAQIAPDRFACISLFCHCKNLPKKASVRVEKLQQVEHVIGGTMMCLLKKVITHKIYERF

SEQ ID NO: 183015 - protein, 135 aa, Glycine max
  Coding DNA Sequence Number=SeqID_66237
  Homolog annotation: Hit_ID=Q9M3A6; Match level="QueryCoverage=72%, HitCoverage=19%, E-value=7e-12, Identity=40%"; Hit description=SF16 -like protein
MSDLILRTIDPTIQLSYHPPPSHHSSPSSCASHKENKEEQWQQHVAPEEVSVEHFPAESSPDVINEGSATSSTPVTEDRNHAVAFAAATAAAAEAAVAAAQAAARVVRLAGYGRQPKEERAAILIQSYYRGYLSL

SEQ ID NO: 183016 - protein, 246 aa, Glycine max
  Coding DNA Sequence Number=SeqID_66238
  Gene Ontology: Mol. function=ATP binding
MTPFFICKVEKKILIMKIFMILFCKVYLQNQCFTIGKSDSSSKATIGDMDNPNPTNDEEVNKQILQHEKSAAGILCQLRIHHGAQASHLTLTKDVVGIVATLGKVEDDILSRLFSEYLGVETMLAIVCRTYEEVKALEMPYAGNYMLEDAQRKLDILIPRLPNGELPSGFLGYAVTMINLDSSNLFCVTPSGYGLRETLFYNLFSCLQVYKTRAKMIQALPCISEGALSLDGGMVRSCGVFSLGNS

SEQ ID NO: 183017 - protein, 95 aa, Glycine max
  Coding DNA Sequence Number=SeqID_66239
EIGIPGANDNPAAGPDFGWVPQRGNDDVASPNPEAGAWRAPRAPGACVVEHQVPEVCKCEGRCFLAMYMDNGGLDLEEEKQLAEKICSWTVDTLF

SEQ ID NO: 183018 - protein, 220 aa, Glycine max
  Coding DNA Sequence Number=SeqID_66240
  Homolog annotation: Hit_ID=Q9M3A6; Match level="QueryCoverage=83%, HitCoverage=37%, E-value=1e-31, Identity=43%"; Hit description=SF16 -like protein
MKRERALAYAFNCQRQLKQYMHIDPNGDDIGCYNTERERPQLDWNWLERWMSSQQSPNLRPRETLYRTLANATTDDMSEEKTVEMDMAANMGFMNQESYDTSPISNRYHQRQHSAGIPSYMAPTLSAKAKVRSQGPQGPFKQRGSPGPHWNSSTRRSSAIGLGCDSSSSGGPTSAHVSPRSPNPKINEIRLQSRRISGGSPDNVHIEDWALPLGATNGWP

SEQ ID NO: 183019 - protein, 518 aa, Glycine max
  Coding DNA Sequence Number=SeqID_66241
  Gene Ontology: Mol. function=transferase activity, transferring glycosyl groups; Cellular component=chloroplast; Biological process =glucan biosynthetic process
  Homolog annotation: Hit_ID=Q75T80; Match level="QueryCoverage=99%, HitCoverage=80%, E-value=0.0, Identity=90%"; Hit description=Starch synthase I precursor
  Pfam annotation: Domain name=Glyco_transf_5; Domain location=13-269; Score=399.6; E_value=4.5e-117; Accession=PF08323.2; Description =Starch synthase catalytic domain
  Pfam annotation: Domain name=Glycos_transf_1; Domain location=312 -478; Score=23.3; E_value=4.6e-05; Accession=PF00534.10; Description =Glycosyl transferases group 1
  Pfam module annotation: Pfam domain module=Glyco_transf_5::Glycos _transf_1; Domain location=13-269::312-478
TEEEGAKTRVSHNIVFVTSEAAPYSKTGGLADVCGSLPIALAGRGHRVMVVTPRYIHGTPEDLKFAGAVDLDQSTKVFCFGGAQEIGFYHEYREGVDWVFVDHPSFHRPGNPYGDTFGTFGDNQFRFTLLCHAACEAPLVLPLGGFTYGEKCLFLANDWHASLVPILLAAKYRPHGVYKDARSILVIHNIAHQGVEPAITYSNLGLPPEWYGALGWVFPTWARTHALDTGEAVNFLKGAVVTSDRIVTGYSWEITTSEGGCGLHDLLSSRKSILSGITNGIDVTEWDPSCDKHIASNYSADDLSGKAECKISLQKELGLPVRPDCPMIGFIGRLDYQKGIDLIRLAMPELMEADVQFVMLGSGNPIYEDWMRATESAYKDKFRGWVGFNVPISHKITAGCDILLMPSAFEPCGLNQLYAMRYGTIPVVHETGGLRDTVHNYNPYTEESKAESTGWTFSPLTKDSMLAALRYAIQTYNEHKPSWEGLMIRGMTRDYTWVNAATHYEQDIEWAFSDPPYC

SEQ ID NO: 183020 - protein, 227 aa, Glycine max
  Coding DNA Sequence Number=SeqID_66242
  Gene Ontology: Biological process=transport
  Homolog annotation: Hit_ID=Q9LVV3; Match level="QueryCoverage=98%, HitCoverage=99%, E-value=3e-22, Identity=29%"; Hit description =Genomic DNA, chromosome 5, P1 clone:MNB8
MISNPELIHYACIARSETILGQHQSEKEPNMEALAAQCVAQAPPNHTLFSHTVHNRTYTFLIDPPFVFFAISHHSLLKSQTLPFLHCIRSSFRQTLPPSSNNNHHFAPLSFQSQFTSIFQNALHHHHHHHHHQLQASPPPPPPPLNPPPQGLKKKKRPNDAPGTLDVSDDVVSLKPHHQPLNYNHSNKAKHVWKKHVWVLLILDLFVCAVLFVIWLWVCSGFKCMAY

SEQ ID NO: 183021 - protein, 109 aa, Glycine max
  Coding DNA Sequence Number=SeqID_66243
MTSLVSITCWACLSLPLVMGLSKHDGSWVKKGARHVGEEGHDGEDSCLLSKILDRFDGLQTFVGERFDTLELQVDMHFNEIELRITQVEEDVSYIRLSFDLPLPPPPSS

SEQ ID NO: 183022 - protein, 1207 aa, Glycine max
  Coding DNA Sequence Number=SeqID_66244
  Homolog annotation: Hit_ID=Q8LDQ4; Match level="QueryCoverage=32%, HitCoverage=98%, E-value=1e-138, Identity=63%"; Hit description=PP2A regulatory subunit TAP46
  Pfam annotation: Domain name=TAP42; Domain location=4-385; Score =469.4; E_value=4.6e-138; Accession=PF04177.3; Description=TAP42-like family
MEDVPLPALFEQARKIHNSATATASAADQVVKKGCEALHRCEDMVNNLGLFSPNETKEDISTTNLKYILVPFYLAELTEKLAQDDRIHILKASQAKLKEFISFCEAMELVPKEELESYIEGASKTVADQRARKIARFKRQRAAESKLLEIKEQKERRGRSTKAAALSTPVEAGEEEVLDDDGEEEREAWITTISLAICKALDLLDMLKKEEEMLSAVKDRQSKDGDKEFSKDVLDERAKKAEAWHHDSAVRARYTKPSSPITCATFAQDVLEGRAKASQAHDHKHQPLIFGPASLVNGNITTERERMAAQVFQPSHRMPTMSIEEAGLKEMEIMNKWQERNVRLMEEANSSWHNDRKSKPGEDDDEDDAAQEKARAWDDWKDDNPRGAGNKRLTPCGGARESDLTGMGEKEVSVLDRVSCDNKSDTESMYPMYFGVSCAFFALQVLTEEPQVEVERWSKIRDTMLQGSAQLLGLVVWKLQKGMPNGVEGLCKLKIAEREIENLKRMRHEDAKANEKVVGIFAAQEQSWLSERRRLRQQIGALLSELRVLERNKDAAISEMNQKLKEMQALVESRDNEIEKEEQKRKELEEKLNKVERDAEEMRESARREAQEHSSDLRKHKTAFIELVSNQRQLEAELGRTVKQVEATRQELALAAENKEESDLMAQKLSLEITKFHKDLEQKDKILSAMLRKSKLDTAEKQMLLKEVKLSKARRKQAEQETQRWKAVSEGKHERHSLKSMLVNLSSRMDVFPGSRGMQHSFTGSSHIANEPDQLSPFPDHYLQQRNGDLSIPANAKRLEDWVRAEAERYATLIEQRHHLELDAFAEQLRLKDEKLEAFRWQLLRTELEMKQMRAHVEGQVKDVTQLRHDKMRLETLLLEREDELTSLKEQFVSKLRPLKNNSNLPPQSSELAQYAVWSRVKVVKRKPGEKVLETMETLVEEDCEKEVQCLPHDQLNSANLLVQSQENEIEEEKGVSREDSPTPMQNQSPNKVEADASEKIASTSQTLSTTKQSLWKMDLHALGISYKIKRLNQQLVLVERLTGRQANDEQAEINYDSKVGMKAYLSLTTLLNKQVGRYQSLQEKTDDLCKRMHENDLYANRGDVNAAREKEKTSTLEHFLEETFQLQRYIVATGQKLMEIQSKIVSGFVGVAEEMEKGSGIDMNRFADSIRNLFHEVQRGLEVRTARIIGDLEGTLAREGMTCLRR

SEQ ID NO: 183023 - protein, 99 aa, Glycine max
  Coding DNA Sequence Number=SeqID_66245
MQWNELSVSYLSEDKCIMHQNWVLLNLEAYALLSICNGISGFCAKCSLISEKEEHLGASGKEKEQLTSDDDVGVILRRKAATELRLRFHGGGGGGSLNL

SEQ ID NO: 183024 - protein, 120 aa, Glycine max
  Coding DNA Sequence Number=SeqID_66246
MVRIRGLHRALGRVLGRVLGRHIASDEEEAPRRRRPIAFAHSQQPVIAVAEDVDHVDHVANGVHEQPQEPVTNHKRTELKLVSHGRNVEKFGRLAPEIEGIVAATRLISMITCSLEIGDN

SEQ ID NO: 183025 - protein, 82 aa, Glycine max
  Coding DNA Sequence Number=SeqID_66247
MVHTAYIGTCRAQPDKYKQKASMADFAMDRIEAAIAELTSSQLKFTAVVDTMPTKLDDLLQRLALRNATQHFPSSSSEQSPP

SEQ ID NO: 183026 - protein, 95 aa, Glycine max
  Coding DNA Sequence Number=SeqID_66248
  Subcellular localization annotation: CTP_CleavageSite=29; ConfidenceScore=5.20e-01
MVPNKTRQQPMKAHSGNGYCSPMNKARPKAEGGGSSVTCRVCELLLRKRALCGVAAAKQNTAWGSAKHMQTEPNKAIIASPKKKHGGEAARGCVM

SEQ ID NO: 183027 - protein, 236 aa, Glycine max
  Coding DNA Sequence Number=SeqID_66249
  Gene Ontology: Mol. function=chromatin binding; Cellular component =chromatin; Biological process=chromatin assembly or disassembly
  Homolog annotation: Hit_ID=Q1SAV4; Match level="QueryCoverage=52%, HitCoverage=39%, E-value=9e-37, Identity=59%"; Hit description =Integrase, catalytic region
MVGGIVAPFRKAEESAPFGRFVVDKAAESSRRNLLTKIGSRSEIRLRGNPWSLETSPMKSWAAVWAMKWDDKDPKWGPFENRSTTVIMTVAPCELGSPVMKSRAKSSQGHDGGGIGWRRPAGFWEKRDEGIGSINPYAPLVKQEVVSDLKLRALQRLVAIAIHKVMEFLRCIGVRVRPPPHYCALPCIGLCNCSKGVSRDTHAVLESPQDDKRMAQEILTPTFHGSGNGVQFMDIC

SEQ ID NO: 183028 - protein, 247 aa, Glycine max
  Coding DNA Sequence Number=SeqID_66250
  Gene Ontology: Mol. function=chromatin binding; Cellular component =chromatin; Biological process=chromatin assembly or disassembly
  Homolog annotation: Hit_ID=Q1SAV4; Match level="QueryCoverage=90%, HitCoverage=58%, E-value=6e-51, Identity=49%"; Hit description =Integrase, catalytic region
  Pfam annotation: Domain name=Chromo; Domain location=174-223; Score =24.3; E_value=0.00044; Accession=PF00385.14; Description='chromo' (CHRromatin Organisation MOdifier
MEQIPQPCGMVLQYLLPFFHWLISIRGHVRETAARNSRLPPWFFRRQGRRLPSHFLPRYVQRPPPELERSQARMKNSADHHCRQANFAVGYWVYVKLRPYRRTSVADKFQKLRKRFYGPYQITELVGKVAFHLASPPTAMIHPVFHCSKLMPHHGPLVTAQSLPPSSWDNNPVIEPLVILDHKWDDQDPSVLSVLVQWVGVQPEDATWENWADLQGIYHLVDKVLPEGVGDRVAATRPKRTIKRPLS

SEQ ID NO: 183029 - protein, 220 aa, Glycine max
  Coding DNA Sequence Number=SeqID_66251
  Gene Ontology: Mol. function=protein transporter activity; Cellular component=nuclear pore; Biological process=protein import into nucleus, docking
  Homolog annotation: Hit_ID=Q9LHS4; Match level="QueryCoverage=95%, HitCoverage=18%, E-value=1e-47, Identity=46%"; Hit description=RAN binding protein 16-like
MQIQTQYETQYLMVENEWKWIQMAAEKPEGTEGAETELGGGIWESEGAGATKGGDSVYYLLNLWSRSVTSVRYLKSDKPNLLDEYVPKVIEGFVSSRFDSLQSELSDELGENPLDNVEVLQDQLEFFPFLCRFQYESCSSYLMKIVEPIMKSYMNEIHVDSYELSVTESKLAWFTHIVAAILRTKQISGSSGESHEILDAEISACVLQLINICDSGFHSK

SEQ ID NO: 183030 - protein, 83 aa, Glycine max
  Coding DNA Sequence Number=SeqID_66252
MAVGEVVEVDHEMDELHRLDRARIIVKTPLLPLIQHKVSAWINGVEYTVHMAEETWTQMAIEGVILETDPSEEDTLPSTDGDE

SEQ ID NO: 183031 - protein, 78 aa, Glycine max
  Coding DNA Sequence Number=SeqID_66253
MSYSLWYPLEEEEEEVVEEEGAEEGTEVAGTIILGAGRLPTRWNLYNQWQFQIKNCGLEKSQQPSMYTGIYLNSTNFI

SEQ ID NO: 183032 - protein, 170 aa, Glycine max
  Coding DNA Sequence Number=SeqID_66254
MAFAPSNFVSQPFPNSVAEKLDDSNYLHWHQHVEPAIKSHKLQRFVVNVVVPSRYLTEDDRIVDRVNPEYETPGRFKTKRFLFGTDVSFQPHESLTLFDPTTMHPIPYSAGPPRTSNTWVNPNSKSTGSVHNQPSAMLTNLASHGTAPAGSTWIPDSGASFHVIGDSQNI

SEQ ID NO: 183033 - protein, 111 aa, Glycine max
  Coding DNA Sequence Number=SeqID_66255
MVRFHESEGEGTGVRCCGGGCLWHTRYAVLGAFWCMAGCADQMNEDHWMYEGIIPEEMDMNYENEEECGVNEPHVDCSDAFNTSQVFDSRDDVLRWARSVAYEHGFVTVIV

SEQ ID NO: 183034 - protein, 509 aa, Glycine max
  Coding DNA Sequence Number=SeqID_66256
  Gene Ontology: Mol. function=nucleic acid binding; Biological process= DNA integration
  Homolog annotation: Hit_ID=Q1S7C5; Match level="QueryCoverage=53%, HitCoverage=22%, E-value=2e-42, Identity=38%"; Hit description =Integrase, catalytic region
  Subcellular localization annotation: CTP_CleavageSite=45; ConfidenceScore=5.57e-01
MASAKKIQSPPPSSISLTLVEDSSIPVTRTLTPVMEFSTAVPQPFLMMVPQPQPFPTMTLEVVTPLQSFCIPTAIPATVTSLSSQPSSFSHAISAKFTNSNYLLWCKQVEPVLKGHRLHHFLVNPTIPSQFRTLADRDLGISSPKYLAWESQDQLLLSWLQSMISPEALPRLLGCRTSWHLWDSYHSHFCSSIRAKTRQLRTEFRNMQLQNKSVSEYLLQIQTIVDPLGSIGVTISSNQQPDVILEGLPRDYESTKSLICSKFETLSIDEVETLVLGHEARLDRFQKHDSQISINLTQGASSSSAVNFSQGASTSNSTAYAQPVQVQKSLPSSSNGSSSTQTFDAQAHLTRGNYNNFNTSNNGNNAKMVTDFLILAKVDMAMEAAMEEEAMLVEEMVEVVVGLPMFNAKFVTNFAMKLPFATIAMKKIVLLHSPWFMKTHKPLLHHSKLLHSASCNLATSITTSFFCSTVYAVHGSFSILLPSNALCAKCWNPSHHCSFSSFSSQHSYC

SEQ ID NO: 183035 - protein, 44 aa, Glycine max
  Coding DNA Sequence Number=SeqID_66257
MHEMALRKLPSKRSRKDTTEEGSNAASQADTDFDRHQFRSAEHQ

SEQ ID NO: 183036 - protein, 195 aa, Glycine max
  Coding DNA Sequence Number=SeqID_66258
MTLLLSNILPSDLNSDLPLPKCQLVYAILTQDGTYETPYGLGEVQQGLGVPSSDHGPLLVLRSVRRPQQGHSVSHYQSLHQEVLHPQAGAKPSIAVARGGSAASGTYATAATRGSTVSKAANHKGQGRLNETFYRYNLHQQSQDPSLFPWLAPEAVRGHGGLAWERDQVGTKPSTIRTWQTCWISSSEKDMVDML

SEQ ID NO: 183037 - protein, 346 aa, Glycine max
  Coding DNA Sequence Number=SeqID_66259
  Gene Ontology: Mol. function=methyltransferase activity; Biological process=metabolic process
  Homolog annotation: Hit_ID=P67087; Match level="QueryCoverage=44%, HitCoverage=54%, E-value=2e-70, Identity=85%"; Hit description =UPF0011 protein yraL
  Pfam annotation: Domain name=Multi_Drug_Res; Domain location=255-323; Score=32.7; E_value=9.7e-07; Accession=PF00893.10; Description=Small Multidrug Resistance protein
AAGLPSDRFCYEGFLPAKSKGRCDALRALSDEPRTLIFYESTHRVLDTLQDMVSVWGAARYVVLARELTKTWESLYGAPVGELLAWVQADENRRKGEMVLIVEGHKADEETLPAEALRTLALLQAELPLKKAAALTAEIHGVKKNALYKYALEQQEAVPGNAWGAQAYDQCNREQTADGPVMGSGKGERVRVRAAPHPNLLPQAGEGTDCAWDELSIRPPTPHLTIPSPRGRGLGYHAAVCAWMAFISHRREIMLYWILLALAIAAEITGTVSMKWASVNGGSAGYIFMLLMIALSYIFLTFAVKRIALGVAYAMWEGVGAVGDEGGGFDHADRGYRADQSGDIQP

SEQ ID NO: 183038 - protein, 107 aa, Glycine max
  Coding DNA Sequence Number=SeqID_66260
  Subcellular localization annotation: CTP_CleavageSite=42; ConfidenceScore=5.23e-01
MRMSPPPLEPHNHSQTHLKLSGRLPLQALFSAGGLVGAFALSATMDRSALISGFWLSAYFSRSTDGLKWCASLDEPSLSEHGKLILLPDFSSRSTKGVLRSADGSLS

SEQ ID NO: 183039 - protein, 71 aa, Glycine max
  Coding DNA Sequence Number=SeqID_66261
MGVAGKEGEDNTIGRYHKLEDKDQEEKKVRIERRKKGEECGRNSYVEGVGVALIIGALLEILIVFVVCVSA

SEQ ID NO: 183040 - protein, 93 aa, Glycine max
  Coding DNA Sequence Number=SeqID_66262
MARTHIPQWDRDDLHVILLKFQPARINWTFAPYALRSYSAQWNAPGLLHDKHTLFSSRILGKMEVEEPWLGLWLPLNYQVDMGASQHRTPELG

SEQ ID NO: 183041 - protein, 65 aa, Glycine max; identical to SEQ ID NO: 118620
  Coding DNA Sequence Number=SeqID_66263
  Homolog annotation: Hit_ID=Q1SGR1; Match level="QueryCoverage=71%, HitCoverage=5%, E-value=2e-17, Identity=91%"; Hit description =Kinesin, motor region; Prefoldin

SEQ ID NO: 183042 - protein, 142 aa, Glycine max
  Coding DNA Sequence Number=SeqID_66264
  Gene Ontology: Mol. function=binding; Biological process=embryonic development ending in seed dormancy
  Homolog annotation: Hit_ID=Q1SPH8; Match level="QueryCoverage=99%, HitCoverage=28%, E-value=2e-53, Identity=77%"; Hit description =Tetratricopeptide-like helical
DTVGGGGRVHGSVVEELFVVFEGRVGFAAIEVGLEYEVVCDDVGDHAGLRDEAMEGEEVGVAGLAEEGGEDGVDREDGGAAVGVDRVARVQRRLVEGLGSRVRIGASARFGYGLGRRGEVPCGAGACGGGAPRRPPPGRRMK

SEQ ID NO: 183043 - protein, 392 aa, Glycine max
  Coding DNA Sequence Number=SeqID_66265
  Gene Ontology: Mol. function=binding; Cellular component =mitochondrion; Biological process=embryonic development ending in seed dormancy
  Homolog annotation: Hit_ID=Q1SPH8; Match level="QueryCoverage=73%, HitCoverage=62%, E-value=1e-126, Identity=52%"; Hit description =Tetratricopeptide-like helical
  Pfam annotation: Domain name=PPR; Domain location=106-140; Score =21.4; E_value=0.0032; Accession=PF01535.11; Description=PPR repeat
  Pfam annotation: Domain name=PPR; Domain location=142-176; Score =41.4; E_value=3e-09; Accession=PF01535.11; Description=PPR repeat
  Pfam annotation: Domain name=PPR; Domain location=177-211; Score =32.1; E_value=2e-06; Accession=PF01535.11; Description=PPR repeat
  Pfam annotation: Domain name=PPR; Domain location=212-245; Score =24.3; E_value=0.00043; Accession=PF01535.11; Description=PPR repeat
  Pfam annotation: Domain name=PPR; Domain location=246-279; Score=3.3; E_value=3.1; Accession=PF01535.11; Description=PPR repeat
  Pfam annotation: Domain name=PPR; Domain location=32-65; Score=15.4; E_value=0.11; Accession=PF01535.11; Description=PPR repeat
  Pfam annotation: Domain name=PPR; Domain location=66-100; Score=35.4; E_value=1.9e-07; Accession=PF01535.11; Description=PPR repeat
  Pfam module annotation: Pfam domain module=PPR::PPR::PPR::PPR::PPR::PP R::PPR; Domain location=106-140::142-176::177-211::212-245::246 -279::32-65::66-100
MLGHTRVSDGDGVLRLYEELRERLGGVVEDGVVFGCLMKGYFLKGMEKEAMECYEEVLGKKKMSAVGYNSVLDALSKNGRLDEALRLFDRMMKEYEPPKRLSVNLGSFNVIVDGYCGEGRFEEAMEVFRKIGEYRGCSPDTLSFNNLIERLCDNGRIVEAEEVYGEMEGKGVSPDEFTYGLLMDACFRENRADDSAAYFRKMVDSGLRPNLAVYNRLVDGLVKVGKIDEAKGFFELMVKKLKMDVASYQFMMKVLSDEGRLDEMLQIVDTLLDDNGVDFDEEFQEFVKGELRKEGREEELTKLIEEKERLKAEAKAKDIEAAEAAKRSARAAVASLLPSKLFGNKETDSESKTEGEIQALGEESANATASEAELAEKTTETEGDRASEQLTG

SEQ ID NO: 183044 - protein, 270 aa, Glycine max
  Coding DNA Sequence Number=SeqID_66266
  Gene Ontology: Mol. function=zinc ion binding; Cellular component =nucleus; Biological process=ubiquitin-dependent protein catabolic process
  Homolog annotation: Hit_ID=Q1EP48; Match level="QueryCoverage=88%, HitCoverage=78%, E-value=1e-135, Identity=93%"; Hit description =Ubiquitin ligase SINAT5-related
  Pfam annotation: Domain name=Sina; Domain location=48-247; Score =445.2; E_value=8.5e-131; Accession=PF03145.7; Description=Seven in absentia protein family
MLQVGYVTELQDVVVFRMQNIVMPVSWLDALSRVHNRCPTCRQELGDIRCLALEKVAESLELPCKYYSLGCPEIFPYYSKLKHETVCNFRPYSCPYAGSECSVVGDIPFLVAHLRDDHKVDMHTGCTFNHRYVKSNPREVENATWMLTVFHCFGQYFCLHFEAFQLGMAPVYMAFLRFMGDENEARNYSYSLEVGANGRKLIWEGTPRSVRDSHRKVRDSHDGLIIQRNMALFFSGGDRKELKLRVTGRIWKEQQQQNSEAGVCMPNLCS

SEQ ID NO: 183045 - protein, 123 aa, Glycine max
  Coding DNA Sequence Number=SeqID_66267
  Gene Ontology: Mol. function=receptor activity; Cellular component =outer membrane-bounded periplasmic space; Biological process =glycolysis
  Homolog annotation: Hit_ID=Q0K2A5; Match level="QueryCoverage=99%, HitCoverage=36%, E-value=7e-35, Identity=52%"; Hit description =Probable extra-cytoplasmic solute receptor precursor
  Pfam annotation: Domain name=Bug; Domain location=1-120; Score=-90.6; E_value=2.8e-05; Accession=PF03401.5; Description=Bordetella uptake gene (bug) product
MVFDPILVPMQYVKQNRLKALGFTGKQRWPTEPSIPTMEEAGMPGFVTGSWAGLMAPANTPRPIIERMAREISEIVQEPDVRQKFLDAGFLPASGTSAQFAELMKQDSARYAGIIKQARITVD

SEQ ID NO: 183046 - protein, 126 aa, Glycine max
  Coding DNA Sequence Number=SeqID_66268
MPICRNSLPNNTSFPIVRYSVLTILYYLCDPMASRKRKAPSTPTQARFDISRFTSQEAWERYTDIVVPRKLLPERKVVVYYTEFEEFKEELKKCHWDEELIDFVDGNIDVAIVKEFYANLYDPKDK

SEQ ID NO: 183047 - protein, 84 aa, Glycine max
  Coding DNA Sequence Number=SeqID_66269
MHTHTHAYCCDKTGAESSRATVKGRGKVKDRKPIKVLRNGRKWRIGSRLTDRRPFLALDKQRTSLQGSPVSFEFTVIITIVCFK

SEQ ID NO: 183048 - protein, 92 aa, Glycine max
  Coding DNA Sequence Number=SeqID_66270
PRVVPQPPQTNIPHVPEPGAPSTSARPAVEEPRHAVEVCHWIAERLERHLSLGVVTPGSSTHEVIEECLRMARSVTQDQLAYIRFRRRRHTD

SEQ ID NO: 183049 - protein, 89 aa, Glycine max
  Coding DNA Sequence Number=SeqID_66271
GVCSEALDSHLKVVSLAIGEHPLQASYPRHMLGGEAPSSMAYSLLDGASRLLFSFAFRCISMGGFVSEKMRKRGGDDVLVMRVQGEGRE

SEQ ID NO: 183050 - protein, 294 aa, Glycine max
  Coding DNA Sequence Number=SeqID_66272
  Homolog annotation: Hit_ID=Q1SKD7; Match level="QueryCoverage=33%, HitCoverage=26%, E-value=4e-09, Identity=34%"; Hit description =Ankyrin
MAPRKLASKRSRKDKAAEGTSSAPEYDSHRFRSVVHQQRFEAIKGWSFLRERRVQLRDDEYTDFQEEIGRRRWAPLVTPMAKFDPEIVLEFYANAWPTEAAGPMTSRDQVWSFCTHDTRRYLMVIRTLLSSRGGGPDDKAETKFGHSAPMIRGDTLWLFAPFCHPEAAGPMTSRDQVWSFCTHDTRRYLMVIRTLLSSRGGGPDDKAETKFGHSAPMIRGDTLWLFAPFCHPEAAGPMTSRDQVWSFCTHDTRRYLMVIRTLLSSRGGGPDDKAETKGGGPDDKQRPSLVILHP

SEQ ID NO: 183051 - protein, 91 aa, Glycine max
  Coding DNA Sequence Number=SeqID_66273
IARARHTVDPKKSNRVLRFPTLIMGVCQFYRVPVAPSKVIRPPTNLAFIKKYCAPRQAQGETPQQPGDGQQRAIDALPPPLEFTSAHPQKG

SEQ ID NO: 183052 - protein, 35 aa, Glycine max
  Coding DNA Sequence Number=SeqID_66274
MKRLKSSLHAKSDQVAPHWIELKWFGDGTPLAWRP

SEQ ID NO: 183053 - protein, 92 aa, Glycine max
  Coding DNA Sequence Number=SeqID_66275
  Gene Ontology: Mol. function=triacylglycerol lipase activity; Biological process=lipid metabolic process
  Homolog annotation: Hit_ID=Q1S2A7; Match level="QueryCoverage=94%, HitCoverage=30%, E-value=1e-36, Identity=80%"; Hit description =Lipase, putative
VLEEEPNKNYFSLFWVIPKILNAVWELIRGFLIPFIEGRDYIQNWFMTIFRLVGLIIPGLPAHLPTDYVNVTRLGSLNKSLELQNSQDSKAD

SEQ ID NO: 183054 - protein, 191 aa, Glycine max
  Coding DNA Sequence Number=SeqID_66276
  Gene Ontology: Mol. function=methyltransferase activity; Cellular component=nucleus; Biological process=metabolic process
  Homolog annotation: Hit_ID=Q2HU54; Match level="QueryCoverage=98%, HitCoverage=27%, E-value=2e-91, Identity=82%"; Hit description=SAM (And some other nucleotide) binding motif; WW/Rsp5/WWP
  Pfam annotation: Domain name=Methyltransf_11; Domain location=56-153; Score=7.3; E_value=0.01; Accession=PF08241.2; Description =Methyltransferase domain
  Pfam annotation: Domain name=UPF0020; Domain location=46-188; Score= -52.9; E_value=0.011; Accession=PF01170.9; Description=Putative RNA methylase family UPF0020
  Pfam module annotation: Pfam domain module=Methyltransf_11::UPF0020; Domain location=56-153::46-188
MPEVYSAAVGKYWCQRYSLFSRFDDGVKLDEEGWFSVTPEVIARHQAIRCASGVIIDGFTGVGGNAIQFAQQCRHVIGIDIDPLKIEYARHNAAIYGVDDQIEFVVGDFFHLAPMLKADTVFLSPPWGGPDYVKAATYDLKTMLRPHDGYTLFNVAKEIASRVVMFLPRNINFNQLAELSLSSCPSWSLEA

SEQ ID NO: 183055 - protein, 546 aa, Glycine max
  Coding DNA Sequence Number=SeqID_66277
  Gene Ontology: Mol. function=protein binding; Biological process =negative regulation of macrophage differentiation
  Homolog annotation: Hit_ID=A0EXR2; Match level="QueryCoverage=84%, HitCoverage=91%, E-value=1e-162, Identity=64%"; Hit description=Cold- induced protein
MEDGDTTEEAVVVPVSIGDEQPFPHSLSRHRDSEEESPHETLRDTKASIENIVAEILSLKNQGKPKPLLTLRLRELLTQTFLHFVTLRQANRSILMEEERARTETERAKAPLELATHQLQNLTYEKSQFVKAIKACNDSKSKYPDIEVVSEEEFFRDAPQDMKDSVLSNHSEHNVVLKRLNFELFQRKELCKLGDKLEQKRKTLLETIASRKKFLSSLPSLLKSLKKASLPVQNQLGVQHTKKLKQHHSAELLPPPLYVIYSQLLAQKEAFGESIDVEIIGSVKDAQAFAHHQAHKETGIFITVESPKLENDEPNEEDGQRQSKRPRRFQGKESLDQEGIFQIHPLTVNLHVYDDEISDLESAKLTTLKFEYLMQLNIICVGNKASNDGPENDILSNLFPDDTGLELPHQSAKLFVGDAIMFNGDRTSRPYKWAQHLAGIDFLPEVAPLLLASRETSDSDEAAKEAIANANNDYEIEGSNIECPILNSKIVVNIGAIIDLSSRVGKEQKTAMEVAMEDVNRQSCYKLALNFNNNTHGNPSPTILAA

SEQ ID NO: 183056 - protein, 507 aa, Glycine max
  Coding DNA Sequence Number=SeqID_66278
  Homolog annotation: Hit_ID=Q2HU54; Match level="QueryCoverage=86%, HitCoverage=62%, E-value=1e-139, Identity=60%"; Hit description=SAM (And some other nucleotide) binding motif; WW/Rsp5/WWP
  Pfam annotation: Domain name=WW; Domain location=312-342; Score=24.5; E_value=0.00037; Accession=PF00397.16; Description=WW domain
MVIVDSDYEGAAIEALGSLFKVTQVFLWDDGLQVSSSAERWKLDEADDNHGSDPVPGKKFVFSAADLIDLITPEDLELTKQLNELGLPLSFQTNKEKNGPVKGKKKGKLLKHPNTCHNPVDETLYEVSGEEIVSPAKFHDKTSSPLSCISMLGQSESSFLEGAMDIDMTQCAYGEGANSACCTGFASGVCREINNDNINQVATNDDQDDDFLISNDRVDLKTAPASDTGVSAGSHLKGAGVNYCGTEYDESLIDSECLEVSPIVGKNTDCDTIYNDDGAATCHPHSIESELHPVSSEGIECDRNDVSNNYAEHGDWMVVWDTFYERTYFYNIRTHTSTWDAPSGMEHLATGRYTESDDSKTLKASEEWGIQNSTKPPEETLIEENLEVKQHEEYLTESGVAVGNLVSDITTHGEDQSLNHSDGCHERSSCNDGVSCCLISNTLDHINSSNEGCIQAASEDNHTPLENMLIDMSGLDSKSDPFESKQGKKVKRRQRQRKLYNEAEGLC

SEQ ID NO: 183057 - protein, 238 aa, Glycine max
  Coding DNA Sequence Number=SeqID_66279
  Gene Ontology: Mol. function=ionotropic glutamate receptor activity; Cellular component=membrane; Biological process=ion transport
  Homolog annotation: Hit_ID=Q69L11; Match level="QueryCoverage=84%, HitCoverage=24%, E-value=1e-23, Identity=34%"; Hit description =Putative Avr9/Cf-9 rapidly elicited protein 141
MQGVVGCKTNFMEMSETFKRFKFMFRRKFGLEYPEEENSQLPSIFALRAYDAVWTITHALKKSQGNFSLSENILHSNHEGLSGKISFKDKMLLEPPTFKIVNVIGKGYKELANWSPGSGFSENLVENMVVNTRRTSRAGSARVLLGSVDWPGGLKTVPKGWVYNSTEGRPLKIGVPAIDPCPQFVNVSHDKRLNETQFTGFSINVFESVVKRLPYHLPFVFVPFYGSYDQIVEQVNNK

SEQ ID NO: 183058 - protein, 194 aa, Glycine max
  Coding DNA Sequence Number=SeqID_66280
  Gene Ontology: Mol. function=ionotropic glutamate receptor activity; Cellular component=membrane; Biological process=ion transport
  Homolog annotation: Hit_ID=Q84QE2; Match level="QueryCoverage=91%, HitCoverage=19%, E-value=8e-31, Identity=35%"; Hit description =Avr9/Cf-9 rapidly elicited protein 141
  Pfam annotation: Domain name=Lig_chan; Domain location=1-194; Score= -53.7; E_value=2.2e-07; Accession=PF00060.17; Description=Ligand -gated ion channel
MWMLMAVMHLFIAFVIWFIEGENNSELKSLGAILWFSVTTLFFVHREPVKSNLARAVLAPWLFAILIVTSSFTASLSSMMTVSHLEPSVPDIQTLLRTNAIIGCNKNTFLVHYLVDELKFQPENIRVFDSIHDFPRAFENKEIVASFTIAPHADVFLATYCKGYIKAGPTLKLGGLGFVSFSSISFPYNCHPTC

SEQ ID NO: 183059 - protein, 161 aa, Glycine max
  Coding DNA Sequence Number=SeqID_66281
  Homolog annotation: Hit_ID=Q2PMM5; Match level="QueryCoverage=94%, HitCoverage=8%, E-value=2e-71, Identity=76%"; Hit description =Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMGTWSELHLSSNPTERSTRDQKLLKKEQKKHLCSFQAIGK

SEQ ID NO: 183060 - protein, 148 aa, Glycine max
  Coding DNA Sequence Number=SeqID_66282
MASRKRKATTLASRDGYDRSRFVSQEAWDRYLDNVLARNILTETNVKLYINEFDDFRRELIRRNWHKKLTNLTERSIDVAIVMEFYENLYVPDDKFPKQVRVRGHLIKFDVNSLNTFLETPVVVEQGESLPFYSRFAILRPNPQELAA

SEQ ID NO: 183061 - protein, 69 aa, Glycine max
  Coding DNA Sequence Number=SeqID_66283
  Subcellular localization annotation: CTP_CleavageSite=42; ConfidenceScore=5.15e-01
MEFPSSSYSSIFSPRPSNDTIFYDVYPDSLTTTTTTTLHTTRKMLISDGQNMSARMKIRQTKICWSYHR

SEQ ID NO: 183062 - protein, 95 aa, Glycine max
  Coding DNA Sequence Number=SeqID_66284
  Subcellular localization annotation: CTP_CleavageSite=32; ConfidenceScore=5.64e-01
ANALTPTAPTPSPKAGYLPEYNKRKAKKRRKRRMQKKVGTRFVGSTPLSKRSVGIRLYRTELSSHTYNLRCSPVSLLSYSTALGTDARLSAFHRY

SEQ ID NO: 183063 - protein, 544 aa, Glycine max
  Coding DNA Sequence Number=SeqID_66285
  Gene Ontology: Mol. function=protein serine/threonine kinase activity; Cellular component=phragmoplast; Biological process =protein amino acid phosphorylation
  Homolog annotation: Hit_ID=Q1RYC9; Match level="QueryCoverage=92%, HitCoverage=96%, E-value=0.0, Identity=86%"; Hit description =Serine/threonine protein kinase
  Pfam annotation: Domain name=Pkinase; Domain location=110-410; Score =281.4; E_value=1.8e-81; Accession=PF00069.15; Description=Protein kinase domain
  Pfam annotation: Domain name=Pkinase_C; Domain location=428-477; Score=41.7; E_value=2.6e-09; Accession=PF00433.14; Description =Protein kinase C terminal domain
  Pfam annotation: Domain name=Pkinase_Tyr; Domain location=110-388; Score=23.4; E_value=6.6e-14; Accession=PF07714.7; Description =Protein tyrosine kinase
  Pfam module annotation: Pfam domain module=Pkinase::Pkinase _C::Pkinase_Tyr; Domain location=110-410::428-477::110-388
MDGYDATVRLGAINLKHGRAADFDSASPDVSVSSPVTRQKAAAAKQFIENHYKNYLQGLQDRKDRRRALQRKVQESQISAEEQEEMMRNLERRETEYMRLQRRKIGMDDFEQLTVIGKGAFGEVRLCRAKGTGEIFAMKKLKKSEMLSRGQVEHVRSERNLLAEVDSRCIVKLHYSFQDSDFLYLIMEYLPGGDIMTLLMREDILSEDVARFYIAESILAIHSIHQHNYVHRDIKPDNLILDKNGHLKLSDFGLCKPLDDKYSSILLENEDLTGQESTSETEAYSVSPWLMPKERLQQWKRNRRALAYSTVGTLDYMAPEVLLKKGYGIECDWWSLGAIMYEMLIGYPPFCSDDPRMACRKIVNWKTCLKFPDEPKISAEAKDLICRLLCDVDSRLGTRGVEEIKAHPWFKGIQWDMLYESEAAYKPTVTGDLDTQNFEKFPEVDGPPSVTASVGPWRKMLTSKDNNFIGYTFKKSDILKSLESSDADIRVNGSLKTPSLITLLGMNSYIYLMHICKACTYAVFLLVPLDGVNNLHVSKFRNHP

SEQ ID NO: 183064 - protein, 198 aa, Glycine max
  Coding DNA Sequence Number=SeqID_66286
  Homolog annotation: Hit_ID=Q9FMM9; Match level="QueryCoverage=74%, HitCoverage=63%, E-value=2e-17, Identity=39%"; Hit description =Arabidopsis thaliana genomic DNA, chromosome 5, P1 clone:MBD2
MAPEWTDEKHSMYIKSIEASFVNQLYDSKQMKTSYDSATTSGQFKVLRGGCWQKINFERVNPQMSRINQCHDLMENPWIQHYRFSSKQRSIVAPSLQESVTTTSNVVDLGQRKGVPSGSGHLHLCESRICHKDMLCSDTEMSDQNFVDEEVKGKKQNKKSKVKRQRSLISDAQSNDQMVPNRKSSSGGDFTKNFVSAA

SEQ ID NO: 183065 - protein, 162 aa, Glycine max
  Coding DNA Sequence Number=SeqID_66287
  Gene Ontology: Mol. function=RNA-directed DNA polymerase activity
MCTFINTLESSWANNQDVKEYWRTFVVLLMWNQFNIALISKFERPTSMRDLKPIALYVMSIGKAGTRLFGKVSIKLLKESFIMLNISLMIGLLPEVWLIPRNLTYLPNFCIAGYFKCNADASFHPQDHKTGMGYCFWDDSGTFVAARTSWSIGPLASSAMGF

SEQ ID NO: 183066 - protein, 42 aa, Glycine max
  Coding DNA Sequence Number=SeqID_66288
MTVDKEVGYKVAIVVTHRPGPSHAQGRKHIGSCKSTKVNYKI

SEQ ID NO: 183067 - protein, 317 aa, Glycine max
  Coding DNA Sequence Number=SeqID_66289
  Gene Ontology: Mol. function=binding; Cellular component=thylakoid; Biological process=photosynthesis
  Homolog annotation: Hit_ID=Q1T1X0; Match level="QueryCoverage=77%, HitCoverage=52%, E-value=4e-42, Identity=36%"; Hit description=IMP dehydrogenase/GMP reductase
  Pfam annotation: Domain name=TPR_1; Domain location=234-267; Score =12.7; E_value=0.17; Accession=PF00515.18; Description=Tetratricopepti de repeat
  Pfam annotation: Domain name=TPR_1; Domain location=268-301; Score =32.4; E_value=1.6e-06; Accession=PF00515.18; Description =Tetratricopeptide repeat
  Pfam annotation: Domain name=TPR_1; Domain location=90-123; Score =16.1; E_value=0.065; Accession=PF00515.18; Description =Tetratricopeptide repeat
  Pfam annotation: Domain name=TPR_2; Domain location=234-267; Score =15.3; E_value=0.22; Accession=PF07719.7; Description=Tetratricopeptid e repeat
  Pfam annotation: Domain name=TPR_2; Domain location=268-301; Score =21.2; E_value=0.0036; Accession=PF07719.7; Description =Tetratricopeptide repeat
  Pfam annotation: Domain name=TPR_2; Domain location=56-89; Score=5.7; E_value=7.2; Accession=PF07719.7; Description=Tetratricopeptide repeat
  Pfam annotation: Domain name=TPR_2; Domain location=90-123; Score =13.2; E_value=0.98; Accession=PF07719.7; Description=Tetratricopeptid e repeat
  Pfam module annotation: Pfam domain module=TPR_1::TPR_1::TPR_1::TPR _2::TPR_2::TPR_2::TPR_2; Domain location=234-267::268-301::90 -123::234-267::268-301::56-89::90-123
MEHREEQVSQKEGERKEPRELWKWKVVATSSSTQIQWFGKKFSEIAKHTYSFDTVFTLRHAFSNSCSVEERFEEALALYDRAIVVNSKKATYHCNKNATLISLGRFLQAIVECEEAIRLEPSCGRPHNRLATIYFRLREAEKALNCNETSPCVDSVLAFQAQALQNHLSKYTEARKVKDWKVILKESQAAISLGADSAPLVSWFEDAVTTSQQASKLDPSSFEVNAVVRRARAVASARMSGNLLFKASKFTEASAVYNEGLEHDPYNSVLLCNRATCHSKLGQFKKAIEDCNVALIVQPSYSKVRLRRTDYNVKVHP

SEQ ID NO: 183068 - protein, 79 aa, Glycine max
  Coding DNA Sequence Number=SeqID_66290
MADGDVDAGEWLHKAQRDRVIYGDTEVSITRGTCLVLASPDERVVTIHLARTGTNLAMVPSARYENICISVIVNVAQVG

SEQ ID NO: 183069 - protein, 70 aa, Glycine max
  Coding DNA Sequence Number=SeqID_66291
LITGLCQFYGVPVTPNKVIRPPINRAFLKRYCAPRQAQGETPQQPGDGWQRATNAPSPPLEFISAHSQKG

SEQ ID NO: 183070 - protein, 124 aa, Glycine max
  Coding DNA Sequence Number=SeqID_66292
TFPGAEKVHAILSWLCNGKKAKEAHEVYVVATEKGKLPLVNVISFLVLKLCGEDETVKSALEILEYIPEEKSERAIKLFLAVVRALCRIKEAGEMGKAVEMTRLMESRGLRPDVYTYIVLASTY

SEQ ID NO: 183071 - protein, 42 aa, Glycine max
  Coding DNA Sequence Number=SeqID_66293
EKRKLGARDTSSTTDILSKIPMTQKFHDDPTVYESGIVVLQR

SEQ ID NO: 183072 - protein, 280 aa, Glycine max
  Coding DNA Sequence Number=SeqID_66294
MKSRRRYNNVRGILMENDFLVGDFSKEEIRQAASLKQNFCGLEANSECKGLYIHQLGGWEGNIWKWRRQWFMSELEEVILSHVIKKNVEDRWEGYDLHCKEGIDECKKQTFMFLWSIIPAPPKETTSHLFFHCKVAYSVWCMCYDWLELKLALPFETVAHCGCGWLLCGVSGICGMTLSLTKYSWTWGKLWTLKFCSWSWLKVKAPGFTTSFYEWCNCPRHILRVDVPSLIQLFDRVLCWRKAKLSLALAIYRVDVEGISPTALTKQLLVSERAGMVSLP

SEQ ID NO: 183073 - protein, 112 aa, Glycine max
  Coding DNA Sequence Number=SeqID_66295
  Homolog annotation: Hit_ID=Q1T2D5; Match level="QueryCoverage=53%, HitCoverage=4%, E-value=2e-12, Identity=58%"; Hit description=Chromo
MFDLMALHHQEYLQHCVEDCKPLKQMEISINSLRLSPLPGGSDLGNSSLVHYFSKCGPTFSNLGAVSHVPWNWSLGRPLLSVPGPHYSSYNNMDPSTSVTQPLFPLQIEPKD

SEQ ID NO: 183074 - protein, 181 aa, Glycine max
  Coding DNA Sequence Number=SeqID_66296
  Gene Ontology: Mol. function=triacylglycerol lipase activity; Biological process=lipid metabolic process
  Homolog annotation: Hit_ID=Q6Z307; Match level="QueryCoverage=94%, HitCoverage=35%, E-value=4e-28, Identity=38%"; Hit description =Lipase class 3-like
MASSEELFGLNYLLLKPQEASAVDLGRLLFSSNLNNRGFIECPREIEAREFRQRWLLFISIVAQKVLVASRNSLKNVGDTLELWLNLLSSNGGLIRLLFKFLTGKMKTPERSSAAFLSVVGITDTRVDLDKTIKENDAKYKGFLSMMASKLAYENEEFVSNAVQNHWDMEFLGSHSFWNGT

SEQ ID NO: 183075 - protein, 199 aa, Glycine max
  Coding DNA Sequence Number=SeqID_66297
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=90%, HitCoverage=11%, E-value=7e-62, Identity=63%"; Hit description=Chromo
MDPALCTLLIVYKHGFATPIGLQPTRSHDHGIPLLEGSNLVKVKQYRYPYSQKEQIKNMVSKMLQEGIIRPNTSPFSSPILLVKKKDGTWRCCTDYRALNAITIKDSFLIPTIDELGGAYFFSKLDLHSRYHQILVRPEDKHKTTFRTHQGLYEWLATMFGLSNPPTTFQSLMSSIFQQQLFHHGSYIWSSRRSVTDFE

SEQ ID NO: 183076 - protein, 50 aa, Glycine max
  Coding DNA Sequence Number=SeqID_66298
MAKIRVASYEFTTLTCIPGVITYRGAKIQIFCLWVDKLGMPKAEFSCTFF

SEQ ID NO: 183077 - protein, 193 aa, Glycine max
  Coding DNA Sequence Number=SeqID_66299
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=13%, E-value=1e-46, Identity=46%"; Hit description=Chromo
METLAKFHHNLLGQKFIIRTDQRSLKSLCNQIIQTPEQHVWIHKFWGYDFTIEYKPDKENVAADTLSRSFFMALSEPHASLLSQIEQATNMDLPCWIFPPMVPNQPELATSILKEFHSPQIGGHSRVACTKARIASLFYWPTMAKYIKLVVSQHLVCQQAKSSNALLAGLLQPLPISTQIWEDVAMDFIVRCR

SEQ ID NO: 183078 - protein, 532 aa, Glycine max
  Coding DNA Sequence Number=SeqID_66300
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=4e-51, Identity=31%"; Hit description= UPI00006A17C9 related cluster
LHVLAFRGLHALAFRGLHVLAFRGLHVLAFRVLHVVAFRGLHVLLHVLAFRGLHVLTFRGLHGLAFRGLHGLAFIGRDVLTFIGLHALAISGAHVLAFTGLHILAFRELHVLTLRGLHTLALIGLHTHAIRRAHVLAFRGLHALAFRRLHVLSFRKLHVLAIRGIHILTFRGLHVLAIRGLHVLAFRGLHALAIKRLHILAFRGLHALAFRGLRVLTIRGLHTLAFIGLDSLAFIGLDMLAFCGQYALTFRGVHDLDIRGLHALAFRGLHILTFRVLHALAFRGLHALTFPSEGNTPSPSEDYTGLHVLNFRGLHVLTLRGLHALSFRGLHEILHLLAISGLDVLAFRGLNALAFRGLDDYMSYCASSPSEGYTPSPLEGYTPSPSEDYMSLPSEGYKGLHALAFRGLHVLLHVLAFRGLHVLAFRGLHGLAFRGLHGLALIGRDVLTFIGLHALAIRGAHVLAFRGLHVVTFRGLDILAFRGLHILAFSGLHVLTFRGLHVLAFRGLHSLAFRGLHVLLHVLAFRGLHGLA

SEQ ID NO: 183079 - protein, 564 aa, Glycine max
  Coding DNA Sequence Number=SeqID_66301
  Gene Ontology: Mol. function=catalytic activity; Biological process =cellular metabolic process
  Homolog annotation: Hit_ID=UPI00005F75AE; Match level="QueryCoverage =58%, HitCoverage=75%, E-value=1e-148, Identity=70%"; Hit description= COG0702: Predicted nucleoside-diphosphate-sugar epimerases
  Pfam annotation: Domain name=ADH_zinc_N; Domain location=386-533; Score=-13.3; E_value=0.064; Accession=PF00107.16; Description=Zinc -binding dehydrogenase
  Pfam annotation: Domain name=Epimerase; Domain location=390-564; Score=-19.4; E_value=6.4e-05; Accession=PF01370.11; Description=NAD dependent epimerasedehydratase family
  Pfam annotation: Domain name=NAD_binding_4; Domain location=392-564; Score=-61.4; E_value=0.00012; Accession=PF07993.2; Description=Male sterility protein
  Pfam annotation: Domain name=RmlD_sub_bind; Domain location=389-564; Score=-192.5; E_value=0.099; Accession=PF04321.7; Description=RmlD substrate binding domain
  Pfam module annotation: Pfam domain module=ADH_zinc_N::Epimerase::NAD_ binding_4::RmlD_sub_bind; Domain location=386-533::390-564::392 -564::389-564
DLSRRAAAERRQLTAPGGPPPDRRNFAPERRAVVAGGAGEPAGLSGRSAGAPGAGAPHLRRCRAGVPQLSGYVPTLYRHQRQTALADPDPLADAADFGVVHQPDHLGADADRPRADPGAEARSARRRPAAAGADPAAAAHLRSGGRHHAAARTGGGRFRRLGLRSGGAGPLAPRLRLLSETGRLFAGHRRHPRGPMANGAAVGGRRRLFLRQYSVADPRPHGRHDRQRRGLWPPGAREPGAGRRDRRLESHHAETAAATGAAVRHEGAGAGAAELHHYRSRRSPHAGRARLVASGRLQRAAVLVRHDARASVHFPRHGEAHRRTCRGSGPPTALNAVHLSINRTVCRCASGLSDCIAHEITEEWHLICWERRKRPPVFRFWVRIESVMKVLVTGATSGLGRNAVEYLRRQGIKVRATGRNQAMGGLLEKMGAEFIHADLTNLISSQAKAMLTDVDVLWHCSSFTSPWGTEEAFELANVRATRRLGEWAAAYGVAQFIHISSPAIYFDYHHHRNVAEDFRPQRYANEFARSKAAGEQVIQQLALSNPQTHFTILRPQGMVGPHDK

SEQ ID NO: 183080 - protein, 488 aa, Glycine max
  Coding DNA Sequence Number=SeqID_66302
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=99%, HitCoverage=28%, E-value=1e-153, Identity=87%"; Hit description =Protein ycf2
  Pfam annotation: Domain name=AAA; Domain location=77-304; Score=22.4; E_value=4.3e-06; Accession=PF00004.19; Description=ATPase family associated with various cellular activities (AAA)
MIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRDLVALTNEALSISIIQKKSIIDTNIIRSVLHRQTWDFRSQRFLYEKYESEFEEGGGVLDPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKH

SEQ ID NO: 183081 - protein, 84 aa, Glycine max
  Coding DNA Sequence Number=SeqID_66303
MAKGCGMTIICLRMSSGPPPLDDKRGCGMTIICLRMSSGPPPLHDKRVQNDHNLSLRATDPTGQYDRDCGSADKCEALAPTYPQ

SEQ ID NO: 183082 - protein, 94 aa, Glycine max
  Coding DNA Sequence Number=SeqID_66304
MEGSQQKTHYPKEKLPKIITHKWKFGNLLEAPNTLPMKGLFVTKLESNKVLLSPIALKVVGPLLLDSNSSRDGTNPPSNSLYGNPQTRKQRDKQ

SEQ ID NO: 183083 - protein, 58 aa, Glycine max
  Coding DNA Sequence Number=SeqID_66305
  Gene Ontology: Mol. function=ribonuclease H activity; Biological process=DNA integration
MARKILRAGYYGLTMESDCCIHVKKCRKCQTFTDNVNALPMPLNVLATPWPFSMWGID

SEQ ID NO: 183084 - protein, 114 aa, Glycine max
  Coding DNA Sequence Number=SeqID_66306
MALLRIKMKIYKLKLSTTSKSSPAKNTCECANLETLGPIGPRIKWGYTLNDEDMTKSKGKDPLEGLGGPMTRARARKAKEALQQVLSILFEYKPKFQGEKSKVVSCIMAQMEED

SEQ ID NO: 183085 - protein, 121 aa, Glycine max
  Coding DNA Sequence Number=SeqID_66307
  Gene Ontology: Mol. function=DNA binding; Biological process=DNA integration
  Homolog annotation: Hit_ID=Q1S3H4; Match level="QueryCoverage=79%, HitCoverage=21%, E-value=2e-27, Identity=48%"; Hit description =Integrase, catalytic region
MGYLGVKGRKCVGCENLVADHLSRLVNEEVTQEEQEIWDKFPNESLLSVGERPWFADIANFKAVGIIPDDLNWHQWKKCVTKKEARSILWHCHNSPYGGHYSGDQIAAKTGGIYGRNEMLL

SEQ ID NO: 183086 - protein, 167 aa, Glycine max
  Coding DNA Sequence Number=SeqID_66308
  Subcellular localization annotation: CTP_CleavageSite=90; ConfidenceScore=5.16e-01
MARSVGGESEGKNADTTLVVASNMAMARGIVRRMRNTVGAVLLLRSSTTTTHSHSFHFYKDSLSPLESHLCSFSSTFLRSFSHHFPDETTDEGASTDGWEEEDEVEPKIGDGGDGGGVALQNVPWGQRALSIAEEVLMQFSEDIKLFAFKTTPRGYVYVRLDKLTHE

SEQ ID NO: 183087 - protein, 98 aa, Glycine max
  Coding DNA Sequence Number=SeqID_66309
  Subcellular localization annotation: CTP_CleavageSite=59; ConfidenceScore=5.45e-01
MVQFGIASAFLFFFFSFSFLRFSSIFQFSDPRNLFPYMAIYRKNHLVQGKLAQATCLLRLEVISSPKMQLLWYIHLNHVLMTLQTILCLVLNVKKGAN

SEQ ID NO: 183088 - protein, 210 aa, Glycine max
  Coding DNA Sequence Number=SeqID_66310
  Gene Ontology: Mol. function=transition metal ion binding; Cellular component=cytoplasm; Biological process=proteolysis
MDQSWKKESHISDEIIWNYTKWIWQGELLVMLTVGRTKPIDEDVEDCIEDMIRNHGQDYFQQAHAPLYEKIENDSKKPLYLGCTTFTRLLAVLALVNLKTRFGWSDKSFNELLVLLKKLLPKDNMLSKNHYKAKKILWPVGIEYQKIHACPNDYVLYKNQFVELNKCPTCGVSCGPRQPGNDINIYLTSLIEDLRKLGEDEVDVWDANLQ

SEQ ID NO: 183089 - protein, 73 aa, Glycine max
  Coding DNA Sequence Number=SeqID_66311
MASPEWRRRDNKHDFIDYKLGRILVIEVGFVLYAIFITTTCKMMVKAIHHNHSLARVAPEQPEPPQGEAMHQV

SEQ ID NO: 183090 - protein, 166 aa, Glycine max
  Coding DNA Sequence Number=SeqID_66312
  Subcellular localization annotation: CTP_CleavageSite=56; ConfidenceScore=5.41e-01
MSSLATDVWGANTFPVHKYNSRTFHLKVRRPRLFWFFRRFPQINVGGDSARIPFLEDASRESRRHPPAEGCNNRLKIILKNWILKQRCNTHIGNKYNITTFTMIMVTIQALNGEHHHAHIDSPGVPNVELVVAPDQVRAGLAMRRSSSDRETPVPMHELIFLFEYQ

SEQ ID NO: 183091 - protein, 1191 aa, Glycine max
  Coding DNA Sequence Number=SeqID_66313
  Gene Ontology: Mol. function=DNA binding; Cellular component=nuclear pore; Biological process=DNA integration
  Homolog annotation: Hit_ID=Q1SS72; Match level="QueryCoverage=99%, HitCoverage=99%, E-value=1e-147, Identity=45%"; Hit description =Integrase, catalytic region
  Pfam annotation: Domain name=rve; Domain location=603-746; Score =23.0; E_value=7.1e-05; Accession=PF00665.16; Description=Integrase core domain
  Pfam annotation: Domain name=zf-CCHC; Domain location=248-265; Score =5.0; E_value=0.15; Accession=PF00098.13; Description=Zinc knuckle
  Pfam annotation: Domain name=zf-CCHC; Domain location=299-316; Score =8.6; E_value=0.037; Accession=PF00098.13; Description=Zinc knuckle
  Pfam module annotation: Pfam domain module=RVT_2::Retrotrans _gag::rve::zf-CCHC::zf-CCHC; Domain location=843-1025::79-194::603 -746::248-265::299-316
MNQEQDESLSVHSPYYLHPSENPAIALVSPLLDPTNYNSWSRSVLTALSAKNKVEFVDGSLPRPASNHRLYAAWKRANNMVVSWLVHSVATSIRQSILWMDNAVDIWKDLKARYSQGDLLCISDLQHKLASIKQGNMNITDYFTKLRTIWDELESYRPDLVCTCASKCSCDALIEAKKRKDQDRIMEFMRGLNDQYNHVRSNILMMDPLPSISKVFSYMAQQERQLASSDALGNLSLVNVAASTRSSNSCSYCGRDNHTVETCYKKNGFPPNFFSNRGGGGGGRGFGRGGTGGKSTNGKVCTHCGIINHTVDECYKKHGYPPGHKFYKPQGASINNTVKEEEKVSRSETSDHGQDIKITQQQYQALMSLLAANNNSSHGSQVNKIDTNSAHTSAVGNTLSFICNMHKFEAATWILDSGATYHVASSLTYYSTYREINPIVVHLPNGQQVMATHSGTVKFTEFLHLEDVLYLPSFNFNLISISKLVSALNCKLTFMPNSCLIQDISNQRMIGTVDVVEGLYKLRIPATNSVPKTNNNFISIKSILSCNKEAIDIWHFHLGHPSYDRMQLLKQTYPMLTCDKTFVCDTFHRAKQRKLPFPNSDSYASSPFSLIHVDIWGPCATTALNGHKYFLTIVDDHTRFVWIFIMTSKVETQTHLQAFVSYVERQFNTKVKAIRSDNGAEFIMKHFYHNTDCFPYASPSASQSFPSFPVHSYPTIYDHGKDLVCSSPFSHSNILDDSQSNMSVDHSQLDSSNTSSNPLNSPIIVPPRRSNRDKTRPKKFQDFHTTFISTVTGQSSGIRYPLASVLSYKNLSPTYHSFIMVVSSEIEPKSFKEASQSDKWIKAINAEIEALEANHTWILTDLPPNKSAIGCKWVYKIKHKADGSVERYKARLVAKGYTQIEGQDYLYTFSPVAKITTVRLLLALAAANNWHLQQLDVNNAFLDGDLNEEVYMALPSGMLGSKPVSTPIDYAVRLHQQSGTPLDDTTTSSYCRLIGRLIYLINTRPDITYAVQHLSQFVAHPSSAHQQAAYRILRYLKAAPGSGCVDTRRSITGYSVYLGNSLISWKFKKQATVSRSSSEAEYRALASATCELQWLTHLLNDFGIVYTQPALLFCDNRFALHIAANPVFHECTKHIEIDCHIVREKLHSGLIKLLPIASAQQLADIYTKSLPPGAFHFLQCKLGMSDIHSPA

SEQ ID NO: 183092 - protein, 98 aa, Glycine max
  Coding DNA Sequence Number=SeqID_66314
MRETSTGKWKEYKETFLDHCEKTQCNCSLRFFLQKAVASGGSNLALLGELGGKLLPYFAINRGRSEGRRGSAFLALLILSKLLRKIVSMKKIQAEALP

SEQ ID NO: 183093 - protein, 192 aa, Glycine max
  Coding DNA Sequence Number=SeqID_66315
  Gene Ontology: Mol. function=6-phosphogluconolactonase activity; Cellular component=microtubule; Biological process=carbohydrate metabolic process
  Homolog annotation: Hit_ID=Q75IV7; Match level="QueryCoverage=86%, HitCoverage=57%, E-value=7e-55, Identity=63%"; Hit description =Putative 6-phosphogluconolactonase
MHYNIPGVHNLLFTYLSQQLQLVNEYRKKVPIVPSHVHSINDSVSAEEAADDYEFVIRQLVKTRVVSVSEISDCPKFDLILLGLGPDGHIASLFPNHSALNEREEWVTFITDFPKPPPERITFTLPVINSASNVAVVVTGESKAESVHLAIGDVGPDGPLIPARMVQPAMGKLVWFLDKLAASKLEDSNLNK

SEQ ID NO: 183094 - protein, 364 aa, Glycine max
  Coding DNA Sequence Number=SeqID_66316
  Gene Ontology: Mol. function=kinase activity
  Homolog annotation: Hit_ID=Q10H44; Match level="QueryCoverage=69%, HitCoverage=41%, E-value=1e-40, Identity=37%"; Hit description=PfkB -type carbohydrate kinase family protein, putative, expressed
MACLSFPQFLLLHRYHMTWSYCFTSFNTVQLGKLGPGCKWGHVAMARKKASLDSAIEEELSDNESLVEKKTTRSSKTKKETTRTRKKTKDESPGDTDSASIEGSTAASSDNSKKTQRTRKKDASSSAGLEEKKEVKEEKKVRRRKKTEEEKLIVEDKGSEAEISDQDEPSFLENVEDDSDSGLELIKDDGEDISFTYGWPPLVCCFGAAQHAFVPSGRPANRLINHEIHESMKDALWSPENFVRAPGSSAGSVAIALATLGGKVAFMGKLADDDYGQAMLYYMNANNVQTRSVRIDSKRATAASMMKVGKRNRLKMSCVKPCAEDSLTKSELNIDVLKEVEPKFISSKIGRLILNGNIDMAVEC

SEQ ID NO: 183095 - protein, 76 aa, Glycine max
  Coding DNA Sequence Number=SeqID_66317
MGISKVGMAITLVLILCKVFDDMPQRMWTLYDNCFPLVTDGWDTACNVHFVYSQMSILKCLGEPRNKLFAARKYLE

SEQ ID NO: 183096 - protein, 490 aa, Glycine max
  Coding DNA Sequence Number=SeqID_66318
  Gene Ontology: Mol. function=2-amino-4-hydroxy-6-hydroxymethyldihydrop teridine diphosphokinase activity; Cellular component=mitochondrion; Biological process=folic acid and derivative biosynthetic process
  Homolog annotation: Hit_ID=O04862; Match level="QueryCoverage=99%, HitCoverage=94%, E-value=0.0, Identity=86%"; Hit description =Dihydropterin pyrophosphokinase /dihydropteroate synthase precursor
  Pfam annotation: Domain name=HPPK; Domain location=24-150; Score =237.1; E_value=3.8e-68; Accession=PF01288.10; Description=7,8 -dihydro-6-hydroxymethylpterin-pyrophosphokinase (HPPK)
  Pfam annotation: Domain name=Pterin_bind; Domain location=215-438; Score=335.3; E_value=1.1e-97; Accession=PF00809.12; Description =Pterin binding enzyme
  Pfam module annotation: Pfam domain module=HPPK::Pterin_bind; Domain location=24-150::215-438
LGFSSFHTASKSSVELHSQEEEVVIALGSNVGDRLHNFKEALKLMRNSGINITRHACLYETAPAYVTDQPRFINSAVRAVTKLGPHELLSALKKIEKDLGRTGGIRYGPRPIDLDILFYGKYKVRSDILTIPHERIWERPFVMAPLMDLLGSAIDSDTVASWHSFSGHSRGLTGLWEDLGSESLIGEFGKEGMYRVMPVANGLLDWSRRTSVMGILNVTPDSFSDGGNFKSVESAVYQVRLMISEGADMIDIGAQSTRPTASRISAAEELGRLIPVLEAVVSMPEVEGKLISVDTFYSEVASEAVSKGAHLINDVSAGQLDSNMFKVMADLDVPYVAMHMRGDPSTMQNSENLKYGNVCKEISSELYSRVREAEMLGIPAWRIMIDPGIGFSKKTEHNLDILMGLPDIREEIATRSLAISHAPMLIGPSRKRFLGEICSRPDAAKRDPSTIASVTAGVLGGANIVRVHNVKDNLDAVKVCDAILRQKSLT

SEQ ID NO: 183097 - protein, 66 aa, Glycine max
  Coding DNA Sequence Number=SeqID_66319
MTCSLARCKDLMPQWAFAKCQILRVVRVMCCHNSIASSFLLQIWGFLYDLRRAYINVLVLLEFLIA

SEQ ID NO: 183098 - protein, 335 aa, Glycine max
  Coding DNA Sequence Number=SeqID_66320
  Gene Ontology: Mol. function=protein serine/threonine kinase activity; Biological process=protein amino acid phosphorylation
  Homolog annotation: Hit_ID=Q9ARL7; Match level="QueryCoverage=38%, HitCoverage=16%, E-value=2e-33, Identity=58%"; Hit description =Putative serine/threonine kinase
MDRSSFSPGTGKTRTKPDIYSTFVVHDDEDDDGGGTFRRRKSGGGAQPQDDPYATMVFKDNGHDDEDDEDSSLPPLLKRLPKDFGGGAPLDYDDEDDDAGDFGTMIVKSDRSRQRDRPSSGVASPAWKARSPLNRFGGGDDDGDDDDDDGGGFSTFVVRSTVKSGERESVSGTVVRRTSGGGSVGVGVGVGSTMERAVASMQGMGEFGFGKQRKGSGSSQNDEGRHQSITTKVSTSSIPDSVTREDPTTKYELLNELGKGSYGAVYKARDLRTSEMVAIKVISLSEGEEGYEEIRGEIEMLQQCNHPNVVRYLASYQGEEYLWFLADSDGVLRWW

SEQ ID NO: 183099 - protein, 54 aa, Glycine max
  Coding DNA Sequence Number=SeqID_66321
ANGTKEEEEFYREAWKEVSGRPTRVVAPGRPTSVTAPGRVAGHHVWSRLTGHHV

SEQ ID NO: 183100 - protein, 87 aa, Glycine max
  Coding DNA Sequence Number=SeqID_66322
MKLLQGTTQTLTISHPICAFDKESHKLSYRGGGKHNTRIGDQTLMIESRYRISITVLVWQKSLIVSTVWSPSLPVNGTLIYMFRGFD

SEQ ID NO: 183101 - protein, 57 aa, Glycine max
  Coding DNA Sequence Number=SeqID_66323
MEQNKHLLKQAVDSHQPNVPRLHSDTGNLIQCPRHLNAGGATQNFCKAGRLDDESCD

SEQ ID NO: 183102 - protein, 186 aa, Glycine max
  Coding DNA Sequence Number=SeqID_66324
  Gene Ontology: Mol. function=glutamyl-tRNA reductase activity; Biological process=tetrapyrrole biosynthetic process
  Homolog annotation: Hit_ID=Q6AVG1; Match level="QueryCoverage=88%, HitCoverage=41%, E-value=2e-70, Identity=72%"; Hit description =Expressed protein
  Pfam annotation: Domain name=DUF266; Domain location=1-115; Score =188.8; E_value=1.3e-53; Accession=PF03267.4; Description=Arabidopsis protein of unknown function, DUF266
MVFIFDVVTVRPRIEISNQPSPSQVAEWGMMSMCDAERRLLANALLDISNEWFILLSESCIPLQNFSIVYLYIARSRYSFMGAVDEPGPYGRGRYDGNMAPEINMSDWRKGSQWFEINRELALRIVEDNTYYPKLKEFCKPHKCYVDEHYFQTMLTINTPHLLANRSLTYVDWSRGGAHPATFGEG

SEQ ID NO: 183103 - protein, 81 aa, Glycine max
  Coding DNA Sequence Number=SeqID_66325
  Gene Ontology: Mol. function=oxidoreductase activity
  Homolog annotation: Hit_ID=Q70EW1; Match level="QueryCoverage=82%, HitCoverage=9%, E-value=2e-17, Identity=61%"; Hit description =Diamine oxidase
MKIVEYHDNVVEPVPKAENTEYRASHLKPPFSPRLHSFASHQPEGPGFTIKGHSIRYSSWLHGNIPFDLLKPSDLMFKPWK

SEQ ID NO: 183104 - protein, 63 aa, Glycine max
  Coding DNA Sequence Number=SeqID_66326
  Homolog annotation: Hit_ID=Q940V4; Match level="QueryCoverage=62%, HitCoverage=8%, E-value=3e-11, Identity=65%"; Hit description =Cytochrome P450 85A2
MLTVFYYALALTFCAFFALLKWNSLRYSRKGMPPGSLGWPFVGETLKFLTQGPDFMKESRSSS

SEQ ID NO: 183105 - protein, 385 aa, Glycine max
  Coding DNA Sequence Number=SeqID_66327
  Gene Ontology: Mol. function=oxidoreductase activity; Cellular component=membrane; Biological process=electron transport
  Homolog annotation: Hit_ID=Q2MZW1; Match level="QueryCoverage=99%, HitCoverage=83%, E-value=1e-129, Identity=58%"; Hit description =Brassinosteroid-6-oxidase
  Pfam annotation: Domain name=p450; Domain location=1-382; Score=28.9; E_value=2.7e-12; Accession=PF00067.12; Description=Cytochrome P450
MDPDVNRYILLNEAKGLVPGYPDSMRKILGTNIAEVHGAIHKRIRGSLLSLIGPIAVKDRLLPEVDEFMRSYLDNWGGKVIDLQEKTVEMAFFISMKAVVENEPNSFVESFKATFDSMALGTISLPIKIPGTQYYRGLKAREKVVTMLRELLAKRRASSATHDDILDHLMRNEDGKHKLDDEEIIEQIITILYSGYETVSTTTMMAIKYLCDNPSVLQAIRDEHFAIQQKKMPEERISWDDYKNMSLTRAVILETMRLASVVAGVMRRTTTNDIELNGFIIPKGWRVYVYTRETNFDPFIYEEPFTFNPWRWVEKKDLESHNHNMLFGAGGRVCPGKEWGMLKISLFLHYFVTRYRWEEAEGNKQLMKFPRVLAPEGLHIRITNY

SEQ ID NO: 183106 - protein, 73 aa, Glycine max
  Coding DNA Sequence Number=SeqID_66328
  Gene Ontology: Mol. function=protein serine/threonine kinase activity; Cellular component=Golgi apparatus; Biological process =protein amino acid phosphorylation
  Homolog annotation: Hit_ID=Q9ARL7; Match level="QueryCoverage=75%, HitCoverage=6%, E-value=6e-16, Identity=76%"; Hit description =Putative serine/threonine kinase
MAPEVIQESRYDGKVDVWALGVSAIEMAEGVPPRSSVHPMRREVVVSTSNQALRMLVGLGSIEALVASRERPS

SEQ ID NO: 183107 - protein, 141 aa, Glycine max
  Coding DNA Sequence Number=SeqID_66329
  Subcellular localization annotation: CTP_CleavageSite=18; ConfidenceScore=5.09e-01
MSSSTIVGADRSAFFTTSSKKLSKRKRSCDTLPLLWNDRFKMYRYFGIATLKYDFPYFGIAISEYLYFSKIHKYEQRCVKCHNLNLEHGHHHISVSSPYIKGRLCKNPCGMSKIVASLTVVAIQESVKLWNLEAASRFEST

SEQ ID NO: 183108 - protein, 562 aa, Glycine max
  Coding DNA Sequence Number=SeqID_66330
  Gene Ontology: Mol. function=heat shock protein binding; Cellular component=integral to membrane; Biological process=protein folding
  Homolog annotation: Hit_ID=O23230; Match level="QueryCoverage=61%, HitCoverage=21%, E-value=2e-18, Identity=28%"; Hit description =Trichohyalin like protein
MEFTAATATLTKKLSNGCGYSVTGRSAYDGVFATPIKLRAPSFSSHFDDYREIFCTSSPGSSIPILELPELNQRRKNDDVWRSKLDYSKVFSGFGNLDATAAVPFEELVAEPKEKESFRAKSKVKGENQSSREDLTNCSKEIPVASWSSNDTRRINMSFHKVNQGSENGTNGMTHIAQLRAVPAYTQLIEEVNPLKMNRVNKSIPVAQDTTCSGSHGNEGKKEAAHSTKSFTGASPDNSKKQPSNNGVKVTSTSDSIDLFFGACEISNGSNGIHHVKVPLSETTEGNSEAMKSMPTKCQASKSSSSEGVAGGDSPSYLDDMVDSNSEVAASVAALRKAMEEAQVRMKVAKELMRRKKEGFPDHVKRKSNIELKAERKKEAKDTYKTKKPDTKQTFREMDAFPNASSELGKSTMRIEQVRPDLGAKETSVAKEAVQKAQKKLKSTQVKYEKEVEQKDADHKGKILELKEAKNNKKELYVKNTDRSATNKPEESDQTIEVVKKYCRLENNEEKVHVDNEASVCEELVQETKHRCQEAVDETKLVHETLECGTMDKSLKFIETGE

SEQ ID NO: 183109 - protein, 40 aa, Glycine max
  Coding DNA Sequence Number=SeqID_66331
MPKKELAEEHIQLLFVNAIRDNTIDPIKDEVLGPLNSSEK

SEQ ID NO: 183110 - protein, 519 aa, Glycine max
  Coding DNA Sequence Number=SeqID_66332
  Gene Ontology: Mol. function=heat shock protein binding; Cellular component=integral to membrane; Biological process=protein folding
  Homolog annotation: Hit_ID=Q06166; Match level="QueryCoverage=98%, HitCoverage=81%, E-value=6e-23, Identity=24%"; Hit description =Mature parasite-infected erythrocyte surface antigen
MQESEDVKEEMAKRKGKEIEYFVNKGKGEEPKRMDMESKNDLTTETMQETKDVIEVMVKRKDKEIKNFADKSEGKEPKRMHTEPKKDLIKETMQENEDVKEAMFKEKSKETEYFVVNGEGGEPKRMHMEENKDLTTETMQESEYVKEAMSKRKGEEEIGYFLNEGEGENPKGTHMEAKDTTEIMQESEDIKEATIKKKGKETEYFVDQGEGREPKRIHTKEVEYDSEPIVKRKDKEIDYFVDKREGEELKMTHMEAKKDIAEETMQEEIKKNKNGTKDIDQENVLEKTDKGKFEVPTEELPKLVGRQDGSRGLKVAKMEEQKEIIKEAMAETECSMEKVKGEKSNTTGRVTEKNIASEILQKETEESNIERKSRDGPYVPNNMVKVVFEVLGTFQAKLPKQVMEAISQNKRDKNEYVIVNLRGEGSIKMHVEPNDAFDEYETEDINQKEIGTPKLNSSDQISEKDNVDVWGESTQTEREGSKIQTIEKDHIVDQKKGTNEDLKQAQLPKKIPVKRGFTS

SEQ ID NO: 183111 - protein, 98 aa, Glycine max
  Coding DNA Sequence Number=SeqID_66333
MKSELWMTKWWNYVNYIIYVRGRGCHTLKKKSAQEMKNPTPREQYLKLQEDQNANSVALHPFVDKIMEAQLLPGWKSLTIDRYDGLWYPNEHMDTFVT

SEQ ID NO: 183112 - protein, 113 aa, Glycine max
  Coding DNA Sequence Number=SeqID_66334
  Gene Ontology: Mol. function=RNA-directed DNA polymerase activity; Biological process=RNA-dependent DNA replication
MLNHRGIKANPEKCVIIIEMRSPNTLKKLQRLADRSAVFSRFLPRGANTTKPIFKLLEKQGGTKWNEDCEANFQKLKEFLASPLILTRVLKDAETWYPMIEKLALALSLLLED

SEQ ID NO: 183113 - protein, 97 aa, Glycine max
  Coding DNA Sequence Number=SeqID_66335
MVKNFQGLAQCEVSMSLMTSMPLMHIYKLSFNPRKIKMRSLCRAHEVKVDPSFTPPYKSICSPISWNYIVTNYGVDLHNIDPNVEEVARQKEEMKQQ

SEQ ID NO: 183114 - protein, 84 aa, Glycine max
  Coding DNA Sequence Number=SeqID_66336
MTKFDYQSIKKARAKKRPRLEPMSIIFPFSTESHPDFLSMNKGFVSLWVSMDMNSIARFQARTYKIVEFWDDEFEKADVKSKKA

SEQ ID NO: 183115 - protein, 78 aa, Glycine max
  Coding DNA Sequence Number=SeqID_66337
MKLCFYSYNQLRNLGSLLKALKVKMTMIEDSTKPLQEEVECLNKESTLFKPNAKKVEEKLKSDLNKIEAEILKTHEVE

SEQ ID NO: 183116 - protein, 243 aa, Glycine max
  Coding DNA Sequence Number=SeqID_66338
MEIFIQSIDPGAWNAIFKGPFIETKEVNGELVPKEWDEMKDDEKIKNEETISGLQTRFTHIVNHLLVLGKMFEDDKLNIKILNYLTRTWEPKITTIKESKDLASMSMKALFKKFLAYYKEISSDVQDVENLSLMVKKAYIALEDNASTSSNSSNEEDVANVCLMTDLMNDSSTIEEIEKGSKIAYHKLASTQSKLDKLKEENEKLVSSYKATGRVCASTSLNMDDYKALQIEFEKFKRITMKN

SEQ ID NO: 183117 - protein, 259 aa, Glycine max
  Coding DNA Sequence Number=SeqID_66339
  Gene Ontology: Mol. function=nucleic acid binding; Biological process= DNA integration
  Homolog annotation: Hit_ID=Q1S7C5; Match level="QueryCoverage=98%, HitCoverage=25%, E-value=3e-20, Identity=26%"; Hit description =Integrase, catalytic region
MMRTFSLDRKLIDEYLLKIKGYVDELADVGVSVRHEEYVDALLKGLWSDYAPAISVIESKNRMPSIAKIEALLYDHETRLVRYNKETQGLSSPSLNYTLGYLNSNSYKSGDSDGSRGLYGRGGGNRGGFADHGSGGRFANFQCQICLRYGYTANVCHFQSDMSFQPMNPSPSLIQIHFNLLPTPLVLSEPPTLGLIPIPSLELLLQPQDSQVLCSPIPTLMEMLTPPGFQILVLVSMGPIESFFEFPDQIFIGNGEGDQ

SEQ ID NO: 183118 - protein, 526 aa, Glycine max
  Coding DNA Sequence Number=SeqID_66340
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=88%, HitCoverage=43%, E-value=0.0, Identity=82%"; Hit description =Phosphoenolpyruvate carboxylase
MLTRLRLKTEVLVNLFSNLIGVIQTKNASQNRFRKSRLEPNKECLILNFQRFILRIDMISYTIFFDVREVLDTLRTAAELGSDSFGAYVISMASNLSDIFFCHFLFAPDYQASDVLAVELLQKDARLAASGELGRACPGGTLRVVPLFETVKDLRGAGSVIRKLLSIDWYRQHIIKNHNGHQEVMVGYSDSGKDAGRFTAAWELYKAQEDIVAACNEYGIKVTLFHGRGGSIGRGGGPTYMAIQSQPPGSVMGTLRSTEQGEMVQAKFGLPQTAVRQLEIYTTAVLLATLRPPQLPREEKWRNLMEDISKISCQCYRNVVYENPEFLSYFHEATPQSELGFLNIGSRPTRRKSSTGIGSLRAIPWVFAWTQTRFVLPAWLGVGAGLKGACEKGQTEELKAMYKEWPFFQSTIDLIEMVLGKADIPIAKHYDEVLVSQKRQELGEQLRNELITTGKFVLAVSGHEKPQQNNRSLRKLIESRLPFLNPINMLQVEILKRLRCDDDNLKARDALLITINGIAAGMRNTG

SEQ ID NO: 183119 - protein, 240 aa, Glycine max
  Coding DNA Sequence Number=SeqID_66341
  Pfam annotation: Domain name=DUF1723; Domain location=176-218; Score =16.7; E_value=0.0054; Accession=PF08330.1; Description=Protein of unknown function (DUF1723)
PPPNWEQVTIRVSHEGPNLASGKSMLYLMLDSCYWVVLLFYPWRLPSRCCQSTDKGSFKEVVLCRSDDVGWGIVLGRAQWCWMTRVVQVSGDEKEAPQHRRPTTSTHRQWAVTVVAEDVENMDNVANVSHEEPYDSVIENDTLVLTDYAYHVASKVWARELTSRRRKVEKFGRLASKIEGMMHKETKSFHLPIGELTITLDDVASFLHLPLQSWIYENFPTIASITADEDYHERKPRACH

SEQ ID NO: 183120 - protein, 56 aa, Glycine max
  Coding DNA Sequence Number=SeqID_66342
MVQDDTYIIPDPSVLLVHTAVMPQPPVPATIDANMPQHVVCIHSEWALSNIIQACH

SEQ ID NO: 183121 - protein, 206 aa, Glycine max
  Coding DNA Sequence Number=SeqID_66343
  Gene Ontology: Mol. function=dihydroneopterin triphosphate pyrophosphohydrolase activity; Cellular component=cytosol; Biological process=isoprenoid biosynthetic process
  Homolog annotation: Hit_ID=Q9CA40; Match level="QueryCoverage=62%, HitCoverage=86%, E-value=2e-36, Identity=58%"; Hit description=Nudix hydrolase 1
  Pfam annotation: Domain name=NUDIX; Domain location=14-149; Score =72.1; E_value=1.8e-18; Accession=PF00293.18; Description=NUDIX domain
  Subcellular localization annotation: CTP_CleavageSite=19; ConfidenceScore=5.26e-01
MENNNNNGDPTPVPRVAVVVFLLKGRSVLLGRRRSSVGNATFALPGGHLEFGESFEECAAREVKEETGLVIGSSKFLTVTNNVMLEQPKKCHYVTIFMRAMVGVDAVEEQVPQNLEPTKCDGWEWYEWDHLPHPLFGPLEKMVKGAMLDRSPNVSKIEVFGGQNFRRWQECVYDILDMSEVAFALTEPKLRPPIGIDSLRNGLLQT

SEQ ID NO: 183122 - protein, 120 aa, Glycine max
  Coding DNA Sequence Number=SeqID_66344
MNCVFVHGSSTHEFGAMRSDCLVKFSILNPFSEPMNCVFVHVSSTHEFGVMRSDCLVQFSILNPFAENMNCVFVHVSSTHESAAMRSDCLVQFSIFNPFLEPHELRFRSCVFHPRVWSHA

SEQ ID NO: 183123 - protein, 144 aa, Glycine max
  Coding DNA Sequence Number=SeqID_66345
  Homolog annotation: Hit_ID=Q1SFS3; Match level="QueryCoverage=88%, HitCoverage=24%, E-value=3e-08, Identity=31%"; Hit description =Lambda repressor-like, DNA-binding
MVEELEEILGSPIGGRKPYLFSGFYPSLTRISKIVQISAQELDHRKQVENGVVGVPRKCLEAKARILAGRGEWAPFTDILALLIFGGVLFPNVDGLVDLAAIDAFLAFHGRKESPVVATLADLYDTFGRRCEKSSTRMFGGGRP

SEQ ID NO: 183124 - protein, 151 aa, Glycine max
  Coding DNA Sequence Number=SeqID_66346
  Homolog annotation: Hit_ID=Q1SKD7; Match level="QueryCoverage=69%, HitCoverage=27%, E-value=8e-11, Identity=33%"; Hit description =Ankyrin
MYEYPRRTRALTCKHSFQNSYGCSCFVGKREMVPKKLSTKRSRRDAAAEGSSATREFDSHRFRSAEHQQRFEAIKGWSFHRERRVQLREDEYTDFQEEIACRRWTSLVTPMAKFDPKIVLEFYANAWPTEECDVPLFLLFLNPFCTILNTD

SEQ ID NO: 183125 - protein, 222 aa, Glycine max
  Coding DNA Sequence Number=SeqID_66347
  Gene Ontology: Mol. function=chitin binding; Cellular component =extracellular region; Biological process=chitin metabolic process
  Homolog annotation: Hit_ID=UPI0000DBF0F4; Match level="QueryCoverage =97%, HitCoverage=73%, E-value=1e-17, Identity=47%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
  Subcellular localization annotation: CTP_CleavageSite=38; ConfidenceScore=5.59e-01
MAARSRLQRTTRPGLQRAARPCLQRPALPRLQGATRPRLQSATHLRLQRTTRPRLQSAARPRLQRTTRPRLQRAVVPSLQRTTHPHLQRTTRPCLLGTSTLTFRGLCALAFRGLCALAFRGLHAIAFKGLHALAFRGLNALTFRELHVLAFTSWILVLSPSEGYAPSPLEGYASSTSEVCTPLPLEGWAPLPLEDYTSSHSEGCTPSPSEDYTPSPSDGYTS

SEQ ID NO: 183126 - protein, 428 aa, Glycine max
  Coding DNA Sequence Number=SeqID_66348
  Gene Ontology: Mol. function=allophanate hydrolase activity; Cellular component=cytoplasm; Biological process=metabolic process
  Homolog annotation: Hit_ID=Q0VNA8; Match level="QueryCoverage=96%, HitCoverage=36%, E-value=1e-126, Identity=54%"; Hit description=Urea carboxylase/allophanate hydrolase
  Pfam annotation: Domain name=AHS2; Domain location=287-428; Score= -19.3; E_value=1.7e-09; Accession=PF02626.6; Description=Allophanate hydrolase subunit 2
  Pfam annotation: Domain name=Biotin_carb_C; Domain location=147-256; Score=118.8; E_value=1.6e-32; Accession=PF02785.9; Description =Biotin carboxylase C-terminal domain
  Pfam annotation: Domain name=CPSase_L_D2; Domain location=1-136; Score=32.8; E_value=1.5e-13; Accession=PF02786.7; Description =Carbamoyl-phosphate synthase L chain, ATP binding domain
  Pfam module annotation: Pfam domain module=AHS2::Biotin_carb _C::CPSase_L_D2; Domain location=287-428::147-256::1-136
MQRCNSADELEEAFTRVKRSSRFLAKVGANVIALGERDCSAQRRNQKVLEETPAPRLSDAVRAQLQATAVRLARAVNYRSAGTVEYVYDEVSQQFWFLEVNTRLQVEHGVTELVYGVDLVRWMVELAQQRLPPLATLQPEAQGHAIQVRLYAEDPAKQFQPSAGLLSHVQFPTALDHATLRIDSSVESGMEVSPFYDPMLAKILVHAADRQRALDGMTAALAQSELYGIETNLRWLRQLCTLPDVQQGRIITATLGSVAWQPPTLDILSGGTLTTVQDAPGRVGYWHVGVPPSGPFDSRAFQLGNRLLGNEAQAAGLEITLRGPTLRFNQACSFVLSGAPLAATLDSQPLAMHQVLHAQAGQTLTLGDVRDGCRSYLLLAGGLDTPRYLGSRSTFTLGKFGGHAGRALRAGDVLQLAAPRQAAAGAPA

SEQ ID NO: 183127 - protein, 62 aa, Glycine max
  Coding DNA Sequence Number=SeqID_66349
MTPSQQYHGPIPTPNAPLTKKKRGGIGAEEILIAKHEDGIDHVAHPHDITDTKMNDLHVFVY

SEQ ID NO: 183128 - protein, 97 aa, Glycine max
  Coding DNA Sequence Number=SeqID_66350
  Gene Ontology: Mol. function=D-arabinitol 4-dehydrogenase activity; Biological process=metabolic process
  Homolog annotation: Hit_ID=UPI00005F8F76; Match level="QueryCoverage =86%, HitCoverage=18%, E-value=3e-27, Identity=69%"; Hit description =COG0246: Mannitol-1-phosphate/altronate dehydrogenases
MILSPDARRWKKVGVELVASVLPWEEAKIRILKATHAAIAWAGTLTGHDYVDDSSRQPAIYQLAYYYITQEVIPSLSPIPLDLADYRDMVLARFSNP

SEQ ID NO: 183129 - protein, 105 aa, Glycine max
  Coding DNA Sequence Number=SeqID_66351
  Gene Ontology: Mol. function=sequence-specific DNA binding; Cellular component=nucleus; Biological process=regulation of transcription
  Homolog annotation: Hit_ID=Q7XJB6; Match level="QueryCoverage=94%, HitCoverage=20%, E-value=7e-52, Identity=97%"; Hit description =Putative WRKY-type DNA binding protein
  Pfam annotation: Domain name=WRKY; Domain location=5-44; Score=54.5; E_value=3.4e-13; Accession=PF03106.6; Description=WRKY DNA -binding domain
MFSIQKSYYKCTNAGCPVRKHVERASHDPKAVITTYEGKHNHDVPAARNSSHDMAVPAVAAGGQTRTKLEESDTISLDLGMGITSAAEHRSNGQGKMLHSEFGDT

SEQ ID NO: 183130 - protein, 63 aa, Glycine max
  Coding DNA Sequence Number=SeqID_66352
MFVLNNALKGFDDTPQSKSKAAARWIIVKYFNDARLLESERLKVFCIQRASYYLKVKNKTISV

SEQ ID NO: 183131 - protein, 65 aa, Glycine max
  Coding DNA Sequence Number=SeqID_66353
ILLAGEQGAEPTKPREIKLVAACIELVIFHDQCDDDELPFLVDVGTLLNHVKSSEILGCLLCCVL

SEQ ID NO: 183132 - protein, 177 aa, Glycine max
  Coding DNA Sequence Number=SeqID_66354
  Homolog annotation: Hit_ID=Q1SKD7; Match level="QueryCoverage=86%, HitCoverage=39%, E-value=3e-07, Identity=25%"; Hit description =Ankyrin
MTHEVLSGNCDEPAKCAYGFLEKKGTFYTLSNELDRRHWRKELTDFLDGNIDVAIVKEFYANLYDPEDKSPKQVRVRGHLIKFDEDTLNTFLKTSVVVEEGETLCAYSRFALLGPYPQELAAKLCIPGRGFELNADGYPVKILRKNMTPLAQTWSVLSFSNLFPTSHTSDVTLDRAK

SEQ ID NO: 183133 - protein, 100 aa, Glycine max
  Coding DNA Sequence Number=SeqID_66355
MFILGIATCPFAGERRRGSWVRFPKEERCAELPPTFNCEKRRKNRRKPVDKSGALAPTYPPSKRKSDLRSSFLRVNHTISFYLKGDHLKVLDLKNDPLTW

SEQ ID NO: 183134 - protein, 66 aa, Glycine max
  Coding DNA Sequence Number=SeqID_66356
MQQEISSLAFLPQSQLPQQEEKSMISKQLSKKGVDVTQQTWRDLLEMAVNEVGIRMMDDDVEKSHE

SEQ ID NO: 183135 - protein, 165 aa, Glycine max
  Coding DNA Sequence Number=SeqID_66357
MEAQSSHFCPANPCWATMNETRPMSNYNEEQDVGRVFNSELDKETTNDIMVRGSMIAKQQNFCVTNIKTMRPEINVSHIVVPQLDLDEIEQELIKKEQRTKKKHDLVSLSNPHAPDSKRPKNVPSRKSTRRPTEKKTTNENLKDFNETDDDGPIIQIKRKDEYQQ

SEQ ID NO: 183136 - protein, 60 aa, Glycine max
  Coding DNA Sequence Number=SeqID_66358
MCMIRLRLLAPNEYGSGVIDILIGSVRISCPSFLESSSHGSGDRYNAMTMAFIICVCSTR

SEQ ID NO: 183137 - protein, 105 aa, Glycine max
  Coding DNA Sequence Number=SeqID_66359
  Gene Ontology: Mol. function=nucleic acid binding; Biological process= DNA integration
  Homolog annotation: Hit_ID=Q1SMW8; Match level="QueryCoverage=55%, HitCoverage=5%, E-value=6e-10, Identity=61%"; Hit description =Integrase, catalytic region; Zinc finger, CCHC-type; Peptidase aspartic, catalytic
MTSKCKDRPEKSIINNFMDNTKGPKKIWVPKKKIVYVANALDSRKQIHVMVSGQWLLMTHDKRKFVEGLKHNLLSISQLCDSGYNVSFNKDECVVLCKDGSPLQN

SEQ ID NO: 183138 - protein, 109 aa, Glycine max
  Coding DNA Sequence Number=SeqID_66360
MTLIYISKTTMSFDEDMTKSKGKDPLEGLGGPMTRARARKAKEALQKVLSILFEYKPKFQGEKSKGPIGNLGISLLGDQIVADLMAVGGDFWLPQFQLHSAIKFFNSLG

SEQ ID NO: 183139 - protein, 226 aa, Glycine max
  Coding DNA Sequence Number=SeqID_66361
MAKIKEPRGTYPISIQNSMYGSQIFVNSDIKEIVDFKDCMDPSQLTMIHCTQSGNQISGSSLYSVGDRFMHNAKMIYFDEVSKVKKPMVGFMILIPNVTRRLMERLCLFFMLAVQMKVDISKALDHVLEKRLTFMFKVVPGNTCHFVSQLSQDEALINSIVAKLPTFDLQQCFSTTAESNPLLSGSITPAKHNLVLSNTQLDDIPFEDLSSIQLSSIGVTKHIKIE

SEQ ID NO: 183140 - protein, 59 aa, Glycine max
  Coding DNA Sequence Number=SeqID_66362
MGVPLRAVVRQQVRVARGGHRWSWVVEEKIPLSDTSSLSEISLLVLRATSRAEQITSSD

SEQ ID NO: 183141 - protein, 76 aa, Glycine max
  Coding DNA Sequence Number=SeqID_66363
MKTQRCREVATPVERIDTVKGQRNRDCGHMCEEWRQLEELVTLRDCVKREKNDTGGENGKGRRRNRKMKVVGVGFW

SEQ ID NO: 183142 - protein, 114 aa, Glycine max
  Coding DNA Sequence Number=SeqID_66364
  Subcellular localization annotation: CTP_CleavageSite=44; ConfidenceScore=5.50e-01
MTKEVIHGHNSTTPQLDFSSSPSSSAFSPCFLGCGTLFPPQPCMAIYRKQPLSAGKFAQASCWLNGKGLKLYLSPGELDVSLGEFRVRNLHEETILPFLVALFLDLTNNHHNPE

SEQ ID NO: 183143 - protein, 109 aa, Glycine max
  Coding DNA Sequence Number=SeqID_66365
MKVRDHHKYQPHGTKLQDMKYDTWEPLMHWPWIIKDSKPPFHSRPYERSSSCDGLATSNNGLWWPPVVVDGGGEGISLSELVSLSKNPLLALSVASRAERVTSSNWDYI

SEQ ID NO: 183144 - protein, 41 aa, Glycine max
  Coding DNA Sequence Number=SeqID_66366
MAARPSELMLALEVTGSPRRAAAHPGELATGENQGSETEKA

SEQ ID NO: 183145 - protein, 184 aa, Glycine max
  Coding DNA Sequence Number=SeqID_66367
  Gene Ontology: Mol. function=oxidoreductase activity, acting on single donors with incorporation of molecular oxygen, incorporation of two atoms of oxygen
  Homolog annotation: Hit_ID=Q3BZH1; Match level="QueryCoverage=99%, HitCoverage=36%, E-value=2e-65, Identity=64%"; Hit description =Putative lignostilbene-alpha,beta-dioxygenase precursor
MQVAMLGCFDHIGAAQLAVRTDVPDQQAMAPHQADRAEVPEAAVAIGQRVRRERQRGQVRAPGDRAERLQRIGVHFERRTGFAQREQAAIDHRHRGVGHVGIIVVAYRQRTGNAGAGSRILEAAGLLFTGEFRRGDHAPVMGQAAITIETPAMHHAVAVEPVVVAEAIALGPRRAVAVQRTGQA

SEQ ID NO: 183146 - protein, 48 aa, Glycine max
  Coding DNA Sequence Number=SeqID_66368
  Homolog annotation: Hit_ID=Q3BZH1; Match level="QueryCoverage=94%, HitCoverage=9%, E-value=6e-07, Identity=54%"; Hit description =Putative lignostilbene-alpha,beta-dioxygenase precursor
MTDQHLVFVMMPFDFTGAGGSFFERMQFAPQRPVRIAVVAKDAPDKAQ

SEQ ID NO: 183147 - protein, 285 aa, Glycine max
  Coding DNA Sequence Number=SeqID_66369
  Homolog annotation: Hit_ID=Q47522; Match level="QueryCoverage=22%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIRFIATYEADTHENFKKLIVKSGIRDTVVTGATLGHPARIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 183148 - protein, 146 aa, Glycine max
  Coding DNA Sequence Number=SeqID_66370
MAKIGLSDSGGSSKIQFQALHIYTFALARRDGLSGMSLKIEFLLCINGASCHLWHNTILWGSSFGIVATYPSAGGRRVTHGMRVPRKEYARSRHQRLFEENVGKTGKDAIYELLSERFGSCIYARGRVFPFAPTYSSIWDEKIRPT

SEQ ID NO: 183149 - protein, 107 aa, Glycine max
  Coding DNA Sequence Number=SeqID_66371
MRKMQGSCMSEHNMRTMKIEWSTRVLPLLLRILRKMGNWGNGSSPRRAGYFTLKSFGGPGNSIKRPFCPSFLVCFAFLIETLNGSLLCTITGVQHCKSTSKDQKINE

SEQ ID NO: 183150 - protein, 94 aa, Glycine max
  Coding DNA Sequence Number=SeqID_66372
MKLLEGDQLDVLCFLKVAVVATYPFAGERGEVHGCVFHGRKMRGVAINVDKSGAFAPTYPPSKRKSDLCSSFKRGESSDSFYLEGGHLRRWTLK

SEQ ID NO: 183151 - protein, 55 aa, Glycine max
  Coding DNA Sequence Number=SeqID_66373
MHKCPRCGVSQYKVKDDDDSSSDENSKKGPQRRRCKRPYMTYKWEKLRWNAPSSG

SEQ ID NO: 183152 - protein, 76 aa, Glycine max
  Coding DNA Sequence Number=SeqID_66374
MEKSDKMNFKEKKEKKGYITWEDNVINYSSDSEKKIISLDIMMKDYENGEEQSRYIDSNFSKHMACIQVYSFFSPR

SEQ ID NO: 183153 - protein, 55 aa, Glycine max
  Coding DNA Sequence Number=SeqID_66375
  Subcellular localization annotation: CTP_CleavageSite=26; ConfidenceScore=5.04e-01
MCGDLGHEALLPPKKLSKSVISSSIRASSASPGDPAGSSPVGPRAMRLQPQTALE

SEQ ID NO: 183154 - protein, 255 aa, Glycine max
  Coding DNA Sequence Number=SeqID_66376
  Gene Ontology: Mol. function=sequence-specific DNA binding; Cellular component=intracellular; Biological process=regulation of transcription, DNA-dependent
  Homolog annotation: Hit_ID=Q5WCV1; Match level="QueryCoverage=88%, HitCoverage=78%, E-value=1e-29, Identity=34%"; Hit description =AraC/XylS family transcriptional regulator
  Pfam annotation: Domain name=AraC_binding; Domain location=14-166; Score=27.1; E_value=6.2e-05; Accession=PF02311.9; Description=AraC -like ligand binding domain
  Pfam annotation: Domain name=HTH_AraC; Domain location=180-226; Score= 42.3; E_value=1.6e-09; Accession=PF00165.13; Description=Bacterial regulatory helix-turn-helix proteins, araC family
  Pfam module annotation: Pfam domain module=AraC_binding::HTH_AraC; Domain location=14-166::180-226
MGEAQLLERITLDRQAISFNRMYTTSVLYYHWHQCVELLYISSGYGIVVVDNQHYTARPGRLFIFPPFRLHKVQVDHSDKNPYHRTTMHIEQSVVESALSTFPRHQARFASLAASNLPAQIYDLSTHAAFIERILEQFQRLEDNAQTEACEVAFLVMQLMTCLPEQPQPYPPRQQTVASRIMSWVEAHYASKFSLDRLAHDLGLSRSYTSRIFRQQTGGSIHEYLLTRRIKSSCDLLRYSDEPVDAIALAVGFSE

SEQ ID NO: 183155 - protein, 224 aa, Glycine max
  Coding DNA Sequence Number=SeqID_66377
  Homolog annotation: Hit_ID=Q47522; Match level="QueryCoverage=27%, HitCoverage=82%, E-value=3e-21, Identity=74%"; Hit description=LacZ protein
VPPVQLLTGWCVTAKAPPDISAGKCSGHAARRVPFAIQAAQLLGRAIGAGLFAITPAGERGMCCKAIKLGNARVFPVTTFALADGRLVACQATYTGADMVDSIGAKPQQASGSVSRVAAPAAPPTVQPVVQQATTRQPVAAAPATQLRSSLSIPSTSRGGPVPAFVPFSEVGKPVVPAALMNRPTRGERRFAYWALAECILAYYVGTDEGVSEVLHVAGEKRLH

SEQ ID NO: 183156 - protein, 168 aa, Glycine max
  Coding DNA Sequence Number=SeqID_66378
  Gene Ontology: Mol. function=DNA binding
  Homolog annotation: Hit_ID=Q1RTB4; Match level="QueryCoverage=66%, HitCoverage=25%, E-value=2e-14, Identity=39%"; Hit description=IMP dehydrogenase/GMP reductase
MGQLQRQAFRKAYGEWASFIDILALLIFGGVFFPNVDGLVDLAAIDAFLTYYDHKESPVIAMLADIYDTFDRRCEKTTNKEGASVNWFPRWTEGRTGVLILCEGFANVPLIGTRGCISYNPVLAIRQLGYPMRVTTRGRARACPQGMGGGAKEGQNSEAVTMGPSVAT

SEQ ID NO: 183157 - protein, 114 aa, Glycine max
  Coding DNA Sequence Number=SeqID_66379
MWGIPFILEPNQALTCIMSSHSTSFEPKSRLTINLDPGRRRRRRREKKENSPIKEWGKAKRKERKFPIKEWEKVKKEEEEGKKAPDRGSKEKQKKCAERSLDRTISEQYRIVTK

SEQ ID NO: 183158 - protein, 99 aa, Glycine max
  Coding DNA Sequence Number=SeqID_66380
MTTKWRRKRERRRHFKEKMSLEEAHHHRRPWIRAWRKKEMNEGRGREEHEILCSKRALKSELWFSPLIQDQFQDSPLSVLRCHETCKARRTCTKCDCMM

SEQ ID NO: 183159 - protein, 468 aa, Glycine max
  Coding DNA Sequence Number=SeqID_66381
  Gene Ontology: Mol. function=hydrolase activity, acting on acid anhydrides, in phosphorus-containing anhydrides; Cellular component =membrane; Biological process=conjugation
  Homolog annotation: Hit_ID=Q8KNJ9; Match level="QueryCoverage=98%, HitCoverage=27%, E-value=1e-102, Identity=42%"; Hit description=TraI
  Pfam annotation: Domain name=TraI; Domain location=348-468; Score =109.5; E_value=9.8e-30; Accession=PF07057.2; Description=DNA helicase TraI
MVGNRDMADAMGHIAAGGGRAVLSGDRDQLLPVDNGAPFTLLQERSPLDTAIMQDIVRQSPALKPAIESVIARQVPAALDTIRSVTPDTVPRTPGRWSPTQSVVAIPQTKEQKEEQGDRVIQAIVDDFTGRTPEARDNTLIVTQTNADKNAINTAIHAQLQERGELGREVTITVLDRVKTQTDRLKSVAGMAAQHGNIALINDRYYTIRAGQDSRQNGYVELIDDTGQAQALSAFESSLRDIAVFKPREIAVSVGEKVSFSRSDRERGREANSNWTVTGVTKDGELQLTQGEETRILNPNADLADRHLDYGYAGTAHKAQGASALYVIVLAGVDGGRQALASLRDAYVGLSRVKAHVQVYTDNLGKWLTKVSQPAERQTAHDVLLADSDRQAATAQQLWEKATPLSASALGRALATQLPEAGEARFIHGSRKYPAPHVALPVHDASGVQRAVLLREVQLDGDGRLRGL

SEQ ID NO: 183160 - protein, 197 aa, Glycine max
  Coding DNA Sequence Number=SeqID_66382
  Gene Ontology: Mol. function=DNA binding
  Homolog annotation: Hit_ID=Q1RUD8; Match level="QueryCoverage=83%, HitCoverage=36%, E-value=2e-18, Identity=33%"; Hit description=IMP dehydrogenase/GMP reductase
MIEVSVEAIASHTQYYDQSLRCFTFKDFQLAPTVEEFEGILGCSIGGRKPYLFSGYYPSMARIAGVQSRNRVAGIPRKFLEEKAETLASQREWVTFIDVLALLVLETILFPNVDGLVDLAAIDAFLAYHHNKESPIIAILADAYDTFNLRCEKSSARIVCCMPGLYICLSPTRSSHVLEKGQSKLGRTLGKHDGSVH

SEQ ID NO: 183161 - protein, 77 aa, Glycine max
  Coding DNA Sequence Number=SeqID_66383
MSAMFMKRKDMHWQFAEPVPHFFLFSHFLSLRNGDFKFCSIAVPDQGEGELAQMFAQKKVMLSPGRHKIVILDEADR

SEQ ID NO: 183162 - protein, 132 aa, Glycine max
  Coding DNA Sequence Number=SeqID_66384
  Gene Ontology: Mol. function=protein serine/threonine kinase activity; Cellular component=membrane; Biological process=protein amino acid phosphorylation
  Homolog annotation: Hit_ID=Q10LW0; Match level="QueryCoverage=99%, HitCoverage=16%, E-value=3e-22, Identity=38%"; Hit description =Protein kinase family protein, putative, expressed
VSLAEWALYNKRRGTLEDIIDPNIKGQINPESLKKFADAAEKCVSDLGFERPSMNDLLWNLEFALNVQQNPDGKTHEPRLDESEFEEVNLENNDMAAHYKNLSLGSEHDLSHESSSDNHASIFSQIANPKGR

SEQ ID NO: 183163 - protein, 159 aa, Glycine max
  Coding DNA Sequence Number=SeqID_66385
  Homolog annotation: Hit_ID=Q1S013; Match level="QueryCoverage=30%, HitCoverage=23%, E-value=9e-08, Identity=50%"; Hit description =Prenylated rab acceptor PRA1
MEKNEIMQRDSNLLTEKQHYEQAKKFHWVKTQKLDDGCGTEHNIIKWGNKSSVTLNAACKPTRTTATISESKTLRPTEVEVVPGDEDEEEDDHGDGVPEEAEEDDEERDGGVVEAEVAQGQERAERSRNSRHGRGVTKEVVVVVVVVVVPVGVAPARVP

SEQ ID NO: 183164 - protein, 711 aa, Glycine max
  Coding DNA Sequence Number=SeqID_66386
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=94%, HitCoverage=75%, E-value=0.0, Identity=51%"; Hit description =Receptor-protein kinase-like protein
  Pfam annotation: Domain name=Pkinase; Domain location=519-711; Score =29.7; E_value=2.5e-10; Accession=PF00069.15; Description=Protein kinase domain
  Pfam annotation: Domain name=Pkinase_Tyr; Domain location=519-711; Score=29.2; E_value=2.9e-14; Accession=PF07714.7; Description =Protein tyrosine kinase
  Pfam module annotation: Pfam domain module=Pkinase::Pkinase_Tyr; Domain location=519-711::519-711
MYIHVCLWLVLCFPVFLNAVPPDKGGGDSLMLGCGLGEGGGKDSDGRQWTPDNKYLSGGNSVTSKASFQDPSLLSEVPYMTSRVFTSEATYKFPVKLDKRYWLRLHFYPAVYNTFDPVNSYFSVTANSVTLLSNFSASITCQALSQAYLDREYSLAPLDSDTLSLTFKPSGKQNGAFAFVNGIQLIEMPELFDSAPMVGYSDQTMDTKSFHFQTMFRLNVGGQFISPKQDSGLSRMWYDDTPYLYGAATGVTNHATKDVKIDYKTMPQNIAPPIVYSTSRSMGNNKDVNMGFNLTWIFHVDPGSMYLTRLHFCDYYYSKVNEIVFKIFINNQTAEAEADVIGWTGGKGVATYKDYVIYVKDEAGDDQLWLALHPAPETEPEFYDSLVNGVEVFKLNDTDLSGPNPQPSEMLIEHEEHAKTFQNKHGSNKTFVIGSAAGGAAGFALMAAIIVVVQHQKKKRAPGSYSTSSWLPIYGNTHTAGTKTTGSGKSVGSANISAMAQGLCRYFSLQEMKEATKNFDESNVIGVGGFGKVYKGVIDNGFKVAIKRSNPQSEQGVNEFQTEIEMLSKLRHKHLVSLIGFCEEDDEMCLVYDYMALGTMREHLYKGNKPLDTLSWKQRLEICIGAARGLHYLHTGAKYTIIHRDVKTTNILLDENWVAKVSDFGLSKTGPNMNQGHVSTVVKGSFGYFDPEYFRRQQLTEKSDVYSFGVV

SEQ ID NO: 183165 - protein, 129 aa, Glycine max
  Coding DNA Sequence Number=SeqID_66387
  Gene Ontology: Mol. function=chitinase activity; Cellular component =cellular_component; Biological process=defense response to bacterium
  Homolog annotation: Hit_ID=P09761; Match level="QueryCoverage=79%, HitCoverage=51%, E-value=2e-44, Identity=74%"; Hit description=Wound- induced protein WIN1 precursor
  Pfam annotation: Domain name=Barwin; Domain location=7-127; Score =210.2; E_value=4.8e-60; Accession=PF00967.8; Description=Barwin family
MGAGPNEAYKCKHTSKPTARQSVKHNWDLLAVSAYCATWDADQPFSWRSKYGWTAFCGPVGPQGPPSCGKCLMVTNTRTGDQQIARIVDQCTNGGFNLDVSVFQRLDSDGNGNAQGHLIVHYEFVDCAD

SEQ ID NO: 183166 - protein, 403 aa, Glycine max
  Coding DNA Sequence Number=SeqID_66388
  Gene Ontology: Mol. function=metal ion binding; Cellular component =integral to membrane
  Homolog annotation: Hit_ID=Q60DL1; Match level="QueryCoverage=95%, HitCoverage=62%, E-value=7e-58, Identity=39%"; Hit description=Zinc finger, C3HC4 type (RING finger) containing protein
MNPTPVCRKCIYEKLSDEETDCCPVCNIDLGCLPVEKLRMFAFHCVMTSAIDNIALNIFPNVSLKYFAKLILFLSIFKNQQCHKSVGRSLQNNQRKKIKAQEVLSSISLPAKRKERSLSSLVVSAPKVSMQPGFTGKRTKNSTRKAAALRGCSFLLDESIKKEQANGDDNMDSSMPEPSKKHKPHEDTENNVEHTEGKVDLWTPLNCLVEAANRTKSSRSNSQATPLAKLESPTTPHGGQDTSETTTKTDLPASAKSELNIPKSKNKDTGHKTIFGDDKDANSLPSGPGKRRRLRPAGQKRVAASEMSASSPAPLDTTGGKCNRKNSPIWFSLVASEDQKGDVPLPQISACYLRIKDGAVPVSFIQKYLVKKLNLACEAELFVRTDKLLQEAKQHSASLVDIV

SEQ ID NO: 183167 - protein, 142 aa, Glycine max
  Coding DNA Sequence Number=SeqID_66389
  Gene Ontology: Mol. function=chitinase activity; Cellular component =cellular_component; Biological process=defense response to bacterium
  Homolog annotation: Hit_ID=P29062; Match level="QueryCoverage=97%, HitCoverage=95%, E-value=1e-51, Identity=67%"; Hit description =Pathogenesis-related protein PR-4A precursor
  Pfam annotation: Domain name=Barwin; Domain location=22-140; Score =265.0; E_value=1.5e-76; Accession=PF00967.8; Description=Barwin family
MMTKLTLFVLSMVCVLALASAQSAIVQSTYHLYQPEQHNWDLLAVSAYCATWDANQPFSWRSKYGWTAFCGPAGPQGQPSCGRCLRVTNTRTGDQQIARIVDQCKNGGLDLDVSVFQRLDSDGSGNAQGHLIVHYEFVDCAD

SEQ ID NO: 183168 - protein, 509 aa, Glycine max
  Coding DNA Sequence Number=SeqID_66390
  Gene Ontology: Mol. function=protein serine/threonine kinase activity; Cellular component=intracellular; Biological process =protein amino acid phosphorylation
  Homolog annotation: Hit_ID=Q9FLJ6; Match level="QueryCoverage=81%, HitCoverage=86%, E-value=6e-33, Identity=24%"; Hit description =Arabidopsis thaliana genomic DNA, chromosome 5, P1 clone:MFB13
  Pfam annotation: Domain name=PPR; Domain location=167-201; Score=6.1; E_value=1.4; Accession=PF01535.11; Description=PPR repeat
  Pfam annotation: Domain name=PPR; Domain location=237-271; Score =17.2; E_value=0.06; Accession=PF01535.11; Description=PPR repeat
  Pfam annotation: Domain name=PPR; Domain location=314-348; Score =33.0; E_value=1e-06; Accession=PF01535.11; Description=PPR repeat
  Pfam annotation: Domain name=PPR; Domain location=349-383; Score =12.1; E_value=0.27; Accession=PF01535.11; Description=PPR repeat
  Pfam annotation: Domain name=PPR; Domain location=386-420; Score =17.8; E_value=0.04; Accession=PF01535.11; Description=PPR repeat
  Pfam annotation: Domain name=PPR; Domain location=421-455; Score =15.3; E_value=0.11; Accession=PF01535.11; Description=PPR repeat
  Pfam module annotation: Pfam domain module=PPR::PPR::PPR::PPR::PPR::PP R; Domain location=167-201::237-271::314-348::349-383::386-420::421 -455
  Subcellular localization annotation: CTP_CleavageSite=71; ConfidenceScore=5.56e-01
MPPLASLQLRRLLLRSRSLPFTSPSPIHHSPLFPRHSSSHFYSRTLFTPSFFITRHFSSETQTDEIASSLSSELLKEPDSDALSVSQRLNLSFSHITPTPNLILQTLNLSPQAGRTVLGFHQWLSSNPQFSHTDDTLSYFVDYFGRRKDFKATHDVLAAASPAAGPKTLASAIDRLVRAGRSSQAVQFFERMERDYGLKRDRDSLKVVVEKLCSEGFASYAEKMVKDLAREFFPDEATCDMLIRGWCIDGKLDEAQRLAGEMYRGGFDLGVGAYNAMLDCVCKLCREKDPFQLHSEAEKVLVEMEYRGVPRNTETFNVLITNLCKIRKTEDALGLLHSMGEWGCYPNETTFLVLIRSLYQAARLEEGDEMIDRMRSAGFGEFLDKKAYYQFLKILCGIERVDHALSVFAMMKDDGCEPGVITYDLLMGKLGAHNRIDKVNALFNEAKSRGLPVILKEYAVDPRYLKKKKKVVKGVKKRETLPEKMARKRSRLKQIRLSYVKKPKRVMGR

SEQ ID NO: 183169 - protein, 37 aa, Glycine max
  Coding DNA Sequence Number=SeqID_66391
MVLVIIIWGAVGRGNRAAKMLPRVAVFRCWIIRGLSG

SEQ ID NO: 183170 - protein, 74 aa, Glycine max
  Coding DNA Sequence Number=SeqID_66392
MPVRYAIIGASMNLLILHNHRTQYLFHLIGRVLAEKTLAQGHCRNLPFGGRATRDSRDACSTKGIRAESPPTFI

SEQ ID NO: 183171 - protein, 49 aa, Glycine max
  Coding DNA Sequence Number=SeqID_66393
MAIPQRKEEIARRNWAPLVTPMVKFDPEIGMKFYTNAWPTKERVCDMRS

SEQ ID NO: 183172 - protein, 68 aa, Glycine max
  Coding DNA Sequence Number=SeqID_66394
MFGEGINCENNKDNISQSRGSALDGGGHMNSARQSIHGAPNKRREWRIALGNHYAWLQTRWWRNQSGK

SEQ ID NO: 183173 - protein, 85 aa, Glycine max
  Coding DNA Sequence Number=SeqID_66395
  Pfam annotation: Domain name=zf-CCHC; Domain location=46-63; Score =6.7; E_value=0.078; Accession=PF00098.13; Description=Zinc knuckle
MGLNEGETAVVKKILRLMSPKFNYADEARTKVGSYRGRQSFNKQTVECYSRHELGHFHQECPAKQEGEANYTGSQEQVVVIICAE

SEQ ID NO: 183174 - protein, 168 aa, Glycine max
  Coding DNA Sequence Number=SeqID_66396
MAGNSSSEGLVDDFFEQILAVPEAAAFRGAAGLMPLGLNLEQAGFLRHQHQINVDDVVHVNVDDATIHHHHLTLHNNTTSSSPSSTAPITQDRDSMHMRGLFSAFGQLHTPTLAHSIRPTLPSPPPPRQPQLHLHHHNNQQRKLSIGFGGFTLQFDPSACGCAHSVDL

SEQ ID NO: 183175 - protein, 281 aa, Glycine max
  Coding DNA Sequence Number=SeqID_66397
  Gene Ontology: Mol. function=protein dimerization activity; Cellular component=nucleus; Biological process=regulation of transcription, DNA-dependent
  Homolog annotation: Hit_ID=Q0GPG9; Match level="QueryCoverage=100%, HitCoverage=61%, E-value=1e-105, Identity=73%"; Hit description=BZIP transcription factor bZIP89
  Subcellular localization annotation: CTP_CleavageSite=48; ConfidenceScore=5.40e-01
MDRVFSVDDISDHFWPPPPIPVSGANTSSQMSRSASEWAFQRFIQEASASAPSPPSSSSPADVVFVEIDDQPKPTPPPPSHGGVLPSDPGPVALDSEEYQAFLKSKLNLACAAVAMTRGSLAKSQDPSPFSDGGSQPTNPSLVGSQTTSKGSIPSGNDQSKLQDKDINAPVGIPSIPAIQKKPAVAIRPSTSGSSREQSDDEDIEGETSMNDNTDPADVKRVRSKLNKFYTGGKFNWGTNYASVNSMPNSYILYLRMLSNRESARRSRRRKQAHLTDLETQ

SEQ ID NO: 183176 - protein, 62 aa, Glycine max
  Coding DNA Sequence Number=SeqID_66398
MTHQEDETKGPLERGRSSVRDNTKTKEEEAHNCWVSKATTNRLWGKSHVLNSSSAEVRVLDS

SEQ ID NO: 183177 - protein, 295 aa, Glycine max
  Coding DNA Sequence Number=SeqID_66399
  Subcellular localization annotation: CTP_CleavageSite=74; ConfidenceScore=5.36e-01
MELYFLFLFPDSLSFNPLLNHIHLISSPPLATKTSPLRSPPSTSPYWSASSSATTSTPHPPHMRHLRCHLPNPRCVNLKPLVLDTLAASSTTASTSMTSSSSAAPSPENPKQPPYFLGLDLDSFAYRVFVRRPVEKTTLVHLTSLGKHGRFDLMACLVFNDVGGLLVLLVVLMGGGVKVVVVMGLGERGICFVLMHFVFLPQSLKPYESWRSCSKPQTRRDETTHTRVRFATRDTRRHATQRRAVRWLPCSVGSRESHKVHDELERSHDPRGPRRAREKQKPRVWGVRISEISWC

SEQ ID NO: 183178 - protein, 116 aa, Glycine max
  Coding DNA Sequence Number=SeqID_66400
  Gene Ontology: Mol. function=GPI anchor binding; Cellular component =anchored to membrane; Biological process=carbohydrate metabolic process
  Homolog annotation: Hit_ID=Q9SD84; Match level="QueryCoverage=80%, HitCoverage=48%, E-value=1e-35, Identity=69%"; Hit description =Glucan endo-1,3-beta-glucosidase-like protein 3 precursor
  Pfam annotation: Domain name=X8; Domain location=20-103; Score=163.0; E_value=7.8e-46; Accession=PF07983.3; Description=X8 domain
MALFALAVLLLAFTGSSSATWCVCKEGSDAILQKTLDYACGAGADCNPLHQNGPCFQPNTVRAHCNYAVNSYFQRKGQAQGSCDFAGTATVTASDPSTGGCSYPASASLEFDSSNL

SEQ ID NO: 183179 - protein, 215 aa, Glycine max
  Coding DNA Sequence Number=SeqID_66401
  Gene Ontology: Mol. function=ATP-dependent helicase activity; Cellular component=spliceosome; Biological process=cis assembly of U2-type pre-catalytic spliceosome
  Homolog annotation: Hit_ID=Q9FNQ1; Match level="QueryCoverage=84%, HitCoverage=8%, E-value=4e-62, Identity=68%"; Hit description=RNA helicase
MEAAIRIRSDKNASNAQSRMPSYGTQVTVQTESEKQIDKLRRKEEKRNRRGVEHAGDGELSALDFSSLHQASERKKMFDEMIGSGDKFESIAVTALPEGTVRKHFKGYEEVNIPPKPTAPLKPGEKLIEIRELDDFAQAAFRGYKSLNRIQSRIFPTVYGTNENILVCAPTGAGKTNIAMVSILHENKRGKWYKGDNVTEEAERRFLEVGSSALA

SEQ ID NO: 183180 - protein, 80 aa, Glycine max
  Coding DNA Sequence Number=SeqID_66402
MSMTSSTASSRMRYPIIRPPSIMQFKAALHNDQTFIEIPPFYHQQWVPNTQNRSSGDTREQPTKYNSNNTEADIFWQMDS

SEQ ID NO: 183181 - protein, 154 aa, Glycine max
  Coding DNA Sequence Number=SeqID_66403
  Homolog annotation: Hit_ID=Q9FNQ1; Match level="QueryCoverage=59%, HitCoverage=4%, E-value=1e-23, Identity=56%"; Hit description=RNA helicase
MARILLDLQHFPHVKMKLKVQRKDTDGDRSRILSVRLEKTNSRRHSSRAFVPRFPKIKEEQWWLVLGNTSTSELYALKRVSVSDHLVTSMKLPLTPANLQGLNEVSTICIPSARPFNIQNGPGNNKGIMSEAQMKIFNHHISISTYNLFPATKN

SEQ ID NO: 183182 - protein, 354 aa, Glycine max
  Coding DNA Sequence Number=SeqID_66404
  Gene Ontology: Mol. function=nucleoside-triphosphatase activity; Cellular component=intracellular; Biological process=regulation of transcription, DNA-dependent
  Homolog annotation: Hit_ID=Q9FNQ1; Match level="QueryCoverage=94%, HitCoverage=53%, E-value=1e-144, Identity=58%"; Hit description=RNA helicase
  Pfam annotation: Domain name=DEAD; Domain location=20-168; Score =24.6; E_value=4.7e-08; Accession=PF00270.19; Description=DEADDEAH box helicase
  Pfam annotation: Domain name=Helicase_C; Domain location=283-346; Score=6.4; E_value=0.004; Accession=PF00271.21; Description=Helicase conserved C-terminal domain
  Pfam module annotation: Pfam domain module=DEAD::Helicase_C; Domain location=20-168::283-346
MTCMQIGQHFRDGYLHKEEFKIVYVAPMKICFLFPAFVCHYSFLSIDSCPFQALAAEVTSTFSQRLSPLNMIVRELTGDMQLSKNELEETQMIVTTPEKWDVITRKSSDMSLSMLVKLLIIDEVHLLNDDRGPVIEALVARTLRQVESTQTMIRIVGLSATLPNYLEVAQFLRVNPDTGLFFFDSSYRPVPLAQQYIGISEPNFAARNELLNDICYTKIADSLRQGHQAMVFVHSRKDTAKTADKLVELARRNEDFELFSNNTHPQYTFMKVKEVIKSRNKDLVQLFEYGVGVHHAGMLRADRGLTERLFSDGLLKVLVCTATLAWGVNLPAHTVVIKLLRVGSPSAWALITLA

SEQ ID NO: 183183 - protein, 139 aa, Glycine max
  Coding DNA Sequence Number=SeqID_66405
  Gene Ontology: Mol. function=nucleoside-triphosphatase activity; Cellular component=intracellular; Biological process=regulation of transcription, DNA-dependent
  Homolog annotation: Hit_ID=Q9FNQ1; Match level="QueryCoverage=97%, HitCoverage=44%, E-value=2e-58, Identity=61%"; Hit description=RNA helicase
MAVILQGTQLYDPKAGGWRDLGMLDVMQIFGRAGRPQFDKSGEGIIITSHDKLAYYLRLLTSQLPIESQFISSLKDNLNAEVALGTVTNVKEACAWLGYTYLFIRMRMNPLAYGIGWDEKEEDGESHRALEHPGSRVLE

SEQ ID NO: 183184 - protein, 108 aa, Glycine max
  Coding DNA Sequence Number=SeqID_66406
MSSGRVLLRDMGQGAEGEIPPRNTKKVKRKEPEKKPGGDKDAREGGEKDKKTMKDFLPCPVVPNSEFEDWCRPWKGSLVVHVLGKRLNFKSWRLIFKKTGQGWKIDNS

SEQ ID NO: 183185 - protein, 377 aa, Glycine max
  Coding DNA Sequence Number=SeqID_66407
MPIITKDAITVYTEGEPTIHIEHFFDIGMLEGLGLNIQHTLMYCGIHGYFNDPEFIEMFWRNAQLKDWKTIVSKVLGKEVVLSMDFIAQVIGCIREGSTYQEDWEKPYECHVLKALYDRNLKETDGKKKIQYNLLYDMAKFWNGQGLQPVHHQQQRNLHHQHFSAVNLKKKLAKTIVDEDKALEAFGLAKKVKKILGEQKDKNYGRPSEIVQRPKMEPIQRQHKVVTTPQWISGTPRTTHPSSKQAKQKHKITITSNDLFAKTPRFTTPIVTIRMDLSKENLTPQVQWSKEATTYPLGLHINRSTNIKMVPGRTCPRLPICDEGKKKGLKLYINKEIPNRDSAQYEVAWKAKLATEVKYKVDAEARRQAAAKRKAEA

SEQ ID NO: 183186 - protein, 94 aa, Glycine max
  Coding DNA Sequence Number=SeqID_66408
  Gene Ontology: Mol. function=oxidoreductase activity; Cellular component=membrane; Biological process=electron transport
  Homolog annotation: Hit_ID=Q2PEY1; Match level="QueryCoverage=67%, HitCoverage=18%, E-value=4e-18, Identity=75%"; Hit description =Putative flavonoid 3'-hydroxylase
MEMSSMPTTKATNGGGAEKEPRGTKKMKAKALPINPFFPATCCHRELQDIQFRPERFLQDDEKAKVDIRGNDFEVIPFGAGRRICVGLSLGLRM

SEQ ID NO: 183187 - protein, 77 aa, Glycine max
  Coding DNA Sequence Number=SeqID_66409
MMIGTPKEEQADQRKRKTKKRPLAEEKESCTDNFFHLRYALLFTFSLSCWFFIVEIGVTSVEVKVLRRFIGGDYCGG

SEQ ID NO: 183188 - protein, 149 aa, Glycine max
  Coding DNA Sequence Number=SeqID_66410
  Gene Ontology: Mol. function=methyltransferase activity; Biological process=rRNA processing
  Homolog annotation: Hit_ID=Q8ZJW6; Match level="QueryCoverage=50%, HitCoverage=22%, E-value=6e-35, Identity=92%"; Hit description=16S ribosomal rRNA
EWLGNSAAGRTGDGVRHDWPAGGSLARDDCAGVTTIGGNDLAPSVTSFRTVAVKRSAGKAWRHVEHAADGKRRLFPGLASHHRAVNFETAGLGDHFVEAKRLIQHLRIRQEGVGNDTQFAAAVQMADRAADQRLRRFKTGLQAVVEWRI

SEQ ID NO: 183189 - protein, 105 aa, Glycine max
  Coding DNA Sequence Number=SeqID_66411
  Homolog annotation: Hit_ID=Q8W3Y5; Match level="QueryCoverage=44%, HitCoverage=9%, E-value=1e-18, Identity=95%"; Hit description =Flavonoid 3'-hydroxylase
MNLQELFAHRGQRRHHDVDEAEAEVHQRAVDAGQGRQGVVRYRAHVWGQTYLKLLGESCHSAEEDQKTFKYLEQAVGLPNPSLDLKDSCCQASMSSETYRVGSKL

SEQ ID NO: 183190 - protein, 86 aa, Glycine max
  Coding DNA Sequence Number=SeqID_66412
  Gene Ontology: Mol. function=oxidoreductase activity; Cellular component=membrane; Biological process=electron transport
  Homolog annotation: Hit_ID=Q8W3Y5; Match level="QueryCoverage=98%, HitCoverage=22%, E-value=2e-23, Identity=57%"; Hit description =Flavonoid 3'-hydroxylase
MMIGLRVFNDGSGGCDPRADEFKAMVVEARTMFYDIGRCFLKKTEHNSSSKNEKHKNLLSILLSLKDERDDHGNHLTDTEIKGLLL

SEQ ID NO: 183191 - protein, 187 aa, Glycine max
  Coding DNA Sequence Number=SeqID_66413
  Gene Ontology: Mol. function=oxidoreductase activity; Cellular component=membrane; Biological process=electron transport
  Homolog annotation: Hit_ID=Q8W3Y5; Match level="QueryCoverage=87%, HitCoverage=30%, E-value=9e-68, Identity=82%"; Hit description =Flavonoid 3'-hydroxylase
MAALRYLFKEVSRIHFFLKFNEEVARLTCNLASSDTKAVNLGQLLNVCTTNALARAMIGRRVFNDGNGGCDPRADEFKAMVMEVMVLAGVFNIGDFIPSLEWLDLQGVQAKMKKLHKRFDAFLTSIIEEHNNSSSKNENHKNFLSILLSLKDVRDDHGNHLTDTEIKALLLVPILFHNSFIVGLPTL

SEQ ID NO: 183192 - protein, 60 aa, Glycine max
  Coding DNA Sequence Number=SeqID_66414
MFQDKRPLLFVMHFVTRMFDHVNVVVPHKGKFRRDDHGTMKFVDCEFYVWEDNEVDLMIM

SEQ ID NO: 183193 - protein, 203 aa, Glycine max
  Coding DNA Sequence Number=SeqID_66415
  Gene Ontology: Mol. function=nucleic acid binding; Biological process= transport
  Homolog annotation: Hit_ID=Q8H6Q8; Match level="QueryCoverage=64%, HitCoverage=4%, E-value=1e-26, Identity=45%"; Hit description=CTV.20
  Pfam annotation: Domain name=MP; Domain location=11-181; Score=45.7; E_value=1.5e-10; Accession=PF01107.9; Description=Viral movement protein (MP)
MNDWSIPEIPQDSLYVLETIKDKHNFNYIIKTVENNIPLGHDIVEEFHLLSKNSIYEHSRKYKYLHIGCVQVAIKPLIDMGIDAAVLMCLRDIRHNKFEDSLIGTVETSLGQGPVYFNCYPNKTVSLVDRNILDSLFLNIHFHGLDMKEGSIPTSLIYRIQYKVMNSYASRVHLKPQRGETTLFITDMTKANVSLPRTIKWDE

SEQ ID NO: 183194 - protein, 162 aa, Glycine max
  Coding DNA Sequence Number=SeqID_66416
MAPRKLSAKRSRKDAMVEGTSAAPEFDNHRFRSAEHQQRFEAIKGWSFHRERRVQLRDNEYTDFQEEIARRRWTSLVTPMAKFDPDWIPFDADALSQFLGDLLVLEEGQECEYSHCPAVMHTGSGFFPDRCRETGADHAHPHDYLDLDVDDVAAQQHPAQRS

SEQ ID NO: 183195 - protein, 83 aa, Glycine max
  Coding DNA Sequence Number=SeqID_66417
MGFPLPAVPYLAENLSGVGLGPNSHITPQGTRDNDDLKTTCKISHGYSQVGTQASRLWNCDTTVGNLHKQTQRFPNYVLLSVQ

SEQ ID NO: 183196 - protein, 47 aa, Glycine max
  Coding DNA Sequence Number=SeqID_66418
MSLSVEDQLIRQALRASAKRNTPGLSARKTLEEDKLYRFAKHTASSH

SEQ ID NO: 183197 - protein, 259 aa, Glycine max
  Coding DNA Sequence Number=SeqID_66419
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=8e-41, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=27; ConfidenceScore=5.25e-01
MARTCSPLKARTCSPLKVRTCSPVKVRACNPMKEKVRTCSPLKERACSPLKGRTCSPLKARACGPLKARTCSRLKVRTCSSLEARTCSPLKVRACSPLRVRTCSPLKARACSPLKARTCSPLKVRTCSPLKVMACIPPMARTCCPLNARACSPLKARMCSPLKARTCSHLKVRVRDPLMVRMCSPLKVMACIPPMARTCCPLNARACSPLKARMCSPLKARTCSHLKVRVRHPLEARMCSPLKVRACSPLKVRTCSPLK

SEQ ID NO: 183198 - protein, 85 aa, Glycine max
  Coding DNA Sequence Number=SeqID_66420
MVSPSGIEDSLEISEKNCFHEENPSRGASVTLSRRFRGRFRGDSSPFFIVLRSSTVLKELHRSDFLIAIEEYIGVRETPLSTTKR

SEQ ID NO: 183199 - protein, 209 aa, Glycine max
  Coding DNA Sequence Number=SeqID_66421
  Gene Ontology: Mol. function=oxidoreductase activity, acting on NADH or NADPH; Cellular component=chloroplast; Biological process =electron transport
  Homolog annotation: Hit_ID=Q2PMN7; Match level="QueryCoverage=43%, HitCoverage=25%, E-value=2e-45, Identity=100%"; Hit description =NAD(P)H-quinone oxidoreductase subunit 1, chloroplast (EC 1.6.5.-) (NAD(P)H dehydrogenase subunit 1)
  Pfam annotation: Domain name=Complex1_49kDa; Domain location=1-115; Score=-102.5; E_value=1e-05; Accession=PF00346.9; Description =Respiratory-chain NADH dehydrogenase,
  Pfam annotation: Domain name=NADHdh; Domain location=112-209; Score= -146.4; E_value=6.2e-05; Accession=PF00146.11; Description=NADH dehydrogenase
  Pfam module annotation: Pfam domain module=Complex1_49kDa::NADHdh; Domain location=1-115::112-209
MMESIKIIQQALEGIPGGPYENLEIRCFDREKEPEWNEFEYRFISKKPSPTFELPKQELYVRIEAPKGELGIFLIGDQNGFPWRWKIRPPEIQDIHFFFRLESFKEIYGIIWVFAPILILILGITISVLAIVWLEREISAGIQQRIGPEYTGPFGVLQALADGTKLLFKENLIPSRGDIRLFSIGPSISVISIIISYSVIPLGYNLCFI

SEQ ID NO: 183200 - protein, 58 aa, Glycine max
  Coding DNA Sequence Number=SeqID_66422
MDIDAAILMCLRDIRHNKFEDSLIGTVETSLGQVSLMDRNILDPLFLNIHFHGLDMKE

SEQ ID NO: 183201 - protein, 97 aa, Glycine max
  Coding DNA Sequence Number=SeqID_66423
MGLNQTSEYRVMVVWNWLRASTFNFERLDMLRDSIRHPCKKLLSFELAQRINIQFRASQYDTGLNHTSEKKSFNIPFRASRYITGLNQTSEKKVIVV

SEQ ID NO: 183202 - protein, 91 aa, Glycine max
  Coding DNA Sequence Number=SeqID_66424
MRGSGEFVPFLDTTSRGSKVPQRTFLRRRHGPSVGLFTQGIKTEPICNAYAKDTMRECAQGIIPFEEHIVAVGTTSNNRFSKRKALDEGSL

SEQ ID NO: 183203 - protein, 378 aa, Glycine max
  Coding DNA Sequence Number=SeqID_66425
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=32%, E-value=1e-109, Identity=43%"; Hit description =Chromo
GDPSLQDHHLSYNALKGSSGLGIMKFQGSINGLGVQILLDSGSSDNFLQPRLAQCLKLPVEPIPNLQVLVGNGNALTAERLIQDLEVKIQGHTLKLPVYLLPISGADLVLGAAWLATIGPDLFDYSTLTLKFYLELFTLQYSRLDGPQDQLLDIPDDMEPELAMILYIYRTVFDVPSEALFSPPIILVKKKDGTWRFCTDYRALNAITIKDSFPIPTVHELIDELHGAVYFSKLDLRPGYHQILVNEEDRHKTAFRTHQWHYEWLVMPFGLTNAPATFQSLMNEIDYLGHIVSSKGVTMDQEKVQAVLNWPYPINMKQLRGFLGLAGYYRKFIKGYVSIATPLSNLLKKENFHWNDHTSMAFDNLKAAITKGTSTGIA

SEQ ID NO: 183204 - protein, 145 aa, Glycine max
  Coding DNA Sequence Number=SeqID_66426
  Gene Ontology: Mol. function=transporter activity; Cellular component= integral to membrane; Biological process=transport
  Homolog annotation: Hit_ID=Q7CGC6; Match level="QueryCoverage=60%, HitCoverage=20%, E-value=5e-39, Identity=90%"; Hit description =Transport of hexuronates
MLYTVRWEGARGHRICYTTYSAPLPEEQKARRGGRATGSAARRRRLQRGRLRFGGRAVLQHRPDDDGAENIEDRQRGEQRAEAESVRQGADHQREQRAGGPGCHAGQAVGGRHLIAAEHVGREGDQRAGQRLMGEAADAQQRNSR

SEQ ID NO: 183205 - protein, 67 aa, Glycine max
  Coding DNA Sequence Number=SeqID_66427
MKTHDVNLASRPKILAADMPIREEELANLVKMVGSHEGTVNVSIHDFDDAKEESNKAASNDKHLLQE

SEQ ID NO: 183206 - protein, 296 aa, Glycine max
  Coding DNA Sequence Number=SeqID_66428
  Gene Ontology: Mol. function=nucleoside-triphosphatase activity; Cellular component=chloroplast
  Homolog annotation: Hit_ID=Q2PMM5; Match level="QueryCoverage=99%, HitCoverage=16%, E-value=1e-140, Identity=95%"; Hit description =Protein ycf2
MSHTNGFGSTTMGSNVRDLVALTNEALSISIIQKKSIIDTNIIRSVLHRQTWDFRSQTFWSLPGPDEKNGITSYGLVENNSDLVHGLLEVEGALVGSSRTEKDCSQFDKDRVTLLLRSEPRNPLNMIQNGSYSIVDQRFLYEKYESEFEEGGGVLDPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKH

SEQ ID NO: 183207 - protein, 758 aa, Glycine max
  Coding DNA Sequence Number=SeqID_66429
  Gene Ontology: Mol. function=heat shock protein binding; Cellular component=integral to membrane; Biological process=protein folding
  Homolog annotation: Hit_ID=Q8RYN2; Match level="QueryCoverage=21%, HitCoverage=10%, E-value=4e-50, Identity=65%"; Hit description =Auxilin-like protein
  Pfam annotation: Domain name=TolA; Domain location=376-646; Score= -139.0; E_value=0.018; Accession=PF06519.2; Description=TolA protein
MTGDDESNLGGQGLITRNGKKVTCKPEEDGNKFEGSFDLEECQTNLRAAQELGEVEKNITQEQKGSEDRVAVSNELEECKINLRAAQELREVEKNITQEQKGSEDRVAVSNELEECELTEILEPLNNENVHSQHGSDFISTDEDIENFGCLENRKKRNDSGFLDIYQEIEYSGQREATDDALYNKEPTEVIRVTQSDPSCEEVKAEEAGKSTETSSSYDPDETEKLNKTQVADTTIENEETLNVNPEVHSCDVQDDTMVASSASFQHQERYEETDPVQETNDFHEKHNAGETSSFIQIAPELNGAVNQMQNIFETETSEGNATSIGDTDINDRQNQDQCWEKSENDCNLEMLVEDIITPESAEICKDAKENRVTLNEEADENQSNFSNEENLFDNEHNIEESQISSSSDRKSSLFKEEEVESSHSNLRESNRASVIMEEKEANGNLHKEEQEKEQLKKLAEANETKREREKEKLAVERAIREARERAFADARERATLERAAAEARQKNISDGRERLGKTTSQANEKTPAEKAAMEAKLKAERAAVERATAEARARALERALSERAASEARNKSDKSVAGFGASRDNGIKHNFYSKSFSYGVRDSTDVFDGADGDSAQRCKARFERHQRIGERVAKALAEKNMRDWLVQKEQEHRNRVAESLDADVKRWSSGKTGNLRALLSTLQYILGPDSGWQPIPLTDIVTTTAVKKAYRKATLFVHPDKLQQRGASIQQKYICEKVFDLLKVWPSFVLLSSKQFY

SEQ ID NO: 183208 - protein, 89 aa, Glycine max
  Coding DNA Sequence Number=SeqID_66430
MRTISSSFDEGIDEQVCDACVIIIELVMVAGLNLHKGLHNEDAIGGVDVVDDRIWKGPVTRAMSKKLQEDWARAVEEGPRVLMNLRLDF

SEQ ID NO: 183209 - protein, 96 aa, Glycine max
  Coding DNA Sequence Number=SeqID_66431
METEDHMHNETRQFHWDISFSHVQQGTYDQLEISKLMGPQTLLNELAAPYLTPMVLCDNSNVVQMAHGPVLHAKTKHMELDLSLLCQRKSLVQEAD

SEQ ID NO: 183210 - protein, 53 aa, Glycine max
  Coding DNA Sequence Number=SeqID_66432
MYAYQLSPQVYEYKDCPYNLYSAISNTPRPLPLQAPQTQVDNDEEDGRRMVLQ

SEQ ID NO: 183211 - protein, 193 aa, Glycine max
  Coding DNA Sequence Number=SeqID_66433
  Homolog annotation: Hit_ID=Q9AVH2; Match level="QueryCoverage=24%, HitCoverage=16%, E-value=6e-20, Identity=97%"; Hit description =Putative senescence-associated protein
MTEGCGEGFCLANLPGDAFSLWGNFFEAKKQMMADAKFAGLLGLGKPLVEICPRSTSWFCPLWLARVACWGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 183212 - protein, 54 aa, Glycine max
  Coding DNA Sequence Number=SeqID_66434
MDASMLAYMEENGKGTRKSIIMNWVNSSSEGDSRDKDCSSLYCSLIIFLVNVIS

SEQ ID NO: 183213 - protein, 75 aa, Glycine max
  Coding DNA Sequence Number=SeqID_66435
  Gene Ontology: Mol. function=small conjugating protein ligase activity; Cellular component=nucleus; Biological process=protein modification process
  Homolog annotation: Hit_ID=P25865; Match level="QueryCoverage=56%, HitCoverage=28%, E-value=4e-16, Identity=88%"; Hit description =Ubiquitin-conjugating enzyme E2-17 kDa 1
MDVFISDLFIIATGNVTHCDQLPTCDLFCKWYKSLLCDPNPNSPANSEAARMFSENKREYNRRVREIVEQSWTAD

SEQ ID NO: 183214 - protein, 708 aa, Glycine max
  Coding DNA Sequence Number=SeqID_66436
  Gene Ontology: Mol. function=protein-tyrosine kinase activity; Cellular component=integral to membrane; Biological process=protein amino acid phosphorylation
  Homolog annotation: Hit_ID=Q1S7R4; Match level="QueryCoverage=98%, HitCoverage=99%, E-value=1e-159, Identity=47%"; Hit description =Protein kinase
  Pfam annotation: Domain name=LRR_1; Domain location=122-144; Score =5.0; E_value=33; Accession=PF00560.23; Description=Leucine Rich Repeat
  Pfam annotation: Domain name=LRR_1; Domain location=146-168; Score =13.2; E_value=0.93; Accession=PF00560.23; Description=Leucine Rich Repeat
  Pfam annotation: Domain name=LRR_1; Domain location=170-191; Score =12.4; E_value=1.3; Accession=PF00560.23; Description=Leucine Rich Repeat
  Pfam annotation: Domain name=LRR_1; Domain location=193-212; Score =5.7; E_value=24; Accession=PF00560.23; Description=Leucine Rich Repeat
  Pfam annotation: Domain name=LRR_1; Domain location=214-236; Score =11.7; E_value=1.8; Accession=PF00560.23; Description=Leucine Rich Repeat
  Pfam annotation: Domain name=LRR_1; Domain location=238-260; Score =10.0; E_value=3.8; Accession=PF00560.23; Description=Leucine Rich Repeat
  Pfam annotation: Domain name=LRR_1; Domain location=262-281; Score =11.7; E_value=1.9; Accession=PF00560.23; Description=Leucine Rich Repeat
  Pfam annotation: Domain name=LRR_1; Domain location=286-307; Score =10.1; E_value=3.7; Accession=PF00560.23; Description=Leucine Rich Repeat
  Pfam annotation: Domain name=Pkinase; Domain location=408-688; Score=- 67.7; E_value=0.00016; Accession=PF00069.15; Description=Protein kinase domain
  Pfam annotation: Domain name=Pkinase_Tyr; Domain location=443-688; Score=-147.7; E_value=0.0021; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::Pkinase::Pkinase_Tyr; Domain location= 122-144::146-168::170-191::193-212::214-236::238-260::262-281::286 -307::408-688::443-688
MKILWLCFSYLFPAIILVLLTPSSVAQLSPSEGRILFQVQKLLEYPQALQGWTRWTNLCFLPPSPSLKIVCSNGHVTELTIIGNKTSPSSHNPKAGAWTSLQTLSERFSIDSFFTVMTKLSNLKVLSLVSLGLWGPLPAKINRFWSLEVLNISSNFIYGGIPQSLSSMRNLRSLVLVDNLFNGSVPDLQRLTSLEELNLGGNNLGAQFPSVGKNLVTIMLRNNSLRSHIPPQLVHFDKLQVFDVSSNNFFGNIPSFLISLPSLQYLNLASNHLSGNLSVNMACSSSLTFVDISHNLLVGKLPSCFGSVSSKAKVLYSGNCLSTEKRLNDQQHPFSFCKREGALAVKPPAKNLKKESGSGAKLGLMLGIIVGIVLIGGLLVLLVVCIFRKSKAERSHPKMDKSVANKYSISVSPRPIGTIGHIPQAMKQAAVGLPPYRIFTSEEIEDATNNFDPSNLIEEGSLGQQVEVLHNLRHRHMVSVLGHCIITEQEHPQTTSTVFIVFEYISNVSLRDQLSDGRKREMLKWPQRMAMSIGIARGVQFLHTGVAPGIYGNNLKIENILLDDSLNAKVSRYNIPLPSKIAHIEQNATNHIGSTNDAEKEDIYQLGIILLEVITGKQITSSSEIEELKEELENGSSEATSVIRSAIDPSLRGTYAYESMKTAVQITINCLSKVSSQRPSIEDVLWNLQYAMQVQESWTSSGNLSTKL

SEQ ID NO: 183215 - protein, 63 aa, Glycine max
  Coding DNA Sequence Number=SeqID_66437
MTAWNGVCKKDEGKHTSNSVRQKVVITLHTIQMMDHRPFFPQPSDHLDHITVVRQEKEQHEVH

SEQ ID NO: 183216 - protein, 55 aa, Glycine max
  Coding DNA Sequence Number=SeqID_66438
MALLGWMKAIGVRYFANCHAITDRDMVRTKEKESLEGFGVPMIRARIKKIKEVFQ

SEQ ID NO: 183217 - protein, 32 aa, Glycine max
  Coding DNA Sequence Number=SeqID_66439
MSSSFVKSGIHMEGNSVTVVNARILVVAYGLI

SEQ ID NO: 183218 - protein, 167 aa, Glycine max
  Coding DNA Sequence Number=SeqID_66440
  Gene Ontology: Mol. function=serine-type peptidase activity; Biological process=proteolysis
  Homolog annotation: Hit_ID=UPI00006B0FAA; Match level="QueryCoverage =59%, HitCoverage=31%, E-value=1e-15, Identity=42%"; Hit description =putative peptidase
MKRIIYFCLLILSNLVFSQNLSTGFEELQPEKIGGYTVKNTEGKEVYKTEYQHLDSVKIFGYNYLSEDNLKIRGFLIEPKIKGKYPVIIFNRGGNGELGAVTLPVLTDFLSKIAAKGFVVIGSQLRGGARSEGKDEFGGKDIGDVLKLFEIIDHQETIDPKKVGMLG

SEQ ID NO: 183219 - protein, 221 aa, Glycine max
  Coding DNA Sequence Number=SeqID_66441
  Gene Ontology: Mol. function=binding
  Homolog annotation: Hit_ID=Q8S3S1; Match level="QueryCoverage=54%, HitCoverage=18%, E-value=1e-31, Identity=56%"; Hit description =Putative kinesin light chain gene
MTAPLQTHKSQNWQEKKLNTCALYHRAQHKGVAEGLDLDLEALVVAGDGSIDLAEHGEGGEGVIGAAFDVRDFNSAFEDGDDFFKVSEAAVDGGEDVEAHGEVEAGLSLADATLEGLGGPDGEVEGLGGPIARGNGVASQFKEEWAEIRVVERGIKEKRRGFWSFLFRGARRRWGGWFFGIGWVCPGWRFGGVGCPIRDVAVEGVGLEIRVWRMSCREWGG

SEQ ID NO: 183220 - protein, 97 aa, Glycine max
  Coding DNA Sequence Number=SeqID_66442
MTKAIVSLLLSSLVPKVVDLAVDPQEYRLYRYLICWNLSSCIWYFQVTFDGLVICTMFIQTKFHAKDEGDNKSKQVLEEIYKVELFGCNGEEFDLLN

SEQ ID NO: 183221 - protein, 480 aa, Glycine max
  Coding DNA Sequence Number=SeqID_66443
  Homolog annotation: Hit_ID=Q1S7R7; Match level="QueryCoverage=94%, HitCoverage=90%, E-value=3e-48, Identity=35%"; Hit description=IQ calmodulin-binding region
  Pfam annotation: Domain name=IQ; Domain location=69-89; Score=18.0; E_ value=0.035; Accession=PF00612.17; Description=IQ calmodulin-binding motif
MDVLVVSSETSMSTPTSGANAIKGVLSEKEVVSVSSNDGVILSIEDKQDKAQSLANIGSGDHQEKIGQIEAAIIVQAAIRGYQSIVKFQALARGYKVRHSDVGLAVQKIFKDTKLPNFIGVDSTTQAGKLSDSIFINKASSPSSVSPNLKYNAGEPNLAWEWLDRWTKSHFWVPLREARKPDSMSDKKNGSCQIVETNKGQVKRNARKAPSVRAGDDSVSDSNKHKCYPKKDSNLPLHSAKEHPQKDLEKRSSKKPQIQNGFDKSEVANKKRTHITRKVSDHTTVTDVQEDDAGAPSKKLEGLAVSESKQSDLEKSLGQQTEEHDTNESCNDTNAPLQSSLVNGKDGEFIEDLNNVNSKNFQRRASLPANFADHENLLHNNTPRRPSYMAPTESTKAKLRGHEQGSPRSVSDLADVSSITRRLSLSSSLNGKLGSFPPWSDRLAALSNKIRTNRCLSSSKDGTGKNIGFCTFLLFHLFTR

SEQ ID NO: 183222 - protein, 311 aa, Glycine max
  Coding DNA Sequence Number=SeqID_66444
MDSQQDSPPSAHGTQGPVAYNRFIYIYYFTYLRYFFNKYPHTLYTVKSTPTAYTNRVCKPNLCMNTNTHFTPIPTYFHKHYPKPSSPLRYPKIHLPSFDGSDPLGWLFQDDQYFLYYQIPLEQSLITLGSFLYGGELDILHPYFITQAIGMVKLMEDKIRDVRPKQFWSSNINPDSFTKLVATPALVTIVSPSSTTILLKHFSIAYMHERRAQDNDCDTIAPLEEAIVPFPFNEEEPMHFHFYHHRPLMDNIHPSLSNFLVKLVILSVMVEQPKVTFGVQVTLAVEASGLHLTVPSACRTPMCEVVATTHL

SEQ ID NO: 183223 - protein, 132 aa, Glycine max
  Coding DNA Sequence Number=SeqID_66445
ESHPQRHPVDPEKSNWALGFPALVTGLCSPTGCLFPPTRSRHHDIDTQWTRRSPTGSWSCQALITGLCQFYGVPVTSSKGIRPPTNRAFIKKYCVPRQAQGETPQPPGDGQQRATDAPPSPLEFNSAHPQKG

SEQ ID NO: 183224 - protein, 98 aa, Glycine max
  Coding DNA Sequence Number=SeqID_66446
  Subcellular localization annotation: CTP_CleavageSite=65; ConfidenceScore=5.90e-01
MKDSRNTSSGDVSSTSRTSQSLTNSSQALRTTFSSSSNLYSGALSGMILRSANMHNSSFFLILPRAQLRSVALSGWLAKPEDWLSERVKISTSQTCLN

SEQ ID NO: 183225 - protein, 79 aa, Glycine max
  Coding DNA Sequence Number=SeqID_66447
MFVTTFNTPPSVYNLAPSSSCYRPSLPTQIRDMSHEDEDENEDEDEDNNNNNDDDDDGDGVDDDDNSGHHVPQQHRTIA

SEQ ID NO: 183226 - protein, 236 aa, Glycine max
  Coding DNA Sequence Number=SeqID_66448
  Homolog annotation: Hit_ID=Q9AVH2; Match level="QueryCoverage=19%, HitCoverage=16%, E-value=4e-22, Identity=100%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGFVGDFGGEGRIKATRAESQWIVAARPLCHLQYPVAYLSRLQRILPAARWELRFKASRRANPPHEGHQRHVPFGGPRPPTAAHVPYWWVNNPTLGEFCFTMIGRADIEGSKSNVAMNAWLPQASYPC

SEQ ID NO: 183227 - protein, 93 aa, Glycine max
  Coding DNA Sequence Number=SeqID_66449
MAMDLNFSLTTRALSSSAFRACTSSLSSEIWEPIQSLCSDSQPLMIAADDPITASPKLSVLSSRRIPCLANSLEYPRVVVTETPCDERRDAFV

SEQ ID NO: 183228 - protein, 233 aa, Glycine max
  Coding DNA Sequence Number=SeqID_66450
  Gene Ontology: Mol. function=DNA-directed RNA polymerase activity; Cellular component=chloroplast; Biological process=transcription, DNA-dependent
  Homolog annotation: Hit_ID=Q2PMQ3; Match level="QueryCoverage=87%, HitCoverage=61%, E-value=1e-108, Identity=95%"; Hit description=DNA -directed RNA polymerase alpha chain
  Pfam annotation: Domain name=RNA_pol_A_bac; Domain location=87-199; Score=77.3; E_value=5e-20; Accession=PF01000.16; Description=RNA polymerase Rpb3RpoA insert domain
  Pfam annotation: Domain name=RNA_pol_L; Domain location=45-228; Score= 31.3; E_value=3.5e-06; Accession=PF01193.14; Description=RNA polymerases L  13 to 16 kDa subunit
  Pfam module annotation: Pfam domain module=RNA_pol_A_bac::RNA_pol_L; Domain location=87-199::45-228
MQRAEVMIKGPGLGRDAALRAIRRSEKIRVSTRTLQWKCVESRIDSKRLYYGRFILSPLMKGQADTIGIAMRRVLLGEIEGTCITRVKSEKIPHEYSTIIGIEESVHEILMNLKEIVLRSNLYGTRDASICFKGPGYVTAQDIILPPSVEIVDNTQHIANVTEPVNLCIELKIERNRGYRIKTLKNFQDGSYPIDATFMPVRNVNHSIHSYVNGNEKQKDTLTRNMENGSFNS

SEQ ID NO: 183229 - protein, 178 aa, Glycine max
  Coding DNA Sequence Number=SeqID_66451
  Gene Ontology: Cellular component=extracellular region; Biological process=sexual reproduction
  Homolog annotation: Hit_ID=O23547; Match level="QueryCoverage=93%, HitCoverage=69%, E-value=3e-30, Identity=40%"; Hit description =Expansin-like B1 precursor
  Pfam annotation: Domain name=DPBB_1; Domain location=55-126; Score =4.5; E_value=0.0057; Accession=PF03330.8; Description=Rare lipoprotein A (RlpA)-like double
MELSFKHQLGLVCVILFFPALCNCQEYIGPVDDYWNPIGACGFGEYGKTVNNGIVAAVSEPLWRDGAGCGTCYQVCCKLQCCDEKGVYVVVSDAQGDRRNSSLTLSPGALSILVHNKPGCANRIKHDMGDIVIKRVPCRYPGNIKLRVQESSKNPGYFAVVILDVNGIRDITAVEMWL

SEQ ID NO: 183230 - protein, 47 aa, Glycine max
  Coding DNA Sequence Number=SeqID_66452
MARIPDKIRSIDGSKETLKLVVRITDLWFVGTPNKSEQAEKVFVDSE

SEQ ID NO: 183231 - protein, 194 aa, Glycine max
  Coding DNA Sequence Number=SeqID_66453
  Gene Ontology: Mol. function=transition metal ion binding; Cellular component=chromatin; Biological process=cytoskeleton organization and biogenesis
MMEENTSLIDKGQWQPYSPNHLIFAINDFATNSIKNKGTFIFLTPIKNFLQSPIQVIRTCVMSFNTISTQISICWKVINGTKNHSTLSSHTSTPSSHNFLKSSINRVRYTSISFHDCLGPAIIIQSIMYFRLMHNQLGRLQIISKTGHELWLVLKLQKGFILSEARPSLRFLGSSEKSRYKRSIVSHCGESTGC

SEQ ID NO: 183232 - protein, 364 aa, Glycine max
  Coding DNA Sequence Number=SeqID_66454
  Gene Ontology: Mol. function=nucleic acid binding; Biological process= DNA integration
  Homolog annotation: Hit_ID=Q1SDN3; Match level="QueryCoverage=34%, HitCoverage=9%, E-value=6e-39, Identity=61%"; Hit description =Polynucleotidyl transferase, Ribonuclease H fold
  Pfam annotation: Domain name=Pkinase; Domain location=193-359; Score=- 94.2; E_value=0.006; Accession=PF00069.15; Description=Protein kinase domain
  Pfam module annotation: Pfam domain module=Pkinase::RVT_2; Domain location=193-359::1-226
MQDEITALETNHTWFLTDLPSDKTAIGCHWVCKIKYNADGSIELYKARLVAKDYTQLEGVDFLDTFSLVAKLTIVRLLLALAAIHKWHLKQLDVNNAFLHGELLEEVYIQPPLGLHVSKPGQSLELDHTCMPFHLRTSHSRLHPTFSSPQISVVTFHKPPSHSQLYSRPLGSLAVGATPPSSQQQGLWFFLRFHNMPRVHTLAHLPQVESVLIAASNATKEKAQLKALQLLCYMFFSSEISNSRLLQDLKWGNFGLLSLGKFGAFPEAVIRTYTKQLLLVLEYLHKNGIMHRDIKVDFYFVGANILVDNKGCIKLADFGASKQVVELIISVLYVALLLCMSLYLCVDHSKKKLCISRVVLELPA

SEQ ID NO: 183233 - protein, 63 aa, Glycine max
  Coding DNA Sequence Number=SeqID_66455
  Homolog annotation: Hit_ID=Q40442; Match level="QueryCoverage=90%, HitCoverage=40%, E-value=4e-07, Identity=42%"; Hit description=Tumor- related protein
KSQQRWEPLRRSYGAVFDFANPPSGEILLRFKAGFWKQAKIPANWKPGATYDTKVQIPGTYYK

SEQ ID NO: 183234 - protein, 271 aa, Glycine max
  Coding DNA Sequence Number=SeqID_66456
  Gene Ontology: Mol. function=nucleic acid binding; Biological process= DNA integration
  Pfam annotation: Domain name=zf-CCHC; Domain location=174-191; Score =9.2; E_value=0.03; Accession=PF00098.13; Description=Zinc knuckle
MAFIAIFTFIRVRILLLLLCLLLLDANNYDSWSRSMLTALSAKNKVEFVDGSAPQPSSSDPLFNVWRPCNNMVVSWLVHSVFISIRHSILWMDRADEIWKDLKSRHSQQAQQEHQLLGNVTYDTKETLINVVNNSYCTHYGRAGHTEVVCYRKHGFSSNTDNKSGKSITNRGGKICTHCGRTGHTVEVCYRKHGFPSRHKFYNNKNNVVNNIVIGHGRVMENDPQQFQALSLIQQPNNGTSTSSTSCVNQIGLMSSSITVGLENHEEDWYN

SEQ ID NO: 183235 - protein, 443 aa, Glycine max
  Coding DNA Sequence Number=SeqID_66457
  Gene Ontology: Mol. function=transferase activity; Cellular component= chromatin; Biological process=DNA integration
  Homolog annotation: Hit_ID=Q2HSF9; Match level="QueryCoverage=89%, HitCoverage=64%, E-value=1e-145, Identity=66%"; Hit description =Polynucleotidyl transferase, Ribonuclease H fold
MGHIDGTISSQSPTIIQDGSSTPNPQYTNWFTIDQLIINLLLSAMTEANNLSFASYDTARSLWVAIEAQYANTSRSHVMSIKNQLQCCTKGDKSITDYLFSVKSLADELAVIDKSLSDDDVTLYVLNGLGAEYRDIAASIRTREHPFTFEELHSHLLAHDDYIRREEAQINVQVPTTNFAQHQRNSKQAGLLPLPSDGRGHVSSKPSQNMHPSLLTDRVIIHARLVALIPVVIDLHHDASASNHVTTNLNNMHLYSEYNGLEEVQIGDGTGLKISHVGSTTLPTPTTMFNLRDVLSVPHAKHNLISVSKFCKSNKAYIEFHPSFFCVKDQGTGATLMHGPSNGDLYTYRLASPPSPIALSTTCTSSPLWHSRFGHPSSRVLAQGMPYISQSAISFNYVGVEVTEGIAGTIREGELVTIGSKEVGCVGEKEVEEGNDGSEDNVW

SEQ ID NO: 183236 - protein, 51 aa, Glycine max
  Coding DNA Sequence Number=SeqID_66458
MAMNALSVSCCAKRMASRKRKAAASRPQPYYDTHRFTSEDAWNRYADNILG

SEQ ID NO: 183237 - protein, 87 aa, Glycine max
  Coding DNA Sequence Number=SeqID_66459
MYHLIKKRRMDINGMVVEPRPWGFFRHGVEVPMTRDDDPMESKPSSKAGIKGEKKVESRKVEYTRKKCDEKETCDYSCVDIKLGVLF

SEQ ID NO: 183238 - protein, 124 aa, Glycine max
  Coding DNA Sequence Number=SeqID_66460
MAPKFIWSRSTSVIEREDNSFNLLHRRKVSQHSIIFRSDQIGNELRYQIIREEKKFSSKKGREKLDGMFLDLIYGIKDSATILEKVDLVDCMPLFSDSVEEGWVMMYVTKNIFVPEFKSRLYIL

SEQ ID NO: 183239 - protein, 205 aa, Glycine max
  Coding DNA Sequence Number=SeqID_66461
MHEVFSRNVAEKCKKIEGRGTLRYSGRRGSKNLGELASGDYPTFGALIYVLSSIENVVCLEKPYAMVMSRGLIPTTNNFQSQEMSRESHLLRAWSSRQTERVWSCQEMHTSVYTCHTLGHIVSVDKPDVTFITIDHHRYYYIPWDLRLTDNCGVSHDAQEFKVTPVRLDTRGNESWRFELMMTKEMTKSSKINQRTTQVNQRSIK

SEQ ID NO: 183240 - protein, 71 aa, Glycine max
  Coding DNA Sequence Number=SeqID_66462
MSNFYIQNKNLHRSSMEASLQEKGEWKWSAKENEREFTMPRSTVELQEKKKMTFFEQENQSSQILKEWVSW

SEQ ID NO: 183241 - protein, 205 aa, Glycine max
  Coding DNA Sequence Number=SeqID_66463
MATRGGGSDDSWVAKIHKAMKKANNSVIGYVSSKSHWPLPQVHISLRPQHKSMEKILSMGFDLFKHKKSSKTRAHAVNRRMSLLAMGNLIGALDGLANLRYSVVLSKIEFEREKLELKLDDVLHSQMKLLQVWGSIEKRHVTAITIIYECLYAVACRVHLLDGAMVSPTKDVYSVFGLTFYSRYPSGALSLTWIQLNATILQTHS

SEQ ID NO: 183242 - protein, 151 aa, Glycine max
  Coding DNA Sequence Number=SeqID_66464
  Pfam annotation: Domain name=zf-CCHC; Domain location=3-21; Score =6.7; E_value=0.078; Accession=PF00098.13; Description=Zinc knuckle
MPPSCWAHCKTIGHLVSNCKVIFSSSDNVIKAHAHQGKKNAKENGAELNVVVVEPILTKPSSSSPLEDVIDATQNPQQQIPLSFINSPIPIEKTVSPFHERVVNDLRIASKFGEDLVEEEFEDESIPPEGTSTINPDFDVVLSKSQKKKLK

SEQ ID NO: 183243 - protein, 112 aa, Glycine max
  Coding DNA Sequence Number=SeqID_66465
  Homolog annotation: Hit_ID=Q75ID5; Match level="QueryCoverage=59%, HitCoverage=78%, E-value=4e-14, Identity=54%"; Hit description =Expressed protein
MASFARGAASLTRIGLSSSKTPLQLIHRRGLADHHGPPKVACWKDPMSPSKWKEEHFVIVSLTGWGLLIYGGFKLATGGKGKKEEAVCFLISNIVRQDNNQISSEGAKDQWV

SEQ ID NO: 183244 - protein, 499 aa, Glycine max
  Coding DNA Sequence Number=SeqID_66466
MAYNKGVHSSSGGSHRGRPYVLVLLITFGIALLGVMVLHKLRERRICTLLVKEKDQQILALQLLLQKERDRSKELRSKNEEMKGKLYTLRSQKMELARTVGEMQSTLDSLKDEQKLMESAFEEQQNELRSMQEKGKSVAQGGYDIEALRDNLKHKEEELEDLKRRLETPVNDHPTIFNEIVTANGTIAAQDEIEKDENSGESAKHEGDNNEGASKSELTKFKDGEVATEMRDGIRTDGDGATKDMDDAEVVDGREKKAMREEHAGQVENNTDGGGRVKQLAGTKRKHSRASRMKGKRWRTTVKNSSMENNGVFENHSDNRKVYKDELKGRRVGKVSNEENFAREDEGRNNNSQRKEKPHAKLLKTENHESKEDANDMKVNNTKHQVTNSGSNIYSQKILDEIRQSEENEQSQVQENWNKGHINKVDRNAAQTKSKVLLEGLEELKEVLDVQKQEKDSIDSGQDDEDNDYDFFKELHSEFEDEKDEYKGEIDESEFQTGL

SEQ ID NO: 183245 - protein, 441 aa, Glycine max
  Coding DNA Sequence Number=SeqID_66467
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q9ZQZ7; Match level="QueryCoverage=96%, HitCoverage=85%, E-value=1e-165, Identity=67%"; Hit description =Putative glycosylation enzyme
  Pfam annotation: Domain name=Branch; Domain location=52-322; Score =350.0; E_value=4e-102; Accession=PF02485.11; Description=Core-2I -Branching enzyme
ILGLLSSDGGGEQSPFEIISFKRSEDSSGYFVESDIQRSLNVSVVKREAPRFAYLISGTKGDSRRMMRTLEAVYHPRNQYILHLDLEAPPRERLELANAVKADPIFREVENVRVMSQSNLVTYKGPTMIACTLQAIAILLKESSEWDWFINLSASDYPLMTQDGSPTLPDLNSRVAAYISVGQLHLVPIGFKLKSNGDGSLCNIVTSFDLLHVFSNLSRNINFIEHTRIAGWKLNQRARPIIIDPALYLSKKSDLALTTQRRTLPTSFKLFTGSAWVVLTRSFVEYCIWGWDNFPRTMLMYYTNFISSPEGYFHTVVCNTEEFRHTAVNHDLHYIAWDTPPKQHPISLTMKDFDKMVKSKALFARKFAKEDPVLDKIDKELLGRTHRFSPGAWCDGNTDGGADPCSVRGNDTMFRSGPGAERLRELLQVLLSKESLSKQCL

SEQ ID NO: 183246 - protein, 43 aa, Glycine max
  Coding DNA Sequence Number=SeqID_66468
MKGSKKKYVELGCKVNSKLSSSKCYWDLEDGHEHKFLGLGYCN

SEQ ID NO: 183247 - protein, 69 aa, Glycine max
  Coding DNA Sequence Number=SeqID_66469
MAIACDCFRDSQLGGCTAARIFGVVGNTSPDLQLRPRTRVGLQLSDGAVAASAVEQEQALPKEESLCVV

SEQ ID NO: 183248 - protein, 161 aa, Glycine max
  Coding DNA Sequence Number=SeqID_66470
MWAFHTGRQIDWAHLVPYHMHKALRLNAPFPYPYLVTLFLQHFNIPLDSEPYVPIKRSFLISAVVLASFGYRKERDDSWVKKDAQPNDEEGHLPAGEDSSLLQSILDRFDGLQTYVGERFDSLEHQVDTRFEEMDSRITKVEGDVTFIRDCFDLPPPPPSI

SEQ ID NO: 183249 - protein, 171 aa, Glycine max
  Coding DNA Sequence Number=SeqID_66471
  Gene Ontology: Mol. function=DNA binding
  Homolog annotation: Hit_ID=Q1STZ2; Match level="QueryCoverage=61%, HitCoverage=21%, E-value=3e-09, Identity=31%"; Hit description=IMP dehydrogenase/GMP reductase
MSSRGKKTIPFLQVSPLFEQNCNCGQGFSKRFGPHKTDSERHSGPTTEVPRRQGEGYGQSRRLGPVYGCVSFANFWQDTRHPCPLQSHRSCTEKRRIDWDQLLAGIGGRTINWFPRWKEGKEGVLFSCGGYPNIPLIGTRGCINYNPALAIRQLGYPMRGAPMEESMSPFL

SEQ ID NO: 183250 - protein, 235 aa, Glycine max
  Coding DNA Sequence Number=SeqID_66472
  Gene Ontology: Mol. function=tartronate-semialdehyde synthase activity; Cellular component=chloroplast; Biological process =glyoxylate catabolic process
  Homolog annotation: Hit_ID=Q92TV7; Match level="QueryCoverage=93%, HitCoverage=36%, E-value=1e-114, Identity=92%"; Hit description =Putative glyoxylate carboligase protein
  Pfam annotation: Domain name=TPP_enzyme_N; Domain location=6-177; Score=194.5; E_value=2.5e-55; Accession=PF02776.8; Description =Thiamine pyrophosphate enzyme, N-term
MAMARMRAVDAAVLVLEREGINCAFGVPGAAINPFYSAMKARGSIRHILARHVEGASHMAEGYTRAKHGNIGLCIGTSGPAGTDMITGLYSASADSIPILCITGQAPRARLDKEDFQAVDIAKIAAPVTKWAVTVMEPALVPYVFQKAFHIMKSGRPGPVLIDLPIDVQLAEIEFDIDTYQPMEAYKPAATRAQAEKALAMLNEAERPLIVAGGGIINADASDLLVEFAEITGIP

SEQ ID NO: 183251 - protein, 84 aa, Glycine max
  Coding DNA Sequence Number=SeqID_66473
  Homolog annotation: Hit_ID=Q10QF4; Match level="QueryCoverage=69%, HitCoverage=23%, E-value=2e-18, Identity=71%"; Hit description =UPF0326 protein hag1, putative, expressed
  Subcellular localization annotation: CTP_CleavageSite=36; ConfidenceScore=5.27e-01
MKGKKKFKSKKGWKSIVPLHLKGKSATRFSLFRKVNSAGYGPGKTPVYLNVYDLTPMNGFVYWAGLGIYHSGVEGAVLIYYVEF

SEQ ID NO: 183252 - protein, 55 aa, Glycine max
  Coding DNA Sequence Number=SeqID_66474
MASEAVKPGTEDTLRNSHKRNVNQALVAWHTASLAHTEIKDTNELLIRVVLDSVS

SEQ ID NO: 183253 - protein, 161 aa, Glycine max
  Coding DNA Sequence Number=SeqID_66475
  Homolog annotation: Hit_ID=Q10Q83; Match level="QueryCoverage=92%, HitCoverage=33%, E-value=2e-15, Identity=30%"; Hit description =Expressed protein
MSNLIYVLDGLAKLRHSVMQKRIELEREKIEMKLNFVLHSQMKLLETWGSMERQHLTGITIMKECLQSVVCKVPLLEGAKVDMQLVSIAQRRASDLADSIKSVLSTFSPLAGKTAELLSELARVVAQEKLLLQELNDIFHNMSVLELKERSLMCSLIQLKC

SEQ ID NO: 183254 - protein, 52 aa, Glycine max
  Coding DNA Sequence Number=SeqID_66476
MEEEDEEEEISIKKKKPIILGHSTKEEVEILLVLLTKEEAEVMWSLIDLCWK

SEQ ID NO: 183255 - protein, 332 aa, Glycine max
  Coding DNA Sequence Number=SeqID_66477
  Subcellular localization annotation: CTP_CleavageSite=47; ConfidenceScore=5.52e-01
MKSDSNDSVSPYSPKPRIRQVSSRFMSPHSTGSPEPGSASPLPRFHRAAKRNSSTLADHIGNERLKEREENHQNQNQTPTNRTGSVFSVLTKQRSLREFRNNINGSEENDQDQYINGKSTRNGFSAKFPASPVVKKPSSHIAPGRLSLDENALKKNFHCSKNSIDSESDNTSLDSVSLQRTFSSRKLGREVSSKYMMTTSGRKGEASDSDPLSSDDSWMMKKLITQKAMKRANSLIGYMSSKSQWALSPGRSGSPPLSLESKDKPLSFSSLRPQHKRVEKILSMGFDLFRTKKPSTCEVVHQLRLLHNRLIQWRFANARANDANHTMSLQAE

SEQ ID NO: 183256 - protein, 68 aa, Glycine max
  Coding DNA Sequence Number=SeqID_66478
MWRVYLEPSCMEATCFTESKGRVLFKRGSLKFWLGSLCKILSVDPDILEKATDLAERLSICFIFVFVF

SEQ ID NO: 183257 - protein, 143 aa, Glycine max
  Coding DNA Sequence Number=SeqID_66479
MSNHKSTESAIKNLEIQVGQLAKQIAENSSGSFRANTEKNPKEECKVVMTRGKKAIMIEGEWRNVDEQEPIVEEEDQLRENKINDEIGDNYPFLRSLTTNATLLKVSEGYANQEEQMASRKRKATASKPQKPYDTTRFNSEGA

SEQ ID NO: 183258 - protein, 269 aa, Glycine max
  Coding DNA Sequence Number=SeqID_66480
SGILGYLRNILSCSGPRIPGEVCGVASGVTSGCGCTSGCSSWAVGASPPCKKDEICKGLKLVFSEACALNENHALSKALSSLSELGASGGESEKHLRAQHIINSLNEAFVSSQGTEADAGGGGAGVEGAGTEEEGAEVSDGPRAQALRVPGKVIEGSFGYQQFFRIYAKLMARLKDSNVNESGTTHLAMHRQALLQHLKQTRALEYRAWKQAPEGLNVCGGTWSRWVLEIGIKLLDQGHINVTVRLPGQGSTPLPLFELLAELIVLYDK

SEQ ID NO: 183259 - protein, 144 aa, Glycine max
  Coding DNA Sequence Number=SeqID_66481
  Homolog annotation: Hit_ID=Q5NBI2; Match level="QueryCoverage=30%, HitCoverage=10%, E-value=3e-13, Identity=77%"; Hit description =Putative actin-related protein 6
MVIVPQNYHSSGTKVSHKLRYFGSIMKLILGLSLVTHIAPCPSPKSISCEDQTQSSLTDLACVANEVTPIELSLCEYKNGQMSYSCYIVRNQAGLAKCIVRAVNACHPHLHSVLYESIILTGGNTLFPQFAERLVPWTKFEEEK

SEQ ID NO: 183260 - protein, 434 aa, Glycine max
  Coding DNA Sequence Number=SeqID_66482
  Gene Ontology: Mol. function=protein kinase activity; Cellular component=cytoplasm; Biological process=protein amino acid phosphorylation
  Homolog annotation: Hit_ID=Q2HTW4; Match level="QueryCoverage=99%, HitCoverage=97%, E-value=0.0, Identity=77%"; Hit description=Protein kinase
  Pfam annotation: Domain name=Pkinase; Domain location=111-391; Score =142.4; E_value=1.2e-39; Accession=PF00069.15; Description=Protein kinase domain
  Pfam annotation: Domain name=Pkinase_Tyr; Domain location=111-391; Score=131.2; E_value=2.9e-36; Accession=PF07714.7; Description =Protein tyrosine kinase
  Pfam module annotation: Pfam domain module=Pkinase::Pkinase_Tyr; Domain location=111-391::111-391
  Subcellular localization annotation: CTP_CleavageSite=12; ConfidenceScore=5.04e-01
MGNCLDSSAKVEAAHSSRTPSVLLDVKRAGKTEKHRSPNNICGTNSFPLLPASGISKTSPSSVPSNLSILSYSEASDFSNLPTPRSEGEILSSPNLKAFTFNELKNATRNFRPDSLLGEGGFGFVYKGWIDEHTLTASKPGSGMVVAVKKLKPEGLQGHKEWLTEVDYLGQLHHQNLVKLIGYCVEGENRLLVYEFMSKGSLENHLFRRGPQPLSWSVRMKVAIGAARGLSFLHNAKSQVIYRDFKASNILLDAEFNAKLSDFGLAKAGPTGDRTHVSTQVMGTQGYAAPEYVATGRLTAKSDVYSFGVVLLELLSGRRAVDRSKAGEEQNLVEWAKPYLGDKRRLFRIMDTKLGGQYPQKGAYMAATLALKCLNREAKARPPMTEVLETLELIATSKPAGRNCQLEQKRVHAPDRKSSVQKGSHLNHTPTAFP

SEQ ID NO: 183261 - protein, 88 aa, Glycine max
  Coding DNA Sequence Number=SeqID_66483
MEGDFGNVPTTSGCNNFRWLPNEVVDDKSLVIVRQRRKIVKLEMSLKNKDKWLKFVIVICCLLLMLNVIVMNMWWSTRSKDRRNVYLR

SEQ ID NO: 183262 - protein, 70 aa, Glycine max
  Coding DNA Sequence Number=SeqID_66484
  Subcellular localization annotation: CTP_CleavageSite=41; ConfidenceScore=5.69e-01
MKDWRNTSGEDVFSTSRTSQSPTNSSQALRTTSSSNSILCSATMDRSVRISGFWLSACFSCSTDGLKQCA

SEQ ID NO: 183263 - protein, 259 aa, Glycine max
  Coding DNA Sequence Number=SeqID_66485
MSEIEEVQEQMKADIEAMLSMRRMMESNAATVVATSAAAEVDLTHPSDINQTSRPVLYMVGQGGQVLGSTGGLHMVQNKNSFPPYGLPPNYTPPNPVHVPNENTNHSIPIPLEGQQPQLGHAPFAKPVGEAPFSGMPQPNAAGAPQHHPLQPLHFSVGRLPPTIEEREKLDLIEERLRAIEGIGDYSFVNMAELCLVPDIVIHPKFKVLDFNKYKGTTLPKNHLKMYCQKMGAYSRDEKLLMHYFQKSLAGATITWYTN

SEQ ID NO: 183264 - protein, 90 aa, Glycine max
  Coding DNA Sequence Number=SeqID_66486
MVHDIFVKVKLEVTGTSLAVDETAMMVTSILQLDSMNLFVKARAWFNPITQGMAILIANTSSTIHRDERLRNMHAMHGKWENARVTHEQT

SEQ ID NO: 183265 - protein, 120 aa, Glycine max
  Coding DNA Sequence Number=SeqID_66487
MECLEGVWETLEGNERCRFCGTIRLTATSLPVEWILPTPTPYRLVEPVQVIEVSSSEEDLEEDPEELHPEPAMDAPDFPKDDEDPLPDVDSPEDIMSASEADSTEESGPGGTTISDDYSS

SEQ ID NO: 183266 - protein, 94 aa, Glycine max
  Coding DNA Sequence Number=SeqID_66488
MEEKKPKVNEIKMKAKKTRNELKVSDLENYPLKNEERMKNGKRGKRLPPSSPKRAGLLTPEAIQLRKTVWKAQFKISKFLFAPPRFDKFTPLLS

SEQ ID NO: 183267 - protein, 97 aa, Glycine max
  Coding DNA Sequence Number=SeqID_66489
  Gene Ontology: Mol. function=DNA binding; Cellular component=nucleus; Biological process=regulation of transcription
  Homolog annotation: Hit_ID=Q2HTW0; Match level="QueryCoverage=56%, HitCoverage=11%, E-value=8e-19, Identity=85%"; Hit description=Myb, DNA-binding
MILVYHAAAQNNKIQGTFLKKDDPKISALMQQAELLSSLALKVDTENMDQSLENAWKSPKVFVICYDPIASYVAWSPTLEVWDSSVGFIRPWALQPQ

SEQ ID NO: 183268 - protein, 164 aa, Glycine max
  Coding DNA Sequence Number=SeqID_66490
MIIIKTSKSFSSTDPSGNDLETGDSDKCGLYIEANPPRLLPGQVKVGVEEVKDAQAPVPVPTDEVTLVGQTLNTFLAWLTHLVEPLSEHATVSLAKPPQRPDPKVDDPLYLMALTIPKLFLKPFQVNWDATMFWVFNPDFSLCIKHKDLSEIVHGGQCLSISII

SEQ ID NO: 183269 - protein, 209 aa, Glycine max
  Coding DNA Sequence Number=SeqID_66491
  Gene Ontology: Mol. function=calcium ion binding
  Homolog annotation: Hit_ID=Q65XE2; Match level="QueryCoverage=62%, HitCoverage=27%, E-value=8e-59, Identity=81%"; Hit description =Putative tonneau 2
  Pfam annotation: Domain name=FAA_hydrolase; Domain location=96-203; Score=-64.3; E_value=0.0017; Accession=PF01557.9; Description =Fumarylacetoacetate (FAA) hydrolase family
MLFQKPEEGSINHRVQRLAKYRFLRKQSDLLLNADDLDAMWVCLRENCIIDDATGAEKMNYEDFCHIACVCTEQIGPKCRRFFSPSNFMKFEKNEQGRIAILPFYLYVMRTVSLTQARIDMSELDEDSDGFLQPHATNVEPGNELGKPVDINNAEDHIFGLVLLNDWSGTTISPWIVTMEALEPFARETPKQENDYSIGFDTARARLYL

SEQ ID NO: 183270 - protein, 200 aa, Glycine max
  Coding DNA Sequence Number=SeqID_66492
  Gene Ontology: Mol. function=cobyrinic acid a,c-diamide synthase activity; Cellular component=chloroplast; Biological process =selection of site for barrier septum formation
  Homolog annotation: Hit_ID=Q45RR6; Match level="QueryCoverage=69%, HitCoverage=46%, E-value=5e-44, Identity=62%"; Hit description =Plastid division regulator MinD
MVVFCFVVSLFGLDSVVCDPEAVYMEIGDAVHVTEDGLVSWHGGGDEASVNADRAVDEDEVGGLAAESEGEFVARFGDAEEFKVGPALVTDEGLVDTAVTIQDLNHGVVDKVLEVEEEVKVAEADVGVDGDHGEAETGEGEAGVGGGGGLAHTILVGGDDSDVGYDPPMNACQKSIIVGLMKDLDELLERGIDVVGIGLT

SEQ ID NO: 183271 - protein, 167 aa, Glycine max
  Coding DNA Sequence Number=SeqID_66493
MVLGVVRFDGADNGSNGKKTCELSSTHRNEVDKWEWKSNSLNLGFKLCREWELVLFVLFPLVKRCRAVINKTINSEKRARFHEKGVRLKFGESVMDEIDLKALTNDKGSMEMIDITKRDGSVHLFVLHPVLKQAKNVQVPNNLRTTMGQPNIMDLYHLIVHFKSMDQ

SEQ ID NO: 183272 - protein, 136 aa, Glycine max
  Coding DNA Sequence Number=SeqID_66494
  Homolog annotation: Hit_ID=Q52RG7; Match level="QueryCoverage=26%, HitCoverage=6%, E-value=3e-08, Identity=80%"; Hit description =Sphingosine-1-phosphate lyase precursor
MATRPNTKPKDDEGSDNDGEGPRPSQRLEIIFDRKITGMCFSLLSSSLMLFAPSSTSSPRMDSKPRSFTYGSGFLIKSIKLILGVKGYIDAKKQKAEVVAMTAALLGSKEKNSGGQICGNMTPSGTEYIISYQVIS

SEQ ID NO: 183273 - protein, 111 aa, Glycine max
  Coding DNA Sequence Number=SeqID_66495
MYVSGTYREYKWSWDVDDMSYIDITKMISFFGYKTFNDKDGVKVKDQANVEKEGEVQGEVHVDTQREVDVRKESEMCWRPHLGVRMKGQRPRNVLGLKCQGMIQIFVLRKG

SEQ ID NO: 183274 - protein, 127 aa, Glycine max
  Coding DNA Sequence Number=SeqID_66496
  Homolog annotation: Hit_ID=O82279; Match level="QueryCoverage=85%, HitCoverage=40%, E-value=7e-22, Identity=45%"; Hit description =Expressed protein
MVVVVTQEEPSGFLSVNRVMSLDSLEVDLSKEPAAPINHNAHQQIDAETNVIVSNRVRYKSAPICREQEKWDRATKAAIGGSLKRKLQMFTLGIGGVGLVSAYVSYSPEIAARYLNSSCTIDIVILN

SEQ ID NO: 183275 - protein, 115 aa, Glycine max
  Coding DNA Sequence Number=SeqID_66497
MAQSSKEDLILMLAFLTGAGAVTSFGYRKDRDGQLLKKDTLPPQDERTPSPPPPQRDDSSVLMNEVLSELRGLRTYVGERFDSLDSRFEGMDTHITRLEEDVTYLCRCFDLPPPS

SEQ ID NO: 183276 - protein, 48 aa, Glycine max
  Coding DNA Sequence Number=SeqID_66498
MSSSADHPPFLKSEFKEKLITASTEPRMRSKVESETGCLLDQSTYVDL

SEQ ID NO: 183277 - protein, 320 aa, Glycine max
  Coding DNA Sequence Number=SeqID_66499
  Gene Ontology: Mol. function=DNA binding; Cellular component=nucleus; Biological process=regulation of transcription
  Homolog annotation: Hit_ID=Q2HTW0; Match level="QueryCoverage=69%, HitCoverage=42%, E-value=3e-64, Identity=59%"; Hit description=Myb, DNA-binding
MIEELKSGNKEGQVLQELLNRTKESDNAGHNIPDLQPVDLKDMIENLKSGNEEGLVLQEFLNQTNRADIPEHKIPHLWLVDHKDMIEKFKSGNEEGQVLQEFLNRTKESDIPGHKIPDLQLVDLKDVIEDLKSGNEEGQACWRQVDRYEDSPGSSGYSTGSILLCESAGDNLEPSFHQDIGTELKSEQLEDEKGVGRDDGKVVLSTLNVDQDTLPCFEEQINNDGIVSASSRLEFSSPLQVTPLFRSLAAGIPSPQFSESIIPLINLKYSSIYCYFKVHSGLDEERNFLRKTLGMESPSINPSANSSQPPPCKRALLPSL

SEQ ID NO: 183278 - protein, 52 aa, Glycine max
  Coding DNA Sequence Number=SeqID_66500
MVPSKENRVDDHGDDKEGRIGAVGASDGSWWRWPTSTVVEDVPFLFFDDYAI

SEQ ID NO: 183279 - protein, 94 aa, Glycine max
  Coding DNA Sequence Number=SeqID_66501
MQREEEDKTTMPDLEKETMEKGGRGVDLRSGKRNDVEGETVSRDGGTNKEEMKWLSSKSQSLEKKSLAGDGKASGYKKILVYMYWSPRKIFRDS

SEQ ID NO: 183280 - protein, 74 aa, Glycine max
  Coding DNA Sequence Number=SeqID_66502
  Gene Ontology: Mol. function=DNA binding; Cellular component =mitochondrion; Biological process=DNA integration
  Homolog annotation: Hit_ID=Q1SX87; Match level="QueryCoverage=98%, HitCoverage=6%, E-value=4e-30, Identity=70%"; Hit description =Polynucleotidyl transferase, Ribonuclease H fold
MHDPRVDHMSALKRIIRYVQDWGGCPDTRRSTSGYCVFLGDNLISWSSKRQPTLSRSSAKAEYRGVANVVSESC

SEQ ID NO: 183281 - protein, 398 aa, Glycine max
  Coding DNA Sequence Number=SeqID_66503
  Gene Ontology: Mol. function=helicase activity; Cellular component =membrane; Biological process=viral genome replication
  Homolog annotation: Hit_ID=Q9ZQR0; Match level="QueryCoverage=92%, HitCoverage=34%, E-value=2e-94, Identity=46%"; Hit description =Putative helicase
  Pfam annotation: Domain name=DUF889; Domain location=129-314; Score =216.6; E_value=5.6e-62; Accession=PF05970.5; Description=Eukaryotic protein of unknown function (DUF889)
  Subcellular localization annotation: CTP_CleavageSite=40; ConfidenceScore=5.09e-01
MSVVNTQSAAVYFLYGYGGTDKTFVWTTLSSGIRSNGGIVCTVASSGIASLLLPGGQTAHSKFAIPVPATENSTCNIHQGSELAELLKVTKLIVWDEAPMCHKFAFEALDKSLKDIMQNNMPFGGKIMVFGGDFRQILPIVPKEITIPDEFLIKNYDDPIHAIVEATYPSLIDNYSDTDYLQKRVVLASKKEIVDKINDYVLSLIPNHEKEYCSADSIDKSDELLNPVFALLPPEFLYSLQTSGIPNHKLKLKVGTPIMLLRNLDQTDGLCNGTRLIITKLGSNVIEVEVITVPNSGNRTYIPRINMSPSESAWPFKLIRRQFSFIVSYAMTINKSQGQSFHHIGLYLPHPGFSHGQLYVALSRVKNKDGLHILIHDNDGNPKNITTNVVYNEVFANL

SEQ ID NO: 183282 - protein, 70 aa, Glycine max
  Coding DNA Sequence Number=SeqID_66504
MEMGVSSRPTERAKTPGVWRCRKLWRRFRYRVPIMCMRFQKYNNSMLLSITHFPWVWKIGQWLNGGTENG

SEQ ID NO: 183283 - protein, 113 aa, Glycine max
  Coding DNA Sequence Number=SeqID_66505
  Subcellular localization annotation: CTP_CleavageSite=46; ConfidenceScore=5.44e-01
MSSMSISSSSGRLPTSCGLWMFSSIFLWFKLFIRNNRLFFMDKVISGRTANNTLVKGCKRRYKHSLHVRISRLHCSKIYIYEITHKVFFASLKELGIVPITFLMMMRLWHEFI

SEQ ID NO: 183284 - protein, 60 aa, Glycine max
  Coding DNA Sequence Number=SeqID_66506
  Gene Ontology: Mol. function=sugar porter activity
  Homolog annotation: Hit_ID=Q0KIH2; Match level="QueryCoverage=98%, HitCoverage=34%, E-value=5e-13, Identity=67%"; Hit description=UDP -galactose transporter, putative
  Subcellular localization annotation: CTP_CleavageSite=42; ConfidenceScore=5.62e-01
MAEGSVASLCSPSASPESGPRTSTKAFFRKMCKNPYPLRNSRARGRRSDSTVKGSSTLRF

SEQ ID NO: 183285 - protein, 513 aa, Glycine max
  Coding DNA Sequence Number=SeqID_66507
  Gene Ontology: Mol. function=DNA binding; Cellular component=nucleus; Biological process=regulation of transcription
  Homolog annotation: Hit_ID=Q2HTW0; Match level="QueryCoverage=97%, HitCoverage=96%, E-value=0.0, Identity=73%"; Hit description=Myb, DNA-binding
  Pfam annotation: Domain name=Myb_DNA-binding; Domain location=26-72; Score=48.0; E_value=3.3e-11; Accession=PF00249.21; Description=Myb -like DNA-binding domain
MKKQQQQEKHKKQMVNEESKKKERHIVTWTQEEDDILREQIGVHGTENWAIIASKFKDKTTRQCRRRWYTYLNSDFKKGGWSPEEDMLLCEQLPFKFKNLEKFCTSSFAVYFSVFPFCMVDLNPLMYKDCIIAQKIFGNRWTEIAKVVSGRTDNAVKNRFSTLCKKRAKYEALVKENSTSYINSNNKRIFLQHGCDTDVASETAIKKMRRSHIPDAAEKINFGDRSHKQNGIPLNEQSRAPFAVLAQNTHNVNLPDQHHVCNLKFSDYAENNKIQGTFLKKDDPKINALMQQAELLSSLALKVDAENMDQSLENAWKVLQEFLNRTKESDIPRYKIPDLQLVDLKELLADLKSSSEEIQPCWRQMELYEDSPGSSEYSTGSTLLPHSAGEDLEHSLHQDIGTELNIQIEDSEGVRGCDQGVLSSATLDQDLFPSCEEQINNDAIVSALSSSAEFSSPLQVTPLFRSLAAGIPSPQFSESERSFLMKTLGMESPSLNPSVNPSQPPLCKRALLI

SEQ ID NO: 183286 - protein, 153 aa, Glycine max
  Coding DNA Sequence Number=SeqID_66508
MGTIGRIVIENHSWYRLEVMVYHKEECTNFLLWDRECANLIGQSDDEVNRLKIADGDVDLNVYLEALDKILGYTLAFKVKVQSKFRNFVVLKYSFDSDLINTTIDLLPDIEAPYKVHFPLSDTNDPLQYETINHDPLLEVPLTPTKQQTPQDI

SEQ ID NO: 183287 - protein, 230 aa, Glycine max
  Coding DNA Sequence Number=SeqID_66509
  Homolog annotation: Hit_ID=Q1SN45; Match level="QueryCoverage=33%, HitCoverage=5%, E-value=6e-11, Identity=43%"; Hit description=AAA ATPase
MVHGPCGNLGKGSPYRKEGKYSRFYPKMFQPHTLLDADGYPGYDRVTVVIVHDENDATLHVATHHDEIKDYLDCRRIILLEDDAYCLQRSQSHSNISGQFLMFNILHEKHASPWGGTKNKPEEVWQQTWNWLADGDWPNQLGNGLILSELNYNTDELKSKFLHLFATLTAMNKQEGEMFSLYGYGGTGKTFIWKMLASSLRADNKIVVLMVASSGITSFLTIVWRQNCTL

SEQ ID NO: 183288 - protein, 277 aa, Glycine max
  Coding DNA Sequence Number=SeqID_66510
  Gene Ontology: Mol. function=oxidoreductase activity
  Homolog annotation: Hit_ID=Q2HVR6; Match level="QueryCoverage=99%, HitCoverage=100%, E-value=3e-54, Identity=42%"; Hit description=RNA -binding region RNP-1
  Pfam annotation: Domain name=RRM_1; Domain location=8-76; Score=13.7; E_value=0.0078; Accession=PF00076.12; Description=RNA recognition motif. (a.k.a. RRM, R
MNSGGYAVEVTGLSPKATDKDVRDFFAFSGVIENVEIIRSGDYACTAYVTFKDAYAQETACLLSGCCTTRSHVATPRYTWEEIYTRFEKLILNPKYQGATILDQRVCITRWGHYEDEFDFWNQPSYSHEDETASTTPQSNQFVSSAGEAVTMAQEVVRTMLSKGYVLSKDALAKAKDFDESHQVSATATAKVSELSQRIGLSDKISAGIGAVKSVDQRYNVSETTMAAASTAGRSVAAAANSLVNSSYFSKGALWVSGALTRAAQVASDMGTHRDRQ

SEQ ID NO: 183289 - protein, 50 aa, Glycine max
  Coding DNA Sequence Number=SeqID_66511
ASCVPRLLYKDTESLKSRLLYDNGCGDGSCGCGHDGCGDDSCGYGDGGCG

SEQ ID NO: 183290 - protein, 64 aa, Glycine max
  Coding DNA Sequence Number=SeqID_66512
MSSRRSRSRQSGASAEITDAQITDLVSKLQQLIPELRARRSDKPQLEAIVYGTHHQILPPLAPY

SEQ ID NO: 183291 - protein, 96 aa, Glycine max
  Coding DNA Sequence Number=SeqID_66513
  Gene Ontology: Mol. function=RNA-directed DNA polymerase activity; Biological process=RNA-dependent DNA replication
  Homolog annotation: Hit_ID=Q1S5T5; Match level="QueryCoverage=96%, HitCoverage=31%, E-value=1e-10, Identity=35%"; Hit description =Multicopper oxidase, copper-binding site
MKYLGLPIGANLRKLSTWDPVVEMFIWGGEWVFSREWLKRVSLVEVNLKVGNGDNGVKRGWFTYSIGRVVGNGTKAFFWKDNWVEGVSLRERFPRL

SEQ ID NO: 183292 - protein, 97 aa, Glycine max
  Coding DNA Sequence Number=SeqID_66514
MSGCSDEEEISYSESDRHGYEGDNDDDDSEIGKNEHRSKRRMGSVVLERWQCTTKAKKQVHKFRSRKNLLAKSRSGNNIKDKNDFYSKECNPHLELD

SEQ ID NO: 183293 - protein, 107 aa, Glycine max
  Coding DNA Sequence Number=SeqID_66515
MPKTKVVEDSLDLIVKDSFDTQDDEYFLDSQDEGYSIVSKKVQDCMHLEIVNDYVVKTLYFQKFKSSYIHVVLDVEEAPGLGAVDNLIERVGLRLDACYCWGVVMAF

SEQ ID NO: 183294 - protein, 181 aa, Glycine max
  Coding DNA Sequence Number=SeqID_66516
  Gene Ontology: Mol. function=transferase activity, transferring hexosyl groups; Biological process=metabolic process
  Homolog annotation: Hit_ID=Q53UH2; Match level="QueryCoverage=89%, HitCoverage=35%, E-value=2e-47, Identity=53%"; Hit description =Glucosyltransferase
MESRPLHIAMYPWLAMGHQTAFLHLCNKLAIRGHKISFITPPKAQAKLEAFNLHPNSITFVTITVPHVEGLPPDAQTTADVTYPLQPQIMTAMDLTKDDIETLLSGLKPDLVFYDFTHWMPALAKSLGIKAVHYCTASSVMVGYTLPPARYHQGTNLIESDLMEPPEGYTTKHPYLNLLCI

SEQ ID NO: 183295 - protein, 91 aa, Glycine max
  Coding DNA Sequence Number=SeqID_66517
MNARGNVYAMHDKMCLSMDTKIRKSVPSYPQCIGFLEISFSLISNIVAVEATSDNVSSKRKTLDEASLSSSESEAQHDHKSTSTSYVSMDP

SEQ ID NO: 183296 - protein, 183 aa, Glycine max
  Coding DNA Sequence Number=SeqID_66518
  Gene Ontology: Mol. function=RNA-directed DNA polymerase activity; Biological process=RNA-dependent DNA replication
MEITNPTRMISSSVGCHPQVKLEIMSFKKPKIAFLFLPMMKRRPKYLPESMVIDTPRDQRHYFLPQGLFFFKAGGKILGAQNKKGILSRIDLPSTKADCSKEIYFWRSGLSLLATVLYMILYMTLHREICIVFHGCEVVNFWEESNGGLVNLRGKGTLLKPEGSCGKNIKTTKVPKTFVKSGI

SEQ ID NO: 183297 - protein, 43 aa, Glycine max
  Coding DNA Sequence Number=SeqID_66519
MALHFCFIGIGQGRKPPERIPSLLWLRASKANLDSCWSLEINR

SEQ ID NO: 183298 - protein, 354 aa, Glycine max
  Coding DNA Sequence Number=SeqID_66520
  Gene Ontology: Mol. function=structural molecule activity
  Homolog annotation: Hit_ID=Q1SPA1; Match level="QueryCoverage=54%, HitCoverage=73%, E-value=2e-65, Identity=67%"; Hit description=Major sperm protein
  Pfam annotation: Domain name=Motile_Sperm; Domain location=22-131; Score=119.5; E_value=9.7e-33; Accession=PF00635.16; Description=MSP (Major sperm protein) domain
MSTGELLNIEPLELKFPWFPSHLSHFPFLCSFVLLVELKKQISCSLQLSNKTDSYVAFKVKTTNPKKYCVRPNTGIVTPRSTCDVIVTMQAQKEAPADMQCKDKFLLQSVKTVDGTSPKDITADMFNKEAGHVVEECKLRVLYVSPPQPPSPVPEGSEEGSSPRGSVSENGNANGSDFTQAARGFTERPESQDKSAEALCTNEHFCHVIGGDGYSPDWRVQFHVFPYARTRSTLRELGRCCSKKRIIGLREELRVREHDFENFQVEERMKARALISRLTEEKNNAIQQNSKLHQELMWGKSDRSSQGKLMNVDFLHQNELLKREGNKSRGGVSFVIVVLIGLLGIIMGYLMKKT

SEQ ID NO: 183299 - protein, 66 aa, Glycine max
  Coding DNA Sequence Number=SeqID_66521
MSRSSSEAEYRALASATSTGTLLMSTNEAELSESKIRSFGKSFRTDLHTSRKIPRFAKAERCVQWI

SEQ ID NO: 183300 - protein, 57 aa, Glycine max
  Coding DNA Sequence Number=SeqID_66522
MTTIVVINITVGGGTVVMVAAIMTMRTIMLVVLAAIDNRGDNNGSCDSYGENGHQSG

SEQ ID NO: 183301 - protein, 412 aa, Glycine max
  Coding DNA Sequence Number=SeqID_66523
  Gene Ontology: Mol. function=nucleic acid binding
  Homolog annotation: Hit_ID=Q1SP97; Match level="QueryCoverage=79%, HitCoverage=100%, E-value=1e-130, Identity=68%"; Hit description =Zinc finger, CCHC-type; Zinc finger, HIT-type
  Pfam annotation: Domain name=zf-CCHC; Domain location=257-274; Score =20.3; E_value=0.00044; Accession=PF00098.13; Description=Zinc knuckle
  Pfam annotation: Domain name=zf-HIT; Domain location=172-201; Score =28.0; E_value=3.4e-05; Accession=PF04438.6; Description=HIT zinc finger
  Pfam module annotation: Pfam domain module=zf-CCHC::zf-HIT; Domain location=257-274::172-201
  Subcellular localization annotation: CTP_CleavageSite=63; ConfidenceScore=5.08e-01
MGTRTNFYKNPSISYKKRLSISSVLQNLHAYNIAAGNVPPADPPQATSTANVPPGNPPHLTPSARLKRSRNPEPPEFLREYRDDAPSSMSHHDYIQNRRKEVVSSRNHDRVELTEEVLGNSNSTLPLVDYDASDEDTPSECEETHTLLNSGQQEEFDGVKKSRNEQRFPVSGEPVCLICGRYGEYICNETDDDVCSMECKSELLEILKLNEGSSHNQVRDISSSGISAAVPVPVFGDDTWDYNQHHWSKKTCSLSTYECWKCQRPGHLAEDCMVTDGSNRSSSIPKDLLQLYRRCHQIGKDLLAANCNVCRRSSNLATCLDCSIVLCDGAGHLIEHIRTHPSHQKYYSHKLKRLVKCCKSTCKVTDIKDLLVCHYCFDKAFEKFYDMYTATWKGAGLAIMWGSICCEDHFTW

SEQ ID NO: 183302 - protein, 296 aa, Glycine max
  Coding DNA Sequence Number=SeqID_66524
  Gene Ontology: Cellular component=mitochondrion
  Homolog annotation: Hit_ID=Q1SP96; Match level="QueryCoverage=91%, HitCoverage=36%, E-value=1e-111, Identity=71%"; Hit description =Villin headpiece
MTMIGCSSDGQMDDTKFSKPMPWIGIYIAAASLACLITMAADLIHGIRGRKLWFPCKFFCLNATSLAIIAVAVKLSVDLNTPMPHRRDQLSKLSSSALICTIMANSMPTLGITENKDTMMNLMAMAILVITMIVNICIQFVTGVIYVFWVEHAVIMLLMLILLMTMTSSVISLPKMKHYFELKYKMNEEAIKEGSKLFGEEGNQMVSILRDHLMKIWMMTHTSSPQFVLGRSVTCTASGAFCLLSTLTLIEAMLRSYLMPWLFDFCTGDCDYKWSTILILIVQVAAVVVGGDCANV

SEQ ID NO: 183303 - protein, 87 aa, Glycine max
  Coding DNA Sequence Number=SeqID_66525
  Subcellular localization annotation: CTP_CleavageSite=77; ConfidenceScore=5.78e-01
MMKEVVHGHNSTAPQLHFSFPSSSFTLSLCFSLVSTSAGMISPSTCMAIYRKQPRRPDKFDQASCSSPRQVCCLLVKASTRLGEFLA

SEQ ID NO: 183304 - protein, 285 aa, Glycine max
  Coding DNA Sequence Number=SeqID_66526
  Gene Ontology: Mol. function=sucrose transporter activity; Cellular component=integral to plasma membrane; Biological process=sucrose transport
  Homolog annotation: Hit_ID=Q000Y6; Match level="QueryCoverage=99%, HitCoverage=46%, E-value=1e-125, Identity=78%"; Hit description =Sucrose transporter 2A
MDESNSTQTEDHIEKDAELKHGNFKAGEDHAENVMDGPGAVLVNLLTSLRHLPPAMHSVLVVMALTWLSWFPFFLFDTDWMGREVYHGDPKGGTSEVDLYDQGVREGAFGLLLNSVVLGISSFFIEPMCKWMGAKLVWALSNFIVFVCMASTAIISLISIRDYSGGIEHVIGANEAIKIASLVVFVLLGFPLAITYSVPFAVTAELTADSGGGQGLAIGVLNLAIVIPQMIISLGSGPWDALFGGGNIPAFVLASLCALAGGVIATLKLPDLSSSSFQSTGFHIG

SEQ ID NO: 183305 - protein, 388 aa, Glycine max
  Coding DNA Sequence Number=SeqID_66527
  Gene Ontology: Mol. function=DNA binding; Cellular component =membrane; Biological process=DNA integration
  Homolog annotation: Hit_ID=Q1SS72; Match level="QueryCoverage=85%, HitCoverage=29%, E-value=1e-36, Identity=38%"; Hit description =Integrase, catalytic region
MSWTKQNEVGVEVTLSIDHLSSSIEEALPCNSLFLYLFKFPFDSLIMTNDLLPQDQSLNVHNPYYLHPGENLAIALVSPVLDSTNYNLWSRSMLIALSAKKKTDFVDGSIQRYASNHPLQAAWRRCNNMVISWLVHSVSPSIRQSIFWMDNARDIWKDLKLQDSQEDLLRISELQQDMASIRLGDQTITDYFTRLRVIWDRPDPVCSYESKKNGFPHNYASRGGRGNQSSYSKGNSGGKGNKLCIHCDFTNLTIDECYKKHGYPLGHKFQKSQSSNINNVNDVKKEGDNSTTDQNQETHNEEVKLTPQQYKALMTLLQQQGSTHKTSQVNQIGTFNNKGSVLSITCSVSKTSQDEWILDSSATDHVTAFPPLFSLCKKINPIMVRILT

SEQ ID NO: 183306 - protein, 113 aa, Glycine max
  Coding DNA Sequence Number=SeqID_66528
  Homolog annotation: Hit_ID=Q9SPM7; Match level="QueryCoverage=37%, HitCoverage=9%, E-value=7e-11, Identity=69%"; Hit description=Apyrase
EDALARAQAAKAVQMRCIAVRTTLSDEALELAGPTLIRDNIGSVLLNDILSGGSVTKPGLSVHTENPQEVVESLIPLMEEAEAVVPYELHHRMPVKLGVRIPQLNTMKITLFN

SEQ ID NO: 183307 - protein, 156 aa, Glycine max
  Coding DNA Sequence Number=SeqID_66529
MSPPNQWANQSGKLTGPLTRSRTKKLEEELEKTQRTWGAWSREIGFEVAKFESNIRIGMSLDPCCPRCGLKEETLTHALLTCEEVRRWWFACPLAIRVEENEEIDILQWIGGMSMGMILKDDEGMVLFSASKREEQCFRPVIAEALTQVECETSFR

SEQ ID NO: 183308 - protein, 287 aa, Glycine max
  Coding DNA Sequence Number=SeqID_66530
  Gene Ontology: Mol. function=sucrose transporter activity; Cellular component=integral to plasma membrane; Biological process=sucrose transport
  Homolog annotation: Hit_ID=Q7X9X8; Match level="QueryCoverage=97%, HitCoverage=39%, E-value=4e-59, Identity=48%"; Hit description =Sucrose transporter
MTTGKSDLVSIRVPYKNLHDDSSAPELELVDVHHRGNHRNSPPPNHSPSPPNSNNAPLLHLVLSCTVAAGVQFGWALQLSLLTPYIQVPLPLPLRLNNFDFFDITVSSLTRSFCNRNRILYVFIFNFPINCVLSYCVLVQTLGIGHAFSSFIWLCGPITGLVRIINSVIRTSLCFALVGLELENHKTTIHSGRISYDMSGYIGYVLGDTHEHCRTFKGTRTRAALVFILGFWMLDLANNTVQGPARALLADLSGPDQRNVANAVFCSWMAVGNILGYSSGASGKWNK

SEQ ID NO: 183309 - protein, 120 aa, Glycine max
  Coding DNA Sequence Number=SeqID_66531
  Gene Ontology: Mol. function=inositol or phosphatidylinositol phosphatase activity
  Homolog annotation: Hit_ID=Q1RXP2; Match level="QueryCoverage=99%, HitCoverage=26%, E-value=1e-30, Identity=58%"; Hit description =Inositol polyphosphate related phosphatase
MEDLLETCNNSCDIYVLGFQEIVPLKASNVLGYENNKISTKWNSIIGKALNKSTHHSFRDDKKEEDVKNNICCNNKEAGNNNNNPGQQCEAPQDFECIISKQMVHILISVWAKRELRPFI

SEQ ID NO: 183310 - protein, 73 aa, Glycine max
  Coding DNA Sequence Number=SeqID_66532
MKRTINMREREREGSGSGWIQESHTRTRTRLLVIWENPNPNPYPVNSGITRQSRDGLGRVPTGTDFLAMSKPR

SEQ ID NO: 183311 - protein, 151 aa, Glycine max
  Coding DNA Sequence Number=SeqID_66533
MDNMHNHHESIGLFKESRHKDLASSFKRAITSYPFMLLAMLSLFFFHFALYNNSTHGSETTGEGWGPGIAGAVYTDRSYHSTAPSPYGLLPAGQPNATCMRASRASSSACELRWTLGTVVDMEAVVVRLLPAAAAGLASTAMPTLVCNTSQ

SEQ ID NO: 183312 - protein, 176 aa, Glycine max
  Coding DNA Sequence Number=SeqID_66534
  Homolog annotation: Hit_ID=Q1SDG1; Match level="QueryCoverage=38%, HitCoverage=6%, E-value=5e-09, Identity=45%"; Hit description =Integrase, catalytic region; Zinc finger, CCHC-type
MMIAHFKYTHIDLWDFVDNGNHIPYDVELNEIHGSQWTEEQKQIFMLNSKALDVLSCALSEEVYTKVLEELVGTLKVHEQELQQDEGTKKGKYLALNAYKLKKVPLSKEFSSRPSSKSVSKALSMDNSSNKEFEEESNEDDELALISRKIRKMWKNKSRSKWKNSSKKVFKEKKGR

SEQ ID NO: 183313 - protein, 101 aa, Glycine max
  Coding DNA Sequence Number=SeqID_66535
MEALPIIFNDIVYDLTKIDERDFKDQNEGQAKSITAKADEVVQLKLQQAQQNMMGVFIQPPLIVQQLPTTGPSIEQQPTPNILPAPVEPTPPPPSSPPLDQ

SEQ ID NO: 183314 - protein, 153 aa, Glycine max
  Coding DNA Sequence Number=SeqID_66536
MAPKKLYAKWARKATAGEGSSATPQAEIEFDGYRFRCKEHQHPFDMIKDWHWTQLTEPMAKYDPEIVMEFYANTWPTEEGVMDKIFFTNGFLCFLEDEWQRNGERKRERRRHFKEKMSLEEAHHHRRPWIRAWRKKEMNEGRGREEHEILCSK

SEQ ID NO: 183315 - protein, 339 aa, Glycine max
  Coding DNA Sequence Number=SeqID_66537
  Gene Ontology: Mol. function=RNA-directed DNA polymerase activity; Biological process=RNA-dependent DNA replication
MAANQVQTLMEYLTPTLGKPTPSNFLIYIWESYLTSSMGSYKYWRTTRSVSTLNSMFFLSFSMGRYRVGCAHYLRTISLHGISAQVPLQRYLSPIKMDQYIRDIGNVEQRDQESLPEASKWLQKMIRRCPHHNITQQRLAHIFYGGVSSHNRTGLDVACEDMCSNPYNNLGDMRIMKKGINQVEKDNPLTELGKQMQALTLKIETLMIAQAQKQEDSEEKECSFPKAADYVLTKKNQTPKKVEVPTDGNLVLMKEGGEKKEILTYPQARINLIPCSILKKLGITNLEPSNITLHLVDHSVIYPRGVIEDVLVKVDKFIFSADFVILDMEADENVPIILG

SEQ ID NO: 183316 - protein, 56 aa, Glycine max
  Coding DNA Sequence Number=SeqID_66538
MGVKGEGLRVQESQKDNKETVTTIGPAVGEVDDGKPERKKGGSGKQDKKSRGWGSR

SEQ ID NO: 183317 - protein, 86 aa, Glycine max
  Coding DNA Sequence Number=SeqID_66539
MIFIRKRLQCERYFSQLKDYITILNGENSRNWASNMVLKFHDDPTVNESEIVVFLRQVRWPTGKRKGFGRREKKRNCEAEEAEKSV

SEQ ID NO: 183318 - protein, 103 aa, Glycine max
  Coding DNA Sequence Number=SeqID_66540
MTLNGNLLGVTIYTKEHFVPTLLCIVPIFCCASSPCISFAFSASSCISYINPRAFAEKRGENPCVFLEITMNMLSAPAVLSRFIASDEYFDFQMIALSPTLLR

SEQ ID NO: 183319 - protein, 166 aa, Glycine max
  Coding DNA Sequence Number=SeqID_66541
  Subcellular localization annotation: CTP_CleavageSite=49; ConfidenceScore=5.75e-01
MATPPSSPPPSPPPPPPPPPTEVASQSSSTLKQTRKATQLRSLATRPPRVDRLVVHVDLAIGKADSPHKKKLRTYLGIVTRYKVDVTYENWKQAEFDIPEASGGRTKKKILQIVREWWTQFKSDLTLKWALAADKDSLDDTVCEKYDTSKEKWAQFCQSHRDPSWE

SEQ ID NO: 183320 - protein, 217 aa, Glycine max
  Coding DNA Sequence Number=SeqID_66542
  Subcellular localization annotation: CTP_CleavageSite=66; ConfidenceScore=5.45e-01
MGVHFFNFDHLRIKLQSSDFFRGTKFRALLFLSLHSSSSTFKLLSMASYGVVSPFIFLLLHFAAIRPQEAKESIDEEDPRPTSSTWSYIILAVASSSDATIALRASKWIWAWHQCCAEPGKRQMTRLATDLALSALLQFRCSSRFLLHAKGTEAALSDGYELSLLSSLSAIATLALQEISSFLPEIVQMLTLIPIKETLMTEIKIQQSLFKIPTKEL

SEQ ID NO: 183321 - protein, 77 aa, Glycine max
  Coding DNA Sequence Number=SeqID_66543
MLKTVKALFFLSIATLPRFVPVTHIHVCDPGNQIELPGRKLVVDSRVLHSSVTVVIVSPGHPQSQAKEEYHQEYPIL

SEQ ID NO: 183322 - protein, 124 aa, Glycine max
  Coding DNA Sequence Number=SeqID_66544
KVKVGVEEVKDADAPVPVPTDEFNLVGQTLNTFLAWPTHLIKRLSEHGVVGLAKPADRSDHEVDDPQYLMTLIIPELFLKSLQVMWDATVFGVFNQDFPLYIKHEDLSEITHGGQCLSISVIQL

SEQ ID NO: 183323 - protein, 112 aa, Glycine max
  Coding DNA Sequence Number=SeqID_66545
  Homolog annotation: Hit_ID=Q93XR7; Match level="QueryCoverage=58%, HitCoverage=9%, E-value=6e-13, Identity=58%"; Hit description =Fructose-6-phosphate 2-kinase/fructose-2,6-bisphosphatase
MMSFNVARLQGLRCLALIVARFLSIKFFVKGDKVSSFDLAASWRAYQDNFRPSSVRWIPDVSISSAPQTGGEVGLPARERYEGLKDKETQDIIAEEGCFIDLESRVHFTKRC

SEQ ID NO: 183324 - protein, 52 aa, Glycine max
  Coding DNA Sequence Number=SeqID_66546
MHMTRMQFTNTGARETVSFLDTTSRGSKVPQQGIKTEPMCDANAKGATRKCT

SEQ ID NO: 183325 - protein, 208 aa, Glycine max
  Coding DNA Sequence Number=SeqID_66547
LRLNNNEVVDEIHYRRPVEDTSNNIYFESMQLKNDMDVNTMLMYNDEFSFVGPIELLCTVGRTTDAILNLLECPSIPTHDAVLYYNGRWNMSRQNNFVGYAFTGINPKKFDIPKGCSIDQLKDLIKQVAPKGNPPHGIHESQVVRRLFYRQPSHLEYFEKVLEFKIVELKCDDDVLKVLVESNYWKQFVSIEILALFHKVVMENEDDV

SEQ ID NO: 183326 - protein, 325 aa, Glycine max
  Coding DNA Sequence Number=SeqID_66548
  Gene Ontology: Mol. function=nucleic acid binding; Biological process= regulation of transcription
  Homolog annotation: Hit_ID=Q1RY40; Match level="QueryCoverage=88%, HitCoverage=82%, E-value=5e-65, Identity=48%"; Hit description=Zinc finger, CCCH-type
  Pfam annotation: Domain name=zf-CCCH; Domain location=118-143; Score =29.9; E_value=8.9e-06; Accession=PF00642.15; Description=Zinc finger C-x8-C-x5-C-x3-H type (and similar)
  Pfam annotation: Domain name=zf-CCCH; Domain location=153-175; Score =2.6; E_value=0.6; Accession=PF00642.15; Description=Zinc finger C-x8- C-x5-C-x3-H type (and similar)
  Pfam module annotation: Pfam domain module=zf-CCCH::zf-CCCH; Domain location=118-143::153-175
MSSVFSEHKFQLQPSHQLLSLKKSLGDIDIPVPPRKLLTRRSAAVHDGSGDIYLPHSGSTDSSTDDDSDGDPYASDQFRMFEFKVRRCSRSRSHDWTDCPFVHPGEKARRRDPRRFYYSGTVCPEFRRGQCDRGDACEFSHGVFECWLHPSRYRTEACKDGKNCKRKVCFFAHTPRQLRVFHSNDNSNKKKCTDISPHNNNNCCLVCHCSNSTRSPTSTLFGMSHFSPPLSPPSPSSPSMFETNNHHHGVVKYNKDVFSELVCSMEGLNFDEASSLLSAASKPHHHNNLSSWLDVSKDHNQKQLYATSEEEDDDDDKKSGSWWDL

SEQ ID NO: 183327 - protein, 133 aa, Glycine max
  Coding DNA Sequence Number=SeqID_66549
MVAILPKGNLVVWFCSLHNGPNNYLKGIINRSVLFFNTFALPLLNRYIVLMFPVFNNALKGLDDTPQPKSKASARWIVVKCNRQKGSTECGYYVMHWMPTIILGSFRNNWKTTIGSREIEGASHPVGTTLSQS

SEQ ID NO: 183328 - protein, 143 aa, Glycine max
  Coding DNA Sequence Number=SeqID_66550
  Subcellular localization annotation: CTP_CleavageSite=49; ConfidenceScore=5.40e-01
MIHGLLFFPLSPLPPPPPLSNKVVVAFGSKERKRNGGANSNFPRHGYVAAAGDREAFGGVSDELSSDQGASASVAFLGAEVEGAVRRGGAGGRRSAAAVQEPGGGGGAGSVAEELAEVEKGGEGGSGGGGGCETEEEEAQWET

SEQ ID NO: 183329 - protein, 57 aa, Glycine max
  Coding DNA Sequence Number=SeqID_66551
MRQQSGDREAAMTWRSRGMRGREEPREVAVPVVREFQCRKCESEGFRVRVRARNVSK

SEQ ID NO: 183330 - protein, 392 aa, Glycine max
  Coding DNA Sequence Number=SeqID_66552
  Subcellular localization annotation: CTP_CleavageSite=64; ConfidenceScore=5.61e-01
MATPPSSPPLLPESATPSSSMSKKTRKATRLRSLATRPIGVERLVAEFDTPEASDLRTKKKNTSDRMRAKAQDIQKQNIAPHVLSRGGYDYLEEKLMEDKKNKRLEEAAQSKSIGTIFGLPSPIRQHVKWKMVRTKKSCQMTYKAAKEIADWIASQGSFVAHERLDVLTTAIGRPEHPSHVRVAGVGVMIKQYFGLTSRSSRTSMSMAPKDLEHQMQSQMQSQRLALPHQPKPGPSIACVSTKESCVDPSGQDLDTGDSKKCGLYVDENPPRLVALGRVYEGSMTIHSFPLGNDQVKVGVKKVRDADAHVLDKQGAKGPTKLVDRLDPDVDLLYLMALTIQQLFLNPLQVSWDVTVFRVYNDSFPLYINHEDLLEIALGGQCLSISVIQLWI

SEQ ID NO: 183331 - protein, 52 aa, Glycine max
  Coding DNA Sequence Number=SeqID_66553
MELIVGGRCWKSRDLVKDYSRTCFFVYSNITTVPELALPTTIGRKFNIFLTR

SEQ ID NO: 183332 - protein, 230 aa, Glycine max
  Coding DNA Sequence Number=SeqID_66554
  Gene Ontology: Mol. function=phosphoprotein phosphatase activity; Cellular component=endoplasmic reticulum
  Homolog annotation: Hit_ID=Q1RY25; Match level="QueryCoverage=93%, HitCoverage=55%, E-value=6e-81, Identity=74%"; Hit description =Reticulon
  Pfam annotation: Domain name=Reticulon; Domain location=19-165; Score= -75.1; E_value=0.092; Accession=PF02453.8; Description=Reticulon
SLVEESETFPCLTFQHFLGHIAIGNSLVGCFILLKLSLSKVEKRSFAKLKEDDILHLAKLILPALNFAISKTRELFSGEPCMTLKVAPFLLLGAEYGHLITIWRLCAIGFFVSFSVPRLYSCYSAQINLRVECLKLRLLDTWSACTHKKIVIASVLIAFWNLSTIKTRIFTAFILLVILRYFRETIMQPVEDGEAQVAEKEQKQALVVVAEPEEEEPQKALVVAEKQRQC

SEQ ID NO: 183333 - protein, 254 aa, Glycine max
  Coding DNA Sequence Number=SeqID_66555
  Gene Ontology: Cellular component=integral to membrane
  Homolog annotation: Hit_ID=Q9SJH9; Match level="QueryCoverage=69%, HitCoverage=82%, E-value=2e-47, Identity=52%"; Hit description =Expressed protein
MEGIMMMMEHFGVDGDPIGIIGERLLLLENKRSATHAQDPTEQLEKSLLLFALNCILKPEKFENHYFNGSIWGMDAIGSGCWGLWKWNPLPQSRRRRIRSNSGSADAAGGGGYRFPVKQAVTAASLALTGDTIAQLSHRWRKAKEGGGSVSQDELWRYLSDHDWLRALRMTSYGFLLYGPGSYAWYQCLDHCLPKPTVQNLVLKVVLNQIVLGPCVIAVVFAWNNLWLQKLSELPEKYRRDALPTLLYGTNLVA

SEQ ID NO: 183334 - protein, 121 aa, Glycine max
  Coding DNA Sequence Number=SeqID_66556
  Subcellular localization annotation: CTP_CleavageSite=68; ConfidenceScore=5.92e-01
MASAAARSIFRSCSASRSAFRVASESKPVRSPFRIASNKPLSQSQSTLRFPVELSSCVESMMPYHTATASALMNSMLSISSRTSAWIPEGIVNCANTFGNSMRLREILNGFALVSGIVDSV

SEQ ID NO: 183335 - protein, 334 aa, Glycine max
  Coding DNA Sequence Number=SeqID_66557
  Gene Ontology: Mol. function=metalloendopeptidase activity; Cellular component=membrane; Biological process=proteolysis
  Homolog annotation: Hit_ID=Q9FLI5; Match level="QueryCoverage=93%, HitCoverage=63%, E-value=5e-77, Identity=49%"; Hit description =Similarity to peptidase
MGWYRRGKLALDRFHSLASRVVPQNPIFQHSSRIWQSGYLDSGSKGARFSGLSLCCSISQRLGAQGVVGVNGNFHNPFLLGANRFYYVDPCNVRHFKPRGPRHWFQNSRHIFVAVMVGWVLITVFFGNLETVPYTKRTHLILLSKAMERRLGESQFEQIKADFEGKILPPIHPESVRVTMIANEIIDALLRRLMKEQGWNDFGYASEHAMPVEGDGRETLSALVGSEEKVEGSCHKENKILDGKWVRLSRKNGQERGSLIATSHLVGLDWEILVVNKPDLNAFCLPGGKIVVFTGLFDHFKSDAEIATIIGHEKNDICHDMLKYVELWSNVAAL

SEQ ID NO: 183336 - protein, 712 aa, Glycine max
  Coding DNA Sequence Number=SeqID_66558
  Gene Ontology: Mol. function=binding; Cellular component=protein complex; Biological process=regulation of progression through cell cycle
  Homolog annotation: Hit_ID=Q1RY20; Match level="QueryCoverage=99%, HitCoverage=79%, E-value=0.0, Identity=84%"; Hit description =Proteasome/cyclosome, regulatory subunit
  Pfam annotation: Domain name=PC_rep; Domain location=235-268; Score =24.3; E_value=0.00043; Accession=PF01851.12; Description =Proteasomecyclosome repeat
  Pfam annotation: Domain name=PC_rep; Domain location=269-305; Score =22.7; E_value=0.0013; Accession=PF01851.12; Description =Proteasomecyclosome repeat
  Pfam annotation: Domain name=PC_rep; Domain location=306-340; Score =33.5; E_value=7.3e-07; Accession=PF01851.12; Description =Proteasomecyclosome repeat
  Pfam annotation: Domain name=PC_rep; Domain location=344-378; Score =10.9; E_value=0.38; Accession=PF01851.12; Description=Proteasomecyclo some repeat
  Pfam annotation: Domain name=PC_rep; Domain location=492-526; Score =11.2; E_value=0.34; Accession=PF01851.12; Description=Proteasomecyclo some repeat
  Pfam annotation: Domain name=PC_rep; Domain location=527-561; Score =30.0; E_value=8.5e-06; Accession=PF01851.12; Description =Proteasomecyclosome repeat
  Pfam module annotation: Pfam domain module=PC_rep::PC_rep::PC_rep::PC_ rep::PC_rep::PC_rep; Domain location=235-268::269-305::306-340::344 -378::492-526::527-561
HNAEPEAVDLLMEVEDLDMLSGHVDKTNFKRTCLYLTSSARYLPGPDDMLVLDIAYSIYKQFEEYPNALQIALFMDNSQHVREVFTSCNDVLRKKQFCYMLARHGITFELDEEMVPDDEDRELLQEIINNSKLSEGYLTLARDIEVMEPKSPEDIYKVHFMLKQQPHVLAHLLDGRASAGASVDSARQNLAATFVNAFVNAGFGQDKLMTVPSDSSSSASSGNWLFKNKEHGKTSAAASLGMILLWDVDSGLAQIDKYFHSNDNHVIAGALLGVGIVNCSIKNDCDPAMALLGDYIDKEDTSIRIGAIMGLGIAYAGSQNEQLREKLTGVLNDSKASLEVLAFAAISLGLIYVGSCNEEIAQAIIYTLMDRSESELGEPLTRLLPLGLGLLYLGKQDSVEATAEVSKTFNEKIRKYCDMTLLSCAYAGTGNVLKVQNLLGHCSQHLDKGETHQGPAVLGIAMVAMAEELGLEMAIRSLEHLLQYGEQNIRRAVPLALGLLCISNPKVNVMDTLSRLSHDTDSEVAMAAVISLGLIGAGTNNARIAGMLRNLSSYYYKDTSLLFCVRIAQGLVHLGKGLLTLNPYHSDRFLLSPTALAGLITMLHACLDMKAIVLGKYHYVLYFLVLAMQPRMLLTVDENLKPLSVPVRVGQAVDVVGQAGRPKTITGFQTHSTPVLLAAGDRAELATEKYIPLSPILEGFVILKENPDYREE

SEQ ID NO: 183337 - protein, 420 aa, Glycine max
  Coding DNA Sequence Number=SeqID_66559
  Gene Ontology: Mol. function=binding; Cellular component=nucleus; Biological process=regulation of transcription
  Homolog annotation: Hit_ID=Q1RY24; Match level="QueryCoverage=99%, HitCoverage=93%, E-value=1e-172, Identity=72%"; Hit description =Pentatricopeptide repeat
  Pfam annotation: Domain name=PPR; Domain location=100-134; Score =32.0; E_value=2.1e-06; Accession=PF01535.11; Description=PPR repeat
  Pfam annotation: Domain name=PPR; Domain location=241-275; Score =46.4; E_value=9.6e-11; Accession=PF01535.11; Description=PPR repeat
  Pfam annotation: Domain name=PPR; Domain location=276-310; Score=4.4; E_value=2.3; Accession=PF01535.11; Description=PPR repeat
  Pfam annotation: Domain name=PPR; Domain location=312-345; Score=5.6; E_value=1.6; Accession=PF01535.11; Description=PPR repeat
  Pfam annotation: Domain name=PPR; Domain location=4-37; Score=9.1; E _value=0.63; Accession=PF01535.11; Description=PPR repeat
  Pfam module annotation: Pfam domain module=PPR::PPR::PPR::PPR::PPR; Domain location=100-134::241-275::276-310::312-345::4-37
MPTLLYNALISAYHIHNHNKALSIFTHMLANQAPPNSHTFPPLLKISPLPLGATLHSQTLKRGLLSDGFILTTLLALYARNHLLPHARMVFEEFPMFCIVACNAMINAFSMNGDMEAAVALFERMPRRDVFSWTTVVDGFALKGNFGASIRFFRNMMNHKDVVAGLVKPNEATCSSVLSSCANLDGKAALDWGKQVHGYVVMNEVKLGVFVGTSLIHLYGKMGCLSNAENVFRVMVVREVCTWNAMISSLASHGREKNALDMFDRMKLHGLKPNSITFAAVLTACARGNLVREGLDLFRSMWYDFGIEPNLKHYGCVIDLLGRAGHIEEAAEIIRNMPFQPDASVLGAFLGACRIHGAIELGEEIGKNMLRLQTQHSGQYVLLSSMNAEKERWDRAANLRREIMEAGIQKIPAYSMLHLT

SEQ ID NO: 183338 - protein, 210 aa, Glycine max
  Coding DNA Sequence Number=SeqID_66560
  Gene Ontology: Mol. function=calcium ion binding; Cellular component =membrane; Biological process=abscisic acid mediated signaling
  Homolog annotation: Hit_ID=Q1SPH6; Match level="QueryCoverage=96%, HitCoverage=90%, E-value=5e-83, Identity=75%"; Hit description =Calcium-binding EF-hand
  Pfam annotation: Domain name=efhand; Domain location=105-133; Score =22.4; E_value=0.0016; Accession=PF00036.22; Description=EF hand
  Pfam annotation: Domain name=efhand; Domain location=149-177; Score =30.5; E_value=5.9e-06; Accession=PF00036.22; Description=EF hand
  Pfam annotation: Domain name=efhand; Domain location=68-96; Score =20.7; E_value=0.0053; Accession=PF00036.22; Description=EF hand
  Pfam module annotation: Pfam domain module=efhand::efhand::efhand; Domain location=105-133::149-177::68-96
MALLLNIRTCNWSIEVFKSDSSPFTVSEVEALHELYKKLSNSIIEDGLIHREEFQLALFRNKNKKNLFADRIFDLFDLKRNGVIEFGEFVRSLGVFHPNAALEDKITFAFRLYDLRQTGFIEREELKEMVLALLHESDLELSDDMIETIVDKTFSDADINGDGRIDQDEWKAFVSKHPSLIKNMTLPYLKDITLAFPSFVTGTDIEESEM

SEQ ID NO: 183339 - protein, 584 aa, Glycine max
  Coding DNA Sequence Number=SeqID_66561
  Gene Ontology: Mol. function=enzyme inhibitor activity; Cellular component=cell wall; Biological process=cell wall modification
  Homolog annotation: Hit_ID=Q1SPH1; Match level="QueryCoverage=99%, HitCoverage=100%, E-value=0.0, Identity=67%"; Hit description =Pectinesterase; Pectinesterase inhibitor
  Pfam annotation: Domain name=PMEI; Domain location=67-218; Score =157.5; E_value=3.5e-44; Accession=PF04043.6; Description=Plant invertasepectin methylesterase inhibitor
  Pfam annotation: Domain name=Pectinesterase; Domain location=269-568; Score=747.3; E_value=9.5e-222; Accession=PF01095.10; Description =Pectinesterase
  Pfam module annotation: Pfam domain module=PMEI::Pectinesterase; Domain location=67-218::269-568
  Subcellular localization annotation: CTP_CleavageSite=56; ConfidenceScore=5.49e-01
MEYGRLGPSDPGGSSRLNNVPPTSSGRKKIVLLSLFSVLLIAASAVTAVVVRSRIQQNTRAHETRLGKPTQAISRTCSKTRFKTLCVKSLLDFPGSEEASEKDLVHISFNVTLQHFSKALYSSAAMSYTAMDPRVRAAYDDCLELLDDSVDALARSLNTVSVGAVGSANDDVLTWLSAALTNQDTCAEGFTDAVGTVKDHMSSNLRDLSELVSNCLAIFSGAGAGDDFAGVPIQNRRRLMEMREDNFPTWLSRRDRKLLILPLSQIQADIVVSKDGNGTVKTIAEAIKKVPEYSSRRIIIYVRAGRYEEENLKLGRKKTNVMFIGDGKGKTVITGGRNYYQNLTTFHTASFAASGSGFIAKDMTFENYAGPGRHQAVALRVGADHAVVYRCNIIGYQDTMYVHSNRQFYRECDIYGTVDFIFGNAAVVFQNCTLWARKPMAQQKNTITAQNRKDPNQNTGISIHNCRIMATPDLEASKGSYPTYLGRPWKLYARTVYMLSYIGDHVHPRGWLEWNTSSFALDTCYYGEYMNYGPGSGLGQRVNWAGYRVINSTVEASRFTVGQFISGSSWLPSTGVAFIAGLST

SEQ ID NO: 183340 - protein, 59 aa, Glycine max
  Coding DNA Sequence Number=SeqID_66562
MELGEGVVVEEEAEEGGRSSDLLLSKSSNYAPFISFVSVGNDVFLGACLPPSSEERDSV

SEQ ID NO: 183341 - protein, 203 aa, Glycine max
  Coding DNA Sequence Number=SeqID_66563
MDFNTMFKKCLDMAKISIKFASWEPINIVFKVKINDRIHDICVVEEDSVPVFYGEVEARKSVSSSSSKMSKWPKKGWSEWQEFFDEENCVFNVKNNEESRIEIQKDLDENKGWGKRRLRMDKMISFAKEGVWVWALEPYEVEGFCVAKTSNDESEAFLEALGRDWYWGDGVVMESRRSKFKGSFKNPMNGEGEENDIQALETS

SEQ ID NO: 183342 - protein, 73 aa, Glycine max
  Coding DNA Sequence Number=SeqID_66564
MDLKIENKPYLTPPKQHCNRQNNQRTTATGFGSGSGGKPTTFLTQIICFRCGKKGISIEIAHIPRRNRMVGSE

SEQ ID NO: 183343 - protein, 106 aa, Glycine max
  Coding DNA Sequence Number=SeqID_66565
MFPHGKCTGKGVFRRFPTPTCQTPLIYMLLFILQGSIMYIQGHYWQHEGNLRDSEDKWVQMFLIYLESRPDGLLDAHSVKESWQEGKGYCGMIKLVGVCMWISYVY

SEQ ID NO: 183344 - protein, 198 aa, Glycine max
  Coding DNA Sequence Number=SeqID_66566
  Gene Ontology: Mol. function=transition metal ion binding; Cellular component=cytoplasm; Biological process=electron transport
MGDRLEDMIRDLGQESFQQAHALVYEGLQSDLKKPLYLGCKNSLTLLSVVLSLVNVKAKYGWSDKSFNLLLEVVHDLLPEENTLPKSYYLAKKILCPMGMEYQKIHACPNDCILYRHEFEEMSKCPRCGASRYKVKDDKECSSDENSKKGPPAKVLWYLPIIPRFKHLFANEDNAKDLTWNANGRNSDGMVYHPADSS

SEQ ID NO: 183345 - protein, 102 aa, Glycine max
  Coding DNA Sequence Number=SeqID_66567
  Gene Ontology: Mol. function=transferase activity; Cellular component= chromatin; Biological process=DNA integration
  Homolog annotation: Hit_ID=Q1SP23; Match level="QueryCoverage=79%, HitCoverage=21%, E-value=3e-27, Identity=69%"; Hit description =Polynucleotidyl transferase, Ribonuclease H fold
INEQVKLIREKIKASQDRQKSYYDRRRKPLDFQEGEHVFLKVSPVTGVGRALKARKLTPKYLGLYQILKKIGPVAYHLALPLNLCKGKQKISQVVSPLKSFA

SEQ ID NO: 183346 - protein, 80 aa, Glycine max
  Coding DNA Sequence Number=SeqID_66568
MANGTEDDVSLFVSTGSFAPWLMKGMGNHKQKDVYTDNHLGTSACPLTLRQKDVYTDNYLGISICPLTLRVRMIEIDGAQ

SEQ ID NO: 183347 - protein, 181 aa, Glycine max
  Coding DNA Sequence Number=SeqID_66569
MTKAALAHNRDREVAVRIIYSRKPIPVRIHFLGLMLYFFLVLSPWNLNKNGFSCWNWICFLDWSHLAFKGGWGAARFGQTSVPDVLGACVKVERFKTAGQLKGEILSSAADGKAILTQLAFAHESEKEEEAVESDVALYCFQIESLKKAIPEARESLVLPTNESHFTDNRFEEEDPNTSID

SEQ ID NO: 183348 - protein, 66 aa, Glycine max
  Coding DNA Sequence Number=SeqID_66570
MALWRFLRIVNPNGQTLDPISAGAGLSIYLGELSSRKDNKDFPLCYVLSTYTIFMGGAAITSDSPC

SEQ ID NO: 183349 - protein, 151 aa, Glycine max
  Coding DNA Sequence Number=SeqID_66571
MNYFSDWGGRFPKPSLSFSSYSIALAWARKGSKKRFENLGFSVEPAYGLELLQLEKGSTADHVARWRFLSVFCLNDYRPGREDESAPSSSYSRPIRENDSFKYRIRPLFGTLDYVGFQEITDKRVLPDGRKSITGARANGIQGLSIGINDP

SEQ ID NO: 183350 - protein, 87 aa, Glycine max
  Coding DNA Sequence Number=SeqID_66572
MTKYSPILQHSEWRSWPDPLSYKVLLLQQRAVAKSGVHVSQREELLSSLSLYFKTDFEFERGGRDDKGIGQRHLSSHRRSGPNLIKG

SEQ ID NO: 183351 - protein, 103 aa, Glycine max
  Coding DNA Sequence Number=SeqID_66573
  Gene Ontology: Mol. function=protein binding; Biological process =defense response
  Homolog annotation: Hit_ID=Q19PK7; Match level="QueryCoverage=90%, HitCoverage=11%, E-value=3e-09, Identity=38%"; Hit description=NBS -LRR type disease resistance protein
IESLSKSIGKLQNLETLDIRGTDVSEMLEEITKLKKLRHLLSYYISSIQWKDIGGMTSLHEIPPVIIDDDGVVIREVGKLEQLRELTVTDFTGKHKETVFLDK

SEQ ID NO: 183352 - protein, 148 aa, Glycine max
  Coding DNA Sequence Number=SeqID_66574
MDPGIGPLFYSNPWVLRMQCKNVEKTAIITFYTVQQMHTQSFTIPQFLKIGLTHKKQSPVESPTVATCTFAGERGEALGKPVIKNIPSSGVVFTFEEGGQKRGLAPTYPPLKRKSNLRSSFKGESSDSFYLEGDHFKALDLKNDPFTW

SEQ ID NO: 183353 - protein, 157 aa, Glycine max
  Coding DNA Sequence Number=SeqID_66575
MNRHIDVALVKEFYWNLYDPEDKSPKQVRVRGRLIKFDAVSLNAFMETPPVIQPGEQYPSYSIFCRSCMDPQELASKLCIPGRGFVLNVEGAAWKLLRKDLMTLAQTWSVLSYSNLTPTSHTPDLNMDRARFLRWPSPTPRGSTFQPSFPHSAWPEE

SEQ ID NO: 183354 - protein, 84 aa, Glycine max
  Coding DNA Sequence Number=SeqID_66576
MTSEHRHWNDDADGAEVPVRTRADGSGGAEVKGAGAGEGASAKETGVGATAKDEHSDPRARALRVPGNSIVGSSRAEGLEGQRI

SEQ ID NO: 183355 - protein, 332 aa, Glycine max
  Coding DNA Sequence Number=SeqID_66577
  Gene Ontology: Mol. function=hydrolase activity; Cellular component =cytoplasm; Biological process=protein folding
  Homolog annotation: Hit_ID=Q7CJR2; Match level="QueryCoverage=72%, HitCoverage=83%, E-value=2e-94, Identity=74%"; Hit description =Putative carboxylase
  Subcellular localization annotation: CTP_CleavageSite=71; ConfidenceScore=5.59e-01
WPPAPRADTPPARTPFPAAAACGCGRSSPDRENSGGRRSPRRTAMPSAPTDAWSAHRRRESRRRCWPSSPVATAPGRWRSLRRDRRSNQRSCNPQAICRRKRSCSALARCASASDTRVTAGGLRIGHQHDRLAVVRHLHHAGQQAVRQHLAVGGALQRRAAVQAVAHAVALRAELPGGAPERVLRLFAELGVLRPRQRADAVGEQQLLHATAVLRQRGGFAQRQPIAVLQITALVAAKGGFHVGAARSQHFRHGDAARDRQVAAHAAFRRAQRQPLPLFHRVAPAGPQRLAVQLRVAAGTGQGDPARAGKLGAELAEGDLQPGGLRRIAHQQ

SEQ ID NO: 183356 - protein, 141 aa, Glycine max
  Coding DNA Sequence Number=SeqID_66578
  Gene Ontology: Mol. function=DNA binding; Biological process=DNA integration
  Homolog annotation: Hit_ID=Q1S3H4; Match level="QueryCoverage=82%, HitCoverage=24%, E-value=8e-31, Identity=48%"; Hit description =Integrase, catalytic region
MSPYQVVFGKACHLPVEIEHRAYWAVKTCNFSIDQAGEERKLQLSELDEIRLEAYENSKFNKEKTKKFHDSLIAKKDFVVGQKVLLYNSRLGLMSVEIKSEYTDKSFKVNGHRLKPFLTNPSLVNVVVEETSLLHPTSLPP

SEQ ID NO: 183357 - protein, 109 aa, Glycine max
  Coding DNA Sequence Number=SeqID_66579
TGAGWRTADPDAPPPPHQADPARSFDTERAHVQTHDCLYQLSLSLQSQGFAPFPCPTPDQFRAKVAWPRDWPEAQAGEAPAEAPDDADEARMDEEMTDLLDFLGGSGAT

SEQ ID NO: 183358 - protein, 66 aa, Glycine max
  Coding DNA Sequence Number=SeqID_66580
MMPFLPSLVSMTLTLVYMGGSNEKISLLGADSYTSCHYTYDLYHGCRHSYINCYCSPHPYGNICPE

SEQ ID NO: 183359 - protein, 46 aa, Glycine max
  Coding DNA Sequence Number=SeqID_66581
MWEEEGKVSDRFQAAGKRDEKSDFRKEEGKVFYMSMIDAKLCENLS

SEQ ID NO: 183360 - protein, 243 aa, Glycine max
  Coding DNA Sequence Number=SeqID_66582
MGEAEEVQEKMKADMEAMKEKMATMMEAMMSVKKIMEANAVAIAATSVVAKVNLMSPSGINQMNHPTSDMVGKDLGSTGSPHNVQIQNEHAFPPYGLPPNYTPPNVAYTLNENLNNSTPILIESQQPQTDQAYISQTMGETQEIPHHNLADFEPWLGYATEGQAVGGIPFENTLEGPQFRPQPQPLHFAVGRAPPAMAEKGKADHLKERLRAIEGGEDYAFANLEKLFLIPKHGHSQVQGAGL

SEQ ID NO: 183361 - protein, 63 aa, Glycine max
  Coding DNA Sequence Number=SeqID_66583
YESISNGIRSGSSDRLEALEIGCSEATNMVLGYVSHWSNNCLLATDVIKKPIKMANMAKLGLK

SEQ ID NO: 183362 - protein, 192 aa, Glycine max
  Coding DNA Sequence Number=SeqID_66584
TLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPMSRRLIGSGLVKGNHRSRSEKRVFTGQLSLLMDPNLGDLSMTRNEAW

SEQ ID NO: 183363 - protein, 59 aa, Glycine max
  Coding DNA Sequence Number=SeqID_66585
MQKLGDKQQRRRQNLRGFGYRSHDVGSFSSISSFWSPKRREGVTPCMWWRQIKPAKRNS

SEQ ID NO: 183364 - protein, 66 aa, Glycine max
  Coding DNA Sequence Number=SeqID_66586
MSSGCLPMQPESYELQENLQSDSGQVLGYFEVFLGISSVFEAELVSAINFIEQAYNRKAKNCQKTS

SEQ ID NO: 183365 - protein, 384 aa, Glycine max
  Coding DNA Sequence Number=SeqID_66587
  Gene Ontology: Mol. function=phospholipase C activity; Cellular component=cytoplasm; Biological process=intracellular signaling cascade
  Homolog annotation: Hit_ID=Q84K11; Match level="QueryCoverage=76%, HitCoverage=56%, E-value=1e-158, Identity=88%"; Hit description=Type 5 protein serine/threonine phosphatase 62 kDa isoform
  Pfam annotation: Domain name=Metallophos; Domain location=78-258; Score=112.0; E_value=1.7e-30; Accession=PF00149.18; Description =Calcineurin-like phosphoesterase
  Pfam annotation: Domain name=PPP5; Domain location=2-72; Score=75.4; E_value=1.8e-19; Accession=PF08321.2; Description=PPP5
  Pfam module annotation: Pfam domain module=Metallophos::PPP5; Domain location=78-258::2-72
MDMNKVWCFILMLDVEPQYSGARIEGDAVTLDFVKKMIEDFKNQKFLHKRYAFQIVLQTREMLQALPSLVDIHVPDGKHFTVCGDVHGQYYDLLNIFELNGLPSEENPYLFNGDFVDRGSFSLEVILTLFAFKCMSPSAIYLARGNHESKSMNKIYGFEEVFCCLPLAHVINEKVFVVHGGLFSVDGVKLSDIRSINRFCEPPEEGLMCELLWSDPQPLPGRGPSKRGVGLSFGADVTKRFLQENNLDLVVRSHEVKDEGYEIEHEGKLITVFSAPNYCDQMGNKGAFIRFEAPDLKPNIVTFSAVLRLTCQCEDNFRQGVNKVGRRGDPQYKCNEVGNMTWMNPTMQCMLGFQFGMKLMSSSGEPNSVTLMRCTNLGSMNVEC

SEQ ID NO: 183366 - protein, 524 aa, Glycine max
  Coding DNA Sequence Number=SeqID_66588
  Gene Ontology: Mol. function=nucleoside-triphosphatase activity; Cellular component=membrane; Biological process=DNA replication, removal of RNA primer
  Homolog annotation: Hit_ID=Q4WVU7; Match level="QueryCoverage=84%, HitCoverage=61%, E-value=2e-76, Identity=39%"; Hit description =Mitochondrial DNA helicase (Pif1), putative
  Pfam annotation: Domain name=DEAD; Domain location=55-193; Score= -38.3; E_value=0.0096; Accession=PF00270.19; Description=DEADDEAH box helicase
  Pfam annotation: Domain name=DUF889; Domain location=193-396; Score= -138.1; E_value=0.04; Accession=PF05970.5; Description=Eukaryotic protein of unknown function (DUF889)
  Pfam module annotation: Pfam domain module=DEAD::DUF889; Domain location=55-193::193-396
  Subcellular localization annotation: CTP_CleavageSite=64; ConfidenceScore=5.59e-01
MKVFNFKAVAAAAYRTFSSKRVAKPSAWALTNPKTKNTNTTVEQCRTPMSKIEWSEEQKQVLSSVSEGKSVFITGSAGTGKTLLLEEIIKFLNRLHTPYGVYVTASTGVAACALKGQTLHSFAGIGIIFSDDDPQLLVERVLSNQGACRRWRKVEALVIDEISMVSAKLFESLEFVAREMRGVDETWGGIQLVVSGDFFQLPPVVSNKDYCCSSQGVMYAFEAECWNRSFDLQVELTRVFRQSDYGLTRLLEGIRRGESDPQDLEFLENLCLGSSECDHDPSIVQLFPLNKDVERVNDERLRSLQKDVVVYRAVDSGKGHWKGNLRYGIVPDEISLCEGARVMLVKNLDTEHGLVNGATGVVVGFSWSLGEEEHLSGICNDKVLPVVKFDGGKFLTIKPAKWHLMDGPEVVACRKQIPLILAWAMSIHKCQGMTLERVHTDLSRAFGCGMVYVALSRVRSLEGLHLSAFNRSKIKVDQRVSRFYRSLASEKSKEVMVVDRRREKVATEVAVVSQENCHILYKLT

SEQ ID NO: 183367 - protein, 143 aa, Glycine max
  Coding DNA Sequence Number=SeqID_66589
  Gene Ontology: Mol. function=transferase activity, transferring acyl groups, acyl groups converted into alkyl on transfer; Cellular component=glyoxysome; Biological process=tricarboxylic acid cycle
  Homolog annotation: Hit_ID=P49299; Match level="QueryCoverage=84%, HitCoverage=23%, E-value=4e-53, Identity=81%"; Hit description =Citrate synthase, glyoxysomal precursor
LRYGFYISKDAYTVYAVYGNLPSESQLAEWEFALSQHSAVPQGVLDMIESMPHDAHPMGMLVNAMSALSVFHPDANPALKGLDIYNSKQVRDKQIARVIGKITTIAAAINLRLAGRPPVLPSNKLSYTENFLYMLDSLYVLLY

SEQ ID NO: 183368 - protein, 43 aa, Glycine max
  Coding DNA Sequence Number=SeqID_66590
MKNKSIQRNPSSSSFKKTGSISGIGSTSKDPKPTKRMLAWGIL

SEQ ID NO: 183369 - protein, 135 aa, Glycine max
  Coding DNA Sequence Number=SeqID_66591
MVVRHTNHPSYAYEENTIKSIIFSKKIRSKQRRWIRKKGQKRRRIRDTNVTKVERERKSVDNGCKRTRRTQARESHALCFFVNNANMRREGVLCQCRVVERLVAPLNIRVARFFNRLAFFLTLTLSLRKLRRFID

SEQ ID NO: 183370 - protein, 465 aa, Glycine max
  Coding DNA Sequence Number=SeqID_66592
  Gene Ontology: Mol. function=transferase activity; Cellular component= nucleus; Biological process=flavonoid biosynthetic process
  Homolog annotation: Hit_ID=Q1T1I0; Match level="QueryCoverage=98%, HitCoverage=96%, E-value=3e-83, Identity=39%"; Hit description =Transferase
  Pfam annotation: Domain name=Transferase; Domain location=1-459; Score=322.4; E_value=7.7e-94; Accession=PF02458.6; Description =Transferase family
MATIKASHTVVPNQPTPKGRLWLSNSDNSTRKAHSPVIYIYKAKHNIEYNIERMKESLSKTLVYFYPVAGRLSLSESGRMEVDCNAKGVTLIEAETAKTLADFGDFSPSDSIKEELVPAIDYHSQPIQEIPLLFVQLTRFKGDQQQQHGLAIGMAYSHPVADGLAWTRFVNTWAMVNRGDSLDVNEMPFLDRTILKFPTWSSSLSLLSPPPLSHSDHPELKPLPLILGRSDSTEEQNKKTTASVLKLTSKQVEMLKKKANDQGSTPCTRFEAVAAHIWRCACKARGQHHKQPTIVRFNGDIRNRLIPPLPRNYFGNALVATVTPECYVGEITSRPLSYAARKLREAIALLRDEYIRSQLEAVFGEEQLKCIRAFFLGQGEGRSEPFGGNPNLQITSWINFPVDSTDFGWGKPVYFGLGYVCALDRGIIVRDPQDDGSLIVIMHFQIAHMQLFKKLFYEDIFTSRL

SEQ ID NO: 183371 - protein, 259 aa, Glycine max
  Coding DNA Sequence Number=SeqID_66593
  Gene Ontology: Mol. function=nucleic acid binding; Biological process= DNA integration
  Homolog annotation: Hit_ID=Q0KIN0; Match level="QueryCoverage=85%, HitCoverage=13%, E-value=6e-28, Identity=31%"; Hit description =Integrase core domain containing protein
  Pfam annotation: Domain name=zf-CCHC; Domain location=232-249; Score =11.8; E_value=0.011; Accession=PF00098.13; Description=Zinc knuckle
MTRYVWNLEGSEWVPTLVILRLNRAALCVEWSPKGHHDHLEKASDSVPNDKRPEWEKLDYQLCAVLWQSVEPDILEILRSFKTCRSFWKKAQEIFANDIQSLFDATMKVTTLKQTSHDMIAHVGKARAAVEELRKFLVADSLEEVNRKLDKFYMVLILRSLHSDFDHVCDQVLAGDQVPSMDSLITRLLRVPHLLKDENPVDGVETLAMVASRGRGGNCNNRGGRSGRGGRPHCTYCKRMGHTQENCYSLHGFPDKVAQ

SEQ ID NO: 183372 - protein, 473 aa, Glycine max
  Coding DNA Sequence Number=SeqID_66594
  Gene Ontology: Mol. function=transferase activity; Cellular component= nucleus; Biological process=flavonoid biosynthetic process
  Homolog annotation: Hit_ID=O64470; Match level="QueryCoverage=99%, HitCoverage=99%, E-value=1e-77, Identity=37%"; Hit description =Putative anthranilate N-hydroxycinnamoyl/benzoyltransferase
  Pfam annotation: Domain name=Transferase; Domain location=1-470; Score=335.2; E_value=1.1e-97; Accession=PF02458.6; Description =Transferase family
MVTIKASHTVVPNQPTPKGRLWLSNSDQTARPAHTPNLYIYKAKHNIIEYDIEKMIDSLSIILVYYYPVAGRLSVTESGRMEVDCNAKGVTLIEAETVKTIDDFGDFTPSESVKEELVPVIDYHSQPIEEIPLVFVQVTRFKGDKEQQQGLAIAVAVSHPVADGSAWIHFINTWAKVNRGDMLGLNDMPFIDRTILKSSSSLSSLSPPPSPRFDHPELQPLPFILGRSDSTEEQKKKTTAAMLKLTSEQVEMLRKKVNENENLSTKQGSRSRSRSRPCSRFEAVAAHIWRCACKARKLDRNQPTLVRFNADFRSRLTRPLPRNYFGNALAATVTPESYAGEITSRPLSYAARKLREAVEMLKEEYITSQLEVVLGEEQLESIKALFSRQGERRNSPFAGNPNLQITSWISIPLYEADFGWGKPEHFVLGYVCPFDRGIIIRGPENDGSVIVIMYFQIAHMQLFKKFFYEDIDP

SEQ ID NO: 183373 - protein, 315 aa, Glycine max
  Coding DNA Sequence Number=SeqID_66595
  Gene Ontology: Mol. function=transferase activity; Cellular component= nucleus; Biological process=flavonoid biosynthetic process
  Homolog annotation: Hit_ID=O64470; Match level="QueryCoverage=72%, HitCoverage=55%, E-value=2e-40, Identity=37%"; Hit description =Putative anthranilate N-hydroxycinnamoyl/benzoyltransferase
  Pfam annotation: Domain name=Transferase; Domain location=2-309; Score=-74.0; E_value=2.3e-07; Accession=PF02458.6; Description =Transferase family
MSCSIPLYVINWRLTLSFICQILSFNQFSEAFGKFYGQSKHGVSNDAVETSRTRGTVHENCINCIMPLGDHGTLVRRFSTSAPCFDHLELKPLPLKLGSSDSTAKQNKKTCVVLLKLTQGQVGKLKKKANDQPMKEGSRVRPYSRFEAIAAHIWRCASKARELDEKQPTLVRFNSDIRSRQIPPLPRTYFGNALAATVTPECCVGDILSKSLSYAAQKVREAIEMLTNEYIRSQLDIVLGEEQLDCIKALFSGQGERRNAPFAGNPNLQITSWMSIPLYEADFGWGKPDYVVMGYIAHMHLFKKFFYEDVFTSRL

SEQ ID NO: 183374 - protein, 456 aa, Glycine max
  Coding DNA Sequence Number=SeqID_66596
  Gene Ontology: Mol. function=RNA-directed DNA polymerase activity; Cellular component=nucleus; Biological process=RNA-dependent DNA replication
MGIHGKVGFGIFWTQLAHESSRLDWVKLRVPKKVVNKLTRLQRNFLWGGVSEQNKIAWIRWETVCLPKEDGGLGVKDISSFNLSLLGKWKWKLFQNQGELWVRVIESKYGGWRNLSEARSANNESTWWRDLKIVDQHPQQGQLLNNSIAWKVGRGDKFKFWEDTWLGEDNRLLEKYPRLYSISVQQNYFIQQMGEFKDSGWEWDFKWRRPLFDNEIDMAVSFLQELEGNRIRSHRADQWVWVADSSGQYTVRSAYNVLREDLLQEDQDGEFKELWKVKVPSKVIVFAWRLLKDRLPTRDNLRRKHVELQDFMCPFCRTIEESAGHLFFHCSKVFPIWCEMLSWVNLVGVFPHHPRHHFLQHIYGAFEGIQLDRWKGWWLALTWTIWKHRNSIVFSNSAFNANKVVDDAVFLLWTWLKNFEKDFTTHYNQWSSNLSEGFFRRRGFESRFNNCISLII

SEQ ID NO: 183375 - protein, 450 aa, Glycine max
  Coding DNA Sequence Number=SeqID_66597
  Gene Ontology: Mol. function=transferase activity; Cellular component= nucleus; Biological process=flavonoid biosynthetic process
  Homolog annotation: Hit_ID=Q1T1I0; Match level="QueryCoverage=99%, HitCoverage=96%, E-value=7e-70, Identity=35%"; Hit description =Transferase
  Pfam annotation: Domain name=Transferase; Domain location=1-450; Score=340.1; E_value=3.6e-99; Accession=PF02458.6; Description =Transferase family
MVTIVGSYNVTPNQPTPKDPLWLSNSDLIGFQGYVPTLYVYKAKPNYSNNIIERLRNSLSKLLVYYYPVAGRLSLTKSGRMEVDCNAKGVTLIEAETTNTFADYGDFTTPSESTDELVPKIDSTQPIEETPILVVQLTRFRGGDEGLAVGFGMFHSLTDATGIIHFMNRWAKLARGEELNPNEIPFLDRTILQLFSSSSQHVDQPEWKPITQAQGVEQKQRSCSLLKLTSSQVERLKKKTNDESPKELGVRPYSRFEAIAAHIWRCASKARAEYSNSNHPTIVRFSVNIRNRLLTPPIPESYFGNALARTTTPKCYEGDIISNPLSFAAQKLREAVNPITGEYIKSQLSVGLGQEQLDHIRAFFMRQEHGMKTPYIAGEHNNVILLTSLMTMPVYEADFGWGKPMQFGLPRGSLDDRVGILPSPDGDGVVVNVFFQEAILQRFKKLFYED

SEQ ID NO: 183376 - protein, 452 aa, Glycine max
  Coding DNA Sequence Number=SeqID_66598
  Gene Ontology: Mol. function=transferase activity; Cellular component= nucleus; Biological process=flavonoid biosynthetic process
  Homolog annotation: Hit_ID=O64470; Match level="QueryCoverage=99%, HitCoverage=99%, E-value=5e-92, Identity=41%"; Hit description =Putative anthranilate N-hydroxycinnamoyl/benzoyltransferase
  Pfam annotation: Domain name=Transferase; Domain location=1-451; Score=359.5; E_value=5.5e-105; Accession=PF02458.6; Description =Transferase family
MVVTIVASHCVVPNQETPKVRLWLSDSDQVVRLGHTPTIYVYKAKHNTKTIERMKTSLGKILVYYYPVAGRLNLSDSGRMELDCNAKGVTLLEAETTKSLGDYGDFSPSESIKEELVPQIDYTQPLEELPLLFVQLTRFKDGESFAIGVACSHTLADGLSAIQFINSWAKVARGETLEPHEVPFLDRTVLKLQHSPSAPCFDHPELKPLPLKLGSSDSIAEENKKTCAVLLKLTPEQVGKLKKKANDQPMKEGSRVRPYSRFEAIAAHIWRCACKARELDEKQPTLVRFNGDIRSRLIPPLPRTYFGNALAATVTPRCYVGETLSKPLSYAAQKVREAIEMLTNEYIRSQLDIVLGEEQLDCIKALFSGQGERRNAPFAGNPNLQITSWMSMPVYEADFGWGKPMYFGLAYVSAQDRAVILLSPHGDGSVIVSMHFQIAHMQLFKKYFYENI

SEQ ID NO: 183377 - protein, 77 aa, Glycine max
  Coding DNA Sequence Number=SeqID_66599
  Gene Ontology: Mol. function=nucleic acid binding; Biological process= DNA integration
  Homolog annotation: Hit_ID=Q1SB98; Match level="QueryCoverage=80%, HitCoverage=14%, E-value=8e-13, Identity=47%"; Hit description=Zinc finger, CCHC-type; Peptidase aspartic, catalytic
MDLGSYFRILDITEHSSDIRIQRVVILMIRDWARVGAIDKSHQVVVYKESIDLHSPGRVIRPSQLDRGLSILRTTID

SEQ ID NO: 183378 - protein, 264 aa, Glycine max
  Coding DNA Sequence Number=SeqID_66600
MENQEAFRGDNLESREHRTKSIAVLMSSNPVTANASYAHEVSANPELEAFETLNRNDEKHETPKSLIGNLKKYGANDVTSSKGEVQLNDQTKVRVISLVGKGQGQFKSNLTGKWILVENKDEDDPKDSQRLKKPIQLVHRSNPNDDPFVDLVKVSILLDREPFQLSWDATMFGVNNNDFPLFIHNSDVQEIISGNQCLNITVIQLWITFLNELTMKSGLDSMYGFLEPQSIQKSGNKRDETQCYIERWLKQSQREIYLGAYLNE

SEQ ID NO: 183379 - protein, 108 aa, Glycine max
  Coding DNA Sequence Number=SeqID_66601
MGKLDDLQERLRAIEGGEDYAFANLEELFIVLDFGKYKGTTCPKNHLKMYCRKMGAYAKDEELLIHSFQESLTGVVVTWYTNLEPSRVHSLKDLIVAFVRQCQYNGSG

SEQ ID NO: 183380 - protein, 231 aa, Glycine max
  Coding DNA Sequence Number=SeqID_66602
  Gene Ontology: Mol. function=nucleic acid binding; Cellular component= integral to membrane; Biological process=protein amino acid autophosphorylation
  Homolog annotation: Hit_ID=Q9FNZ2; Match level="QueryCoverage=98%, HitCoverage=53%, E-value=1e-75, Identity=59%"; Hit description=Zfwd1 protein
  Pfam annotation: Domain name=WD40; Domain location=105-141; Score =34.7; E_value=3.1e-07; Accession=PF00400.22; Description=WD domain, G-beta repeat
  Pfam annotation: Domain name=WD40; Domain location=145-181; Score =31.9; E_value=2.3e-06; Accession=PF00400.22; Description=WD domain, G-beta repeat
  Pfam annotation: Domain name=WD40; Domain location=188-228; Score =9.6; E_value=2.8; Accession=PF00400.22; Description=WD domain, G -beta repeat
  Pfam annotation: Domain name=WD40; Domain location=60-96; Score=10.7; E_value=2.1; Accession=PF00400.22; Description=WD domain, G-beta repeat
  Pfam module annotation: Pfam domain module=WD40::WD40::WD40::WD40; Domain location=105-141::145-181::188-228::60-96
VGSDKLYSGSTEGTVRIWDCHTGQCAKVINLGAEVTSLISEGSWIFVGLQNAVKAWNIQTMSEFTLDGPKGRVRAMTVGNNTLFAGGEDGVIFAWRGSSKADSPFELVASLTGHTKAVVCLVVGCKMLYSGSMDQSIKVWDMDTLQCTMTLNDHTDVVTSLICWDQYLLSSSSDRTIKVWACIEAGSLEVIYTHTEENGVVSLFGMPDAEGKPILFSSCRDNSVHMYELPS

SEQ ID NO: 183381 - protein, 138 aa, Glycine max
  Coding DNA Sequence Number=SeqID_66603
MPISPAEVSVGLCRPDIGRDRVRKTPSGPEKVQQSPGVSSSGYGPLSVLQGAHTPPARSCHPDIGIAPAGHPVDLKKSNRVLGFPALITGLCQFYGVPVAPTRSLGPALTGLSSRSTVPPDGRRARHHSSIGMAGSGQ

SEQ ID NO: 183382 - protein, 155 aa, Glycine max
  Coding DNA Sequence Number=SeqID_66604
MQSLQELAQQRPIMSVDQFIEKVAWPGARPSFVGDNESFTAQAPQQHELEPENDHSFEAIILGAVDFSKRRLETRSNEAANLGPEPVSTDVPFPRVDPSSPQDAADSSTPVLEIPEGQTIPVLALDTSPPATPVLHQTYKEDIQTQDIQDQSQEF

SEQ ID NO: 183383 - protein, 187 aa, Glycine max
  Coding DNA Sequence Number=SeqID_66605
  Gene Ontology: Mol. function=RNA-directed DNA polymerase activity; Cellular component=nucleus; Biological process=RNA-dependent DNA replication
MSPIVVTTLTRVLVKNLVTIIEGTIGHILNITPKEEKKDSKPQEVNISLPYFHGKYNVEAYLDREMKVEQLFPCHHISEERKVPLATLCFHGYALCWWTSLVMEQRIYGDPPIEYWNDLMSALRKRHISSYYERKHMDKFQRLRQGSMSVEEYRQQMELLLLRAGLREEERTSIVFVIVGKCTNSHK

SEQ ID NO: 183384 - protein, 79 aa, Glycine max
  Coding DNA Sequence Number=SeqID_66606
MTKDNSRDLKALHWSNERHCAWDSRRPRGRSKFLTRQRTEEDLLRELVDATPSPRPKENYKQLGLDLKRADNFIKSYLT

SEQ ID NO: 183385 - protein, 138 aa, Glycine max
  Coding DNA Sequence Number=SeqID_66607
  Homolog annotation: Hit_ID=Q9AVH2; Match level="QueryCoverage=27%, HitCoverage=13%, E-value=6e-13, Identity=92%"; Hit description =Putative senescence-associated protein
MGRRGLVVRPPGHTPRFVGDLEGRDESKRQGLNLSGSWQQGHSATYNTPVAYLSRLQRILPAARWELRFKASRRANPPHEGHQRHVPLGGRGPLLLVGKRTAGARVASSPDSDLEAFSHNPTHGSFAPLAFQASAMTH

SEQ ID NO: 183386 - protein, 104 aa, Glycine max
  Coding DNA Sequence Number=SeqID_66608
MGPTKAKLNIHVNVEHPNVDRGHVQDENNMENQHSKQRNVADENNMEPEDVEQGHVANEKNIMECKTNLNIHTNENNVRQLPVVFYLAPELIMANEFEQTGFVS

SEQ ID NO: 183387 - protein, 104 aa, Glycine max
  Coding DNA Sequence Number=SeqID_66609
MMIVADETEMSDARESRSQSEARFEWREFLCALKSRLSVRSWVRFVESINVDFTGEGEAGENDVVLLTLDPRVVVGLRGFGHVVASCVFGRTLYLLFVANVASR

SEQ ID NO: 183388 - protein, 62 aa, Glycine max
  Coding DNA Sequence Number=SeqID_66610
MVPKYLFRSLGYYLFVWMRNLLASAPGRQALGPLTEKIDAIKDVSLIKDVSVFYAEGSSTKH

SEQ ID NO: 183389 - protein, 50 aa, Glycine max
  Coding DNA Sequence Number=SeqID_66611
MAPLWRRCHWKARTKGDAEVAEGVAGVGHVDDKLSVSEGGEEGAEADNGN

SEQ ID NO: 183390 - protein, 143 aa, Glycine max
  Coding DNA Sequence Number=SeqID_66612
MASTSGDATPPSPKTARLMAEMTKLGDRMRRMSYENEERLGKMRKENKESLRRIHKSSEALSMGVMKKMRDEGGMRGIRREEIIEDMKVGKQRKRLRAQIEESKKATIARFLHGLNREIQDIVELHHYVPLEDLIHLAIKVEQ

SEQ ID NO: 183391 - protein, 68 aa, Glycine max
  Coding DNA Sequence Number=SeqID_66613
MKLKAEEGTKTKLQLEAENGKCIHVNSNTKLKRKTLKLHALSLEIPEHTTMPILGKELWRQQEEQLMQ

SEQ ID NO: 183392 - protein, 169 aa, Glycine max
  Coding DNA Sequence Number=SeqID_66614
MCHLTAYVCVYYDGQICNTNEGTTFVSNNTKTFMVDKVITFTQLLELVHQKLNIDPEHHIQHLHFRCPIFESGQRYMYTSFILRDDADVRQMFNIFYNNPSLPFVELFAIICHNNDPPGDQHGSTSNLEDLGEYETCWLRHHDSDTDSSSGPEGSNLSPSHKPIFKRNW

SEQ ID NO: 183393 - protein, 110 aa, Glycine max
  Coding DNA Sequence Number=SeqID_66615
  Pfam annotation: Domain name=zf-CCHC; Domain location=38-55; Score =14.6; E_value=0.0039; Accession=PF00098.13; Description=Zinc knuckle
MMVSDFVKRFNKFLRNKRNKRKSNINPKKKGGDSSLAPKCNECDQLEHLRFDCPVLKRRMEKSDKTNFKEKKEKKVYITWEDNDLDSSSDLENEIINLGLMAKDYESGEE

SEQ ID NO: 183394 - protein, 127 aa, Glycine max
  Coding DNA Sequence Number=SeqID_66616
MTVKLCELERYREWLQKGSGLLGNMLNLLAGVPLKSPKHANGGAMKFEEQRFDITIFRNHPDAILKTEGVNGCPLELPCKITCMRQHLQSPNDIGSCSHTQVISTDNIIVLESESPGRLNLSDYGGQ

SEQ ID NO: 183395 - protein, 118 aa, Glycine max
  Coding DNA Sequence Number=SeqID_66617
  Homolog annotation: Hit_ID=Q1STK9; Match level="QueryCoverage=68%, HitCoverage=57%, E-value=3e-08, Identity=35%"; Hit description =Gonadotropin, beta chain; Peptidase aspartic, active site
MKEFESVPFLISNGYREIVTLELEDDGRANLATINHRVVANLNTQQSCRLGGEIQKTNYLGLNKIMGTSAINQHCQTSMVNEAVNAESLGGCESGKGILANVRDKSGWGGGVRGRLFK

SEQ ID NO: 183396 - protein, 413 aa, Glycine max
  Coding DNA Sequence Number=SeqID_66618
  Homolog annotation: Hit_ID=Q01402; Match level="QueryCoverage=32%, HitCoverage=58%, E-value=6e-46, Identity=70%"; Hit description =Nucleoside diphosphate kinase 2, chloroplast precursor (EC 2.7.4.6) (Nucleoside ...
  Homolog annotation: Hit description=diphosphate kinase II) (NDK II) (NDP kinase II) (NDPK II) [Contains: Nucleoside diphosphate kinase 2 high-molecular-weight; Nucleoside diphosphate kinase 2 low-molecular -weight]
  Pfam annotation: Domain name=GRAS; Domain location=1-218; Score= -120.3; E_value=0.0092; Accession=PF03514.5; Description=GRAS family transcription factor
  Pfam annotation: Domain name=NDK; Domain location=204-332; Score =259.2; E_value=8.2e-75; Accession=PF00334.9; Description=Nucleoside diphosphate kinase
  Pfam module annotation: Pfam domain module=GRAS::NDK; Domain location= 1-218::204-332
MVDSEPQYSILKMVNSGLAGGMVGHYKSDQMLGIALGTEILHIIGSCCIPFGPPLLDDVAILAVAGLGNCAIANIWLQGIKSGCMCSRAAGECVRHLWITGVGLCERLQTIGEELSIYAKNLGINLEFSVVEKNLENLKPEDIKVREKEVLVVNSILQLHCMVKESGGALNLVLQMIHGLGILVVLIRSFLSQPQTEMEAEQVDQTYIMVKPDGVQRGLVGEIISRFEKKGFKLTGLKLFECSKELVEEHYKDLKQKLFFPKLIDYITSGPVMCMGVGVVASARKLIGATYPLQAEPGTIRGDLAVQTRRNVVHGSDNPENGKHEIGAAPEVGADNLCEVLMIDDKDNSFSTPSFRIRYARQDVILAIMISFYVSYGRYEVTNIFANDYFYPQGKSSAVILNFELFHTPTLEM

SEQ ID NO: 183397 - protein, 423 aa, Glycine max
  Coding DNA Sequence Number=SeqID_66619
MTNSRERHDVVRQVSPPRVARGQPPELVSRVGGPEPPFEYLEPTQRQNNSRGTTPGTSGVFILGRGKAGFKGMKEAYPGGNLAILGQPLKPGQCRALHGEGSNNKSFGFRGNMILEELIDFESPSRGIRTIKTRNFELHAREDGCCVRGMRISRRRRRYTSSEQTYSTTYKVSSGQFLPETISSSEGIRSFSYNSLFPYLLRIAKSHWLPLSQRFRYFIITTAELPQLCRSFRSKVFYDPGPSVPQNRCNSGSLVNFQALRSYARDARKGYNLFGRGRPGDEEFKKTWAKEMDEDNNTLWTGSEDESDEDTGPKTDLDKEIRKARLEAKKHADLIDADDSHELRSVWSGSDEEKTLWTGDEMDSDDDIPTEAYPSESSDQYIDNCLSLMKCPNTEPSQMLKAEQEPEELHQESKLGRLLLRML

SEQ ID NO: 183398 - protein, 149 aa, Glycine max
  Coding DNA Sequence Number=SeqID_66620
MEKSKVDTLIAVAPNTWREMHQKQVTYNRLLVGWRKGYSSILTLSLSSPLHSDDAPPFPNLHISFVSSPNQVPQSPNFIFFIPLLIPPIEIFKNFVKWMNQRKRERALPPPLPLLAIVATDHLKHPQHRFLLPCHPHDHLFYFLQMINV

SEQ ID NO: 183399 - protein, 507 aa, Glycine max
  Coding DNA Sequence Number=SeqID_66621
  Gene Ontology: Mol. function=RNA-directed DNA polymerase activity; Cellular component=chromatin; Biological process=chromatin assembly or disassembly
  Pfam annotation: Domain name=Chromo; Domain location=399-447; Score =20.4; E_value=0.0039; Accession=PF00385.14; Description='chromo' (CHRromatin Organisation MOdifier
MPFTYYPSEPINIRPYRYPYFQKQEIEVQGYHQILMKEEDVSKMGFHTHHGHYEFCVMLFGLCNAPSSFQATMSSIFGSYLRKFIIVFFDDILIYSKSFAEHLDHLAKDFELLLAGRFFLKFYNMASNLFPPKLKQFKRGQSLDLCGHYADIWFLSPLYQGICIHRGPFDASLVQGSILPFVVETDASGVGIGAILTQQNHPIAFFNKPFCSKLLHSSTYVQELTAITVAVKKWRQYLLGHPFTILTDHRNLKELMSQVIQTPEQQVYLACLLGYDYSIHTGLGNPIPLLMPYHRSFIHQRPSSWGKFLVWAEWSYNTSVHLAIGLTPYEVTVGKKPPSIPQYLVEASNIDVVDDFLINHDKVFDEIGCWLNCALAVKCPSSDQPTLNWQNPKDNDLVVAPLVILNTKWVTSDNGPEFMVLVQWKGLLPKDTSWEPWAKLKEDYHLENKVLSDGHRDVMNQPTQAHITEIGKLQLDKEGTSTAQRIKRKTTRPQYLKDFVTNSDPGH

SEQ ID NO: 183400 - protein, 1338 aa, Glycine max
  Coding DNA Sequence Number=SeqID_66622
  Gene Ontology: Mol. function=DNA binding; Cellular component=beta -galactosidase complex; Biological process=DNA integration
  Homolog annotation: Hit_ID=Q8LNP3; Match level="QueryCoverage=28%, HitCoverage=87%, E-value=1e-137, Identity=60%"; Hit description =Growth regulator-related protein
  Pfam annotation: Domain name=DUF246; Domain location=927-1271; Score =424.5; E_value=1.5e-124; Accession=PF03138.5; Description=Plant protein family
  Pfam annotation: Domain name=zf-CCHC; Domain location=651-668; Score =12.7; E_value=0.0078; Accession=PF00098.13; Description=Zinc knuckle
  Pfam annotation: Domain name=zf-CCHC; Domain location=687-704; Score =12.8; E_value=0.0078; Accession=PF00098.13; Description=Zinc knuckle
  Pfam module annotation: Pfam domain module=DUF246::RVT_2::Retrotrans _gag::zf-CCHC::zf-CCHC; Domain location=927-1271::7-207::482-597::651- 668::687-704
MYGSCVSSVNEITFWKLYRDRADGSIERYKARLVAKGYTQMKGLDYLDTFSPVAKLTTVRVLLALAAQNQWHLRQLDVNNAFLHGELEEEVYMQVPPGLAVENPKLQSNSDQSLFLKLTKSVTTILLVYVDDIILTGNSILEIQDITTLLDQEFKIKDLGDLKFFLGLEIARTTDGIHLCQRKYALDILFDSGMLGCKPHSTPMDYSMKLQMNSGNSLSDESSSSYRRLIGKLIYLTNTRPDIAYAVQQLSQYMSTPTNIHLQAAFRILRYLKGSPRSGLFFAATGTPQLRAFSDSDWAGCKDSRKSTTGFLVYLGSSLISWQSKKQSTVSRSSSEAEYRALASTACELQWLTYILQDIGVAFIQPATLYCDNQSAIQIATNPVFHERTKHIEIDCHIIRHKVTAGLVKLLSVSSSMQLADIFTKALPPATFQHLYSTNYDSWSRSMVTALSAKNKVEFIDGSAPEPLKTDRTYGAWRRCNNMVVSWIVHSVATSIRQSILWMDKAEEIWRDLKSRYSQGDLLRISDLQQEASTMKQGSFSVTEYFTRLRVIWDEIENFRPDSVCLCNIRCSCTAFTIIAQRKLEDRAMQFLRGLNEQYTNVRSHVLVMDPIPAISKIFSYVAQQERQLLGHAGPNINFEPKDISINATRTTCDFCGRIGHVESACYKKHEVPASYDGRNKNNNGRKTCTHCGKIGHTVDVCYRKHGYPPGYKLYSGRTTVNNVMIMEDKATNDQAQQHESQEVVHFSPEQYKALLALIQQPPTGSTAQSKQVASVSSCTVNTPLNPGLCVLILCDPHQLEFAGLQPKNQVNLSKSSAVAASSLGWSAVPEAGEAGEEFVGEPAAGGRHYGAAEPPVLLPAAAGVHLGAADIFHNLWHDIEGDNSSATELASVWKYKRKLREQKPCPNLTALHREHFVSPGLNGFLIVEANGGLNQQRSAICNAVAVAGLLNAILVIPQLEFHNVWKDPSEFGDIYDEDHFISTLDGYVKVVKELPEALMERHNYNMTNITNIRVQAWAPVSYYLGVVSPILQKEGVIRIAPFANRLAMSVPPHIQFLRCLTNYKALRFSSSISVLGKKLVYRMIEKSSRTDGKYIAVHLRFEEVLILIQLCWNWYLVSIYETVVKGYRIESALSNDGLNLLNMAKFKRKDRIILPDLNRVNGKCPLTPLEVGMMLRGMGFDNNTSIYLASGKIYHAERYLAPLIKMFPNLYTKESLATSDELAPFMGGNFPHFLMGHRRFIYDGHAKTIIPDKRKLVVLLDDVSISWRAFKDQMEDMLTESDRKGIMSSDLYRYQFHSMVLQLLILRPFEVAFLFGKFLASNLKVGHTAPTCSIKGI

SEQ ID NO: 183401 - protein, 72 aa, Glycine max
  Coding DNA Sequence Number=SeqID_66623
MISARWELWWSLLERSLAEWTGDNKSVVKKECGKYWEWREYELSRLSDMVKKQGLDITPHILIVCPSIVRKT

SEQ ID NO: 183402 - protein, 216 aa, Glycine max
  Coding DNA Sequence Number=SeqID_66624
  Homolog annotation: Hit_ID=Q6EPQ1; Match level="QueryCoverage=40%, HitCoverage=29%, E-value=1e-24, Identity=60%"; Hit description=DTDP -D-glucose 4,6-dehydratase-like
MLLSKMVHVVIEAYFCTSGRINDKHAKQSVGLVGFGPKMLNPTTKSLRVSRFWAHRVAVESSGLRQTLARKLISTSRYPSSLSQTLSLTITPKASLLQQFFFFFSAFSFSPFLSLTVTPKAASATAASNSIRNADFGKSEGSDDVGLDGLDFVGLAPVDIGATHDAGSIEDVGGLKLGYVSFEGGPVLEATRAVLGPAEGAEVAAKTARVAIDEKV

SEQ ID NO: 183403 - protein, 83 aa, Glycine max
  Coding DNA Sequence Number=SeqID_66625
MRPDRNWMLQRKDHFGLVTQEFRNGIDGFIQVATRDPRIAYASEHIPCTCAKCRNHYREKSFWVEKHLNDHECGWLNKLNPSW

SEQ ID NO: 183404 - protein, 94 aa, Glycine max
  Coding DNA Sequence Number=SeqID_66626
MANILFGRPGSDGQMKIVVTNGSNYFFFESFSHTRYLLTNTQWSIWNHQHLRYPADDTNNIPMDEAPTLYLTCHTHLVPLTTRLRSFLDHLLLH

SEQ ID NO: 183405 - protein, 79 aa, Glycine max
  Coding DNA Sequence Number=SeqID_66627
MEIGQCTPSTICMIVPVSEMPTPINREPKTFIKGFVSSRGKSTVGSPVPRAEAHPGVSKVATRCHMATFNYHIITGSAI

SEQ ID NO: 183406 - protein, 150 aa, Glycine max
  Coding DNA Sequence Number=SeqID_66628
MRKKIVDPSFVSDESHTGLVEDTPSNSPNHVILISAPLPLPTVRPPRLRGRYSRSSTWINGDNERVEQWLEVVSWELRAFVYHNFLVVKGRGINFKMLCILCLFTLIQGRVPETSRIAPYYVVEDMMKMGKDAGWSFFLELDLAFSVVNN

SEQ ID NO: 183407 - protein, 101 aa, Glycine max
  Coding DNA Sequence Number=SeqID_66629
METNGQLIVATATAGAFLALSAPCRRRPCFDPFMDWPRERRAASSTISFASPAGGGNGDAGTDDGCGSGSESGDANLKLVGDVAQELFRLSPDVIILDVSM

SEQ ID NO: 183408 - protein, 117 aa, Glycine max
  Coding DNA Sequence Number=SeqID_66630
PTKVLSFLHRSLIRGRPLLQLQSYAAVSFLRRPLLQPQSLGNKIPHHTVSPNATKKRKSHKESHIKDTDAFPFGTVTSRNPIFFSRLQAEVTQRLTSAKESSSKPALQSHEDLAKKL

SEQ ID NO: 183409 - protein, 58 aa, Glycine max
  Coding DNA Sequence Number=SeqID_66631
MKFQWISIGGSERGVKKRKIGLYGTCFGEDLSKIRRSNKPSGNRLQDVVIDYRLPVLV

SEQ ID NO: 183410 - protein, 238 aa, Glycine max
  Coding DNA Sequence Number=SeqID_66632
DALTQRQALGGAGRVQRARFGVQHGQDSPLLVVDFRHLRPRLRHALEQVPGRLGIARRQDLAGAADGARSQPSQLAFGFLLGALVGRAMGQHHLVGVDGLAEPAAVERDPREMQLRAERRGLVGGGLLQVPHGGLLVAQRVGRAAAHCMQFRELDAGVQRDVGQVDHFLVVARHQRRPHAQAHGALEGALRAHAGQGVGVEQAVRADALGGIAQAAFFQRLRALFRPGRGLRAQPGRN

SEQ ID NO: 183411 - protein, 42 aa, Glycine max
  Coding DNA Sequence Number=SeqID_66633
MMKKNYLCGVLKIDGNVFLKHGSELRLIPRDRVGAYEMFRDI

SEQ ID NO: 183412 - protein, 124 aa, Glycine max
  Coding DNA Sequence Number=SeqID_66634
  Gene Ontology: Mol. function=transferase activity; Cellular component= intracellular; Biological process=translation
  Homolog annotation: Hit_ID=Q69RP1; Match level="QueryCoverage=75%, HitCoverage=36%, E-value=1e-17, Identity=43%"; Hit description =Ribosomal protein-like
MDPNINFDTLWDQIKDKELEDNTNEEVIRLILQSQQALDNHDEYFQMGVDATRRKGLSSLQKCIVAFCIFAYGSFVDSVDEYIRIVETIVVECLQRFVSSICAIFGDEYLGRPNNENTGRLQQM

SEQ ID NO: 183413 - protein, 64 aa, Glycine max
  Coding DNA Sequence Number=SeqID_66635
MEVHWQGRCNNDGGAMTREVQRKWRCDGDEVGSAWRNGKARFAPTMKKLVDTVSSPTKQSLEML

SEQ ID NO: 183414 - protein, 557 aa, Glycine max
  Coding DNA Sequence Number=SeqID_66636
  Gene Ontology: Mol. function=protein serine/threonine kinase activity; Cellular component=intracellular; Biological process =protein amino acid phosphorylation
  Homolog annotation: Hit_ID=Q019E0; Match level="QueryCoverage=36%, HitCoverage=19%, E-value=6e-43, Identity=49%"; Hit description=[T] KOG0578 p21-activated serine/threonine protein kinase
  Pfam annotation: Domain name=Pkinase; Domain location=339-557; Score =29.7; E_value=2.5e-10; Accession=PF00069.15; Description=Protein kinase domain
  Pfam annotation: Domain name=Pkinase_Tyr; Domain location=339-557; Score=-168.8; E_value=0.041; Accession=PF07714.7; Description =Protein tyrosine kinase
  Pfam module annotation: Pfam domain module=Pkinase::Pkinase_Tyr; Domain location=339-557::339-557
ATQSHNVRPKRATVALRNAANKFEEETPSISDTGEGCKNESSLQVKSLSVGAHKKVQFLTEINNATAQPQGLSVVKATELENISSHMGSLALTDEASIGFNQHVKHQNTQQAESETSLVYEGGKSSPLPKRTIVTQDHLQQFKNFLRQPATQSSVVGLPCPTTTSVHSTSAPMLNSITHCSNSCIDSGSHVAAEPYGNLNVNPHPITQGDVKSPNNSLKDTNRISIDQVASAVQDCNSLIDAELTLKQSDPSKEQQGCMLKDTSISKCTSCRDDMLSKGEVSAAVTNIQPQVPTSSSEVKLESSKLEKQEKNTSSKASSGLRKRAYDPELFFKVNGKLYQRLGKIGSGGSSEVHKVISSDCTIYALKRIKLKGRDYATAYGFCQEIEYLNRLKGKNNIIQLIDYEVTDKALFEGVINGSFSNKDGRVKDDGYIYMVLEYGEIDLAHMLSQKWKELDGSNQTIDENWLRFYWQQILQAVNTIHEERIVHSDLKPANFLLVKGSLKLIDFGIAKAIMSDTTNIQRDSQVLHTSIHSYQSQVAVCSRKQDGCCFKYCNTI

SEQ ID NO: 183415 - protein, 161 aa, Glycine max
  Coding DNA Sequence Number=SeqID_66637
MKADMEVMKEQMTIMMEAMMSMRKMMEVNTATVVTASTTTEVDPTHLSGLNQVNRSVSDIVGQGGEALGNTGSPHVVQVQSKHSFPPYGLPPNFTPPNVAHSPDENVDNFAPIPIESQQTQFGHAQVSQPMRKTHEVPWDHTLADFKLHLGYATEEQAFGG

SEQ ID NO: 183416 - protein, 151 aa, Glycine max
  Coding DNA Sequence Number=SeqID_66638
MMRRHEDGGGFTGSNIIFALIHKKRVVVYKRERERDEIPRITEKEKEKERDGKVQEWENGDGVRFQIENKSTTILSKVSLSSLSIELELDCRKSLEFIKGGAKSAREKERDRQRCKPPPIHPPATDSDDKRIICPARRIRIVLLCLINQLP

SEQ ID NO: 183417 - protein, 355 aa, Glycine max
  Coding DNA Sequence Number=SeqID_66639
  Gene Ontology: Mol. function=DNA binding; Cellular component=nucleus; Biological process=regulation of transcription
  Homolog annotation: Hit_ID=Q6H666; Match level="QueryCoverage=95%, HitCoverage=96%, E-value=1e-97, Identity=56%"; Hit description =Putative OsNAC7 protein
  Pfam annotation: Domain name=NAM; Domain location=7-133; Score=288.9; E_value=9.6e-84; Accession=PF02365.6; Description=No apical meristem (NAM) protein
MNTFSHVPPGFRFHPTDEELVDYYLRKKVASKRIDLDIIKDVDLYKIEPWDLQGSDEENEWYFFSHKDKKYPTGTRTNRATKAGFWKATGRDKAIHSSPRHFLIGMRKTLVFYKGRAPNGQKSDWIMHEYRLETNQNGTTQEEGWVVCRVFKKRMTTVRKMGEYESPCWYDDPAVSFMQELESPSRISNPYASYHQHYPFKKELELQFNIPHDAFLQLPQLESPKVPQSSTSLNCSQVIPYGYGSNNNGNALQSLSLTQEEHIKQHCQQQSLQFPYGSNDQAVDPATDWRVLDKFVASQLSHDQHFSKETSYSKVAEQIKLLANGCTKTEIGQEMASTSTLPPPVARLTCGNESL

SEQ ID NO: 183418 - protein, 187 aa, Glycine max
  Coding DNA Sequence Number=SeqID_66640
MAINVPVASIDDVPCIYLGMDGGGLPYVTSKGVNPGTKMGTFGDPVDNNEDSGKAIRWRCSKHVTFDKDKERNKVFPTAGILDNVSATVLLELDLYLMGGPTTFADHRHDRVELVKISGGPLYSRVECFAVISNRLIVKLVTRHIDLYGGATSKHRQLPSFFLTWSMGDEKGLWLGCIEPASSMVAT

SEQ ID NO: 183419 - protein, 135 aa, Glycine max
  Coding DNA Sequence Number=SeqID_66641
  Homolog annotation: Hit_ID=Q1SAV4; Match level="QueryCoverage=58%, HitCoverage=19%, E-value=2e-07, Identity=38%"; Hit description =Integrase, catalytic region
MAMKIVTDIHHQDVQLTIGDWVYAKLCPYRQTSLALEYTKLSKRDHPQVFWITFPPPHELGQLSYHRTTLNVGLEVGYFILVTNQTHLGSMVGLVPRRHHVGEWEQLRESYNLEDKVVFPDEGNDNNSNITISTS

SEQ ID NO: 183420 - protein, 459 aa, Glycine max
  Coding DNA Sequence Number=SeqID_66642
  Gene Ontology: Mol. function=transferase activity, transferring glycosyl groups; Cellular component=cytoplasm; Biological process =metabolic process
  Homolog annotation: Hit_ID=Q8S997; Match level="QueryCoverage=94%, HitCoverage=94%, E-value=2e-87, Identity=40%"; Hit description =Glucosyltransferase-12
  Pfam annotation: Domain name=UDPGT; Domain location=14-457; Score= -52.1; E_value=5.4e-08; Accession=PF00201.9; Description=UDP -glucoronosyl and UDP-glucosyl transferase
MEEHSSAAPHILALTFPAEGHIKPMFNLTKLLSQKGHRITFVNTRHNHNRLLQFTDLPSFHTQFPNFNFATVNDGVPDGHPPNDFSVMVSPASRSKVALEFRELLSSLVEKRCLWGPPSCMIVDGMMSTIAMDAAEEFGIPVLTFRTYSATCTWVTIHISKVIREEAVDMQDPEDIDKVLSSIPGLENLLRDRDLPSVFRLKPGSNGLEFYIKETLAMTRASGLILNTFDQLEAPIITMLSTIFPKVYTIGPLHTLIKTQITNNSSSSLHLRKEDKICITWLNHQKEKSVLYVSFGTVVKLSHEQLLEFWHGLVNSMKPFLWVMRRDLINREGIMENINVPIELELGTKERGLLVDWAPQEEVLAHPSVGGFLTHCGWNSILECIVEGVPMLCWPLMADQTVNNRCVSEQWGIGIDIDGTYDRLVIENMVKNVLENQIEGLKRSVDEIAKKARDSIKET

SEQ ID NO: 183421 - protein, 130 aa, Glycine max
  Coding DNA Sequence Number=SeqID_66643
MDAQPLVVGLPNRQLEACVRCPQGDEHFAHTLPECTQGESHPRRTINTQDDLSLSHMHRPTGQTTHWHPFVDRIMEANIPLGWKSLNLEQYDGITDLDEHLDAFLTQVNLYTNGDVILCRVFPMSLKGKH

SEQ ID NO: 183422 - protein, 99 aa, Glycine max
  Coding DNA Sequence Number=SeqID_66644
  Homolog annotation: Hit_ID=Q1T1E6; Match level="QueryCoverage=93%, HitCoverage=17%, E-value=1e-07, Identity=54%"; Hit description=Zinc finger, CCHC-type; Peptidase aspartic, catalytic
MDYFLQLQEMRYGAKCHQPNLHNKRYGDIDPKMIAVESNIYYSSEIPENSLSCMLILVGVYVLRDLVHMECYIWACEGKVLRGADKLAVGNGITGRDII

SEQ ID NO: 183423 - protein, 305 aa, Glycine max
  Coding DNA Sequence Number=SeqID_66645
  Gene Ontology: Mol. function=transferase activity, transferring glycosyl groups; Cellular component=integral to membrane; Biological process=metabolic process
  Homolog annotation: Hit_ID=Q8S997; Match level="QueryCoverage=96%, HitCoverage=64%, E-value=1e-76, Identity=49%"; Hit description =Glucosyltransferase-12
MDKVLRSIPGLENLLRECDLPSILKLKPGSLYIDFYIKETLTMTQASGLIVNTFDQLEASIITKLTTIFPKVYTIGPLHTLTKTQFITNNSSSSLHLRKEDKSCITWLDQQKARSVLYVSFGTLAKVSHEQLVEIWHGLVGSLKPFLWVIRQGLIIGEGGLGHNVPMELELKTKERGLMVNWAPQEEVLAHPSVGGFFTHSGWNSTLECITEGVPMLCWPLIADQTVNSRCVSEQWGIGLDMNGICDRLIVEKMVKNLMENQIERLTSSTNEIAEKAHDSVNENGSSFHNIENLIKDIGTMKVRK

SEQ ID NO: 183424 - protein, 115 aa, Glycine max
  Coding DNA Sequence Number=SeqID_66646
  Gene Ontology: Cellular component=membrane
  Homolog annotation: Hit_ID=Q10A36; Match level="QueryCoverage=99%, HitCoverage=32%, E-value=2e-26, Identity=46%"; Hit description =Integral membrane protein DUF6 containing protein, expressed
MGAVLCVGGALTTSLYKGKEFYIGQSSHQTHSTVEASKTNMLRGTLFLLGSCLSYTAWFIVQVKLLEIFPFKYWGTMLTCIIASIQATIVGICLDGRKVTWSLKWNLQLVTIITS

SEQ ID NO: 183425 - protein, 343 aa, Glycine max
  Coding DNA Sequence Number=SeqID_66647
  Subcellular localization annotation: CTP_CleavageSite=78; ConfidenceScore=5.07e-01
MTCGDKLWSFRKSFCHSDRVLFDGTQRLTSSSAPFVIQRRRADDMRKQIMVISHTFSPFRHSCVRWHPETNVVFYTLLSSRGGGPDDIQRQIMVISHTISPFRHSCVRWHAQTNVIFYTLLSSRGGGPDDIWRQIMVIPHTFSPFRHSHVRWHAETNVVFCTFLSSRGGGPDDMRRQIMVIPHIFLPFRHSHVRWHAETNVVFCAFCHPEAAGPMTCRDKLWSFRTPFRHSDTVVSDGTQRLTSSSTPFCHPEAAGPMTCGDKLWSFHTPFRHSDTVMSDGTQRLTSSSAPFCHPKAAGPMTCGDKLWSCCTSFCHSDTIVFDGTQRLTSSSAPFVIQRRRAR

SEQ ID NO: 183426 - protein, 153 aa, Glycine max
  Coding DNA Sequence Number=SeqID_66648
KATLDMDRIDVARLLVKKLQLRFKNVVVGGGAKEALERSSASGEDSLESVIGLEINSSNSDNGEVDNDSTKDELEGEKAQVANHDERRMTTIIEASEWCFKEKSHQVFQNISGQKECPVEKENIVINTQTPEKDQNDQVDKHVFLVEWGGTGS

SEQ ID NO: 183427 - protein, 65 aa, Glycine max
  Coding DNA Sequence Number=SeqID_66649
MESPTVATYPLMGGREKETVKALDLERSQMIYDTNDWFKFSFQEDKRLLMIGEGDEDAQNNKEDP

SEQ ID NO: 183428 - protein, 71 aa, Glycine max
  Coding DNA Sequence Number=SeqID_66650
MRVELETTNEVQDIAMIREETTKLRAVRSTIQRFNHESFNLVTSYGEFEVKSEKIPEWESLIPFGKAHLGS

SEQ ID NO: 183429 - protein, 49 aa, Glycine max; identical to SEQ ID NO: 119686
  Coding DNA Sequence Number=SeqID_66651
  Gene Ontology: Mol. function=serine-type endopeptidase inhibitor activity; Cellular component=extracellular region
  Homolog annotation: Hit_ID=P01063; Match level="QueryCoverage=72%, HitCoverage=43%, E-value=7e-17, Identity=100%"; Hit description =Bowman-Birk type proteinase inhibitor C-II precursor

SEQ ID NO: 183430 - protein, 104 aa, Glycine max
  Coding DNA Sequence Number=SeqID_66652
MQITGAIGGTANAGIQYLMNGEVNPTDVLIATYVGAFTANTGAWGTVGWNAAGGATSSYLNGDDPFKGGVISGAASGIGYGIEATGQGGSKTTNNLWKRTENEK

SEQ ID NO: 183431 - protein, 264 aa, Glycine max
  Coding DNA Sequence Number=SeqID_66653
  Gene Ontology: Mol. function=DNA binding; Cellular component=nucleus; Biological process=regulation of transcription, DNA-dependent
  Homolog annotation: Hit_ID=Q9SEC4; Match level="QueryCoverage=96%, HitCoverage=97%, E-value=3e-88, Identity=60%"; Hit description=Myb -related transcription factor
  Pfam annotation: Domain name=Myb_DNA-binding; Domain location=14-61; Score=46.2; E_value=1.1e-10; Accession=PF00249.21; Description=Myb -like DNA-binding domain
  Pfam annotation: Domain name=Myb_DNA-binding; Domain location=67-112; Score=45.3; E_value=2.1e-10; Accession=PF00249.21; Description=Myb -like DNA-binding domain
  Pfam module annotation: Pfam domain module=Myb_DNA-binding::Myb_DNA -binding; Domain location=14-61::67-112
MGRQPCCDKLGVKKGPWTAEEDKKLINFIFTNGQCCWRAVPKLAGLRRCGKSCRLRWTNYLRPDLKRGLLTQAEEQLVIDLHARLGNRWSKIAARLPGRTDNEIKNHWNTHIKKKLLKMGIDPLTHEPLNKQVSSKDSSSSEENLPQADNTHQVKESDRVLNSEENSSSSAAENSSGEESLLVESDVSLMNTMWLDETPLMDTLWDNTPKLENANSNMGLPIWEDNCAWLLDCQDFGIHDFGFNCFSEIESNVLQSIGMDRKGL

SEQ ID NO: 183432 - protein, 277 aa, Glycine max
  Coding DNA Sequence Number=SeqID_66654
  Homolog annotation: Hit_ID=Q01GV2; Match level="QueryCoverage=50%, HitCoverage=29%, E-value=1e-09, Identity=30%"; Hit description =Homology to unknown gene
MATLSFGIATTCLSAAADYRRRSNWKWSRPRIVKDPEGVLGPPQTGHLARFEFKRRLERDADAREAFQRQVREEKERRQSLRQSRPLPDTPQDLIEYFLDTEAQEIEFEIARMRPRLNEEFFAQLKFELGQLRFAVNKTQLMEDRQIELEALEKAILEGLEAYDKMQGELVKARASLTKILTSKDAKATLLEMVEKNEINRSLLALLDENIASAQKGNQVRNWKCVFLVVVEPETKQAAEYMEKLRGAVLRKTILKNWDVVVADFSTVISEVSNCTF

SEQ ID NO: 183433 - protein, 97 aa, Glycine max
  Coding DNA Sequence Number=SeqID_66655
MQKTTLRLKETYLNRSHHSIHASCIQLPPSATQCLIHYSDHMTILRRFEPPLQWNVIVLHNEIGDKYVVQPWYKFLQESDFSHGDEVSFYYRRDEKI

SEQ ID NO: 183434 - protein, 689 aa, Glycine max
  Coding DNA Sequence Number=SeqID_66656
  Gene Ontology: Mol. function=protein-tyrosine kinase activity; Cellular component=integral to membrane; Biological process=protein amino acid phosphorylation
  Homolog annotation: Hit_ID=O49654; Match level="QueryCoverage=96%, HitCoverage=97%, E-value=0.0, Identity=57%"; Hit description=Leucine rich repeat receptor kinase-like protein
  Pfam annotation: Domain name=LRRNT_2; Domain location=27-68; Score =37.3; E_value=5.4e-08; Accession=PF08263.3; Description=Leucine rich repeat N-terminal domain
  Pfam annotation: Domain name=LRR_1; Domain location=120-142; Score =7.8; E_value=9.9; Accession=PF00560.23; Description=Leucine Rich Repeat
  Pfam annotation: Domain name=LRR_1; Domain location=144-166; Score =12.7; E_value=1.2; Accession=PF00560.23; Description=Leucine Rich Repeat
  Pfam annotation: Domain name=LRR_1; Domain location=168-190; Score =12.9; E_value=1.1; Accession=PF00560.23; Description=Leucine Rich Repeat
  Pfam annotation: Domain name=LRR_1; Domain location=192-214; Score =12.4; E_value=1.4; Accession=PF00560.23; Description=Leucine Rich Repeat
  Pfam annotation: Domain name=LRR_1; Domain location=216-238; Score =16.8; E_value=0.076; Accession=PF00560.23; Description=Leucine Rich Repeat
  Pfam annotation: Domain name=LRR_1; Domain location=96-118; Score =13.7; E_value=0.7; Accession=PF00560.23; Description=Leucine Rich Repeat
  Pfam annotation: Domain name=Pkinase; Domain location=417-682; Score =3.8; E_value=8.6e-09; Accession=PF00069.15; Description=Protein kinase domain
  Pfam annotation: Domain name=Pkinase_Tyr; Domain location=422-682; Score=-9.6; E_value=7e-12; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=27 -68::120-142::144-166::168-190::192-214::216-238::96-118::417 -682::422-682
MKVHHSVQLLLSLFLLLAFHVPHMAVGTAELRALMELKSSLDPEGKILGSWISDGDPCSGFFEGVACNDHRKVANISLQGKGLSGWLSPALAELKCLSGLYLHYNNLSGEIPPHISNLTELLDLYLDVNTLSGTIPPEIANMASLQVLQLGDNQLVGTIPTQMSSLKQLSTLALQYNKLTGQIPLSLGNLEKLSRLNLSFNNFSGTVPATLAHIEHLEVLDIQNNSLSGIVPSALKRLGEGFQGANNPGLCGVGFSTLRACNKDQDLNVNHIDTSDGDQPKNSNSSKALPEPAYVQLHCGQTHCSKSRRFPQTVITAGVVIVTLTFICAGFLTFFRYRRQKQRISNTLSSSSEGKVSLDQPKEFYTKSPSALVNIDYYSGWDQLSNGQNADAGGLSNEYLNQFRFNVDEVESATHYFSEANLLNRSKFAAGYKGVLRDGSLVAIRSISVTCCKTEEAEFVKGLNLLTSLRHENLVRLRGFCCSRSRGECFLIYDFATMGNLSQYLDIEDGSSHVLEWSKRVSIIKGIANGIGYLHSNEESKPTIVHQNISVENVLLDYQFNPLIRDAGLPMLLADDVVFSALKVSAAMGYLAPEYITTGRFTEKSDIYAFGVIILQVLSGKTTIGSSIRTAVESFRFDDSVDTNLKGIYSKSEAATLSKLAIQCTNELPDERPTMVDVIQELSVLSAHL

SEQ ID NO: 183435 - protein, 91 aa, Glycine max
  Coding DNA Sequence Number=SeqID_66657
MEDEAGEASQRRRPPRNFAEERREEKSFFAEERKRNASERGKNRRSRWCHRCTLRCSLFDLPLTDTKKVKSLTMDEVSGSKSCGTLALSGG

SEQ ID NO: 183436 - protein, 203 aa, Glycine max
  Coding DNA Sequence Number=SeqID_66658
  Pfam annotation: Domain name=DUF1442; Domain location=1-203; Score =247.3; E_value=3.1e-71; Accession=PF07279.2; Description=Protein of unknown function (DUF1442)
MRKKAARKGVSGFPRIRSGGVYFGHGGGWNSQLIVETWSQGGVIATSVGLAVARSHTCGRHVCVVSDERARSEYVERMGEAGVTAEIVVGEPEDVMEGLVGVDFLVVDSRRKDFTRVLRLAKLSNKGAVLLCKNANSNSKGFIWRSLVAKGSSRRLVRSAFLPVGKGLDMAHVSASGGNNSSSGHRWIKHVDQHSGDVHLIRR

SEQ ID NO: 183437 - protein, 150 aa, Glycine max
  Coding DNA Sequence Number=SeqID_66659
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=93%, HitCoverage=75%, E-value=7e-17, Identity=34%"; Hit description =Transcription factor, MADS-box
  Pfam annotation: Domain name=SRF-TF; Domain location=17-66; Score =11.3; E_value=0.021; Accession=PF00319.9; Description=SRF-type transcription factor (DNA-binding and dimerisation domain)
MSSNLRIMKGRRKIEMKKMTNKSNLQVAFSKRRSGVFKKAMVHRYLIEVAPHVTQFMGVNLHEFNAQLTKFTTQLETEKKRASELKRLHKVVQTQWWRATPTNEMTILQLNEFKGALQQMKINTTRKSEMILIHNAINPTLFFANDNFLA

SEQ ID NO: 183438 - protein, 180 aa, Glycine max
  Coding DNA Sequence Number=SeqID_66660
MTNTDSGTPTPNFGVGMGLRDCNRNYVKAMTSIVSGTPTPNEVEACALHSTIIWIKRLGLSNVVIETDCKTPVDCFQADTKNSIDFHVAGIFFHQFQTLEHASLPFSISTSQRLVCHNFDGIYDPLLESLSNLKRFLGVTGNFKYNEIWAMLGELRNLWPVDLNYNQLIGGILARANQPL

SEQ ID NO: 183439 - protein, 401 aa, Glycine max
  Coding DNA Sequence Number=SeqID_66661
  Homolog annotation: Hit_ID=Q9SS44; Match level="QueryCoverage=45%, HitCoverage=60%, E-value=3e-76, Identity=78%"; Hit description =Transcription initiation factor IIB-2
  Pfam annotation: Domain name=DUF1723; Domain location=278-327; Score =38.8; E_value=1.8e-08; Accession=PF08330.1; Description=Protein of unknown function (DUF1723)
  Pfam annotation: Domain name=TFIIB; Domain location=127-195; Score =37.1; E_value=6e-08; Accession=PF00382.10; Description=Transcription factor TFIIB repeat
  Pfam annotation: Domain name=TFIIB; Domain location=25-97; Score =58.0; E_value=3.1e-14; Accession=PF00382.10; Description =Transcription factor TFIIB repeat
  Pfam module annotation: Pfam domain module=DUF1723::TFIIB::TFIIB; Domain location=278-327::127-195::25-97
MKEMTGESQNCVYLYPLHMIVVIRIKVIAQGGYCALSCVADRANEIYKRVEDQKSSRGRNQDALLAACLYIACRQEDKPRTVKEICSVANGATKKEIGRAKEYIVKQLGLENGNAVEMGTIHAGDFMRRFCSNLCMNNQAVKAAQEAVQKSEEFDIRRSPISIAAAVIYIITQLSDDKKPLKDISLATGVAEGTIRNSYKDLYPHVAATVVEDVKHMNHAADEVHDLPQEVVVDDKRFELKLSSHGRKIEKFGRLASEFESIVAVTELSPLIACSLDIGERGLIYAFVERWHKETSSFHLPIENVTITLDDVASLLHLPITGAFHSFEALHVDQVVDLLVDLLECWIYEHFLTVASSIATEDYHERKPHACRSKSRKALLVSTYRKRLDRLTSDVVCWIPY

SEQ ID NO: 183440 - protein, 58 aa, Glycine max
  Coding DNA Sequence Number=SeqID_66662
  Homolog annotation: Hit_ID=Q1SV97; Match level="QueryCoverage=89%, HitCoverage=34%, E-value=8e-08, Identity=49%"; Hit description =Ribonuclease H
MAIFKLCHTLREGNQCADLIAKLGANEDANFTVTHEVPHGMLNPLLGDEMETCFPRAV

SEQ ID NO: 183441 - protein, 731 aa, Glycine max
  Coding DNA Sequence Number=SeqID_66663
  Homolog annotation: Hit_ID=Q1RVB7; Match level="QueryCoverage=97%, HitCoverage=97%, E-value=0.0, Identity=71%"; Hit description=Zinc finger, BED-type predicted
MASTTPSADSASADEVTAKAVNKRYEGLVTVRTKAIKGKGAWYWPHLEPMLLHNTETGLPKAVKLRCSLCDAVFSASNPSRTASEHLKRGTCPNFNSAAKPISSVSPSSAVAAMALSPPSSPTNHNHRKRISSSYDAPSQQQQPNLVLSGGKDDLGALAMLEDSVKKLKSPKTSAGPTLTKSQVDSAFDYLADWVYESCGSVSFSALEHPKFRAFLNQVGLPTVSIREFTGSRLDAKFEEAKAYSEARIRDALFFQVASEGWKWKGKKYCEEKLVNMSVNLPNGTSLHRRTLFVTGSAPSNYAQEVMWETLTGICGNVVQQCVGIVADKFKNKALRNLENRNPWMVNLSCQYQGFNSLIKDFNKELPFFNTVTHNCLRLASFINFKSQVRSSFDMYQQQEYGHTWLLRMPLPSRQFEYFDTVYAMMEDVLSSVRALQLLLLNENFKMASIENPNAREVGDMIRDVGFWNDLEAVHSLVKLVKEMVKEIETERPLVGQCLPLWGELRARVKDWCSKFHVAEAAVEKVIEKRFKKNYHPAWAAAYILDPLYLVRDTSGKYLPPFNYLTPEQEKDVDKLITRLVSRDEAHIVLMELMKWRTQGLDPVYARAVQMKERDPVTGKMRLVNPQSSRLVWETYLTEFKSLGRVAVRLIFLHATSRGFKCNWSSWRWVCSQGNSRAALDRAHKLIFIAAHSKFERKDFSTDEEKNAELFSLANGEDDVLNEVFVETSSA

SEQ ID NO: 183442 - protein, 382 aa, Glycine max
  Coding DNA Sequence Number=SeqID_66664
  Gene Ontology: Mol. function=protein binding; Cellular component =mitochondrion; Biological process=vesicle docking during exocytosis
  Homolog annotation: Hit_ID=Q1RVB0; Match level="QueryCoverage=98%, HitCoverage=53%, E-value=0.0, Identity=84%"; Hit description=Sec1 -like protein
  Pfam annotation: Domain name=Sec1; Domain location=14-382; Score= -89.6; E_value=1.3e-07; Accession=PF00995.13; Description=Sec1 family
MLRSSKTGDSKSTWKVLIMDKLTVKIMSHSCKMTDITDEGVSLVEDIYKRRQPLPTMDAIYFIQPTRENVIMFLSDMSGRTPLYRKAFVFFSSAISKELVMDIKKDTKVLTRLGALREMNLEYFPIDSQGFITNNERALEELFGDEENNHKGVTCLNVMAKRIATVFASLREFPSVRFRAAKSLDATTMTTFRDLIPTKLAAGVWDCLMKYKKSIPNFPQTETCELLIVDRSIDQIAPVIHEWTYDAMCHDLLNMEGNKYVHEVPGKSGGPAERKEVLLEDHDPIWLELRHAHIAYASEQLHEKMTNFISKNKAAQIQHGSKWVNPATIGSARVERVIGGQIHFLRSSSEMSTRDIQKMVQALPQYSEQIDKLSLHVEVLTV

SEQ ID NO: 183443 - protein, 246 aa, Glycine max
  Coding DNA Sequence Number=SeqID_66665
  Homolog annotation: Hit_ID=Q6ETC2; Match level="QueryCoverage=57%, HitCoverage=54%, E-value=1e-25, Identity=44%"; Hit description =Pentatricopeptide (PPR) repeat-containing protein-like
  Subcellular localization annotation: CTP_CleavageSite=40; ConfidenceScore=5.34e-01
MSPRRSSPVVAARKNKAPHPSPSPRRRTQSKSRPIKILKRCSSAPLLSSHDNADADVDGHYSRRSGGGSFFRPKTFSDAFLSSPSPFSSPRIHTKQLYRKRYEKEAKVVVNVTVEGSPGPVRTMVKLGSSVEDTIKRVVDKYTEEGRSPQIDPNMASSFQLHHSYFSLQSLDKSQVIADVGSRSFYLRKNNDASSFRWGSAPEIFTRGSTPSIANPPLLIPSFIARKISKIVRRAHRLWNIVLCSQ

SEQ ID NO: 183444 - protein, 441 aa, Glycine max
  Coding DNA Sequence Number=SeqID_66666
  Gene Ontology: Mol. function=amino acid binding; Biological process =metabolic process
  Homolog annotation: Hit_ID=Q1RVD0; Match level="QueryCoverage=99%, HitCoverage=100%, E-value=0.0, Identity=78%"; Hit description=Amino acid-binding ACT
  Pfam annotation: Domain name=ACT; Domain location=114-186; Score =30.6; E_value=5.5e-06; Accession=PF01842.15; Description=ACT domain
  Pfam annotation: Domain name=ACT; Domain location=245-316; Score =21.1; E_value=0.0041; Accession=PF01842.15; Description=ACT domain
  Pfam annotation: Domain name=ACT; Domain location=323-386; Score =39.9; E_value=8.7e-09; Accession=PF01842.15; Description=ACT domain
  Pfam annotation: Domain name=ACT; Domain location=33-96; Score=19.4; E_value=0.012; Accession=PF01842.15; Description=ACT domain
  Pfam module annotation: Pfam domain module=ACT::ACT::ACT::ACT; Domain location=114-186::245-316::323-386::33-96
MEWPASTDEYEKLIIRMSTPRVVIDNSVCSSATLVKVDSARRHGILLDAVQVLTDLNLSIKKAYISADGKWFMDVFHVTDQNGNKIMDESVLKYIEQSLGNIHYGRTNRSNGLTALELTGSDRVGLLSEVFAVLADLQCDVADAKVWTHNGRIASLIYVKDCSSGSAIEDSQKINKIELRLRNVLKGDNDIRSAKMSVSMAVMHTERRLHQLMFVDRDYERTPILKLTSDNPLVTVQNWEGRGYSVVNVQCKDRTKLLFDIVCNLTDMEYVVFHATINTSGDRAYLEFYIRHKDGTPISSEPERQRVIQCLKAAVERRASEGVRLELCTEDRQGLLAEVMRTFRENGLNVTRAEISTIGNMATNIFYVTDAIGIPADSKIIESVRQKIGLSNLEVKELPLINHQEAEGEDQAVGIGGAVLLSIGSLLRRNLYHLGLIKSCS

SEQ ID NO: 183445 - protein, 502 aa, Glycine max
  Coding DNA Sequence Number=SeqID_66667
  Gene Ontology: Mol. function=deoxyribodipyrimidine photo-lyase activity; Biological process=DNA repair
  Homolog annotation: Hit_ID=Q9AVI6; Match level="QueryCoverage=97%, HitCoverage=98%, E-value=0.0, Identity=76%"; Hit description=CPD photolyase
  Pfam annotation: Domain name=DNA_photolyase; Domain location=29-203; Score=162.4; E_value=1.2e-45; Accession=PF00875.8; Description=DNA photolyase
  Pfam annotation: Domain name=FAD_binding_7; Domain location=237-472; Score=358.0; E_value=1.6e-104; Accession=PF03441.4; Description=FAD binding domain of DNA photolyase
  Pfam module annotation: Pfam domain module=DNA_photolyase::FAD _binding_7; Domain location=29-203::237-472
MASTASPMTVQAGRVRTLKEGSRGESGLGPVVYWMFRDQRVTDNWALIHAVAEANKANVPVAVVFNLFHTFLGAKSRHLGFMLRGLRQLCHRMQHSLQIPFFLFQGEAEETVPKFLRECGASLLVTDFSPLREVRRCKEEICKRVSDSVAVHEVDAHNVVPLWVASDKLEYSARTIRAKITKRLSDYLVDFPDIEVEPPAGKWVATENHSIDWDDLIADVLRRGAEVPEVDWCEPGEIAASEVLMGSKNGFLTKRLKGYSLDRNNPCHPNALSGLSPYLHFGQISAQRCALEARKRRNSHPQAIDAFLEELIVRRELADNYCFYQPHYDSLKGAWAWAQNTLTEHATDKREHIYTKEQLEKAQTADPLWNASQLEMVHYGKMHGFMRMYWAKKILEWTRGPEEALEISLYLNDKYELDGRDPNGYVGCMWSICGVHDQAVGWKERPIFGKIRYMNYAGCKRKFDVDKYIAYVNKLVRELKKRKAENLLSQKEKVVRSCDPED

SEQ ID NO: 183446 - protein, 91 aa, Glycine max
  Coding DNA Sequence Number=SeqID_66668
  Gene Ontology: Mol. function=drug transporter activity; Cellular component=membrane; Biological process=multidrug transport
  Homolog annotation: Hit_ID=Q84M81; Match level="QueryCoverage=70%, HitCoverage=13%, E-value=6e-13, Identity=56%"; Hit description =Putative MatE efflux family protein
MYANLGGFYFLALPLGVVSAFKLRLGLVGLFIGLLTGIVTCLTLLLVFIARLNWVEEAAQAQTLTGQEQGTMKKTWLNRVHKLKAGGRSYI

SEQ ID NO: 183447 - protein, 246 aa, Glycine max
  Coding DNA Sequence Number=SeqID_66669
  Gene Ontology: Mol. function=drug transporter activity; Cellular component=membrane; Biological process=multidrug transport
  Homolog annotation: Hit_ID=Q84M81; Match level="QueryCoverage=96%, HitCoverage=54%, E-value=7e-61, Identity=46%"; Hit description =Putative MatE efflux family protein
  Pfam annotation: Domain name=MatE; Domain location=19-155; Score =63.2; E_value=8.2e-16; Accession=PF01554.9; Description=MatE
MGFRSGFDELRVQRGIALPMVAMNLAWFAKTAITTAFLGRLGELSLAAHICGQAHGAKNFRLLHKTLLMTISLLLLVSLPITFLWLNVDKILILFGQQQDISTVARTYVSCLIPDLFVASLFCPLKAYLSSQTITLPTMFSSAVALAFHIPINIVLSRTMGLRGISMAVWITDLIVVVLLAIYVLILERKKESMWKEGGWWDQSIEDWIRLLKLCGSCCLNTCLEWWCYEILVLLTGHLTNAKQAV

SEQ ID NO: 183448 - protein, 56 aa, Glycine max
  Coding DNA Sequence Number=SeqID_66670
LFSLSGWTEVVRLAGWPFAQRICTTHPSSKFFLALSRGMICSADSSLSEKIGLARG

SEQ ID NO: 183449 - protein, 51 aa, Glycine max
  Coding DNA Sequence Number=SeqID_66671
MEVRVAFYREIVAFWLAEVGGGSKCWSNGSFDEVKTKKCSGLHATDTQVID

SEQ ID NO: 183450 - protein, 252 aa, Glycine max
  Coding DNA Sequence Number=SeqID_66672
MDVSALVSGLTCVLECQARSDMSDEGSLHVRCTCSTLAYVSLMEWAHTGDVVRGGRLISDHHYFEFLPSFSQNLFAFMLASCDSLSSSFIFNLQGIPSLTMSSFLSDGESSSSERLRVSHCAGGGISRPCGRAQPFAASPAREPVPITMILPPSISGGARDDVSKYKSFITFVASVVALQRQVKLASPEDSCKIVVQACLESHSPLDRIPMCYACALEHGHLPTPPHGPWLLEIEGTTLTTCRLKLEAWRKS

SEQ ID NO: 183451 - protein, 101 aa, Glycine max
  Coding DNA Sequence Number=SeqID_66673
AQAAEALKSKEKNFQEANSLATESQNAAEADQLVNDSKMLLMLTSCCLVEQPKVMLDSTKEEKAEDVKELASVIAKASDGCEDIVFNPNVFTEFKLAGSPE

SEQ ID NO: 183452 - protein, 70 aa, Glycine max
  Coding DNA Sequence Number=SeqID_66674
MCLSGKGSMLMKSSHITNEILDVSISFLNDHLEETPGSTKIEENHSKCINLTQSEANKSSTHKILVGNQR

SEQ ID NO: 183453 - protein, 154 aa, Glycine max
  Coding DNA Sequence Number=SeqID_66675
SEFLMGGYVGAKASLLSTAPLYVTMTQELVARGDTLRLSAPFCHPEAAGPMTSRDKIWSLCTLVSSRGGGPDDTRRYLTAAGPMIRGDTLRLSAPFCHPEAAGPMTSRDKIWSFCTLVSSRGGGPDDTRRYLMVIHTLLSSRGGGPDDKQRQNL

SEQ ID NO: 183454 - protein, 298 aa, Glycine max
  Coding DNA Sequence Number=SeqID_66676
  Gene Ontology: Mol. function=DNA binding; Cellular component =chromatin; Biological process=chromosome organization and biogenesis (sensu Eukaryota)
  Homolog annotation: Hit_ID=Q6EQU6; Match level="QueryCoverage=97%, HitCoverage=97%, E-value=4e-77, Identity=52%"; Hit description =Putative DNA-binding protein AT-hook 2
  Pfam annotation: Domain name=DUF296; Domain location=105-222; Score =207.9; E_value=2.3e-59; Accession=PF03479.5; Description=Domain of unknown function (DUF296)
MDPITAHGHSLPPPFHTARDLHLHHQQQQHQFHSLQEDEQSGSSGGLNLAAHKREREENNNSDGKEGGAGSAETEISRRPRGRPAGSKNKPKPPIIITRDSANALKTHVMEVADGCDIVESVSAFARRRQRGVCIMSGTGTVTNVTLRQPASSGAVVTLHGRFEILSLAGSFLPPPAPPEASGLTIYLAGGQGQVVGGSVVGALIASGPVVIMSASFSNAAYERLPLEDEEPSIGLQGGGSIGSPGGGGGVGQSQAPHQLMGDSTTAPLFHGLNPNLLNSVQMPSTETFWATGRSPYC

SEQ ID NO: 183455 - protein, 291 aa, Glycine max
  Coding DNA Sequence Number=SeqID_66677
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=98%, HitCoverage=31%, E-value=1e-127, Identity=82%"; Hit description =Kinesin-like protein
  Pfam annotation: Domain name=Arm; Domain location=105-146; Score =18.6; E_value=0.023; Accession=PF00514.13; Description=Armadillobeta- catenin-like repeat
  Pfam annotation: Domain name=Arm; Domain location=147-187; Score =18.6; E_value=0.022; Accession=PF00514.13; Description=Armadillobeta- catenin-like repeat
  Pfam annotation: Domain name=Arm; Domain location=197-237; Score =13.1; E_value=0.28; Accession=PF00514.13; Description=Armadillobeta -catenin-like repeat
  Pfam annotation: Domain name=Arm; Domain location=22-62; Score=12.7; E_value=0.32; Accession=PF00514.13; Description=Armadillobeta -catenin-like repeat
  Pfam annotation: Domain name=Arm; Domain location=63-104; Score=32.2; E_value=1.8e-06; Accession=PF00514.13; Description=Armadillobeta -catenin-like repeat
  Pfam annotation: Domain name=DUF634; Domain location=8-214; Score= -154.5; E_value=0.036; Accession=PF04826.4; Description=Protein of unknown function (DUF634)
  Pfam module annotation: Pfam domain module=Arm::Arm::Arm::Arm::Arm::DU F634; Domain location=105-146::147-187::197-237::22-62::63-104::8-214
MGGLNSLTSQVKHQQQASGNGEKPSIAKLFEQVGLQKILSLLEAEDADVRIHAVKVVANLAAEETNQGKIVEAGGLTSLLNLLKSSHDETIHRVAAGAIANLAMNETNQELIMAQGGISLLSMTAANAEDPQTLRMVAGAIANLCGNDKLQTKLRSEGGIKALLGMVRCRHPDVHAQVARGIANFAKCESRASSQGTKSGRSFLIEDGALPWIVQNANNEAASVRRHIELALCHLAQHEINARDMISGGALWELVRISRDCSREDIKTLAHRTLVSSPTFQAEMRRLRVNY

SEQ ID NO: 183456 - protein, 132 aa, Glycine max
  Coding DNA Sequence Number=SeqID_66678
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=87%, HitCoverage=13%, E-value=2e-19, Identity=48%"; Hit description =Kinesin-like protein
MESIKKLEEQLVMNQRKNEESHMKSSGEIPRVSAEELADLKKMLQKETHLRKAAEGEVNNLKNQVAELKKSEASGKSEILKLHNMLEDKEGQKEKLEGEIAILQSQLLQLNLQADEVGYIKSVQMPQFMDFI

SEQ ID NO: 183457 - protein, 389 aa, Glycine max
  Coding DNA Sequence Number=SeqID_66679
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=82%, HitCoverage=34%, E-value=1e-137, Identity=78%"; Hit description =Kinesin-like protein
  Pfam annotation: Domain name=Kinesin; Domain location=54-369; Score =357.8; E_value=1.7e-104; Accession=PF00225.13; Description=Kinesin motor domain
  Subcellular localization annotation: CTP_CleavageSite=58; ConfidenceScore=5.71e-01
MATSQGGNSYRNARTSLKPHVKSKPSQQRRNSTGSVNGKEHAAAVPGRVRVAVRLRPRNAEESVADADFADCVELQPELKRLKLRKNNWDADTYEFDEVLTEFSSQKRVYEVVARPVVESVLDGYNGTIMAYGQTGTGKTYTLGRLGEEDNAARGIMVRAMEDILADVSLDTDSVSVSYLQLYMETIQDLLDPANDNITIVEDPKTGDVSLPGASLVDIRDKQSFVELLRLGEAHRFAANTKLNTESSRSHAILMVHVKRSVKGRDAALSSENGNHSHVVKSIKPPLVRKGKLVVVDLAGSERIDKSGSEGHTLEEAKSINLSLSALGKCINALAENSAHVPFRDSKLTRLLRDSFGAVRFSIMAWYVADADRYSKNFTSHYYWAISTA

SEQ ID NO: 183458 - protein, 58 aa, Glycine max
  Coding DNA Sequence Number=SeqID_66680
MWVSKSLRRKHMREQKILRGVRACGDNDPQLGVREDNEEANVVLCREYSDKIFVLMTN

SEQ ID NO: 183459 - protein, 62 aa, Glycine max
  Coding DNA Sequence Number=SeqID_66681
MIAIIPAKSLQLLQSSPQTKGLRKRYKKNNTNRYCFKGTSRMGVELIHIDQIEKRIENWKKD

SEQ ID NO: 183460 - protein, 407 aa, Glycine max
  Coding DNA Sequence Number=SeqID_66682
  Gene Ontology: Mol. function=bile acid:sodium symporter activity; Cellular component=membrane; Biological process=sodium ion transport
  Homolog annotation: Hit_ID=Q9SZ68; Match level="QueryCoverage=76%, HitCoverage=79%, E-value=4e-93, Identity=56%"; Hit description =Putative transport protein
  Pfam annotation: Domain name=SBF; Domain location=46-231; Score =168.7; E_value=1.5e-47; Accession=PF01758.7; Description=Sodium Bile acid symporter family
MEQNSMSILEILKQSNSYLPHALIASILLALIYPRSLTWFTSRFYAPALGFLMFAVGVNSNENDFLEAFKRPAEIVTGYFGQFAVKPLLGYLFCMIAVTVLGLPTTVGAGIVLVACVSGAQLSSYATFLTDPQMAPLSIVMTSLSTASAVFVTPLLLLLLIGKKLPIDVKGMVYNITQIVVVPIAAGLLLNRFFPRICNVIRPFLPPLSVLVASICAGAPLALNVETMKSPLGVAILLLVVAFHLSSFIAGYILSGFVFRDSLDVKALQRTISFETGMQSSLLALALANKFFEDPKVAIPPAISLCKWCSSGYSFLSGSPDKVRETDHEKLPCEKSRDKEEPVHSQNGSKEHPDRTGNRLNRPIRSGFENLDFECDPERRTCTGGVEYNIYYCMTRLPREVGGRSAV

SEQ ID NO: 183461 - protein, 62 aa, Glycine max
  Coding DNA Sequence Number=SeqID_66683
MGMCGHGCRTQLICGHTQLFSFATRIRVRSALRSENGLDVDVDLRNVTARALRRKARRIYML

SEQ ID NO: 183462 - protein, 758 aa, Glycine max
  Coding DNA Sequence Number=SeqID_66684
  Gene Ontology: Mol. function=identical protein binding; Cellular component=cytoplasm; Biological process=negative regulation of enzyme activity
  Homolog annotation: Hit_ID=O65836; Match level="QueryCoverage=94%, HitCoverage=96%, E-value=0.0, Identity=55%"; Hit description=P69F protein
  Pfam annotation: Domain name=PA; Domain location=368-467; Score=94.6; E_value=2.9e-25; Accession=PF02225.12; Description=PA domain
  Pfam annotation: Domain name=Peptidase_S8; Domain location=130-600; Score=72.6; E_value=1.3e-18; Accession=PF00082.12; Description =Subtilase family
  Pfam annotation: Domain name=Subtilisin_N; Domain location=43-127; Score=57.8; E_value=3.5e-14; Accession=PF05922.7; Description =Subtilisin N-terminal Region
  Pfam module annotation: Pfam domain module=PA::Peptidase _S8::Subtilisin_N; Domain location=368-467::130-600::43-127
MELALPLALALIFVLISIYPTSAHQNTEFVNAKEELDVPSSLLTYIVRVKKPQSQGDDSLQYKDLHSWYHSLLPASTKTDQNQQRITFSYRNVVDGFAVKLNPEEAKALQEKEEVVSARPERTFSLHTTHTPSFLGLQQGLGLWTNSNFGKGIIIGILDTGITPDHLSFNDEGMPLPPAKWSGHCEFTGEKTCNNKLIGARNFVKNPNSTLPLDDVGHGTHTASTAAGRFVQGASVFGNAKGTAVGMAPDAHLAIYKVCDLFGCSESAILAGMDTAIQDGVDILSLSLGGPPAPFFDDPIALGAFSAIQKGIFVSCSAANAGPFYSSLSNEAPWILTVGASTIDRRIVAAAKLGNGEAFNGESVFQPNNFTSTLLPLVYAGANGNDSSTFCAPGSLQSMDVKGKVVLCEIGGFVRRVDKGQEVKSAGGAAMILMNSPIEDFNPFADVHVLPATHVSYKAGLAIKNYINSTSTPTATILFQGTVIGNPHAPAVTSFSSRGPSLESPGILKPDIIGPGQNILAAWPLSLDNNLPPFNIISGTSMSCPHLSGIAALLKNSHPDWSPAAIKSAIMTSANTVNLGGKPILEQRLLPADVFATGAGHVNPLKANDPGLVYDLQPTDYIPYLCGLNYTDKEVGFILNQKVKCLEVKSIAEAQLNYPSFSIRLGSSSQFYTRTLTNVGPANITYSVEVDAPSAVSISISPAEIAFTEVKQKVSYSVGFYPEGKNNRRKHPFAQGSIKWVSSNGKYSVSIPIAVIFL

SEQ ID NO: 183463 - protein, 67 aa, Glycine max
  Coding DNA Sequence Number=SeqID_66685
MLNEHTCTTPIEEDLAKQQHGPSQTTETHANIHRREDEEAMPQPLMTTGNTNDVHQTNNKNIHKQQE

SEQ ID NO: 183464 - protein, 501 aa, Glycine max
  Coding DNA Sequence Number=SeqID_66686
  Gene Ontology: Mol. function=transferase activity, transferring nitrogenous groups; Cellular component=cytoplasm; Biological process= ethylene biosynthetic process
  Homolog annotation: Hit_ID=Q6U5H3; Match level="QueryCoverage=92%, HitCoverage=98%, E-value=1e-166, Identity=62%"; Hit description=1 -aminocyclopropane-1-carboxylate synthase
  Pfam annotation: Domain name=Aminotran_1_2; Domain location=112-490; Score=255.9; E_value=8.1e-74; Accession=PF00155.11; Description =Aminotransferase class I and II
MRVIVPLQGVVQGTGGLFWGSVIPCALFYFLQLYFKTKTPHHPPPSQNNHKDDDSTTFHRSLSSNHRHSTTTASAYVSPRANSITAANSPYFLGLHKLADDPYHETHNPDGVIQLSLHQSTLSLDLIQDWIHHNGSTAVFGTPLGISRIVPYQPLHGLMELKVAVAGFMSQVLENLIFFNTSRMVLTAGATSAIEILSFCLADHGNAFLVPTPLSPGFDGVVKWRTGVEIVPVPCRSTDDFNLSITSIERTFNQAKMRGQKVRGIIINNPSNPAGKLLDRETLLDLLDFAREKNIHIISNEMFASSSYGNEEFVSMAEIMEAEDHDRDRVHVVFGLSNELSVPGLKVGVIYSYNDNVVAASSKLARFSTVSAPTQRLLISMLSDTSFVQNFIEVNRLRLRKMYNTFVAGLKQLGIECTRSSGGFCCWADMSRLIRSYSEKGELELWDRLLNVAKINVTPGSSCHCIEPGWFRFCFATSTEKAVSVVMERLRRIVEATNGHS

SEQ ID NO: 183465 - protein, 67 aa, Glycine max
  Coding DNA Sequence Number=SeqID_66687
MENMLGRGILIETLANASHQNHTLSTPQIALNVVGFCISGATIIFFTAYAKRQLKELQQKEDGLLLQ

SEQ ID NO: 183466 - protein, 884 aa, Glycine max
  Coding DNA Sequence Number=SeqID_66688
  Gene Ontology: Mol. function=protein kinase activity; Cellular component=integral to membrane; Biological process=protein amino acid phosphorylation
  Homolog annotation: Hit_ID=Q8L4U4; Match level="QueryCoverage=96%, HitCoverage=95%, E-value=0.0, Identity=44%"; Hit description =Putative receptor-like protein kinase
  Pfam annotation: Domain name=LRRNT_2; Domain location=26-67; Score =37.2; E_value=5.7e-08; Accession=PF08263.3; Description=Leucine rich repeat N-terminal domain
  Pfam annotation: Domain name=LRR_1; Domain location=119-141; Score =10.9; E_value=2.6; Accession=PF00560.23; Description=Leucine Rich Repeat
  Pfam annotation: Domain name=LRR_1; Domain location=143-166; Score =14.5; E_value=0.39; Accession=PF00560.23; Description=Leucine Rich Repeat
  Pfam annotation: Domain name=LRR_1; Domain location=168-190; Score =11.7; E_value=1.8; Accession=PF00560.23; Description=Leucine Rich Repeat
  Pfam annotation: Domain name=LRR_1; Domain location=192-214; Score =5.7; E_value=24; Accession=PF00560.23; Description=Leucine Rich Repeat
  Pfam annotation: Domain name=LRR_1; Domain location=216-238; Score =6.1; E_value=21; Accession=PF00560.23; Description=Leucine Rich Repeat
  Pfam annotation: Domain name=LRR_1; Domain location=240-260; Score =12.2; E_value=1.5; Accession=PF00560.23; Description=Leucine Rich Repeat
  Pfam annotation: Domain name=LRR_1; Domain location=264-285; Score =13.9; E_value=0.59; Accession=PF00560.23; Description=Leucine Rich Repeat
  Pfam annotation: Domain name=LRR_1; Domain location=288-310; Score =8.6; E_value=7; Accession=PF00560.23; Description=Leucine Rich Repeat
  Pfam annotation: Domain name=LRR_1; Domain location=312-334; Score =5.5; E_value=26; Accession=PF00560.23; Description=Leucine Rich Repeat
  Pfam annotation: Domain name=LRR_1; Domain location=336-358; Score =8.0; E_value=9.2; Accession=PF00560.23; Description=Leucine Rich Repeat
  Pfam annotation: Domain name=LRR_1; Domain location=360-382; Score =9.1; E_value=5.6; Accession=PF00560.23; Description=Leucine Rich Repeat
  Pfam annotation: Domain name=LRR_1; Domain location=384-406; Score =11.0; E_value=2.5; Accession=PF00560.23; Description=Leucine Rich Repeat
  Pfam annotation: Domain name=LRR_1; Domain location=408-430; Score =21.5; E_value=0.0029; Accession=PF00560.23; Description=Leucine Rich Repeat
  Pfam annotation: Domain name=LRR_1; Domain location=432-454; Score =17.7; E_value=0.042; Accession=PF00560.23; Description=Leucine Rich Repeat
  Pfam annotation: Domain name=LRR_1; Domain location=456-477; Score =12.7; E_value=1.2; Accession=PF00560.23; Description=Leucine Rich Repeat
  Pfam annotation: Domain name=LRR_1; Domain location=71-93; Score=1.6; E_value=1.4e+02; Accession=PF00560.23; Description=Leucine Rich Repeat
  Pfam annotation: Domain name=LRR_1; Domain location=95-117; Score =12.1; E_value=1.5; Accession=PF00560.23; Description=Leucine Rich Repeat
  Pfam annotation: Domain name=Pkinase; Domain location=596-874; Score =74.7; E_value=2.9e-19; Accession=PF00069.15; Description=Protein kinase domain
  Pfam annotation: Domain name=Pkinase_Tyr; Domain location=596-874; Score=45.2; E_value=3.1e-15; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::Pkinase::Pkinase_Tyr; Domain location =26-67::...
  Pfam module annotation: Domain location=119-141::143-166::168 -190::192-214::216-238::240-260::264-285::288-310::312-334::336 -358::360-382::384-406::408-430::432-454::456-477::71-93::95-117::596- 874::596-874
MRRHREIHLSHALLCTVFCLLVAASAATEKEILLEFKGNITEDPRASLSSWVSSGNLCHDYKGVSCNSEGFVERIVLWNTSLGGVLSSSLSGLKRLRILTLFGNRFSGSIPEAYGDLHSLWKINLSSNALSGSIPDFIGDLPSIRFLDLSKNDFTGEIPSALFRYCYKTKFVSLSHNNLAGSIPASLVNCSNLEGFDFSLNNLSGAVPSRLCDIPRLSYVSLRSNALSGSVQELISTCQSLVHLDFGSNRFTDFAPFRVLQMQNLTYLNLSYNGFGGHIPEISACSGRLEIFDASGNSLDGEIPSSITKCKSLKLLALEMNRLEGIIPVDIQELRGLIVIKLGNNSIGGMIPRGFGNVELLELLDLHNLNLVGQIPDDISNCKFLLGLDVSGNKLEGEIPQTLYNLTNLESLNLHHNQLNGSIPPSLGNLSRIQYLDLSHNSLSGPILPSLGNLNNLTHFDLSFNNLSGRIPDVATIQHFGASSFSNNPFLCGPPLDTPCNGARSSSAPGKAKVLSTSVIVAIVAAAVILTGVCLVTIMNMRARGRRRKDDDQIMIVESTPLGSTESNVIIGKLVLFSKSLPSKYEDWEAGTKALLDKESLIGGGSIGTVYRTDFEGGISIAVKKLETLGRIRNQEEFEHEIGRLGNLQHPHLVAFQGYYWSSSMQLILSEFVPNGNLYDNLHGFGFPGTSTSRGNRELYWSRRFQIAVGTARALAYLHHDCRPPILHLNIKSSNILLDDNYEAKLSDYGLGKLLPILDNYGLTKFHNAVGYVAPELAQGLRQSEKCDVYSFGVILLELVTGRRPVESPTTNEVVVLCEYVTGLLETGSASDCFDRNLLGFAENELIQVMRLGLICTSEDPLRRPSMAEVVQVLESIRNGLESH

SEQ ID NO: 183467 - protein, 367 aa, Glycine max
  Coding DNA Sequence Number=SeqID_66689
  Gene Ontology: Mol. function=DNA binding; Cellular component=nucleus; Biological process=regulation of transcription, DNA-dependent
  Homolog annotation: Hit_ID=Q653U4; Match level="QueryCoverage=46%, HitCoverage=25%, E-value=1e-29, Identity=43%"; Hit description=Zinc finger (C3HC4-type RING finger) protein-like
  Pfam annotation: Domain name=YTH; Domain location=127-221; Score =182.8; E_value=8.2e-52; Accession=PF04146.6; Description=YT521-B -like family
MSSDSAKENASVVDSSVTEWRNDIGNSDDPDDHDFSNDSGARNRSSGYKFKENINPTRADKGGHSHGQIGHPAGIGVEKCHNTKYFVIKSLNHQNIHLSIEKGIWATQIMNEPILQEAYHNSGSVILIFSVNMSGSFQGYAQMMTSIGRGRDNAWSEGTGKSNPWGRSFKVKWLCLNDLPFHKTLHLKNPLNDYKPVKISRDCQELSPDIGLALCKLLDGKNDTDGLLTSLSRDEFSLKGHYVSTPSSMGDEDCNFPPLHMLISGTMFTEILPTTSESSQVSGIKRSKDVASQSDFWGLSSESPLASTLTEDDFLDMEQLSWEDPSFIFAMDITAPPMSEHVNFLSAKFCTCVVVSSSARRPLSCYV

SEQ ID NO: 183468 - protein, 331 aa, Glycine max
  Coding DNA Sequence Number=SeqID_66690
MNSSTSSGIECQAAKRQKLEGGSLHKVADVKQQVNFVHKAPKKKFRPYCFPDTALLLWVEIYQIMSKERVATVDQNSGHSKLKITIPREPDLETAHRAQRIRPKPAAEAEVVTVAVPRFKARPLNRKILNAPSFPLPKRSTPRLPEFLEFHLRTQERAMQHTSATSSSSLHCNDFDKDLDKHTAVSAQENRIRDLRRPSALGAPKHDGLDFAHCFKARPLNKKILSSKGDIAVFLNRKQETTVPMEFNFHTEKRVQHNPPSELFSKMSLTSEVQSNNGSQLKLPRHSRVFREETPFVFGGRQIHSGREGCDGDAGAWEFDDDDTDKGQYAT

SEQ ID NO: 183469 - protein, 748 aa, Glycine max
  Coding DNA Sequence Number=SeqID_66691
  Gene Ontology: Mol. function=identical protein binding; Cellular component=cytoplasm; Biological process=negative regulation of enzyme activity
  Homolog annotation: Hit_ID=O04678; Match level="QueryCoverage=98%, HitCoverage=99%, E-value=0.0, Identity=53%"; Hit description =Subtilisin-like protease
  Pfam annotation: Domain name=PA; Domain location=358-457; Score=81.8; E_value=2.2e-21; Accession=PF02225.12; Description=PA domain
  Pfam annotation: Domain name=Peptidase_S8; Domain location=119-575; Score=44.3; E_value=4.1e-10; Accession=PF00082.12; Description =Subtilase family
  Pfam annotation: Domain name=Subtilisin_N; Domain location=38-116; Score=60.8; E_value=4.4e-15; Accession=PF05922.7; Description =Subtilisin N-terminal Region
  Pfam module annotation: Pfam domain module=PA::Peptidase _S8::Subtilisin_N; Domain location=358-457::119-575::38-116
MDKSKYVMELAFLLGLIFMLSANPTSMAEEHDINNNLQTYIVHVKKPETISFLQSEELHNWYYSFLPQTTHKNRMVFSYRNVASGFAVKLTPEEAKVLQEKDEIVSARPERTLSLHTTHTPSFLGLRQGVGLWNSSNLGEGVIIGVIDTGIYPFHPSFNDEGIPPPPAKWNGHCEFTGQRTCNNKLIGARNLLKNAIEEPPFENFFHGTHTAAEAAGRFVENASVFGMAQGTASGIAPNSHVAMYKVCNDEVGCTESAILAAMDIAIDDGVDVLSLSLGLGSLPFFEDPIAIGAFVAIQSGVFVSCSAANSGPDYSTLSNEAPWILTVGASTIDRKIAASAVLGNGAEYEGESLFQPQDFSPSLLPLVYSGANGNNNSEFCLPGSLNNVDVKGKVVVCDIGGGFPSVGKGQEVLKAGGAAMILANPEPLGFSTFAVAYVLPTVEVSYFAGLAIKSYINSSYSPTATISFKGTVIGDELAPTVVSFSSRGPSQASPGILKPDIIGPGVNILAAWAVSVDNKIPAYNVVSGTSMSCPHLSGVAALLKSAHPDWSPAAIKSAIMTTAYTVNLGGTPIVDQRNLPADIFATGAGHVNPNKANDPGLVYDIQPEDYVPYLCGLGYEDREIEILVQRRVRCSGGKAIPEAQLNYPSFSILMGSSSQYYTRTLTNVGPAQSTYTVQLDVPLALGISVNPSQITFTEVNQKVTFSVEFIPEIKENRGNHTFAQGSLTWVRVSDKHAVRIPISVIFK

SEQ ID NO: 183470 - protein, 366 aa, Glycine max
  Coding DNA Sequence Number=SeqID_66692
  Gene Ontology: Mol. function=oxidoreductase activity; Cellular component=cytoplasm; Biological process=flavonoid biosynthetic process
  Homolog annotation: Hit_ID=Q2TUW0; Match level="QueryCoverage=94%, HitCoverage=98%, E-value=0.0, Identity=95%"; Hit description =Anthocyanidin synthase
  Pfam annotation: Domain name=2OG-FeII_Oxy; Domain location=222-321; Score=139.1; E_value=1.2e-38; Accession=PF03171.10; Description=2OG -Fe(II) oxygenase superfamily
AESCADHELNLQSTELEKLGTVESLASSGIKCIPKEYVRPEKELKSIGNVFEEEKKEGPEVPTIDLREIDSEDEVVRGKCRQKLKKAAEEWGVMNLVNHGIQDELIERVKKAGEEFFGLAVEEKEKYANDQESGKIQGYGSKLANNASGQLEWEDYFFHLVFPEDKRDLSIWPKKPDDYIEVTSEYAKRLRGLATKMLEALSIGLGLEGGRLEKEVGGMEELLLQLKINYYPICPQPELALGVEAHTDVSSLTFLLHNMVPGLQLFYQGQWFTAKCVPNSILMHIGDTIEILSNGKYKSILHRGLVNKEKVRISWAMFCEPPKEKIILQPLPELVTETEPARFPPRTFAQHIHHKLFRKDQEGLPN

SEQ ID NO: 183471 - protein, 736 aa, Glycine max
  Coding DNA Sequence Number=SeqID_66693
  Gene Ontology: Mol. function=transition metal ion binding; Biological process=DNA integration
  Subcellular localization annotation: CTP_CleavageSite=38; ConfidenceScore=5.05e-01
MDDSLDITPSQAESNSQSTKKRVRGPTCLKKLRLKRVRDQKISVEFDQSTGNAKGPNRREFNNYVAFLARSKVSILHEDWDHVEESEKNMIWQTIMHNYDVPNSKFLKKKLISYAGQRWRGFKTQLSSFYIYGKYKDKSPCDKYTFLKKDTWQRFVESRLDPAFQEKRKKAQEVQANNLYPHTLSCGGYQKLEENMMQEKAKKVQEASQLDHSLVIVEPPSPLKRHEKWKRARQKKSGDYINEESRIIAEKIDSLVEQSTQGSFLPLGREDILTVAIGQPEHPGRVRGAGRGVGIRQYFGPPSRNPLSMEDLEVITQKIQEQVTKQLSEQLEHKLKADLSQQFQQQVRQELASLGLLQQNTNIEPAPHSPIHVSTKGNDATPDPLVEDNHTNIRDQCELYVDVDPPRLVAIGKVYNLGSTIHHKTIEDDNVRVVVEEVRDAEARVPLPTDEVHTVGQAPNQFIQWPRRLVKSMSAKAVVESSKDAPHKRLEPQLDPLERLLIIVSKIRKDHVQLPWDPDVLSKPSTMPFYIYRRDIFRLCMGSEMPNISIMQLWLMYLHNLCTDKGNAHIYGFMDPQSIQSVGNNATEVQGYLQSRLHESKKQCYLAPYLHSDHWQLLIICPKQNVVVLLCSLHKKTINREMKTTVDLAMDEYQRLVGSQSRSRRKKPTWILPRCQTQTEGYECGYYVMKQMLTVVTVDIVDSWKKIFNSSGPFPEEDIADIQQRWAAFLLQISNL

SEQ ID NO: 183472 - protein, 234 aa, Glycine max
  Coding DNA Sequence Number=SeqID_66694
  Gene Ontology: Mol. function=enzyme activator activity; Cellular component=anaphase-promoting complex; Biological process=cell division
  Homolog annotation: Hit_ID=Q4TU48; Match level="QueryCoverage=74%, HitCoverage=37%, E-value=1e-42, Identity=54%"; Hit description=Cell cycle switch protein CCS52A
MRTKIEDRGVRVRVRVRVRVRNIIYSVGAIDRFSREKFIPSRSGSNFDFFNLPPSSSSEDSCSCSPYSTALRSALFGPDTPDKFESPNIFRYKTETRKSLYSLSPTPFTFQDDLLPGYDHNQKPPKRPRKIPPSSFKVLDAPALQDDFYLNLVDWSSNNVLAVALETSVYLWNASSSKVTKLCDLGIDNSVCSVGWAPLGTYLAVGSNSVSLPYLAVYYYSQRSKGMRFLHLRD

SEQ ID NO: 183473 - protein, 228 aa, Glycine max
  Coding DNA Sequence Number=SeqID_66695
  Gene Ontology: Mol. function=enzyme activator activity; Cellular component=anaphase-promoting complex; Biological process=cell division
  Homolog annotation: Hit_ID=Q4TU48; Match level="QueryCoverage=99%, HitCoverage=54%, E-value=1e-113, Identity=62%"; Hit description=Cell cycle switch protein CCS52A
  Pfam annotation: Domain name=WD40; Domain location=166-204; Score =39.8; E_value=9.3e-09; Accession=PF00400.22; Description=WD domain, G-beta repeat
  Pfam annotation: Domain name=WD40; Domain location=36-74; Score=35.2; E_value=2.3e-07; Accession=PF00400.22; Description=WD domain, G-beta repeat
  Pfam annotation: Domain name=WD40; Domain location=78-119; Score =21.9; E_value=0.0023; Accession=PF00400.22; Description=WD domain, G- beta repeat
  Pfam module annotation: Pfam domain module=WD40::WD40::WD40; Domain location=166-204::36-74::78-119
MEGHRLRVGALAWSSSLLSSGGRDKSIYQRDIRAQEDFISKLSGHKSEVCGLKWSCDNRELASGGNDNRLLVWNQKSTQPVLKFCEHTAAVKAIAWSPHVSGLLASGGGTADRNIRFWNTTTNTQLNCIDTGSQVCNLVWSKNVNELVSTHGYSQNQIIVWKYPTMSKLATLTGHTYRVLYLAISPDGQTIVSGAGDETLRFWDVFPLQKSRNTESEIGASFGRTIIR

SEQ ID NO: 183474 - protein, 163 aa, Glycine max
  Coding DNA Sequence Number=SeqID_66696
MGIGSGHGCPLLGQVKKIGYAILNKIVRTPSVDKDDDFVALDGTCNAQEHRDYGVRRNGFIWEGFVRRSDEKEEFVSTPVIRPATLIIVVTQALFAASGHFGHGEPFKGASRVPPPELGTRVVVPRPHGGCLIRHIGPIEARDVDLHLGGGRGEGTNRGSGFE

SEQ ID NO: 183475 - protein, 137 aa, Glycine max
  Coding DNA Sequence Number=SeqID_66697
  Homolog annotation: Hit_ID=Q5Z800; Match level="QueryCoverage=24%, HitCoverage=4%, E-value=4e-09, Identity=76%"; Hit description =Putative NF-E2 inducible protein
MAAASSSSPPKDEDREQEEQNQQPQPQPQPVKECVHKTKTIQFLGRTTPIVLQNDNGPCPLLAICNFISHPRAMNGGRSKFRRINMPWRASRHKLPMLEASKTPRDSVMTGTISVYNGYLSHIDGNTETVLIPNIWV

SEQ ID NO: 183476 - protein, 179 aa, Glycine max
  Coding DNA Sequence Number=SeqID_66698
  Gene Ontology: Mol. function=transcription factor activity; Biological process=regulation of transcription, DNA-dependent
  Homolog annotation: Hit_ID=Q39E26; Match level="QueryCoverage=77%, HitCoverage=59%, E-value=3e-39, Identity=61%"; Hit description =Transcriptional regulator, LysR family
MLSQIDQRYPALRFECLIAEYEDVVALVQQGRAHLGLMAAQEDYPPDMAHATLREASEIHLRAGRQGPRPIAIHLVGAGLPDVAGNGHAGIRLGGAAALDAAPFRARTTGGTGGAGLAAPDPGRRGVVDAPSAGAGRRLARDAHAVGEHPVAQLGAGQHVIFGAALARHGAAAPGILGR

SEQ ID NO: 183477 - protein, 38 aa, Glycine max
  Coding DNA Sequence Number=SeqID_66699
MAPSLYSDVLCLSSAGKGRRSGSRDPILHLRPFLSTYK

SEQ ID NO: 183478 - protein, 246 aa, Glycine max
  Coding DNA Sequence Number=SeqID_66700
  Homolog annotation: Hit_ID=Q69SU8; Match level="QueryCoverage=14%, HitCoverage=14%, E-value=9e-07, Identity=74%"; Hit description =Putative tetratricopeptide repeat (TPR)-containing protein
  Pfam annotation: Domain name=TPR_1; Domain location=15-48; Score =19.0; E_value=0.017; Accession=PF00515.18; Description =Tetratricopeptide repeat
  Pfam annotation: Domain name=TPR_2; Domain location=15-48; Score =18.4; E_value=0.025; Accession=PF07719.7; Description=Tetratricopepti de repeat
  Pfam module annotation: Pfam domain module=TPR_1::TPR_2; Domain location=15-48::15-48
MNVVNAIKELALQIQVAWVTLGRAQLNFGEPDNAIESFDRALALKPAVSPAKPPESPDEEVNDPLYLMTLTIPQLFLKSLQVMWDATIFGVFNQNFPLYIKHEDLSEIAHGGQCLSISVIQLWILGHWQMVVILPKENLVVWFCSLHNRPDNYLKEIINSALKGLDDTPQSKSKAAARWIVVKCNRQKGITECGYYVMHWMSTIILRSFRNNWETYFNEVRTLEVERFKALRIQWTHYYLKVRNQT

SEQ ID NO: 183479 - protein, 94 aa, Glycine max
  Coding DNA Sequence Number=SeqID_66701
MEDADISGESADDDSRPKDADISGEGADDNPEDTKIFGEGADYDCRNLPFGGRVTRDSRVRVPRKEYVRSLHQRLFQENVGKTGKDVIYELKVK

SEQ ID NO: 183480 - protein, 305 aa, Glycine max
  Coding DNA Sequence Number=SeqID_66702
  Gene Ontology: Mol. function=oxidoreductase activity; Cellular component=membrane; Biological process=electron transport
  Homolog annotation: Hit_ID=Q4IX21; Match level="QueryCoverage=100%, HitCoverage=64%, E-value=1e-116, Identity=64%"; Hit description =Cytochrome bd ubiquinol oxidase, subunit I
  Pfam annotation: Domain name=Bac_Ubq_Cox; Domain location=1-305; Score=294.3; E_value=2.4e-85; Accession=PF01654.8; Description =Bacterial Cytochrome Ubiquinol Oxidase
MLFGWNKVGPSLHFIATLMVAICTLVSATWILASNSWMQTPQGFELVNSKVIPVDWLKIIFNPSFPYRLVHMVIAAYLATALFVSAAAAWQLLRGKNNPAVRKMMSMGLWLILLIAPLQVVIGDMHGLNTLKHQPAKIAAIEAHWENKGNEPTPLVLLAWPDMQQEKNHFALEIPVLGSLILRHSLTEQIPALKEFAADERPNATIVFWTFRIMVGLGMLMILLAVTSLWLRYKNQLYQHKPFLRFAVAMGPAGVIAILAGWLTTEIGRQPWVVYGILRTADAVTPHATTEVAVTLALFVVIYLA

SEQ ID NO: 183481 - protein, 83 aa, Glycine max
  Coding DNA Sequence Number=SeqID_66703
  Subcellular localization annotation: CTP_CleavageSite=56; ConfidenceScore=5.03e-01
MGIAPTKTLNGPKEVQQALGFPALVTGLCRPYRAPVPPSKECLSPPVRASGPLLIELSSRSTASPGRRRAKHHSSIGMAGSGQ

SEQ ID NO: 183482 - protein, 46 aa, Glycine max
  Coding DNA Sequence Number=SeqID_66704
MQQFRKAHNNHGADLDGNDDLILAVVVSTTVVKYHSHCGVQSLQFL

SEQ ID NO: 183483 - protein, 269 aa, Glycine max
  Coding DNA Sequence Number=SeqID_66705
  Homolog annotation: Hit_ID=P0AB55; Match level="QueryCoverage=36%, HitCoverage=100%, E-value=1e-36, Identity=77%"; Hit description =Protein yciI
MRQRQRSDSPKAGGITRYQFRIFIIDPACGINGRLFVFQMRRQRRRRQDLHVDAGAVQQGEARVEFALGAAGAQLPIGGDVVHAMRLQKIQILCAPQVSVYVESHRSISGVRGDAAGSGEYRQATRRLLKGEHFFYRRVRVRARIDPGTARERAFPVLGGWRSEHLLERFHRHVGIDTGGDIGILLRPGLGLRQRLEFGDHRRTGKAGGAGIVAVDGRVRAGDHQATGVAQRLQARQVCWTHRQTIFQRVGDVLRVDQIKHVSPLKSWL

SEQ ID NO: 183484 - protein, 109 aa, Glycine max
  Coding DNA Sequence Number=SeqID_66706
MLCMFVGGKCIDLVGWLIRGGQAWLKNLRISEEMFQCFNWSMVIGTCLWPCSYVVCCVCPWGGSIDLVGRPLCGKLKWLKNLTISEGMLRSFNSSMENYKQLGLDPELA

SEQ ID NO: 183485 - protein, 140 aa, Glycine max
  Coding DNA Sequence Number=SeqID_66707
  Gene Ontology: Mol. function=transition metal ion binding; Cellular component=cytoplasm; Biological process=fucose metabolic process
MYDTLQTASKKPLYLGCKNSLTLLSAVLSLVNVKARYGWSDKSFSSLLEVVHNMLPEENTLPKNYYQAQKILCSMGIEYQKINACLNDCILYKHEFQEMYKCLRCEVSRYKVKDDDECSSDKNSKKRPQTKVLWYLPIIL

SEQ ID NO: 183486 - protein, 315 aa, Glycine max
  Coding DNA Sequence Number=SeqID_66708
  Gene Ontology: Mol. function=alcohol dehydrogenase activity; Cellular component=membrane; Biological process=electron transport
  Homolog annotation: Hit_ID=Q4J0Y1; Match level="QueryCoverage=97%, HitCoverage=71%, E-value=2e-78, Identity=45%"; Hit description =Cytochrome c, class I precursor
  Pfam annotation: Domain name=Cytochrom_C; Domain location=207-295; Score=37.9; E_value=3.4e-08; Accession=PF00034.11; Description =Cytochrome c
MTEGIGHGGKRLYGAMPFTAYTKMSDKDLQDLWAWMQTLQPIHNPVETNQLPFPFNIRTSLMVWNWINFDRGAFQPDARQSAQWNRGAYLVQGAGHCGTCHTPKNLLGGDKNGAFLRGEVVEGWMAPDITANPHSGLGKWSQQDIVSYLRTGVNRFDIASGPMADAVRHSTQHWRDEDLQAVAVYLKSGESRDEQAPAALAATDDRMKLGAQIYAAKCSACHSPGGRGEKNIFPQLADNPLLNQEDATSLIRVVAAGSRGVDTDARPTAPAMPAFAGTLGDQEIAAVVSYIRNSWGNAAAPVSADDVKKVKQKLE

SEQ ID NO: 183487 - protein, 37 aa, Glycine max
  Coding DNA Sequence Number=SeqID_66709
MSMQGALSATPPRSARVDRALSARVAGLAHASVRSRA

SEQ ID NO: 183488 - protein, 81 aa, Glycine max
  Coding DNA Sequence Number=SeqID_66710
MEEDLGGEGEALHTVSEGKCVNSNNQRQRITAKGTQNKTKMARESKLKTSVPMPLPFQTVSELATHINITTEILIVVRNFF

SEQ ID NO: 183489 - protein, 102 aa, Glycine max
  Coding DNA Sequence Number=SeqID_66711
  Subcellular localization annotation: CTP_CleavageSite=24; ConfidenceScore=5.10e-01
MSQPAPSPSTLKRTRKATQLRSLSAKPVGVERPLVHVDSTTRKADDEWPRKGERKRERRRHFKEKMSLEEAHHHRRPWIRAWRKKEMNEGRGREEHEILCSK

SEQ ID NO: 183490 - protein, 187 aa, Glycine max
  Coding DNA Sequence Number=SeqID_66712
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=8e-17, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSQSLAFSKGWTLGGLHTLTFRGLHALTFRGLHVLAFRGLHVLAIRGQNVLAFRGLHVLAIRGLHVLTIRGLHALAFRGLHVLTFRGLHTRPQRTTRPHLQRATCPRLQRATRPYLKRATRPYLQRATCKPSKDYASSPSEGYMPSPSEGYTPSPSEDYTSSPLEDYTSSPSEDYMSSPSGGYTPSP

SEQ ID NO: 183491 - protein, 46 aa, Glycine max
  Coding DNA Sequence Number=SeqID_66713
MYVCLGSENTLDMHFYGVLVIMRPAQEVKEALLGGNLVPFKSLLVI

SEQ ID NO: 183492 - protein, 254 aa, Glycine max
  Coding DNA Sequence Number=SeqID_66714
  Gene Ontology: Mol. function=nucleic acid binding; Cellular component= oxygen evolving complex; Biological process=DNA integration
MDLNNTWTITQFSPNKKPISCKWLFKLKLNSDGTVAKHKAKLSKYDYTLFTKGKSSSFIAILVYVDDIVIASPDKIAINFAKFMLQHYFKLKYLGDLKFFLGLELPRSQVGIFMCQRHYTMSILEDTRMLACKPSTVPMEADLKLNAESGSQLADPGTYRRLIGRLLYLTISRPDICYTVHKLSQFVFDPRSGHINAANILLRYLKHTAGQGILFKATLDTSLHAYVDADWGSCIDSRKSTTGYCICLGNSLIS

SEQ ID NO: 183493 - protein, 310 aa, Glycine max
  Coding DNA Sequence Number=SeqID_66715
  Gene Ontology: Mol. function=nucleic acid binding; Cellular component= beta-galactosidase complex; Biological process=DNA integration
MKVALSIKNKTTFIDDTLSKLEEKAPTYVAWTHANNVVISWLYNSVSKEIITNILFANTAKEIWDDLKTRFSRKNGPRIFQLKHQLMSLQQGTDDISTYYTKLKSIREELTSYKPTFPCTCEGLQQLQTHNESEYVMSFLMGLNDSFSQIRGQILISDPLPSIGNVFSLILQEKAQREIVVTHPPTNTLENIVFSVNSASKNQCDINKGKYIKKERPKCAHCDMLGHTKDKCYKLVGYPPNYFKNRTSNFVNQLNDTPESSTYAQAPTLTATQCQQLISFLTNHMKTENTIDVVATNVTGPQDFEEDWHC

SEQ ID NO: 183494 - protein, 61 aa, Glycine max
  Coding DNA Sequence Number=SeqID_66716
MVMVPNTPKSINNFSSPHLKRKRRSHKEEGDLVEEDKPDELLDKQLSEHIMAVSKYCLLTL

SEQ ID NO: 183495 - protein, 80 aa, Glycine max
  Coding DNA Sequence Number=SeqID_66717
  Gene Ontology: Cellular component=membrane
MEVKTKMSEVLPFILMVIMEGWTIGLTIFAKTGITKGMSPFVFIVYTNALATIILFPCSFLSHQEDRSLSSSFASPYDSS

SEQ ID NO: 183496 - protein, 176 aa, Glycine max
  Coding DNA Sequence Number=SeqID_66718
  Gene Ontology: Mol. function=nucleoside-triphosphatase activity; Cellular component=nucleus; Biological process=DNA replication initiation
  Homolog annotation: Hit_ID=Q1T2L5; Match level="QueryCoverage=86%, HitCoverage=27%, E-value=1e-64, Identity=83%"; Hit description=MCM
  Pfam annotation: Domain name=AAA_3; Domain location=57-176; Score= -12.7; E_value=0.0079; Accession=PF07726.2; Description=ATPase family associated with various
  Pfam annotation: Domain name=MCM; Domain location=3-176; Score=28.0; E_value=3.6e-19; Accession=PF00493.13; Description=MCM235 family
  Pfam module annotation: Pfam domain module=AAA_3::MCM; Domain location=57-176::3-176
MRGWDWLRRGSRRWVWWKEELWWGTIILTAGITLALFGGVRKHPMDQNNVPVRGDIHVIIVGNPGLGKSQLLQAAAAVSPRGIFVFGNATTKDGLTVAVVKDSMTSDYAFEAGAMVLADSGLCCIDELDKMSIEHQDLLKAMEQQRVSIAKAGLVASLSSRTFVLAAANPACGHYK

SEQ ID NO: 183497 - protein, 75 aa, Glycine max
  Coding DNA Sequence Number=SeqID_66719
MLSACSRSAKLHLRDATVDPKRRCFLRGVNLLRDLCLTRFNGGDVTCFAGIIGNLIVYLITWLMEAPLYFPLLQQ

SEQ ID NO: 183498 - protein, 64 aa, Glycine max
  Coding DNA Sequence Number=SeqID_66720
MISGLQRGRRNFKGSKKQHSMPNAHVRSELRYGSNSKGEVDKANRVSYIKSKSTKGKRFGKNGS

SEQ ID NO: 183499 - protein, 73 aa, Glycine max
  Coding DNA Sequence Number=SeqID_66721
KWVYDPNMVGSWYLTHATKNRKTQGSCMSKHENKRGIIPFEKHIAAVGTTSNNMLSKRKTLDEGSLLSSKSET

SEQ ID NO: 183500 - protein, 96 aa, Glycine max
  Coding DNA Sequence Number=SeqID_66722
  Subcellular localization annotation: CTP_CleavageSite=20; ConfidenceScore=5.01e-01
ACARRDTTAALGWPVAGNKRAATTSRAPQLIHKRVRVLPTTHGRPIGDQVQSQRTHLVAHDPMNLNKTSTSSEGNNLQNQVMAYLWFGIKMKHLPV

SEQ ID NO: 183501 - protein, 104 aa, Glycine max
  Coding DNA Sequence Number=SeqID_66723
  Gene Ontology: Mol. function=catalytic activity; Biological process =metabolic process
  Homolog annotation: Hit_ID=Q2QY22; Match level="QueryCoverage=93%, HitCoverage=39%, E-value=2e-20, Identity=53%"; Hit description =Phosphoglycerate mutase family protein
  Pfam annotation: Domain name=PGAM; Domain location=1-102; Score=25.5; E_value=2.3e-05; Accession=PF00300.12; Description=Phosphoglycerate mutase family
GQVDIELNETGRQQAVAVANRLSREPKISAIYSSDLQRAFETAQIIAVKCGGLEVVKDLDLRERHMGDLQGHPYRELATTNPIGYEALESKNDDRELPIKNTPN

SEQ ID NO: 183502 - protein, 99 aa, Glycine max
  Coding DNA Sequence Number=SeqID_66724
  Gene Ontology: Mol. function=catalytic activity; Biological process =metabolic process
  Homolog annotation: Hit_ID=Q9FYE8; Match level="QueryCoverage=95%, HitCoverage=39%, E-value=3e-16, Identity=51%"; Hit description =Phosphoglycerate mutase-like protein
GGGESFVQLFERCKSALLKIGRKHKGERVVVVTHGASIETLYRWANATGRYKGKIDNASIAVFRLYGEDKWTLNMKGDVSHLCHNGFLQPGFEGDTTTT

SEQ ID NO: 183503 - protein, 93 aa, Glycine max
  Coding DNA Sequence Number=SeqID_66725
MHNSNSKKWIDAMKDEMKFMQDNDVWHLVELPEGIKIQRYLMRILKLAKYRLKAQVEKDKVPEWRRMKAQVEKDEGPEAETLSRLLIVAEGPD

SEQ ID NO: 183504 - protein, 102 aa, Glycine max
  Coding DNA Sequence Number=SeqID_66726
MENNLFNGDAHEDPVQHLRKFNKLTHMIIEDMYSKPYNNSRDMRIMKRDINPVEKDDNQTELEKQMQALTLKIETLMRSQAQVPIITPSFPTWDRCGIMHGT

SEQ ID NO: 183505 - protein, 151 aa, Glycine max
  Coding DNA Sequence Number=SeqID_66727
MFSEKEGMMRILKLAKYRLKAQVEKDEGPRGEGQSPRTYQGNPCGVYLDLSSFTKSGVYLDLSSLTGSGVIQIFVACIKRSAPSQVHISILRFSQESYINKDLDIFNMKDSKLGDTAIAKEDKFNLKQCLNNDLERTVMQKIPYVGSLIYT

SEQ ID NO: 183506 - protein, 103 aa, Glycine max
  Coding DNA Sequence Number=SeqID_66728
MAFVVRVMGKYLSDPGLQHWKVAKHMMSLLEENKRDLSLGSLLNRFTNRFDLENPRVDCVSGAFGMPPLLFNENCEIDDDSGDSEFADMLLKKSLEATNENQW

SEQ ID NO: 183507 - protein, 163 aa, Glycine max
  Coding DNA Sequence Number=SeqID_66729
MKLVESQLINIQSLLSQRQLGNLPSQPKPKPKKEDVNAVMNKSKRIQEDSEEKEGYFPKVVNDILTEKEQAPKDVEVPTDGKLMPKKEGDAKKEILTSPQMFDYRNHYKKTCCDLIDFESIVQIDFWIMGEETPLELDIDELENALYLENAIPVGVSSTNNEG

SEQ ID NO: 183508 - protein, 126 aa, Glycine max
  Coding DNA Sequence Number=SeqID_66730
MASPQKFATPSHILYVDDIIIFSRGTKKGLDSLMNLLRLYGDASGQIINLENCQFFDGSLSNRKVYAWPKSLLKENEDWVRNSLWSIDIVVRKLVTVNWNKFFAHLMKVALTFALSHFITTLDGNV

SEQ ID NO: 183509 - protein, 1091 aa, Glycine max
  Coding DNA Sequence Number=SeqID_66731
  Homolog annotation: Hit_ID=Q33BI2; Match level="QueryCoverage=30%, HitCoverage=29%, E-value=1e-113, Identity=63%"; Hit description =Expressed protein
VFDGARARERERELLYPDACGGGGRGWISQGIVSYGRGHGTRETCALHTARLSCDTLVDFWSALGDETRQSLLRMKEEDFIERLMYRFDSKRFCRDCRRNVIREFKELKELKRMRREPRCTSWFCVADTAFQYEVSNDSIQADWRLTFADTVGLYHHFEWAVGTTEGKSDILEFENVGMNGCVQVSGLDLGGLSACFITLRAWKLDGRCTELSVKAHALKGQRCVHCRLIVGDGYVTITKGESIRRFFENAEEAEEEEDDGLMDEDGNEIDGECSRPQKHAKSPELAREFLLDAATVEKAFREGTARQNAHSIFVCLALKLLEERVHVACKEIITLEKQMKLLEEEEKEKREEEERKERKRAKEREKKLRRKERLKGKEKDTERKCSESMDVPGSTEISKDELSPASDVEQNNSIRSRSSVIVIEGDYPKIQDEDFTREGSTLRTQDCSYDDCEGDVAKAQHHTYDDWDGDIANAQDRNSTSTVEQSKFYCQRLRFRKEFQLDAPTKWSDRSHNAVASENGVAVGRSEPIHHEDNFGMPSRGINGLNRQSRINVAKSNGRNISHKCSERLYSSNSWINDRYNFHSCSCSLNNRTNRVSWETKPASKSESTVDTSKQFYGGSKYNHVDFMHESNGRTKGRVIPGNYSSRDLPQPKKVWEPMKSHKKYARSNSDSDVTLGSTSQGFQFDTVRSSVDEFGSSGEIDDEDSNLKRSRMVEGCQNNLDAETGASCSSTEIVSEAGMCLMGSSALNNSSDPNQGSTSSSDNCSSCLSEGDNNTTSSNRENTESSTSDSEDASQQSEVRDSSTCIDNGLSVSREAGMKKINNANDEGLTSRSPFGPSLGVTRGDVSGNPVVKITHNFDNGFSSINKCSQPQSMLPPVPKQNVQFPVFQPPSAMGYYHQNPVSWPAAPTNGLMPFPHPNPYLYAGLFGYSLNEDPCFCLQYGGLQQPAPLFNPVAVPVYQPVARAKGLNAEEPTLMSKPTSMVQEHFSRFAVEKVSLTGANLQKEALHGEVECGNSAKSQGSGFSLFHFGGPVDLSTGHKSVTASSNGDNVGDFSSKSSVDQVDKDHDCNKKEATVIEEYNLFAASNTL

SEQ ID NO: 183510 - protein, 36 aa, Glycine max
  Coding DNA Sequence Number=SeqID_66732
MAMGTDSPTNRTDYFYKNFMSPQLQGQETHAHYGMK

SEQ ID NO: 183511 - protein, 47 aa, Glycine max
  Coding DNA Sequence Number=SeqID_66733
MPALPHGNHQFGSSNGFWSKNRDDVGYNQLHKMALDHFVLVVTWIGS

SEQ ID NO: 183512 - protein, 58 aa, Glycine max
  Coding DNA Sequence Number=SeqID_66734
MCECEREREQKHLEEDEKNGNGCAMEDGRVERLHEVDSSMFTDAEVIFNITSRMSYLN

SEQ ID NO: 183513 - protein, 296 aa, Glycine max
  Coding DNA Sequence Number=SeqID_66735
  Gene Ontology: Mol. function=signal transducer activity; Cellular component=membrane; Biological process=signal transduction
  Homolog annotation: Hit_ID=Q7WJC7; Match level="QueryCoverage=99%, HitCoverage=48%, E-value=1e-108, Identity=73%"; Hit description =Methyl-accepting chemotaxis protein I
  Pfam annotation: Domain name=HAMP; Domain location=44-113; Score =70.0; E_value=7.4e-18; Accession=PF00672.15; Description=HAMP domain
  Pfam annotation: Domain name=MCPsignal; Domain location=144-296; Score=140.1; E_value=5.8e-39; Accession=PF00015.11; Description =Methyl-accepting chemotaxis protein (MCP) signaling domain
  Pfam module annotation: Pfam domain module=HAMP::MCPsignal; Domain location=44-113::144-296
NDSASNVNTKFREAVDNYLSFIDKRTDEFAAQAAVDHNVSRSVTIALLVIALVLAIGCWIFINRTVLRPLHEAGDHFEKISGGDFTGRIEVRSTNEIGQLFAAIKRMQESLTRTVATVRRGVDEINVGSREIAAGNTDLSSRTEQQAASLEETAASMEELASTVKQNADNARQANQLAASASDVAERGGSAVAEVVNTMQGISASSRKISEIVSVIDGIAFQTNILALNAAVEAARAGEQGKGFAVVAGEVRSLAQRSAQAAKEIKGLIEDSVSKVGAGSQQVERAGATMQEIVAS

SEQ ID NO: 183514 - protein, 63 aa, Glycine max
  Coding DNA Sequence Number=SeqID_66736
EEREMAHVREKTIKQRAAKRYNGRLVSRSFKKGDLILKRLLKDASTNKLSPNWEGPFRIQEEI

SEQ ID NO: 183515 - protein, 134 aa, Glycine max
  Coding DNA Sequence Number=SeqID_66737
MKERIDGFFSIKSLRWILRIQLQLKCSSWCGGSAASNDGSWWPSVVVGGGGGGVKAWGLVTRAMSKRLQEDWARAAEEVPRVLINLKLPIQGPFLVVKLLLPWLILYWMAPPLTFSPLSSAGIPWLKFTIKGPY

SEQ ID NO: 183516 - protein, 281 aa, Glycine max
  Coding DNA Sequence Number=SeqID_66738
  Gene Ontology: Mol. function=catalytic activity; Biological process =metabolic process
  Homolog annotation: Hit_ID=Q6ZG49; Match level="QueryCoverage=64%, HitCoverage=49%, E-value=6e-25, Identity=41%"; Hit description =Phosphoglycerate mutase-like protein
  Pfam annotation: Domain name=PGAM; Domain location=23-159; Score =25.7; E_value=2.2e-05; Accession=PF00300.12; Description =Phosphoglycerate mutase family
MAEFAINNNNNGSHSSPHPDYAEIVVVRHGETAWNATAKIQVVKDSDLRERHLGDLQGHVFHEIAKTNPTAYKAFVSKNEDQEIPLYLGMTFHHGCFPVQMCHELSYELQIERIEIIKGGGESLVQLYDRSTSALLKIGLKHKGERVIVVSHGGFIRALYKWACPNGKPGKVLNTCVSVFHLYGEDKWTLKVWGDVSHLNETGFLESGFGGDRNSETMQIAGGIGAFVLDATAGHGVASFNGVLQELGLASLTGELRGCRQLQWRFGWTKAPARAAICVAW

SEQ ID NO: 183517 - protein, 89 aa, Glycine max
  Coding DNA Sequence Number=SeqID_66739
  Subcellular localization annotation: CTP_CleavageSite=76; ConfidenceScore=5.73e-01
MLPGTEASSTLQTSSKRSQRVLQQAPIRLIFFSCSSSLTVVKYSSITFSRGNFILETNFISSLSDTWYRTSNTSIRDDTGGTEGKKSWV

SEQ ID NO: 183518 - protein, 63 aa, Glycine max
  Coding DNA Sequence Number=SeqID_66740
MSANRSCWIEKEYSPWDDQKRKLVGFMDQAKKDAREYNKEVEALKAMLEKWESDIGVMTFEQF

SEQ ID NO: 183519 - protein, 170 aa, Glycine max
  Coding DNA Sequence Number=SeqID_66741
MEVVHVKEHQGERVKSSSSKPTSTFPLVLSNHKPKESCHFELRGVDRLGSLFLNMLSVPICPVLEYVTSLLITSPHDLSWQRSAQRAALLSFEFKFNSFCCSREYEEVLYSHDDDVDIDKDCILGVMHFGDEDSLSDLEVGANGGENDGGVTLVLDGHGYSWVDKKVLRV

SEQ ID NO: 183520 - protein, 59 aa, Glycine max
  Coding DNA Sequence Number=SeqID_66742
DDYDGYEAIAQRLERVLNLRMVIAGTELYEIMQDYLTIAREGASADGSVRARQRHRTDH

SEQ ID NO: 183521 - protein, 144 aa, Glycine max
  Coding DNA Sequence Number=SeqID_66743
  Gene Ontology: Mol. function=oxidoreductase activity; Cellular component=vacuole; Biological process=hydrogen peroxide catabolic process
  Homolog annotation: Hit_ID=Q9FX85; Match level="QueryCoverage=71%, HitCoverage=30%, E-value=1e-23, Identity=51%"; Hit description =Peroxidase 10 precursor
  Pfam annotation: Domain name=peroxidase; Domain location=1-126; Score= -50.9; E_value=4e-05; Accession=PF00141.13; Description=Peroxidase
MRPKLMYMITITSSVQNSHYFYVINAGAHTIGYARCFTLKQRLFNCKGTGKPDPSLDASLLQHLQKLCPDNNSSNPNLAPLDPVTTYTFDSMYYKNLVKNLGLLPTDKALVSDGTTASLVYKYSQWNEKVENHMSVDKTHKPEP

SEQ ID NO: 183522 - protein, 216 aa, Glycine max
  Coding DNA Sequence Number=SeqID_66744
  Gene Ontology: Mol. function=nucleic acid binding
  Homolog annotation: Hit_ID=Q1SS67; Match level="QueryCoverage=59%, HitCoverage=59%, E-value=2e-26, Identity=56%"; Hit description=Zinc finger, CCHC-type
MDGLTSHCHERFTNTKKGTRGVEENERKWRKGSQCTALVLQPSSKPHAVFEGSSKGTNNCNNMVEARITLYDKVNEERMLSDQIIDFNKILDDLENLEVKMEDEDKALMLLNGLPSSYEHFKDAMLFGRDQTITLEEMYQTSTDQNLEVNLKASSNVFTITRRDITRRITLKGEAKIQRNLKNQEMWTLLKQNAPTTWDQHKLKGALRPSVFTPKA

SEQ ID NO: 183523 - protein, 437 aa, Glycine max
  Coding DNA Sequence Number=SeqID_66745
  Gene Ontology: Mol. function=nucleic acid binding; Cellular component= intracellular; Biological process=DNA integration
  Homolog annotation: Hit_ID=Q1S9T9; Match level="QueryCoverage=89%, HitCoverage=56%, E-value=5e-99, Identity=54%"; Hit description =Peptidase S8 and S53, subtilisin, kexin, sedolisin; Integrase, catalytic region; Zinc finger, CCHC-type
  Pfam annotation: Domain name=rve; Domain location=123-286; Score =120.8; E_value=3.7e-33; Accession=PF00665.16; Description=Integrase core domain
  Pfam module annotation: Pfam domain module=RVT_2::rve; Domain location=290-431::123-286
MVDESKIIVFPRQVLVYVGKRKGFERERRKNEIERERKRIDVSSMRESLILNEGGVVMLGNNKPYKVQGMGSICLKMFNDKETLLTGLSQNQHDKTSLWHMRLGHVSEKGKAKRNSFGIGLHATHRHFEYVCSNLWGPVRTMTHGGCSYFLSIIDDYSGRVWIFVLKNKSDTFGKFKEWYTQIQTQMETNVKCLRTNNGLEFVSEKFNEFCRKLGIQRHKIVADTLQQNGLAKRMNRTILEKVRCMLLSASLPKPFWGEVVAIAAYLINRCLSSGLGFKTPMELWSGKPENYSNLKVFGALAFAHIKQDKLGVRAIRCAIIGYPPGIKGYKQSPRQWYKRFYDFMMRMNFQRSNYDNCVYILKRDEEVFLYLLLYVNDILLASSSMDQIDRLKAMLSFEFEMKDLGKAKRILGMDINKNRSKGELFFVSARLYEESC

SEQ ID NO: 183524 - protein, 110 aa, Glycine max
  Coding DNA Sequence Number=SeqID_66746
MPKLRVIGVGGGGGDIVGRWASILSNCQVKKAFLQVSQTNRLQRAHVLYFTRNFRKITRKSNTTWEISELAPLGPEDLLRRFINCWYWAIVGSSSPDELEVAIGRWRLEA

SEQ ID NO: 183525 - protein, 106 aa, Glycine max
  Coding DNA Sequence Number=SeqID_66747
MTLISSSLCPDKLERMLHTKISQKYIKESFCKLEKNTSRISISRYLSIYQSSWSGGLLFGMHTHMEARLNTIQRASEVWWKEYKEEWRIEVKRNSKNHIANYKKPK

SEQ ID NO: 183526 - protein, 261 aa, Glycine max
  Coding DNA Sequence Number=SeqID_66748
  Gene Ontology: Mol. function=DNA binding; Cellular component =chromatin; Biological process=DNA integration
  Homolog annotation: Hit_ID=Q1SDN3; Match level="QueryCoverage=85%, HitCoverage=31%, E-value=7e-67, Identity=68%"; Hit description =Polynucleotidyl transferase, Ribonuclease H fold
MATVRVVLALASINRWHLHQLDVSNAFLHGDLKEDVYMEIPPGLLGYTSTVRILRYLKGCLGKGLFFPRTCSPHLLGFSDADWATCIDSRRSITGYCFFISNSLVSWKNKKQTTVSHSSFEAEYRALASATCELQWLSYLLRDLQILLSKTFVLFCDNHSALHIAANPVFHECSKHLDIDCHLVREKSQVGLMLLLPVPSLNQLADIFTKALPPQSFSTNLSKLFMKKDSRTLGKAWKKNGNGLSFPLDQLVKKRKNEHEW

SEQ ID NO: 183527 - protein, 125 aa, Glycine max
  Coding DNA Sequence Number=SeqID_66749
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=Q1SHA0; Match level="QueryCoverage=98%, HitCoverage=27%, E-value=1e-43, Identity=61%"; Hit description=DNA -directed DNA polymerase B
MRNRQVPLERYVITKTLAKPPEAYPDAKNQPHVAQRLKQQGHSSGCSVGDTIPYIICYEQGGSQAVQIHPVLSRLCASIQGKSPKRLANCLGLHSSKFHHKSNEALNNDSTSSFLSAVDDNERYF

SEQ ID NO: 183528 - protein, 134 aa, Glycine max
  Coding DNA Sequence Number=SeqID_66750
MDNNRMRSFLDIDDSDLPSFLRLTNHSSSISTRLILGLTGVVQDVMMNKKSKESLPTQEFIMRAHQDPMETTDATMKRTIIEGQDYSPYMTNIHDAILPRKGPVTRVMSKRLQEDWARAAEEGPRVLMNLMIDF

SEQ ID NO: 183529 - protein, 94 aa, Glycine max
  Coding DNA Sequence Number=SeqID_66751
MVTSRKSTKVRPSFVLNRNREASLEDSASVEGLLSVRGFNGEQRRFVVATGGSPYQISRRSNEGWVVFLPRQLHVASLRSFIKRLPREASSWLL

SEQ ID NO: 183530 - protein, 71 aa, Glycine max
  Coding DNA Sequence Number=SeqID_66752
MYHKAWLARQTDIEDIYSNWERSYLDLPRLLQTMQQFLPGMVVEKETLPMPPQTGHTNIGFRHVPLSFLEF

SEQ ID NO: 183531 - protein, 66 aa, Glycine max
  Coding DNA Sequence Number=SeqID_66753
MQHTLYLENIEERETGGTPPIIQIARAWDLFLTLMHCRVPNNPQPKIKEVKKKMKEKVNTSSISGN

SEQ ID NO: 183532 - protein, 328 aa, Glycine max
  Coding DNA Sequence Number=SeqID_66754
  Homolog annotation: Hit_ID=Q5GAP0; Match level="QueryCoverage=64%, HitCoverage=73%, E-value=3e-09, Identity=23%"; Hit description =Putative caltractin
MSNEETSERVMYKEKEVEGNQRIILEAAKAELDKVKEELNKAKESSMQSWLDSEPLIDELEKQKSNLANAQQSSNASKAVIEELESQLETIHKSIKSKREDQLKTELMIHDIQNALDYTHKNMERLKLEGKKEKQALAKLRQTLHQRKQTVQTLHLTLQALLLESDAVEESSAKALQHIKFSENHRDVVQLTNENYYALRRRAKAKISQANSRVSVSMEQKLAAEATRELVLSRLKNMYSSRSWSMNKRNTMGQPYTERNAKGQDIIVEEEVKTKIASASPKSSAEESLPKSKGGKLQQSRKSGSNNMKTIKKKSSILYNMRKCLYGS

SEQ ID NO: 183533 - protein, 127 aa, Glycine max
  Coding DNA Sequence Number=SeqID_66755
MDGSSNQNESGASVILEGPNNVALSQSLRFEFKATCNQAEYEALLGDLRLAREYYYAFQNLIEEFNEVQVVHIRQDINDKVDELLRKEISSGEPELKLENTHQNVNWLLTRKDLSGFGIAYRTEPIG

SEQ ID NO: 183534 - protein, 103 aa, Glycine max
  Coding DNA Sequence Number=SeqID_66756
MEIIGHLWIQVDAIYVSNDYHSSLMLRPNCENNIVNVSWRHPPSDSFKLNCDASVQPQCKKAFIEGVFRNHFGNVIFAYSFDIGSCSVLIAETWAILIGIQTA

SEQ ID NO: 183535 - protein, 106 aa, Glycine max
  Coding DNA Sequence Number=SeqID_66757
MVHYDRAKIHHCRGWKLVTLKLWGIVYSPYCGDHRLPRPSLETDVVQKGCHSGISYHGSEKYFLKKALVHWFHVVMPLSVLSHRVGQLDELPQVLCRIFMGSTTKR

SEQ ID NO: 183536 - protein, 229 aa, Glycine max
  Coding DNA Sequence Number=SeqID_66758
  Gene Ontology: Mol. function=RNA-directed DNA polymerase activity; Cellular component=membrane; Biological process=RNA-dependent DNA replication
  Homolog annotation: Hit_ID=Q1RYI2; Match level="QueryCoverage=70%, HitCoverage=29%, E-value=6e-23, Identity=31%"; Hit description =Ribonuclease H
MGAFKAPGPYGFQVVFYQSQWDMVFVEPWLIGGLNDTLKSLIPKVENVKMKDFRPINLCNDSYKRKIHTVVWNQICKPKNVGGLGLRSSMKVNSAFMMKAGWDLCSEHDDLWVRIFRSNWEQVHKNVRWNIGNGASVEFWYHCWVPHGGNLLDRAINNVPEDQSSNLVCQYININGNWDLRKLQPYLSSYNIDCIRVIPPPKVSKDSDKLAWGGATNGKLSVGLDYTCD

SEQ ID NO: 183537 - protein, 194 aa, Glycine max
  Coding DNA Sequence Number=SeqID_66759
MKQQMLEFLSSNPLSSLLALTNQGFFIKECALNPLNDPYHGCHVLNKNDDATNWENFWAFQSRAMAIAQHLHGSSNTDKLKANLEKAKSSLDSALQANIILVGDNSNLKGRVLDLEVEMKALEKCALDSALATFEREKDPERGRRSFKLSIKHIMAFAKLMSPTSVIASDKYYSIARSWMNPFSTSTKMSIMET

SEQ ID NO: 183538 - protein, 125 aa, Glycine max
  Coding DNA Sequence Number=SeqID_66760
MRLPMTNGEDECASNNNGGPLRRKGHNRAVGARPSKLNLNPKVMGSPKRAGYLAMKPFHGPGKPDPSLDELGSRKIHKRSFFPLLWYPFVFLIKTSSDPWLYVVTNTKQHNATSKDQKIILNDVP

SEQ ID NO: 183539 - protein, 56 aa, Glycine max
  Coding DNA Sequence Number=SeqID_66761
MAKMTKELQRRKRERFKPRVGVTMGAREGRVLQLALKRCNGCNEILKVADPFIPYP

SEQ ID NO: 183540 - protein, 104 aa, Glycine max
  Coding DNA Sequence Number=SeqID_66762
MVSSVQVDLSDVNIKVLIWVTDTIVLLDSQVLPIGREGVVKTDYPLVVVHSPSEGSLPLQRDADAYPLLALIISSPLGIGQFGPPRAILHADDSQVVMLQLCLF

SEQ ID NO: 183541 - protein, 87 aa, Glycine max
  Coding DNA Sequence Number=SeqID_66763
MDEEQWMYDSIIYEEVDMNVENEEDAGMKLFASCDEVLHWTRPMTHDIGFVVVIMTSDTNTGVRGRALFLLIACERSGEYRPKKNDL

SEQ ID NO: 183542 - protein, 92 aa, Glycine max
  Coding DNA Sequence Number=SeqID_66764
MPMHKVGSKCREKLLLETRLSYTMLNYTKQNWVGRQWNLLLLVPYTKSLRWLGLLVILTGLLVWVLWYWSCYQLLTEKEGLSFFSLEIRVLR

SEQ ID NO: 183543 - protein, 157 aa, Glycine max
  Coding DNA Sequence Number=SeqID_66765
  Pfam annotation: Domain name=AT_hook; Domain location=41-53; Score =7.6; E_value=1.1; Accession=PF02178.9; Description=AT hook motif
  Pfam annotation: Domain name=AT_hook; Domain location=76-88; Score =8.0; E_value=0.97; Accession=PF02178.9; Description=AT hook motif
  Pfam annotation: Domain name=AT_hook; Domain location=9-21; Score =14.5; E_value=0.073; Accession=PF02178.9; Description=AT hook motif
  Pfam module annotation: Pfam domain module=AT_hook::AT_hook::AT_hook; Domain location=41-53::76-88::9-21
MTRRSRGRGRGRGRPPKLKEDPIQYEEQLQEEDQPQQGRQGRGQGRPRKLIQDTNICEAQLPEEVQAKQQGVRVPGRGRGRPPKPKENTNQCEDEYLQDHAQGFGVEKAEGTKRGSIKDQSQEKQSHQRGQGWNQNQNMGQERFPNPNVEAKQSLGG

SEQ ID NO: 183544 - protein, 1295 aa, Glycine max
  Coding DNA Sequence Number=SeqID_66766
  Gene Ontology: Mol. function=RNA-directed DNA polymerase activity; Cellular component=chromatin; Biological process=chromatin assembly or disassembly
  Pfam annotation: Domain name=RVP_2; Domain location=335-464; Score= -37.5; E_value=0.00084; Accession=PF08284.2; Description=Retroviral aspartyl protease
  Pfam annotation: Domain name=rve; Domain location=1081-1237; Score =121.2; E_value=3e-33; Accession=PF00665.16; Description=Integrase core domain
  Pfam module annotation: Pfam domain module=RVP_2::RVT_1::Retrotrans _gag::rve; Domain location=335-464::587-756::102-192::1081-1237
MAEATRSKTSMERWEDVFAKLSASMTSKFDELLSRMNQLENSHTNTHAPSSFAAPAVTATANTAYRLKLEVPRFDGTDPEGWIFKVTQFFEYHATPEHDRLTIASFYMEGPTLAWFQWMYRSGQLSSWTAFLHAIHARFSSSAYEDPTGVLCKLTQRTTVSAYLSEFETLANRVIGLPAPFVLSCFISGLNPAIRRDVQVMQPHSLAQAVSFACLHEEKLLDGRRQTSKPASSLTLGTSVTRTSPSLTSSIADSPLLPSPSRPRASSIPFKKLTPSELAIRREQGLCFNYDEKYSRGHKCASSLFLFVTEDKDDNREIDPGPSQLPPPLQESVPTQISLHALSGHGAPETLHLTGFICEHRVQILIDGGSTHNFLQQELVTLQQLQPQETSTLRVTVGNGEELQCTQVCPNLVVKIQKHEFQVDLHVLPIRGADVVLGVQWLKALGPVLTDYTALTMKFIYNGQLIELVGDRDSSLQMISPSQLRRLVDTGNTSTFFHIKMEPSMETPVTIAHPIPAVQRLLSKHASLFQPLSTLPPSRTTDHSITLLPNSTPVNVKPYRYPHFQKQEIETQVAAMLRQGHIQYSSSSFSSPVLLVKKRDGTWRFFVDYRALNAITVRDRFPIPIVDELLDELGGAVWFSKLDLMQGYHQILMRESDIGKTAFRTHHGHYVFRVMPFGLCNAPATFQATMNRLFQPHLRRYIIVFFDDILIYSCSLEEHINHLEIAFQVLEHGQFTLKLTKCSFAQKQIEYLGHIITGNGVQPVPEKIQAIQEWPQPRSTRALRGFLGLVGFYRRFIKGYAMIAHPLSQLLTKSELVWSPEADNAFQKLKQVVTTAPVLALPDFSKSFTVETDASGLGMGAVLSQEGHPISFFSKQFCPRLLQASTYVRELAAITAAEFKGVDESGGSNPEQHKYLARLLGFDYVIQYRAGKSNIVADALSWSGASTTASLFIISFPHFVFLEDLRRELQANPEFRELRRKMTAEPHTYPNHSLAQDLILYFGRIWLPQGCSFIKVLLSEFHQSPSGGHMGFRKTLNRITENFTWNTSTRDTRDFVSNCLDCQLVKYETAKPRGLLCPLPVPSRPWEDLSMDFIVGLPAYRSYTCILVIVDRFSKRVHLGMLPSHHTSQMVAQSFMEMVGKLHGMPRSITSDRDPLFMSKFWQSLFSLSGTKLRMSSAYHPQTDGQTEVANRVVEQYLRAFVHRKPSSWGRFLLWAEWSYNTSVHSSTGVTPFEVTFGRKPPSFPQYLTDTSTVPAVDDLLSQREEMFNLLRRKLQKAQARMKDIADGRRRDHEF

SEQ ID NO: 183545 - protein, 326 aa, Glycine max
  Coding DNA Sequence Number=SeqID_66767
  Gene Ontology: Mol. function=binding; Cellular component =mitochondrial inner membrane; Biological process=transport
  Homolog annotation: Hit_ID=Q8L9F8; Match level="QueryCoverage=98%, HitCoverage=90%, E-value=4e-89, Identity=57%"; Hit description =Mitochondrial carrier-like protein
  Pfam annotation: Domain name=Mito_carr; Domain location=101-203; Score=70.0; E_value=7.5e-18; Accession=PF00153.17; Description =Mitochondrial carrier protein
  Pfam annotation: Domain name=Mito_carr; Domain location=226-320; Score=73.9; E_value=5.2e-19; Accession=PF00153.17; Description =Mitochondrial carrier protein
  Pfam annotation: Domain name=Mito_carr; Domain location=8-90; Score =41.7; E_value=2.5e-09; Accession=PF00153.17; Description =Mitochondrial carrier protein
  Pfam module annotation: Pfam domain module=Mito_carr::Mito_carr::Mito_ carr; Domain location=101-203::226-320::8-90
  Subcellular localization annotation: CTP_CleavageSite=45; ConfidenceScore=5.24e-01
MLDKSKFFFLGAALCSGVSCALYPMVVLKTRQQVSSSRFSCLNISCAILRHEGLRGFYKGFGTSLMGTIPARALYMVSLEITKSNVATAFLQFGFSETTAVAVANAAAGVTSAMAAQLVWTPIDVVSQRLMVQGSGGSKTTVLANLNSENYRSGFDAFRKIMCADGARGFYRGFGISILTYAPSNATHLGCFWCAFGSYMGNNNGRKGNEKNDSNKYSRSDSKAMVAVQGLSVVMASGVSAIVTMPFDTIKTRLQVLDLQEGNGRRRPLTFVQTVRNLVKEGGLLACYRGLGPRWASMSMSATTMITTYEFLKRMSTKNQEDLSPP

SEQ ID NO: 183546 - protein, 525 aa, Glycine max
  Coding DNA Sequence Number=SeqID_66768
  Gene Ontology: Mol. function=DNA binding; Cellular component=oxygen evolving complex; Biological process=DNA integration
  Homolog annotation: Hit_ID=Q1SS72; Match level="QueryCoverage=97%, HitCoverage=89%, E-value=4e-83, Identity=46%"; Hit description =Integrase, catalytic region
MADNVVINNTVFANLLNPYYTHPNENPGVAIVAQVQFVDGYLPCPTLNDPNFTIWDHCNTLVVSWLHHSLDPEILQTIMWMENASDIWNTLKKRYYQGDVFRISDLQEELYLLKQVETSHGPYGRGQMHTSQASYGRGQGRGSHSLGGRGSTINQYSLDDQEIEDDLQSLGQKEVAADTSSTAFTPEQHKALLSLLQQTSQASSSHTTNQLISFHKNGNSGIFCATLHAYSSNINSWVLDSGAIDHPIGCKWVFKTKFKADGSIDNHKARLVAKGFTQTTSLDYIETFSPVVKMTIVRLVLSLAASQGWHLHQLDVNTTFLHGDLHKEAYMKVPPGLIVANPALVCKLQRSLSPTSLTIVLVYVDDLVLTGTDLAEIQQLKQSPDAKFSIKDLGILKYFLGFKVARSTSSIVLHQRKYCLDLLQDTGLLATKPCSLPMDPTLKLHKASGVPLSDSTVYRRLIGNLLYLTHTRPDICYVVGKLSQYLQSPINIHMQAAHHVLRYLKGTAGIVTRIGELVLTLEGPS

SEQ ID NO: 183547 - protein, 97 aa, Glycine max
  Coding DNA Sequence Number=SeqID_66769
MSFETEIKLKVKEGINKTNLRSIRCLPYSLFCYSKNKSWILFLDLFHLMNGFHDLGLCHKKLDWYAFDLCHKDHDWFPLEQKPENHQTKQQAASLVE

SEQ ID NO: 183548 - protein, 86 aa, Glycine max
  Coding DNA Sequence Number=SeqID_66770
MDPIIKEVELDVETESSSMVGQAYDPPPLCAHVCMIKVELVKTRIIFYKNITGWKPPRPPTPPDYLIHLSSDSDYSSDEFLRNLDE

SEQ ID NO: 183549 - protein, 66 aa, Glycine max
  Coding DNA Sequence Number=SeqID_66771
MATTDSLPSYPHPDYAEIVVVRHGETAWNSQGRVQFYIDFREPVSLELPEGSNKNLTQVLDSSLTY

SEQ ID NO: 183550 - protein, 92 aa, Glycine max
  Coding DNA Sequence Number=SeqID_66772
MTLNDLSGVFHITMKAAKDVLEMSVTLLPLARRLKVLKRALESSQDPVIIQTTSMEVRRIKQEMTQLCGGVTPTGIEIPEVNWLERNLFFIL

SEQ ID NO: 183551 - protein, 121 aa, Glycine max
  Coding DNA Sequence Number=SeqID_66773
APPQRRPWGFRSLSLRSEPLDYWGGLNLPDMPDWRYCYTTLSLRCGGGIEGHDSQLASRTEACGRSDTTATALNKKRVAADAVSDDGLTVKCQNVLAATTLVFNIREKKEGKKRRENRRKR

SEQ ID NO: 183552 - protein, 47 aa, Glycine max
  Coding DNA Sequence Number=SeqID_66774
MENVCVVWCSGGGSGRAKETAPPQRGMFQTRFVRWGLRGTSASYNGS

SEQ ID NO: 183553 - protein, 276 aa, Glycine max
  Coding DNA Sequence Number=SeqID_66775
  Homolog annotation: Hit_ID=Q2QVF7; Match level="QueryCoverage=41%, HitCoverage=25%, E-value=1e-09, Identity=29%"; Hit description=RWP -RK domain containing protein
MGDDDDNNSSSRFVPYTCRDPFVSPLLDNFFIEPDPAPEPNLQNDEQQSLQGGYVSSTGSTIQDQSQQHFCNDNFTIGGGGVPNYQVAGSSKNKRTYPFTDVDIEHQSFRYDFKAGPSNLNQPESGIMDWPPVPRPFFCTCCQVLRQTIHTNGNDLERLEIHGRIGLINHIIIQNQSITPGDPPCDNYDQMIDFTNGTPAEVKGFLEDYIAQKDKLGYIIVEEAFSAFYEALCTKLDWVGKRTNNEDDDLIPPNLEKEGPEAEPEKRRHKRSRKDQ

SEQ ID NO: 183554 - protein, 123 aa, Glycine max
  Coding DNA Sequence Number=SeqID_66776
MGTRRACANPNTNLNGSLSEEDKQEGILISLVAGRNNYMVEHLTCLPRKQALVGDASGEEQLFSSENSLMDGIGRELDVYLEKIKRKTVKIARLVSLMSKTSAHNKNQMHRKSKTSGNWYSQK

SEQ ID NO: 183555 - protein, 368 aa, Glycine max
  Coding DNA Sequence Number=SeqID_66777
  Gene Ontology: Mol. function=protein dimerization activity; Cellular component=nucleus; Biological process=regulation of transcription, DNA-dependent
  Homolog annotation: Hit_ID=Q8LAL2; Match level="QueryCoverage=51%, HitCoverage=66%, E-value=2e-54, Identity=62%"; Hit description=Auxin- responsive protein IAA26
  Pfam annotation: Domain name=AUX_IAA; Domain location=111-332; Score =101.8; E_value=2e-27; Accession=PF02309.7; Description=AUXIAA family
MNERSRDEASPQLLDLISNEREWQMNKRNEGKSSEERKLELRLGPPGEDWSLGGKMKNNNTEREDQSLLSLGCFSPNINSNAFQSKASHPWPNYHHHGQGNNKKASSSSFLQFPSSTQPVMMGKDASCPKVVVELQQNGGDGKVFSPSSANTAVSQPNTSQKRTAPAPVVGWPPIRSFRKNLSSSSSASKPPPPPESQAEQQHNKVAGKKPVDNYANNKGLFVKINMDGVPIGRKVDLNAYDSYENLSSAVDELFRGLLAAQRDSSAGGVHNKQEEEKAITGLLDGSGEFTLVYEDNEGDRMLVGDVPWHMFVSTVKRLRVLKSSELSAFTQSDFREGIHGPCHWEVPNLDACQNTEIDPHVARIHNT

SEQ ID NO: 183556 - protein, 72 aa, Glycine max
  Coding DNA Sequence Number=SeqID_66778
MELREIGTLKYATTTYFITLELTNPPSPLISLKLQDSNAYFKFNLGCYKQEGKRNINIHLINEIALCTNQIT

SEQ ID NO: 183557 - protein, 294 aa, Glycine max
  Coding DNA Sequence Number=SeqID_66779
  Gene Ontology: Mol. function=helicase activity; Biological process =viral genome replication
  Homolog annotation: Hit_ID=Q9SH75; Match level="QueryCoverage=85%, HitCoverage=27%, E-value=3e-28, Identity=49%"; Hit description =Putative helicase
MARDKLQCFAVCDLKLKLISDRQLDERLYNLPNVVEVAALIVGDEHTYNNRDIIIEKKTSLLQRISELHLAYFPLQHPLLYPKGEDGYRPNILHKDHPNIYVAKRKKVIMRECNQGTMKLTQCYIQEDCFNNGLLMNIELRVNKYMNLNACNNEPLTQGNEKGLPHAHILIFLHPSNKYPNPEEIDNIISAEIPNKNEHPNLYEIVTNHMMQGPCRLSNTRAPCMVNGKCIRFFPKKFHQATIIDQDGFPVVRRRNNGHTMQKHGICRPLKHVGRFSHSQYMDVHQQLNASIST

SEQ ID NO: 183558 - protein, 126 aa, Glycine max
  Coding DNA Sequence Number=SeqID_66780
MATSDQTLVCVKQVKQEVADEWDESMPLPGDVIEGFSEREADDDSFLPVKASSEFSSQLGKINPRGELIWIQVRRGDSLMKLQVRIVQQKGSILQRKYTIQAATDHRHVADLGDLTLERCNELQGT

SEQ ID NO: 183559 - protein, 45 aa, Glycine max
  Coding DNA Sequence Number=SeqID_66781
MNWHYLLKPTRKGCLPRCLPPAKAAPFVLRLEATHPHSLPPLSSK

SEQ ID NO: 183560 - protein, 410 aa, Glycine max
  Coding DNA Sequence Number=SeqID_66782
  Homolog annotation: Hit_ID=Q2QVF7; Match level="QueryCoverage=54%, HitCoverage=71%, E-value=1e-07, Identity=36%"; Hit description=RWP -RK domain containing protein
  Pfam annotation: Domain name=RWP-RK; Domain location=306-357; Score =48.4; E_value=2.5e-11; Accession=PF02042.6; Description=RWP-RK domain
MDNNNNNYSGFVPNNDTDDDCTFLQTLLELDPQHFYLPTEEFVSLSLQQQQQNDPFGVEKGNNVPFLQGNNNNDFPIGEGVVPDVVDVEEEGPPRRTGKEPIPEGQGDRFFIHGHDIFFFGEGGVGNNVEPPQQNQTQPPNNQDVRSLCSWPPPPEPFSCSCCEVLRQINYTNGVRFDKLEIHGAVGVINHAICLVEDKTSNRPPRDTYQIIDFCNKNTEEIRNFLNVYCKERTEAGFIPIEDPSMSAFYDALCTGMDWTEVSNDVDDDLANGTEQESESEPEAENGRRASTSRPRRRDMAVQRQRVPRMTLSDLSGVFHLTISAAAVKLDVGDSTVKSICRRGKLKRWPQRKVQSLAKKVRVLERALNSPDPGVKRRTLDEIRRLQQEIIENCGGITPTGIPMLQFDEE

SEQ ID NO: 183561 - protein, 255 aa, Glycine max
  Coding DNA Sequence Number=SeqID_66783
  Gene Ontology: Mol. function=protein binding; Biological process =defense response
  Homolog annotation: Hit_ID=Q109S4; Match level="QueryCoverage=83%, HitCoverage=18%, E-value=1e-16, Identity=24%"; Hit description=NB -ARC domain containing protein, expressed
MSMRVNKRRREFRRSGIKYNWKMKIGTYLPDQCCSVISSILFMPLISEYCIDTTTARCMAWFSAAVSSGVPLVFVNIQTEQIPSTEETHFLKREIATSKQKINNANQIMHGIRLWFLPGLAEISVVLIPQPGEARFGMEIKRTEEGFVYIYSVMRGSPADRAGVREMYEESSANRFLLVISRLQCKSIMPTSACSAGLVHCCDQSEMKDILTSAIDQYETIQVHVMAWPNQTRPSPIPDVGCLAALLHPKSDSSL

SEQ ID NO: 183562 - protein, 83 aa, Glycine max
  Coding DNA Sequence Number=SeqID_66784
MVSHGMKPDVKAYRVVVINEYCKIRKPMICGLCKVKGRMQQVEELISDMLQNGHNLDATMHNYLLAGFFEDGDEEMTPKTIMT

SEQ ID NO: 183563 - protein, 380 aa, Glycine max
  Coding DNA Sequence Number=SeqID_66785
  Homolog annotation: Hit_ID=Q9LK76; Match level="QueryCoverage=83%, HitCoverage=82%, E-value=4e-48, Identity=37%"; Hit description =Arabidopsis thaliana genomic DNA, chromosome 3, P1 clone: MDC8
  Pfam annotation: Domain name=IQ; Domain location=118-138; Score=21.3; E_value=0.0034; Accession=PF00612.17; Description=IQ calmodulin -binding motif
  Pfam annotation: Domain name=IQ; Domain location=144-164; Score=6.0; E_value=9.3; Accession=PF00612.17; Description=IQ calmodulin-binding motif
  Pfam annotation: Domain name=IQ; Domain location=96-116; Score=32.3; E_value=1.7e-06; Accession=PF00612.17; Description=IQ calmodulin -binding motif
  Pfam module annotation: Pfam domain module=IQ::IQ::IQ; Domain location=118-138::144-164::96-116
MGKATRWLKGLLGKKKEKDYCGYSGSLDLDKREKKRSEKDEVSHFTPTSVTTFDRTRFRSFVAQKENVKNKHSIDVAVVRSKSCDRGTLLIGSMQGWAAVLIQSFFRGYLARKALRALKGLVKIQALVRGYLVRKRVAATLHSVQAMIRAQAVARSARARRSMDKENRFHPQTPSRKHVQRFDEARNYQLPNRRVPICCKAPFNRFDGSQKVVEVDTHMPHSRSRSINTAMSECGEDLNYEAMSSSLGCPVQGRISLHERQHPQEFEWLFNVDEGNNKFSTTHNTPRLQKCMLPGTPVKSVCGETFFRNCSNFPNYMANTHSSKAKLRSHSAPKQRPELKKRLSINEMMAARNSVSGVGMQWSSSNPKTQEDYFFFERVI

SEQ ID NO: 183564 - protein, 411 aa, Glycine max
  Coding DNA Sequence Number=SeqID_66786
  Gene Ontology: Mol. function=metalloendopeptidase activity; Cellular component=mitochondrial respiratory chain; Biological process =proteolysis
  Homolog annotation: Hit_ID=Q41440; Match level="QueryCoverage=95%, HitCoverage=77%, E-value=1e-141, Identity=65%"; Hit description =Mitochondrial processing peptidase
  Pfam annotation: Domain name=Peptidase_M16; Domain location=74-220; Score=164.8; E_value=2.2e-46; Accession=PF00675.10; Description =Insulinase (Peptidase family M16)
  Pfam annotation: Domain name=Peptidase_M16_C; Domain location=225 -402; Score=138.4; E_value=2e-38; Accession=PF05193.11; Description =Peptidase M16 inactive domain
  Pfam module annotation: Pfam domain module=Peptidase_M16::Peptidase _M16_C; Domain location=74-220::225-402
  Subcellular localization annotation: CTP_CleavageSite=47; ConfidenceScore=5.09e-01
MVKVAFVVAGFFCFIGNGRTLGASRGLFRWLTGESSNPLPPLDTPLRGVSLPPSLPDFVEPSNTKITTLPNGLKIASETSPNPAASIGLYLDCGSLYETPLSSGASLLLEKMSFKSTANRSHFRVVREVEAIGGNVGASASREQMGYTFDALKTYVPQMIELLIDCVRNPAFLDWEVNEELRKVKAELGELSNNPQGLLLEAVHSAGYSGALANPLLASETALNRLNSSLLEEFVAENYTASRMVLAASGVEHEELLSVAEPLLSDLPSVPRPEEPKSNYVGGDFRRQELSQGQVARVAIAFEVPGGWKKEKEAIALTILQMLMGGGGSFSAGGPGKGMHSRLFLRVLNEHQQIHSFSAFNSLFNNTGLFGIYASTGSDFVAKAVDLAARELIAIASPGQGLICLAFCLLL

SEQ ID NO: 183565 - protein, 130 aa, Glycine max
  Coding DNA Sequence Number=SeqID_66787
  Gene Ontology: Mol. function=protein serine/threonine kinase activity; Biological process=protein amino acid phosphorylation
  Homolog annotation: Hit_ID=Q9FUU9; Match level="QueryCoverage=73%, HitCoverage=10%, E-value=2e-22, Identity=52%"; Hit description=Leaf senescence-associated receptor-like protein kinase
MVLVYLSSYRMPMTFFVVFLGGLLTQAQDQSGFISIDCGAPADIHYVEKKTGINYISDANFVNTDVSKEIMTGLKSSYREPMWNVRSFPEGTRNCYKINISRGSLYHYLNSYGVVEDFMIIYQSVQGGGL

SEQ ID NO: 183566 - protein, 508 aa, Glycine max
  Coding DNA Sequence Number=SeqID_66788
  Gene Ontology: Mol. function=6-phosphofructokinase activity; Cellular component=6-phosphofructokinase complex; Biological process=glycolysis
  Homolog annotation: Hit_ID=Q1S171; Match level="QueryCoverage=97%, HitCoverage=93%, E-value=0.0, Identity=71%"; Hit description =Phosphofructokinase
  Pfam annotation: Domain name=PFK; Domain location=96-373; Score= -45.8; E_value=4.1e-10; Accession=PF00365.10; Description =Phosphofructokinase
MLDCVTSHDKITTAASGFVLEDVPHLSDYIPLLQTYPDPLQDNPSYSVVAQYYVNVDDTIAQQIVVHKNSPRGTHFRRAGPAQKVYFDSEEVHACIVTCGGLCPGLNTVIREIVCGLYHMYGVHKVLGIQGGYPGFYSRNTVPLTPKVVNDIHKRGGSILGTSYGGHDTSKIVDSIQDRGINQVYILGGYGTQYEAAMIFEEVRRRGLKVAVVGIPKTIDNDIPVIDKSIGFDTAVEEAQRAINSAHVEAESAENGIGVVKLMGRYSVSAEQNKKKSSYLELVVYSHQILTFHAGFIAMYATLASRDVDCCLIPESPFYLEGPGGLLEFVEKRLKEQGHMVIVIAEGAGQELLSGNPSIVNKQDASADKLFPDVGLWLSQKIKDHFEKRQKMAINLKYIDPTYMIRAIPSNASDNVYCTLLAQSAVHGAMAGYTGFTVGPVNGRNCYIPFHLINEGEKRVVITDRMWARLLSSTHQPSFLNPKDITGEREERTVNQTTDGQNHSETAD

SEQ ID NO: 183567 - protein, 529 aa, Glycine max
  Coding DNA Sequence Number=SeqID_66789
  Gene Ontology: Mol. function=hydrolase activity, acting on ester bonds; Cellular component=cellular_component; Biological process =lipid metabolic process
  Homolog annotation: Hit_ID=Q1SAY6; Match level="QueryCoverage=66%, HitCoverage=99%, E-value=1e-165, Identity=80%"; Hit description =Lipolytic enzyme, G-D-S-L
  Pfam annotation: Domain name=Lipase_GDSL; Domain location=207-520; Score=194.4; E_value=2.7e-55; Accession=PF00657.12; Description=GDSL- like LipaseAcylhydrolase
  Pfam annotation: Domain name=Pkinase; Domain location=1-223; Score= -99.1; E_value=0.012; Accession=PF00069.15; Description=Protein kinase domain
  Pfam annotation: Domain name=Pkinase_Tyr; Domain location=1-145; Score=-143.8; E_value=0.0012; Accession=PF07714.7; Description =Protein tyrosine kinase
  Pfam module annotation: Pfam domain module=Lipase_GDSL::Pkinase::Pkina se_Tyr; Domain location=207-520::1-223::1-145
MAYGNLEEYLSVDARREPLSWRQRIQIAVDAAQGIEYLHHGCKPPIIHRDIKTANILLNEKMQAKVADFGFSKLFSAENESHVSTVVIGTFGYVDPEGDIQQIVDPRLRGDFDFGSMWKALEAAIACVPSISIQRPSMSYIVSELKESLEMEAAREKEGINSIEMNVVDLEAFHTKMNLNSTEALLVLFAFVFLAWGNAQNTLVPAIITFGDSAVDVGNNDYLPTLFKANYPPYGRDFINHQPTGRFCNGKLATDITAETLGFKSYAPAYLSPQASGKNLLIGANFASAASGYDEKAAILNHAIPLSQQLKYYKEYRGKLAKVVGSKKAALIIKNALYILSAGSSDFVQNYYVNPLINKAFTPDQYSAYLVGSFSSFVKDLYKLGARKVGVTSLPPLGCLPAARTLFSFHEKGCVSRINNDTQGFNKKIKSAAANLQKQLPGLKIVVFDIFKPLYDLVQSPSKFGFAEARKGCCGTGIVETTSLLCNPKSLGTCSNATQYVFWDSVHPSQAANQVLADALIVQGIALIT

SEQ ID NO: 183568 - protein, 294 aa, Glycine max
  Coding DNA Sequence Number=SeqID_66790
  Gene Ontology: Mol. function=nucleoside-triphosphatase activity; Biological process=proteolysis
  Homolog annotation: Hit_ID=Q0WVW9; Match level="QueryCoverage=49%, HitCoverage=25%, E-value=7e-35, Identity=52%"; Hit description=DNA repair protein-like
MRSQQLRCGVQKNLNLELYLNRIDVVFWQIAWVAFDNNKRWPLILVVCSNGDGNVEGSLERSSSPRSSTSATPNAFSHYSSEANKGNQQQLEHVRKRLRPPSCAAVTKIKGKGKVKTQWVCCNCGHSTGKWWGQCPECQIVGTMNEFRESKLTGTKSSGGLAVSEDPVGSWLPQRPQELRPLKLEEINRRFNYQQWRIPLSGSFGNEVSTVLGGGLVPGSLTLVGGDPGIGKSTLLLQVQIAAMIAKECSDDEEPPVVYVSGEEVDTVVQLYYKSTLWQKPKLGGNNLYEASKE

SEQ ID NO: 183569 - protein, 147 aa, Glycine max
  Coding DNA Sequence Number=SeqID_66791
MSSLSDEEIDDRWMQFSEYIAHVGKLCAAPDHCSSYYMDWFYMISHPFMSPAQPRDPPRVLLVQQYDTFVEPDVYQQPMVAVAPNEADVDVHHVRHAILERLLNLRILTVVTEAYTVAEECLGIARSYIGQPTVGHRSRRRWRMDGH

SEQ ID NO: 183570 - protein, 147 aa, Glycine max
  Coding DNA Sequence Number=SeqID_66792
  Pfam annotation: Domain name=Transposase_23; Domain location=64-126; Score=-15.4; E_value=0.056; Accession=PF03017.5; Description =TNP1ENSPM transposase
MTEIIGSLKEGWRNELEEENKWSLEKMKQELKEAIKIELCQRGSQYSPPIEADIQLLDARVSTKGSNAKITVKPSGKEHVVHVMPTMGLYMQDDVLKVSVEKVYDGDAQVHLPTSKIQYVRHAFDTFVAWPTHLVKLVSHEMIPWVT

SEQ ID NO: 183571 - protein, 152 aa, Glycine max
  Coding DNA Sequence Number=SeqID_66793
MAAVLSDKNISEGETLSNRLFGGLGLIGGVAEMFGAGAMCVVPEPTMLTKAGCIVVGTHGLDTIQASLRQVWTGRNVSTDTYHSAVKLAETLGADSQTALHVGMTVDVAIPMSFAFAAGAVRVAAVRSGRINLAVHEALAGSTGGHTLERHI

SEQ ID NO: 183572 - protein, 439 aa, Glycine max
  Coding DNA Sequence Number=SeqID_66794
  Gene Ontology: Mol. function=oxidoreductase activity; Cellular component=membrane; Biological process=electron transport
  Homolog annotation: Hit_ID=Q947C2; Match level="QueryCoverage=76%, HitCoverage=68%, E-value=3e-79, Identity=41%"; Hit description=P450 monooxygenase
  Pfam annotation: Domain name=p450; Domain location=55-436; Score =161.2; E_value=2.7e-45; Accession=PF00067.12; Description=Cytochrome P450
MLLSSFCVTWPYLWCWDSTNLHPILTILVTLISVLCLLRWFKNSSNEATFSSPLPPVPLGLPLLGYLPFLGTNPHLKFHKLAQTPCSPTVTLPSLLIASLPHGLRWKKACKILVREMLSNTNISNSFSHRKVEVMKSIKDVYEKKIGCKISVGELAFLTATNAIRSMIWGETLQGEGDAIGAKFREFVSELMVLLGKPNISDLYPVLACLDLQGIERRTRNVSHGIDRLFDSAIEKRMNVTGKGESKSKKKDVLQYLLELTKSDSDSASMTMSEIKDIVLSGTETTSTTLEWVVARLLQHPEAMKRVQEELDEETLCLHPPLPFLIPRGPSQTSTVGGYTIPKGAQVILNVWTIHRDPDIWKDALEFRPERFLSDAGKLDYSGVNKFEYIPFGSGRRICAGLPLAEKMMMFMLASFLHSFEWRLPSGEILEFSGKFGAV

SEQ ID NO: 183573 - protein, 68 aa, Glycine max
  Coding DNA Sequence Number=SeqID_66795
MAMVVVVPMAAAIVEMAATILMVVEVAISVVVVSMMVMTTMTLGKAQDGMLMCVENMLTIEFCTSLYI

SEQ ID NO: 183574 - protein, 93 aa, Glycine max
  Coding DNA Sequence Number=SeqID_66796
MAEDASEFIHISPQNSEYEWNQLDYLFGELPKCPVLDRWTKKAKEEIKDDYNVVVNVLSGELFRLKAKHGNSEPQDIPASELANKRILDPPII

SEQ ID NO: 183575 - protein, 115 aa, Glycine max
  Coding DNA Sequence Number=SeqID_66797
  Homolog annotation: Hit_ID=Q1S7U6; Match level="QueryCoverage=75%, HitCoverage=5%, E-value=2e-17, Identity=58%"; Hit description =Prefoldin
MEWRIGENLELLDEATHLSMSWESENLMQQMELEFLLDEIKKFKVGIHQVLATLQIDSGGGHGKGIKQEEMSILHILNNIEGFKGSLVKTQEKLQLLVENSILLIVLLTHHCSIF

SEQ ID NO: 183576 - protein, 58 aa, Glycine max
  Coding DNA Sequence Number=SeqID_66798
MEKKESTEETSCSKQKMENLSRGKTQWQVKLEETDHKNEEKKQTGEGGHMSPPRAWKQ

SEQ ID NO: 183577 - protein, 114 aa, Glycine max
  Coding DNA Sequence Number=SeqID_66799
MANIYQVAVMTYTTHLCFGDVVNVEYVVSVDSIQETDDDYRLPQIVIAATGGTKQNKSNTLDSLFPASYKLMQAPLELVGLGSSSSMDSFASWKINGSGMEKGRARGDATSRRR

SEQ ID NO: 183578 - protein, 450 aa, Glycine max
  Coding DNA Sequence Number=SeqID_66800
  Gene Ontology: Mol. function=protein serine/threonine kinase activity; Cellular component=integral to membrane; Biological process=protein amino acid phosphorylation
  Homolog annotation: Hit_ID=Q9LIG2; Match level="QueryCoverage=96%, HitCoverage=49%, E-value=1e-111, Identity=47%"; Hit description =Receptor-like protein kinase
  Pfam annotation: Domain name=Pkinase; Domain location=144-410; Score =152.1; E_value=1.5e-42; Accession=PF00069.15; Description=Protein kinase domain
  Pfam annotation: Domain name=Pkinase_Tyr; Domain location=145-410; Score=110.8; E_value=3.8e-30; Accession=PF07714.7; Description =Protein tyrosine kinase
  Pfam module annotation: Pfam domain module=Pkinase::Pkinase_Tyr; Domain location=144-410::145-410
MCSHFRDLSNNNLTGAVPEFLSQLRFLRVLNLEGNQLSGTIPMQLIVNSENGLLEFIFGGNPSLCSPGSSCNNKNGNKVVVPLVASLGGAFMILVITVISFCIYKRRQPVSHHLSKQNAYYKIREELESNKQEFTYAEVLSMTRNFERVVGKGGFATVYHGWIDDTEVAVKMLSPSAQGYLQFQAEAKLLAVVHHKFLTALIGYCDDGENMALIYEYMANGDLAKHLSGKSKNILSWNQRIQIAVDAAEGLEYLHHGCNMPIVHRDVKSKNILLNEKFRGKLADFGLSKIYSDEDDTHMTTVVAGTLGYLDPEYNRSHKLREKSDVFSFGIVLFEIITGQPAITKTEERTHIIQWVDSILLERGINDIVDSRLQGEFDIHHVKKALDTAKACVATTSINRPTMTHVVNELKQCFSKMMTTPSNSDDHESSPNSFITVSFDGISGQSSLQR

SEQ ID NO: 183579 - protein, 378 aa, Glycine max
  Coding DNA Sequence Number=SeqID_66801
  Homolog annotation: Hit_ID=Q9LK76; Match level="QueryCoverage=97%, HitCoverage=93%, E-value=2e-49, Identity=36%"; Hit description =Arabidopsis thaliana genomic DNA, chromosome 3, P1 clone: MDC8
  Pfam annotation: Domain name=IQ; Domain location=116-136; Score=21.3; E_value=0.0034; Accession=PF00612.17; Description=IQ calmodulin -binding motif
  Pfam annotation: Domain name=IQ; Domain location=142-162; Score=6.3; E_value=8.8; Accession=PF00612.17; Description=IQ calmodulin-binding motif
  Pfam annotation: Domain name=IQ; Domain location=94-114; Score=32.3; E_value=1.7e-06; Accession=PF00612.17; Description=IQ calmodulin -binding motif
  Pfam module annotation: Pfam domain module=IQ::IQ::IQ; Domain location=116-136::142-162::94-114
MGKATRWLKGLLGKKKEKDYRGYSGSLDLDKREKKQSEKDEVSHITPTNVTTFDRTRFRSYAAPKEKNKHSIDVAVVRSKSCDRGNLLIGSREGWAAVLIQSFFRGYLARKALRALKGLVKIQALVRGYLVRKRVAATLHSVQAMLRAQAVARSVRARRSMDKENRFHPQTPSRKYMQRFDEARNYQLHNRRVPIYCKAPFNGFDESQKVVEVDTHMPHSSSRSINTAMSECGEDLHYQAMSSSLGCPIQGRISLHERQHPQEFEWLFNVDEGNNKFSTAHNTPRLPKCMPPGTPVKSICGKTFFRPCSNFPNYMANTHSSKAKLRSHSAPKQRPELKKRLSINEMIAARNSFSGVRMQWSSSNPKTQEDCCFFERVI

SEQ ID NO: 183580 - protein, 671 aa, Glycine max
  Coding DNA Sequence Number=SeqID_66802
  Gene Ontology: Mol. function=nucleoside-triphosphatase activity; Cellular component=membrane; Biological process=proteolysis
  Homolog annotation: Hit_ID=Q0WVW9; Match level="QueryCoverage=83%, HitCoverage=81%, E-value=1e-152, Identity=52%"; Hit description=DNA repair protein-like
  Pfam annotation: Domain name=DnaB_C; Domain location=196-305; Score= -143.6; E_value=0.048; Accession=PF03796.5; Description=DnaB-like helicase C terminal domain
  Subcellular localization annotation: CTP_CleavageSite=56; ConfidenceScore=5.26e-01
MTTRLLRTIFIAHKLHLRNPKCIFPPLLSRHSSTATNSSEAREPAKETTTTTTTTSWSMYGNVYDRPIAQRELNDHSDGDENPSSGRAAKSVAVVTKIKGKGKVKTQWVCCSCGHSTGKWWGQCPECEMVGTMNEFHESKLTDSKSRGGLEVSEDAVGLWLPQRPEDLRPVKLEEVNRGFNYQQWRIPLSGSFGNEVSTVLGGGLVPGSLTLVGGDPGIGKSTLLLQIAAMIANECSDYEGPPVVYVSGEESLQQIGIRADRLGIKSNIYLYSSTDIEDILTKTHGLSPRALVVDSIQTVYLKTIIGSAGGIMQVKECTAALMRFAKTTNISVFLIGHVTKSGDIAGPRVLEHIVDVVLYMEVGSNVNVFGFDSSNAKGHTLEDEVLSQPWIRKSMIEILTTSEFFMHGEKYSPYRMLRAVKNRFGSTDELAVLEMSQSGLQVVSNASEMFLTQQHSDSNVLAGLAIAVIMDGSRTFLIEIQALCLTHCPVSSSLSNGINANKANIIKCVLIKQTGLHLQDNNSAVNLLASVPNLSQVVKTCQQVVKYSEVRVSNPETLFAQAVFLNVVSGMTVTETAGDLAIAAAICSSFLEFPIPEGTAFIGEIGLGGELRMVPRIEKRVNTLVKLGYRMCVVPKQAEKLLETEGLGKMKVVGCKDLKEVINAVFSRNN

SEQ ID NO: 183581 - protein, 876 aa, Glycine max
  Coding DNA Sequence Number=SeqID_66803
  Gene Ontology: Mol. function=protein serine/threonine kinase activity; Cellular component=integral to membrane; Biological process=protein amino acid phosphorylation
  Homolog annotation: Hit_ID=Q39143; Match level="QueryCoverage=95%, HitCoverage=97%, E-value=0.0, Identity=46%"; Hit description=Light repressible receptor protein kinase
  Pfam annotation: Domain name=LRR_1; Domain location=432-454; Score =1.4; E_value=1.6e+02; Accession=PF00560.23; Description=Leucine Rich Repeat
  Pfam annotation: Domain name=LRR_1; Domain location=456-477; Score =19.8; E_value=0.0096; Accession=PF00560.23; Description=Leucine Rich Repeat
  Pfam annotation: Domain name=LRR_1; Domain location=479-498; Score =14.6; E_value=0.36; Accession=PF00560.23; Description=Leucine Rich Repeat
  Pfam annotation: Domain name=Pkinase; Domain location=594-842; Score =75.8; E_value=1.4e-19; Accession=PF00069.15; Description=Protein kinase domain
  Pfam annotation: Domain name=Pkinase_Tyr; Domain location=595-842; Score=52.5; E_value=1.1e-15; Accession=PF07714.7; Description =Protein tyrosine kinase
  Pfam module annotation: Pfam domain module=LRR_1::LRR_1::LRR _1::Pkinase::Pkinase_Tyr; Domain location=432-454::456-477::479 -498::594-842::595-842
MTGINHRVSIVTNAQEFTGKSIVMATGKNSMHHKQGRRKLDDVTGSICIDCGIAEGLDYTDDKTQIHYTSDAQFIGTGTSKSISHKFISDTPQRTFTNVRSFPEGKKNCYTLRHPEGRNTIYLIRASFMYGNYDDLNKLPQFDLYIGVNLWDTVMFENATHVVIKEILHVPSLDELYVCLLNTDKGTPFISALEVRHFDHSSYRTKSELLSLYRRFDIGSTTNEIVRYDKDVYDRMWYPYNLPDSTPLNTSFTVDSLNHTAYHLPSAVMKTAVRPTNENDSLEFEFDTGQPTSESYVYMHFAEIEVLNENECRAFDITLNGKLWAEYVTPTYLQSNTIDGNQSIRGSKLKFSMHKKPNSTHPPILNAMEIYIVKEFLHSPTNQDDVKAIIDIKSHYKLTSSVGKSWQGDPCAPSKYSWNGLNCSNNGYNPPTITALYLASSGLGGTIIASFLELKFLESLDLSNNSLTGPLPDFSQLQHLKALNLSGNRLSGEIPSLLKERSNNGSLLLSVDGNLDLCREGPCEEDKMNIAPLVAGILSVVVFFIVLGIVLNIIWRRRCNRKPASKQAVRLNEEVVLKTNNTQFTYSQISTITNNFDKMIGKGGCGIVYLGSLQDGTQAQLLMRVHHKNLASFVGYCNEVGHTGIIYEYMAYGNLEEYLSDARREPLSWRQRIQIAVDAAQGIEYLHHGCKPPIIHRDIKTANILLNEKMQAKVADFGFSKLFSAENESHVSTVVIGTLGYLDPEYYTSSRLTEKSDVYSFGIVLLELITGQPAIIKGHQNTHIAQWVNNFLAKGDIQQIVDPRLRGDFDFGSVWKALEAAIACVPSISIQRPSMSYIVGELKESLEMEAAREKEGINSIEINVVDLEALCGPDAR

SEQ ID NO: 183582 - protein, 632 aa, Glycine max
  Coding DNA Sequence Number=SeqID_66804
  Gene Ontology: Cellular component=integral to endoplasmic reticulum membrane; Biological process=protein folding
  Homolog annotation: Hit_ID=Q1SAY7; Match level="QueryCoverage=89%, HitCoverage=97%, E-value=1e-152, Identity=51%"; Hit description =Actin-binding, actinin-type
MMIREEKGVKPVLLKFGLALALSFAGFIYSRLRTRRIKPSKSRKGCSFGIGAALSTCNAISEGNFLCSEETCINKVISDKSPISLSPDSTQNGDEDEFLLPEFNDLVKDVDFEATVVRNSFKEDMGAPWLKVGSSIAYSGPEKDDYEQEVRQLRNMIRMLQDREQSLEVQLLEFCGLREQETAVMELQNRLKASTMEVKIFNLKVKTLQSENWRLKEQVADHEKVLTELENAKAQVELLNKKIRHETEQNREKIITLKQKVSRLQDQECKDAAYDQDIQIKMQKLKYLESEAEELRKSNLRLQIENSDLARRLDSTQILANAFLEDPEAGAVKQESECLKQENVRLMKEIEQFQSDRCSDLEELVYLRWINACLRYELRNYQAPPGKTVAKDLSRSLSPMSEKKAKQLILEYANANGPGNIVDFDIDQWSSSQASSITDFGECDDFSSADNSSAARTNTNPTKLFGKLRQLIQGKGSSHHHSHASSQEKSGYQDSNPLCLSTSTRSEGLRSEFATPIATSRTSLDFSSLTSVKEGLEKNNLEKYAEALKDSSVSATHQRRRRSASLIRAMPCKINASAKTWLAACEGWTLSQNTYWVALEQVPNDFGLHNKDVVSTIPVPQQPFLASTKHID

SEQ ID NO: 183583 - protein, 74 aa, Glycine max
  Coding DNA Sequence Number=SeqID_66805
MAMLMFSSTAEEVNPALKGLNQKTIMVLSVVRERKKARKLFSGSRKIQATGNLIGSVYCCRLIVTIIGVSDWKR

SEQ ID NO: 183584 - protein, 252 aa, Glycine max
  Coding DNA Sequence Number=SeqID_66806
  Gene Ontology: Mol. function=hydrolase activity, acting on ester bonds; Biological process=lipid metabolic process
  Homolog annotation: Hit_ID=Q1SAY6; Match level="QueryCoverage=99%, HitCoverage=99%, E-value=8e-76, Identity=68%"; Hit description =Lipolytic enzyme, G-D-S-L
  Pfam annotation: Domain name=Lipase_GDSL; Domain location=31-243; Score=75.1; E_value=2.2e-19; Accession=PF00657.12; Description=GDSL -like LipaseAcylhydrolase
MTINSTEALLVLLAFVFLAWGNAQNTLVPAIITFGDSAVDIGNNDYLPTLFKANYPPYGRDFSNHQPTGRFCNGKLATDITAETLGFKSFAPAYLSPQASGKNLLIGGNFASAASGNDEKAAILNHAIPLSQQLKYYKEYQGKLAKNALYILSAGSSDFVQNYYVNPLINKVFTPDHYSAYLVGAFSSFVKARKGCCGTGIVETTSLLCNPKSLGTCSNATQYVFWDSVHPSQAANQVLADALILQGIALIT

SEQ ID NO: 183585 - protein, 46 aa, Glycine max
  Coding DNA Sequence Number=SeqID_66807
MFENLLVEEPAWLERRANNAKVAGSRPAWAKRVLEPNTGSQYTPYY

SEQ ID NO: 183586 - protein, 485 aa, Glycine max
  Coding DNA Sequence Number=SeqID_66808
  Gene Ontology: Mol. function=transcription regulator activity; Cellular component=nucleus; Biological process=regulation of transcription
  Homolog annotation: Hit_ID=Q8S0N2; Match level="QueryCoverage=26%, HitCoverage=33%, E-value=1e-31, Identity=59%"; Hit description=BHLH transcription factor-like
  Pfam annotation: Domain name=HLH; Domain location=387-434; Score =27.2; E_value=5.9e-05; Accession=PF00010.16; Description=Helix-loop -helix DNA-binding domain
MASEVTDSSKDSSHPAGSWVSVLVLEAPGSSIVTVMDGLSWDASSVQLVANTPILWSTQPQDLEGGYLHSMPHLCSSALNQTGYPYPCSEKVRGMVHSSTTCEMMSMMPNTNLPQRITATMPVKSVVAAGASWEETLTSQSRPSLSANMNQTSNYVADFNMAHQQQHQHLINGTQNGKATTCSLDQSLDCLLSATNNSNTDMSVQDDGISMILSDCRNLWNNFSYGSVANSSGESESNASINARNSDMRYPSVSELDESVSQSFSDQYLSQGRVIDSSEVICTKRSSSSGFSIAQNSSATELGGFTLISETSPKSKRPRWDHKYPGSSNINFQQPNSSVTPSFEEPDPEAIAQMKEMIYRAAAFRPVNLGLEAVEKPKRKNVRISSDPQTVAARQRRERISERIRVLQKIVPGGSKMDTASMLDEAANYLKFLRSQVKALENLGNKLDTMNCPPTNIAFSFNPSFPIQTHFPIQNPSSHIQYSKG

SEQ ID NO: 183587 - protein, 96 aa, Glycine max
  Coding DNA Sequence Number=SeqID_66809
MRFTHILVICVDGVRQQCCELLHHGRITYVRRGISLCRSDKVLLLLNDCKDFSPKTLGFWVLGSQYVRYLDDPAIVDPLCLSVMEREKRGVYGRGR

SEQ ID NO: 183588 - protein, 434 aa, Glycine max
  Coding DNA Sequence Number=SeqID_66810
  Homolog annotation: Hit_ID=Q9SSM3; Match level="QueryCoverage=32%, HitCoverage=81%, E-value=3e-51, Identity=62%"; Hit description =Similar to jacalin
  Pfam annotation: Domain name=Jacalin; Domain location=273-404; Score =118.8; E_value=1.5e-32; Accession=PF01419.7; Description=Jacalin -like lectin domain
MQIRKSVLHMTSFDLLEDTPCLELWLTIAFYRNIKELDLHVGIKNGECYTLPQTVLSSKTLTGIRLSGCKLGTCNNIMLPYLQKLYLRKIPLVENFIQNLISRCHSIEDLRIIKCSGLKHLHVSNLIRLKRAEIHYCYQLKKVEISAPNLDTFWYCGKKTSPCKNIVIHEDLNNVTLPQVPDLGREIINSSACIDDALNSLLWKLHPLVYEMIKNKGEDPICCIYSSSKNKCWRHFLKDVKFEDLNDVKFEDIEEGKSRKKNVIVGPWGGNGGNSWDDGIFTGVREIKLVYGHCIDSIQVVYDRNGKPFTAEKHGGVGGNKTAEIKLQFPDEFLVSVSGHYCPVVRGGTPVIRSLTFKSNHRTFGPYGVEEGTLFTFSIDGGCVVGFKGRGDWYLDAIAFTLCNTRSKSLFQKVQRSLLWLTTTAPKSTSSKDG

SEQ ID NO: 183589 - protein, 48 aa, Glycine max
  Coding DNA Sequence Number=SeqID_66811
MTRVTAEPASGSKQTQKSMRKLADIASFGLDYPDEILTNSPNPNQETH

SEQ ID NO: 183590 - protein, 80 aa, Glycine max
  Coding DNA Sequence Number=SeqID_66812
MLLLFSRIYMKKVDHEGVSPVLLVRKDHVNDCDIGQCLRRDSQRLHTCLSPSLQRKRDKSQLEVTRFRVCISAVVARGLS

SEQ ID NO: 183591 - protein, 49 aa, Glycine max
  Coding DNA Sequence Number=SeqID_66813
MAVPLGKLILEVFFEIIWATGYWVFQDHFAKRQKMAINLKYIAELSLSL

SEQ ID NO: 183592 - protein, 61 aa, Glycine max
  Coding DNA Sequence Number=SeqID_66814
MAYGSILCKKSYNCLSKDSVSNSIKNECGHEQHSYWCAPSLAILQTGLHLSRCYLSECGCR

SEQ ID NO: 183593 - protein, 67 aa, Glycine max
  Coding DNA Sequence Number=SeqID_66815
MTIGTYISVGSSLESEKWEWRLRLLVSESMVRFGDRLKLVVRMTILMDDKDFHSRKRLTLEVKFHIG

SEQ ID NO: 183594 - protein, 122 aa, Glycine max
  Coding DNA Sequence Number=SeqID_66816
  Gene Ontology: Mol. function=phosphoric monoester hydrolase activity; Biological process=metabolic process
  Homolog annotation: Hit_ID=Q8GUC1; Match level="QueryCoverage=98%, HitCoverage=44%, E-value=2e-48, Identity=72%"; Hit description =Putative phosphatase
  Pfam annotation: Domain name=Put_Phosphatase; Domain location=4-122; Score=47.4; E_value=1.9e-13; Accession=PF06888.3; Description =Putative Phosphatase
MAGIVVIFYFDKTIVDCDSDNWVVDELGFNELFNRLLPTMPWNTLMDKMMMELHSHEKIIEGIVQVLQRIPIHPRITGAIKAAHVLGCDLRIVSDANMFFIKTILKHLKIRECFSEINTNPD

SEQ ID NO: 183595 - protein, 570 aa, Glycine max
  Coding DNA Sequence Number=SeqID_66817
  Gene Ontology: Mol. function=protein phosphatase type 2A regulator activity; Cellular component=protein phosphatase type 2A complex; Biological process=signal transduction
  Homolog annotation: Hit_ID=Q9FVD4; Match level="QueryCoverage=99%, HitCoverage=100%, E-value=0.0, Identity=80%"; Hit description =Ser/Thr specific protein phosphatase 2A B regulatory subunit beta isoform
  Pfam annotation: Domain name=WD40; Domain location=106-145; Score =9.8; E_value=2.6; Accession=PF00400.22; Description=WD domain, G -beta repeat
  Pfam annotation: Domain name=WD40; Domain location=279-317; Score =10.5; E_value=2.1; Accession=PF00400.22; Description=WD domain, G -beta repeat
  Pfam annotation: Domain name=WD40; Domain location=28-66; Score=5.3; E_value=8.7; Accession=PF00400.22; Description=WD domain, G-beta repeat
  Pfam annotation: Domain name=WD40; Domain location=329-368; Score =5.7; E_value=7.8; Accession=PF00400.22; Description=WD domain, G -beta repeat
  Pfam annotation: Domain name=WD40; Domain location=388-425; Score =5.5; E_value=8.3; Accession=PF00400.22; Description=WD domain, G -beta repeat
  Pfam module annotation: Pfam domain module=WD40::WD40::WD40::WD40::WD4 0; Domain location=106-145::279-317::28-66::329-368::388-425
MNGGDEVVAAPAGPPHPLEWKFSQVFGERTAGEEVQEVDIISAIEFDKSGDHLATGDRGGRVVLFERTDTKDHGGSSRDLERVDYSIGRHPEFRYKTEFQSHEPEFDYLKSLEIEEKINKIRWCQIANGALFLLSTNDKTIKFWKSVMVSVFGHCRNLLVEYYFYLQLSPSTVREIMMNNLIYPSSPRSFIRIFPHLRIAQVQEKKVKKISEMNVDPSKSMGNGSIASSSNSSSSRPYLANGGSPDRYNYISNDFSFPPGGIPSLRLPMVSSHETSLVARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRLATGSYSNLFRVFGCAPGSAEATTLEASKNPMRRLVPTPSRPSRSLGNSITRVVRRGAETPGVDANGNSFDFTTKLLHLAWHPSENSIACAAANSLYMYYA

SEQ ID NO: 183596 - protein, 249 aa, Glycine max
  Coding DNA Sequence Number=SeqID_66818
  Gene Ontology: Mol. function=phosphoric monoester hydrolase activity; Biological process=metabolic process
  Homolog annotation: Hit_ID=Q8GUC1; Match level="QueryCoverage=99%, HitCoverage=99%, E-value=4e-70, Identity=50%"; Hit description =Putative phosphatase
  Pfam annotation: Domain name=Put_Phosphatase; Domain location=4-206; Score=268.6; E_value=1.3e-77; Accession=PF06888.3; Description =Putative Phosphatase
MAGIVVIFDFDSTIIECDSDNWVLDEFGLTEKFYQLLPNMLWNPLMDKMMNELHSQGKTIEDIVQVLNRTPMHPRIVPAIKAAYSLGCELKIVSDANIFFIETILKHHGVWNCFSEEPVIGGIIALGMITERIQNSVDAAGKKFIYLGDGSGDFCPSLKLKDRDYLMPRKNFPLCDLVSENSKHIKAEVHAWRDGEELYDVLLHFIDKAIGEGNKNIISSTPIVSVDCKLGSISIEAHKPLPKAIPVPQ

SEQ ID NO: 183597 - protein, 93 aa, Glycine max
  Coding DNA Sequence Number=SeqID_66819
MAEELSIAIPQSQASTTKKRASKNEKLCLEDYLHLVHSRQTLHLTINQLNQCAESAGASGGVAGTGGSAAVNGERERIGVRGGGAGGCGCGSR

SEQ ID NO: 183598 - protein, 153 aa, Glycine max
  Coding DNA Sequence Number=SeqID_66820
  Homolog annotation: Hit_ID=O24408; Match level="QueryCoverage=48%, HitCoverage=31%, E-value=3e-07, Identity=44%"; Hit description=Auxin- responsive protein IAA18
MDERSRNEASPQLLDLISNEREWQMNKRNEGKSSEERKLELRLGPPGEDWSLGGKMKNTEREESLLSLGCFSPNNGFQSKASPWPNYHHHHQGNNNKASSSSFLQCPKVVVELQNGGDGKVFSPSSANTAVSQPNTSQKREKERKKEGTIFKL

SEQ ID NO: 183599 - protein, 112 aa, Glycine max
  Coding DNA Sequence Number=SeqID_66821
  Gene Ontology: Mol. function=exonuclease activity; Cellular component= intracellular
  Homolog annotation: Hit_ID=Q8S3S6; Match level="QueryCoverage=92%, HitCoverage=32%, E-value=3e-24, Identity=50%"; Hit description =Putative exonuclease
MNYPDHMLRDTAKYRPLMKTNLVSHSLNYDIQSGTHDPYEDCISVMRLYKRIRSQLHPEEDHGTMTLSNNIVGMPDSWISRELDNLTPDELYAMSRSDYKCWCLDLIPRLSA

SEQ ID NO: 183600 - protein, 35 aa, Glycine max
  Coding DNA Sequence Number=SeqID_66822
MDKYDLQAIGIPQEQAKQLLQSINDLLFYRLEAFK

SEQ ID NO: 183601 - protein, 321 aa, Glycine max
  Coding DNA Sequence Number=SeqID_66823
  Gene Ontology: Mol. function=hydrolase activity, acting on glycosyl bonds; Cellular component=beta-galactosidase complex; Biological process=carbohydrate metabolic process
  Homolog annotation: Hit_ID=Q93X58; Match level="QueryCoverage=98%, HitCoverage=39%, E-value=1e-168, Identity=86%"; Hit description=Beta- galactosidase
  Pfam annotation: Domain name=Glyco_hydro_35; Domain location=36-306; Score=450.6; E_value=2.1e-132; Accession=PF01301.10; Description =Glycosyl hydrolases family 35
  Pfam annotation: Domain name=Glyco_hydro_42; Domain location=58-321; Score=-253.4; E_value=0.045; Accession=PF02449.6; Description=Beta -galactosidase
  Pfam module annotation: Pfam domain module=Glyco_hydro_35::Glyco _hydro_42; Domain location=36-306::58-321
MVMCLKLKLIMWNVALLLAFSLIGSAKASVSYDSKAITINGQRRILISGSIHYPRSTPEMWPDLIQKAKDGGLDVIQTYVFWNGHEPSPGKYYFEGNYDLVKFIKLVQQAGLYVHLRIGPYVCAEWNFGGFPVWLKYIPGISFRTDNEPFKVQMQKFTTKIVDLMKAERLYESQGGPIIMSQIENEYGPMEYEIGAAGKAYTKWAAEMAMELGTGVPWIMCKQDDTPDPLINTCNGFYCDYFSPNKAYKPKMWTEAWTGWFTEFGGPVPHRPAEDLAFSVASIMEEQISVELLVVPLLLQAMIMMHHLMNMDCSGNQSGVI

SEQ ID NO: 183602 - protein, 527 aa, Glycine max
  Coding DNA Sequence Number=SeqID_66824
  Gene Ontology: Mol. function=hydrolase activity, acting on glycosyl bonds; Cellular component=beta-galactosidase complex; Biological process=carbohydrate metabolic process
  Homolog annotation: Hit_ID=O65761; Match level="QueryCoverage=99%, HitCoverage=66%, E-value=0.0, Identity=70%"; Hit description=Beta -galactosidase
  Pfam annotation: Domain name=Gal_Lectin; Domain location=449-526; Score=171.6; E_value=1.9e-48; Accession=PF02140.8; Description =Galactose binding lectin domain
  Pfam annotation: Domain name=Glyco_hydro_2_N; Domain location=67-205; Score=-59.7; E_value=0.075; Accession=PF02837.8; Description=Glycosyl hydrolases family 2, sugar binding domain
  Pfam module annotation: Pfam domain module=Gal_Lectin::Glyco_hydro_2 _N; Domain location=449-526::67-205
  Subcellular localization annotation: CTP_CleavageSite=54; ConfidenceScore=5.28e-01
MSGACAAFLANYNPKSYATVAFGNMHYNLPPWSISILPNCKNTVYNTARVGSQSAQMKMTRVPIHGGLSWLSFNEETTTTDDSSFTMTGLLEQLNTTRDLSDYLWYSTDVVLDPNEGFLRNGKDPVLTVFSAGHALHVFINGQLSGTAYGSLEFPKLTFNEGVKLRTGVNKISLLSVAVGLPNVGPHFETWNAGVLGPISLSGLNEGRRDLSWQKWSYKVGLKGETLSLHSLGGSSSVEWIQGSLVSQRQPLTWYKYSFVIIIINSIIIIIEEAENVPYGKRTCFTFFLFLNPTLSFVFSMGTPNVMPCTYQTTFDAPDGTAPLALDMNSMGKGQVWLNGQNLGRYWPAYKASGTCDYCDYAGTYNENKCRSNCGEASQRWYHVPQSWLKPTGNLLVVFEELGGDLNGISLVRRDIDSVCADIYEWQPNLISYQMQTSGKAPVRPKVHLSCSPGQKISSIKFASFGTPVGSCGNFHEGSCHAHMSYDAFERNCVGQNLCTVAVSPENFGGDPCPNVLKKLSVEAICS

SEQ ID NO: 183603 - protein, 718 aa, Glycine max
  Coding DNA Sequence Number=SeqID_66825
  Gene Ontology: Mol. function=nucleotide binding; Cellular component =cytoplasm; Biological process=membrane organization and biogenesis
  Homolog annotation: Hit_ID=UPI000016329C; Match level="QueryCoverage =95%, HitCoverage=91%, E-value=0.0, Identity=70%"; Hit description =nucleotide binding
  Pfam annotation: Domain name=RHD3; Domain location=1-711; Score =1198.6; E_value=0; Accession=PF05879.3; Description=Root hair defective 3 GTP-binding protein (RHD3)
MARCVGIEPCTLVMDLEGTDGRERGEDDTTFEKQSALFALAISDIVLINMWCHDIGREQAANKPLLKTVFQVMMRLFSPRKTTMLFVIRDKTKTPLENLEPVLREDIQKIWDSVPKPDAHKETPLSEFFIVEVVALSSFEEKEEQFKEQVANLRQRFYHSIAPGGLAGDRRGVVPASGFSFSAQEIWKIIKENKDLDLPAHKVMVATVRCEEIANEKYDLFATNKDWCELEEAVQSGPISGFGKKLNSLITTCLSEYDAEANYFDEGVRSAKQKQLQEKLFQLVQPTFQIALGHIRSGILDKFKEAFDKALNGGEGFSSAANKCIEFYMAQFDEGCADVVIEIANWDTSKGREKLQREIDAHVASVRASKMSELVSSYEEKLKEALSAPVETLLDGANSDTWPSIRKLLNRETQSAVSGFSVELIRFDVDEQQKKSMIVSLEDYAKGVIEAKAREEAGRVLISMKDRFMTLFSHDSDSMPRIWTGKEDVRAITKSARSSCLKLLSVMAVIRLDDGDDIYDIEKTLIVALADSSSSYAKDKSTMAVEPLASSTWDQVPPSKTLITPVQCKSLWRQFKMETEYSVSQAISAQEANNRSRHWLPPPWAIVALLILGFNEFMTLLRNPLYLGVIFVGYLLIKALWAQLDITGEFRHGALPGIISLSSKFVPTIMNLIRKLAEEGHGRHAAKVPAGRVTSSSASSSVTSSGNGAEYTSSSKYE

SEQ ID NO: 183604 - protein, 298 aa, Glycine max
  Coding DNA Sequence Number=SeqID_66826
  Gene Ontology: Mol. function=aspartic-type endopeptidase activity; Biological process=proteolysis
MAIPFKTKDVNEEVTSKDIKSLMEQANYTNKYLQALGETIKTKVVPKQKSIEEASPSIPIEKPLFKPFKVSEKAKRKFRELRKTRSLIEGVGDNHSELLNKIGSLLKVIPDTPQASENTSKMVTRSTSKLINVINEDSDQNSDNTTEIGSVSEKNINPINSKHWKTPSKLYYQRPTALDLLLEERGENNFQSFSANNIYECNIDAQMEYNIMNILQHMTMVATAYQTSYECSEETIIDILVVGFSGQLKGCAVKTDINGKVITNDDDKEIPDAVNTLIFIIAQHFIGDPSLWKDRSAE

SEQ ID NO: 183605 - protein, 385 aa, Glycine max
  Coding DNA Sequence Number=SeqID_66827
  Homolog annotation: Hit_ID=Q8ZMT7; Match level="QueryCoverage=34%, HitCoverage=79%, E-value=9e-55, Identity=76%"; Hit description=Fels -2 prophage protein
  Pfam annotation: Domain name=Phage_lysozyme; Domain location=197-303; Score=97.9; E_value=3e-26; Accession=PF00959.10; Description=Phage lysozyme
KLAGESARLHHYQNAVWCWTRAVLNERYQDFDATAAAMKRAACRTCRTAPSSLSDESACAAVRHGGRALLAPLRAHAGHNRAGFTGESGAGGARPNPAARAGGGVAGRDNGGNRAGRPALGLNYVGENLHFYHLVHRGGNGVAGWHEPERRVNGGRRSDRPADGADQLALHTSPEGLKLIADYEGCRLKPYLCDAGRWTDGIGNTVGVIPGKTITERQAAGNFITNVLRVEAALARCVAVSMPQQVYDALVSLAFNVGTGNACGSTMVTLLKKGKWREACYQLPRWVYVKGVFNIGLDNRRQRSGGVGRAADACDDVADEPQRRSNAYRGRPCLAAPEGGAEEVSGWQRQAGRAEICGLAAEAADRYVAGLFGLGDHAGLLPAGR

SEQ ID NO: 183606 - protein, 101 aa, Glycine max
  Coding DNA Sequence Number=SeqID_66828
MEAKQNFAQVQKNACVWLAVESLVQNEFWMFASISQRSKCRLIHYRLPLERIDGDPVLRETRRWATWEYVSSVGGGQQGMVGLCAHCGCGKLVVHHRPTAT

SEQ ID NO: 183607 - protein, 144 aa, Glycine max
  Coding DNA Sequence Number=SeqID_66829
  Gene Ontology: Mol. function=RNA-directed DNA polymerase activity; Biological process=RNA-dependent DNA replication
MEEKGKLDHIEERFRDIEGGGDHAFANMTELCLVLDVIIPLKFKVPDLNKYKGIACPKNHLKMYCQKMGAYSEDEKLLMHFFQESLTGAAVTWYTNLEPSRVHSWKDLMVVFVRQYQYNSNMAPDRTQLQKMCKKEHESFKEYA

SEQ ID NO: 183608 - protein, 66 aa, Glycine max
  Coding DNA Sequence Number=SeqID_66830
MRLANGVRNGMPQPLDIFAKTASGIASSKQRAAEQQQGKKFERLVHVSPGVKLKAQQPGCAHRLKA

SEQ ID NO: 183609 - protein, 58 aa, Glycine max
  Coding DNA Sequence Number=SeqID_66831
  Gene Ontology: Mol. function=ATP binding; Cellular component =chloroplast; Biological process=protein folding
  Homolog annotation: Hit_ID=Q1SGV8; Match level="QueryCoverage=96%, HitCoverage=30%, E-value=4e-14, Identity=58%"; Hit description=GroES- like
  Pfam annotation: Domain name=Cpn10; Domain location=2-57; Score=4.6; E_value=0.00036; Accession=PF00166.12; Description=Chaperonin 10 Kd subunit
MLIKIKEAEEKTEGGILLPSTAQTKPQGGEVVAVGKNNVEISTEVYFNGTKHLIVKNP

SEQ ID NO: 183610 - protein, 152 aa, Glycine max
  Coding DNA Sequence Number=SeqID_66832
  Gene Ontology: Mol. function=RNA-directed DNA polymerase activity; Cellular component=nucleus; Biological process=RNA-dependent DNA replication
MSLHSSSSVNGEGSTPKDPLGGHSSHIKHHSQRREKDRRPQEVNITLPYFHGKDNVEAYLDWEMKVEQLFACHHISKERKVPLATLFFQGYALYWWTSLVRERRIQGDPPVEYWNVLKSALRKRHISSYYERELMAKLQRLSQGSIGVEEYR

SEQ ID NO: 183611 - protein, 93 aa, Glycine max
  Coding DNA Sequence Number=SeqID_66833
  Subcellular localization annotation: CTP_CleavageSite=28; ConfidenceScore=5.05e-01
IAPLDTQWTGGANRAWGSSSGYGPLLVLQGARSPQQGIAPARHLVDPEKSNRVLVFPALMTGLCQFYGVPVAPNKVIRLPTNRAFIKKYCAPR

SEQ ID NO: 183612 - protein, 63 aa, Glycine max
  Coding DNA Sequence Number=SeqID_66834
MVEEGYATSLRGLRTYVGERFDSLDGRIDAIDARFAGMDTHITQLEEDISYVRQCFDLPPPSS

SEQ ID NO: 183613 - protein, 204 aa, Glycine max
  Coding DNA Sequence Number=SeqID_66835
MAFLGETSSQTTVNSRLTFIFPNGLIIHNDTGVYFQTSTPVPIRVPNSCDFASLKTRIHNTLQLSDKQFLDEIHYRKPFTDTGNQILFECMKLINDDDVNTMLMCNDQFSCVGMIELLCTVGRTPDGIINLLERTMPRTHDAILYYNGKWNMPPQNKFVGCAFTGKNPKKFQIPSTCTIDELKNLIKQVAPKGIPPHGIHESQT

SEQ ID NO: 183614 - protein, 142 aa, Glycine max
  Coding DNA Sequence Number=SeqID_66836
  Gene Ontology: Mol. function=DNA binding
  Homolog annotation: Hit_ID=Q1SFS3; Match level="QueryCoverage=90%, HitCoverage=25%, E-value=5e-09, Identity=26%"; Hit description =Lambda repressor-like, DNA-binding
MDEVQGQSFSKVYGKIWDLEMIEVLVEVIASLTQYYDQSLRCFTFGDFQLAPTIEDFKGILGCPIGGRKPYLFSRYYLFVARVARVVKISEQELDRVKQSRNGVARIPRKCLEEKAETLASQGGWVSFMDVLALLVLDFNHL

SEQ ID NO: 183615 - protein, 80 aa, Glycine max
  Coding DNA Sequence Number=SeqID_66837
  Subcellular localization annotation: CTP_CleavageSite=42; ConfidenceScore=5.16e-01
MPTSSNGAYITVGMSPPPLEPHNHSQTDLKLSGRLPLQAPVSAGLRRVKSLNSLDSDPSLSRISHMKKLLKKMAKIPSKI

SEQ ID NO: 183616 - protein, 204 aa, Glycine max
  Coding DNA Sequence Number=SeqID_66838
MPLVIDYQLCVIDYTVHFCRFHVLRLWNSSLASGNRLPRLCNRLPEMKNLEIPLLLACSVMVASCCYVVRYHVKEFTPFSSFLQIVMAVQLIHDRVQMECLEGAWETLEGNARCRFRGTIRFTATSLVHPDEPARTLQRTVEWILPTPTPYRLVELVQVIERVMRTYSLRWILPRTSCRHPRQTLRRIVALERWRSVEALHHSR

SEQ ID NO: 183617 - protein, 200 aa, Glycine max
  Coding DNA Sequence Number=SeqID_66839
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-33, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGLHTLAFRGVHTLAFRGLHVLAFRALDALTFRGLHVLPFRGLHVLAFRGLHALAFRGLHVLPFRGLQVLTFRGLHVLAFIGLHVLPFKGLHVLTIRGLHILAITGLHVLAFRGLHVLAFRGLHALTFRGRHVLAFRGVHELTFRGLHALTLKGLQVLASRGLHVLAFRGLHVLTFRGLHALTLKRIQVLPFRGVTHPRL

SEQ ID NO: 183618 - protein, 141 aa, Glycine max
  Coding DNA Sequence Number=SeqID_66840
MSVDRAHQHDHSYTGIARTRHPVDSEESNRALGFPALVMSLYQSYWVPVPPARTRLCDTVRIVPARHPVDPKKSNRVLELPNLITGLCQFYEVLVAPSKVISPLTNRAFIKKYCAPGRCRAKHHNSLGMIGSGQQTHRHHL

SEQ ID NO: 183619 - protein, 62 aa, Glycine max
  Coding DNA Sequence Number=SeqID_66841
  Subcellular localization annotation: CTP_CleavageSite=48; ConfidenceScore=5.16e-01
MCRPLKVRPCSPLKAWACSHLKVRMRSPLKARACSPLKEMKCSPLKVRACSPMKANACSPLK

SEQ ID NO: 183620 - protein, 671 aa, Glycine max
  Coding DNA Sequence Number=SeqID_66842
  Gene Ontology: Mol. function=protein binding; Biological process =hydrogen transport
  Homolog annotation: Hit_ID=Q5Z800; Match level="QueryCoverage=88%, HitCoverage=80%, E-value=1e-124, Identity=45%"; Hit description =Putative NF-E2 inducible protein
  Pfam annotation: Domain name=DUF544; Domain location=13-140; Score =219.5; E_value=7.4e-63; Accession=PF04424.4; Description=Protein of unknown function (DUF544)
MKLNKELKGITVCNVLLLRNNLNLSPDIAEVSQEKLLSLVAERLIDSNSSVNDKDAGYVENQQQNIADAIDLLPSLATGIDVNIKFRRIADFEFTRECAIFDLLDIPLYHGWIVDPQDYDTVNAIGSKSYNALMGELVSLETLIMNVHHENNPEDCVDFVAATTATLGVPSPSLSKARSFDDSSHSISDHMQRKGDLEEEAELLRVLKMSEAESDPVVGHINGGEISVSMDRNMCDEEVINTDSGDKLGNSTGAGNSNFHEHGPEPSLSDDCATSGKDHNEQISSTSTLGEAANSSLKTDAINDLHQSTYMGPEESFDLNNVIENSLDALVQNESEDIPSPEKHSVSLFECRADVSGGDGKVHDQSTPTTIDHEVVDESHGPDATVLSFSSPGHTNSDSSSVRYHQTDVSGALTSCVQGSEPIYEGEECVLDTRTGNFEDREPVYEGEVVLAEQSDKSTLAAPDLRAKDELTPEQGELIKSFLRNNASQLTFYGLFCLQDGLKERELCVFFRNNHFSTMFKFEGELYLLATDQGYINQPDLVWEKLNEVNGDTLFMTSNFKEFKVENHESSTWDENNALTSTADYLASIDSATHASLDINSDLQLAIALQQQEFEQQPPRQNNSQQQSSISGSSRLVTGPQVARNTGRHSSSSTSASPKSDTKSKDKCIVM

SEQ ID NO: 183621 - protein, 154 aa, Glycine max
  Coding DNA Sequence Number=SeqID_66843
  Homolog annotation: Hit_ID=Q1L5X6; Match level="QueryCoverage=29%, HitCoverage=3%, E-value=2e-08, Identity=53%"; Hit description=RNA polymerase IV largest subunit
MYRVMKFSSCSRSWLPMPFFLFYSQVGWHPKYKDSRCFHIVRIDGTVEDFSYRKCILGALDIVDPKKSKIQEKKWSGHVTDYKNRVGRVIVVPQLYNHKKQRCFSTFDLEGCPESVVESTVLFCEFRVMLLALLQLIGGNSLQPSFVVFYYLQG

SEQ ID NO: 183622 - protein, 580 aa, Glycine max
  Coding DNA Sequence Number=SeqID_66844
  Gene Ontology: Mol. function=oxidoreductase activity, acting on CH-OH group of donors; Cellular component=membrane; Biological process =alcohol metabolic process
  Homolog annotation: Hit_ID=Q9M4V5; Match level="QueryCoverage=87%, HitCoverage=88%, E-value=0.0, Identity=62%"; Hit description =Putative mandelonitrile lyase
  Pfam annotation: Domain name=DAO; Domain location=56-369; Score= -55.0; E_value=0.027; Accession=PF01266.14; Description=FAD dependent oxidoreductase
  Pfam annotation: Domain name=GMC_oxred_C; Domain location=411-565; Score=102.8; E_value=1e-27; Accession=PF05199.4; Description=GMC oxidoreductase
  Pfam annotation: Domain name=GMC_oxred_N; Domain location=55-345; Score=57.3; E_value=5e-14; Accession=PF00732.10; Description=GMC oxidoreductase
  Pfam module annotation: Pfam domain module=DAO::GMC_oxred_C::GMC _oxred_N; Domain location=56-369::411-565::55-345
LCCGVTVMGIWWWRLILVSLAGILFSPKHGASQRGMKYTFMKNASSAPSVSYYEYEYIVIGGGTAGCPLAATLSEKHKVLVLERGPSPYGNPNITNLDAFGAALSDTSPNSPSQRFISQDGVINSRARVLGGGSCLNAGFYTRASPYYVREAGWDGKLVKKSYEWVERVVAFEPIVRQWQSAVRGGLLEVGVLPYNGFTFDHIRGTKVGGTIFDQHGHRHTAADLLEYANPTQLTVLLQATVSKILFTNKGSRSRPVASGVIFMDALGREHRVYLKQGPKSEIIVSAGALGSPQLLMLSGIGAERELRKHNIDVVLNQPLVGQGMSDNPMNAIFVPSPVPVEVSLIEVVGITNVGSYIEAASGQMFTSRSPRDYGMFSPKLPPKQRSPEAVAKAIEKMGMLEPAAFRGGFILEKIMGPISTGELQLETSDPNDNPSVSFNYFKDPRDLRRCVQGIRTIEKVIESKAFSRFRYHNMSASVLLNMTANSPVNLLPKHSNTATSLEQFCRDTVMTIWHYHGGCQVGRVVDARYKVIGVDALRVIDGSTFNCSPGTNPQATVMMLGRYMGVKILRERLAGAETE

SEQ ID NO: 183623 - protein, 622 aa, Glycine max
  Coding DNA Sequence Number=SeqID_66845
  Gene Ontology: Mol. function=pyridoxal phosphate binding; Biological process=metabolic process
  Homolog annotation: Hit_ID=Q9FGL6; Match level="QueryCoverage=98%, HitCoverage=97%, E-value=1e-115, Identity=39%"; Hit description =Arabidopsis thaliana genomic DNA, chromosome 5, P1 clone:MJM18
  Pfam annotation: Domain name=Aminotran_5; Domain location=125-455; Score=-206.5; E_value=0.088; Accession=PF00266.9; Description =Aminotransferase class-V
MHLPCAGKASQPCYNGCFPSSFLASISDKSHNAPNSSHDLEAATSTTLHPHTQFTNHESLPSLEESHINFTKAYPSFGNNTCQLVDRIRAQEYHHLNPSNICFDYTGYGLFSHAQDQKQTASSVASSSSSCPPPSSLPEPPFFVISYKPVSLHSQIHYGGQESELESKIRERIMAFMNISEADYSLVFIANEVSAFKLVADSFQFHPDGELLTVYDHKSEAVDVMIETCKEQGVHVSSAKFCWPSLRIMSSKLKKMIMRRRGKRKRGLFVFPPYSNVTGTPYSYIWMSLAQENGWHVLLDARALGPKEMETLGLAMFKPEFMVCSFYKVFGENPSGFGCLFIKKSSISALKESDNATSMGIVGLFPAFRQETEGKEEFVMDNEETETKARQDDGSVSAHGTEEVFSSEIVELSLSTCTSLESGQCRERFGRVRGGGLEVECRGLDHADSVGLIAISIRGKYLINWLVNALISLQHPHAPTGRSLIRIYGPKINSHRGTVVAFNVFDWKGEKVDPAIVQKLADRNNISLSSAFLQNIWFSDKSDEEGQRTLESKVHRVKVLGHSNKTHSSGFGITVVKASLGLLTNFEDVYRLWAFLSRFLDADFVEKEKWRYLALNQKTIHI

SEQ ID NO: 183624 - protein, 927 aa, Glycine max
  Coding DNA Sequence Number=SeqID_66846
  Gene Ontology: Mol. function=DNA-directed RNA polymerase activity; Cellular component=nucleus; Biological process=transcription
  Homolog annotation: Hit_ID=Q1SBA7; Match level="QueryCoverage=94%, HitCoverage=79%, E-value=0.0, Identity=75%"; Hit description=RNA polymerase Rpb1, domain 4
  Pfam annotation: Domain name=RNA_pol_Rpb1_2; Domain location=203-362; Score=117.3; E_value=4.4e-32; Accession=PF00623.11; Description=RNA polymerase Rpb1, domain 2
  Pfam annotation: Domain name=RNA_pol_Rpb1_3; Domain location=365-516; Score=101.5; E_value=2.5e-27; Accession=PF04983.8; Description=RNA polymerase Rpb1, domain 3
  Pfam annotation: Domain name=RNA_pol_Rpb1_4; Domain location=568-648; Score=7.5; E_value=0.0018; Accession=PF05000.7; Description=RNA polymerase Rpb1, domain 4
  Pfam module annotation: Pfam domain module=RNA_pol_Rpb1_2::RNA_pol _Rpb1_3::RNA_pol_Rpb1_4; Domain location=203-362::365-516::568-648
  Subcellular localization annotation: CTP_CleavageSite=38; ConfidenceScore=5.11e-01
MQPGRSLGQVWVSQMHLMSVPHVALKTKGSVKGVRLIYGTKRSNDCNYCSAYPSMKFRVSSNDLFRRTAIIVEVKASKKTLGTEIPADYWNFIPCDAQQEENYVNRRVLSPAQVLNLLNGVDPDFIEKYIPRKNLLYLNCFPVTPNCHRVTEVPYAISSGSRLSFLNPDKTPNSIFADIQQRKIGENACNSSGLRWIKDVVLGKRNDSSLRTVVVGDPDLELSEVGIPCHIAESLQVSEYVNRQNREKLLYCCELRLLEKGKIDVCRNGSKVHLYKKEDLQIGDKIYRPLADGDKVLINRPPSIHQHSMIALTVRVLPISSVVCINPLCCSPLRGDFDGDCLHGYIPQSVTARIELNELVALDRQLINGQSGRNLLSLSQDSLTAAYLLMEDGVLLNVYQMQQLQMLSISDKRLIPPAVVKAPSSNSSLWSGKQIFSMLLPYDFDYSFPSDGVVVSDGELVSSSEASGWLRDSDYNVFQSLVEHYQGKTLNFLYTAQKVLCEWLSMTGFSVSLSDLYLSSDSYARKNMIEEIFYGLQDAEQACNFKQLLLDCYCDFLSGSIQESENAITVDADRLNYERQISAALSQASVDAFRQVFRNIQSLADKYACKDNAFLAMFKAGSKGNLLKLVQHSMCLGMQNSLVRLSYRLPRHLSCAAWNSQKWLDSIQMSSGTLESVQSYIPYAVVESSFLTGLNPLECFVHSVTNRDSSFSDHADLPGTLTRRLMFFMRDLHDAYDGTVRNLYGNQLIQFSYDIEEDSSCDKGFQEYAIGGEPVGAISACAISEAAYSALGQPVSLLETSPLLNLKNVLECGSRKRNGDQTVSLFLSEKLGKQRHGFEYAALEVKNYLERLLFSNIVSTVMIIFTPHDGSSQEKYSPWVCHFHLDKEIVTRRKLKVHSIIDSLYQRYYSQRKDSKVCFTNLKISSK

SEQ ID NO: 183625 - protein, 90 aa, Glycine max
  Coding DNA Sequence Number=SeqID_66847
  Homolog annotation: Hit_ID=Q1SBA4; Match level="QueryCoverage=32%, HitCoverage=8%, E-value=3e-08, Identity=96%"; Hit description =RanBP1; EVH1
MEKLKVGIQYSITLNGSRWHNNNDSCTLKTPEHILGWLKPVYFDHLLFSSGSRMYVQQHYRYLHHFRQYYPTIFSSFTNDFHTHEARSNK

SEQ ID NO: 183626 - protein, 270 aa, Glycine max
  Coding DNA Sequence Number=SeqID_66848
  Gene Ontology: Mol. function=zinc ion binding
  Homolog annotation: Hit_ID=Q1RWV9; Match level="QueryCoverage=96%, HitCoverage=64%, E-value=1e-102, Identity=71%"; Hit description=Zinc finger, RING-type
  Pfam annotation: Domain name=zf-C3HC4; Domain location=187-233; Score= 62.5; E_value=1.4e-15; Accession=PF00097.15; Description=Zinc finger, C3HC4 type (RING finger)
  Subcellular localization annotation: CTP_CleavageSite=72; ConfidenceScore=5.22e-01
MQAVPQRNKEVSDGGPGGRRPDISLQVPPRPTGFGSTSGVRVLDHSQSFGKGISSSRGFLRALSFKRKGNVADGERSSLLNSDPKTAADSPNMASISEIAWKRCTSLPVTPASNLSPSVSTPISARAYNEQTKPHKDVDCSKVSRSLSVPGRNVVIELSILGQSDQITPVPVEVTADEEIPEEEAVCRICFDVCDERNTFKMECSCKGDLRLVHEECLVKWFSTKGDKKCDVCRLEVQNLPVTLLRVTSSVQRENRQLQGQQNLHPESIR

SEQ ID NO: 183627 - protein, 35 aa, Glycine max
  Coding DNA Sequence Number=SeqID_66849
MVQNDKSNCVNCHTYPRFVDAEAQNPAYEGDTGIG

SEQ ID NO: 183628 - protein, 53 aa, Glycine max
  Coding DNA Sequence Number=SeqID_66850
  Gene Ontology: Mol. function=zinc ion binding
  Homolog annotation: Hit_ID=Q1RWV9; Match level="QueryCoverage=79%, HitCoverage=10%, E-value=8e-11, Identity=72%"; Hit description=Zinc finger, RING-type
MNANGKAGSLHLTAIYAILLSSVLGFGVAMGINYAYIQFVTWRLQVSHVDNPV

SEQ ID NO: 183629 - protein, 305 aa, Glycine max
  Coding DNA Sequence Number=SeqID_66851
  Gene Ontology: Biological process=intracellular transport
  Homolog annotation: Hit_ID=Q1SBA4; Match level="QueryCoverage=96%, HitCoverage=82%, E-value=1e-119, Identity=75%"; Hit description =RanBP1; EVH1
MEGSLFDIHRAEPSQQPIVAAPPLDMKRAESSQQHVRALNTQFASWVQTQLKNHPDELWEDGVRDYLDHASSIMEKFSDVVNWLKANATKAENLAADAGVAFSGKKLLPEVINKENKPFGEKTGSTPVSTATNFTSSWSPGLFSNSQGIFGFGNQSSAISNQSLPPSNQSLAPSNHNASDDVDGENELEQPSSPSVKKSEEKGVAVVHEVKCKLYVKSSDPADKDVWKDKGMGQLSIKCKEGVSKATKESKPTIVVRNEVGKILLNALLYPGIKTNLQKNSLVTIFHTSKGNVKGMTSMQFFYNN

SEQ ID NO: 183630 - protein, 169 aa, Glycine max
  Coding DNA Sequence Number=SeqID_66852
  Gene Ontology: Mol. function=transferase activity
  Homolog annotation: Hit_ID=Q1RWV8; Match level="QueryCoverage=99%, HitCoverage=23%, E-value=8e-61, Identity=65%"; Hit description=IMP dehydrogenase/GMP reductase
  Pfam annotation: Domain name=Ank; Domain location=112-145; Score=4.6; E_value=6.7; Accession=PF00023.20; Description=Ankyrin repeat
  Pfam annotation: Domain name=Ank; Domain location=39-74; Score=1.5; E_ value=19; Accession=PF00023.20; Description=Ankyrin repeat
  Pfam annotation: Domain name=Ank; Domain location=78-108; Score=10.9; E_value=0.84; Accession=PF00023.20; Description=Ankyrin repeat
  Pfam module annotation: Pfam domain module=Ank::Ank::Ank; Domain location=112-145::39-74::78-108
MAEMDVESLFNYAVKGQWREALDAYNKNPGALEAKITKVEDTVLHVAVHVGQTCFVKSVLDNIDKEVSLNILCMQNSKGNTPLHLSAQLGNVELCHNMAQRDPKLVCFRNVEGETPLFLAAVHGKREAFFCLHENQQRRRDDEEDGSLLVRKSNGDTILHSTIASEYFG

SEQ ID NO: 183631 - protein, 444 aa, Glycine max
  Coding DNA Sequence Number=SeqID_66853
  Gene Ontology: Mol. function=transferase activity
  Homolog annotation: Hit_ID=Q1RWV8; Match level="QueryCoverage=93%, HitCoverage=60%, E-value=1e-155, Identity=68%"; Hit description=IMP dehydrogenase/GMP reductase
MHLYLLRRVTAIGKDDNAASNDEENNVSRKSEEEQAKKLEKKRYLFPPNWGATIRFLTHMMKILLIICGFGASWIGKIQRKKVKHILAKQVMNELIQRTCSSSLYKHDHTGTSNINSSTSSNNQSKEKGGFQKIRRTDSPILIAAKMGVAEMVEKILETDPVAIHDVDADNKNVVLLAIENRQPHVYSLLNERSMIKETAFRQVDNQGNSALHLAATYRSYKPWRVPGAALQMQWEYKWYKLVKNSMPPNFYERYNENGQTAKQVFISTHERLTKEGGKWLSKTSESCSLVAALVATVAFTTSTAVPGGPNQNTGYPLFQGRLAFNIFAVASLVALCSSVTALVLFLSILTSRFQEKDFAMDLPRKLLLGLTTLFTSIASVLVSFCAGHFFIVEDELKFAVYPIYVATCLPVSFFAFVQLPLYFDLSLAMIRKVPQRSYKSHHH

SEQ ID NO: 183632 - protein, 328 aa, Glycine max
  Coding DNA Sequence Number=SeqID_66854
  Gene Ontology: Mol. function=binding; Cellular component=anaphase -promoting complex; Biological process=regulation of mitotic metaphase/anaphase transition
  Homolog annotation: Hit_ID=Q9STS3; Match level="QueryCoverage=100%, HitCoverage=56%, E-value=1e-136, Identity=71%"; Hit description=Cell division cycle protein 23 homolog
  Pfam annotation: Domain name=APC8; Domain location=1-159; Score =279.6; E_value=6.2e-81; Accession=PF04049.4; Description=Anaphase promoting complex subunit 8  Cdc23
MSSKESCRSELRIAIRQLSDRCLYSASKWAAEQLVGIEQDPAKFTPSNTRFQRGSSSIRRKYKTHEITGTPIAGVSYVATPAMEEDELVDGDFYLLAKSYFDCREYKRAAHVLRDQNGRKSVFLRCHALYLAGEKRKEEEMIELEGPLGKSDAVNHELVSLERELSTFRKNGKVDPFCLYLYGLVLKQKGSENLARAVLVESVNSYPWNWNAWTELQSLCKTVDILNSLNLNSHWMKDFFLASVYQELRMHNDSLSKYEYLLGTFSNSNYVQAQIAKAQYSLREFDQVEAIFEELLSNDPYRVEDMDMYSNVLYAKECFSALSYLAHR

SEQ ID NO: 183633 - protein, 158 aa, Glycine max
  Coding DNA Sequence Number=SeqID_66855
MDSSGDFENEIINLGLMANDYESGEKLMSFNYDLSISFDELQDAFNDLHKESIKLAKLVSYSKKTISSLEKEILKLNVELENLKSEVKTLKLVDKDQLSQPAIRREGDARAHRCVYQERKMCGVATNVYSRKTSEKPERRGLRTLSVKGSGVVFTHGE

SEQ ID NO: 183634 - protein, 720 aa, Glycine max
  Coding DNA Sequence Number=SeqID_66856
  Gene Ontology: Mol. function=transferase activity
  Homolog annotation: Hit_ID=Q1RWV8; Match level="QueryCoverage=99%, HitCoverage=100%, E-value=0.0, Identity=61%"; Hit description=IMP dehydrogenase/GMP reductase
  Pfam annotation: Domain name=Ank; Domain location=112-145; Score=4.6; E_value=6.7; Accession=PF00023.20; Description=Ankyrin repeat
  Pfam annotation: Domain name=Ank; Domain location=39-74; Score=1.5; E_ value=19; Accession=PF00023.20; Description=Ankyrin repeat
  Pfam annotation: Domain name=Ank; Domain location=407-443; Score=5.3; E_value=5.3; Accession=PF00023.20; Description=Ankyrin repeat
  Pfam annotation: Domain name=Ank; Domain location=78-108; Score=10.2; E_value=1; Accession=PF00023.20; Description=Ankyrin repeat
  Pfam module annotation: Pfam domain module=Ank::Ank::Ank::Ank; Domain location=112-145::39-74::407-443::78-108
MAEIDVESLFNYAVKGQWREALDAYNKNPETLEAKITKVEDTVLHVAVHVGQTCFVKSVLDNIDKEVSLNILCMQNSKGNTPLHLSAQLGNVELCHNMAKRDPKLVCFRNVEGETPLFLAAVHGKREAFFCLHENQQRRRDDEEDGSLLVRKSNGDTILHSTVVSEYFGLALQIIELYPNLVNSVNQDGLSPLQILAAKPNCFKSSTRMELLQSIIYKCSIVDEIEETYDIRCNEADTTHHYPMNYETCATFLSLLKSTSIRKDDNAASNDEENNVSRKSAAGGSTYSWSTLRRGRTSKEIGKETLPVPSQLGSNDPIPNPYDEDLANHLRFCLVALISDAGASWIGKIQRKKVKHILAKQVMNELIQRTCSSSLYKHDHTGTSNINSSPSSNNQSKEKGCYQKIRRTDSPILIAAKMGVAEMVEKILETDPVAIHDVDADNKNVVLLAIENRQPHVYSLLNERSMIKETAFRQVDNQGNSALHLAATYRSYKPWRIPGAAMQMQWEYKWYKLVKNSMPPNFYERYNENGQTAKQVFISTHERLAKEGGKWLSKTSESCSLVAALVATVAFTTSTAVPGGPNQNTGYPLFQGRLAFNIFAVASLVALCSSVTALVLFLSILTSRFQEKDFAMDLPRKLLLGLTTLFTSIASVLVSFCAGHFFIVEDELKFAVYPIYAATCLPVSLFAFVQLPLYFDLSLAMIRKVPQRSYKVLSHESHHH

SEQ ID NO: 183635 - protein, 179 aa, Glycine max
  Coding DNA Sequence Number=SeqID_66857
MALDRNHVPPPKLITCKPDILVGSKRNLTFSSKRGFQLYTQRESLKCKKTLKKFNHGPLIGKGALEESGDPNGEKAERGPGAIMSSGFGGLGLEGIVGMSEPAAGVGNTPPGEGNSGAMSGDNSWKGESEDRCGDGGGSVNVAGEDESVGTLGIGCCEYDERRGEGMKAMMMMIIMSVR

SEQ ID NO: 183636 - protein, 1358 aa, Glycine max
  Coding DNA Sequence Number=SeqID_66858
  Gene Ontology: Mol. function=protein serine/threonine kinase activity; Cellular component=nucleus; Biological process=protein amino acid phosphorylation
  Homolog annotation: Hit_ID=Q5NAR7; Match level="QueryCoverage=99%, HitCoverage=99%, E-value=0.0, Identity=58%"; Hit description =Putative FUSED serine/threonine kinase
  Pfam annotation: Domain name=Pkinase; Domain location=4-257; Score =285.8; E_value=8.2e-83; Accession=PF00069.15; Description=Protein kinase domain
  Pfam annotation: Domain name=Pkinase_Tyr; Domain location=4-255; Score=102.7; E_value=1.1e-27; Accession=PF07714.7; Description =Protein tyrosine kinase
  Pfam module annotation: Pfam domain module=Pkinase::Pkinase_Tyr; Domain location=4-257::4-255
MNQYHIYEAIGRGRYSTVYKGRKKKTIEYFAIKSVDKSQKTKVLEEVRILHTLGHVNVLKFYDWYETSAHLWLVLEYCVGGDLLSILRQDSQLPEDSVYDFAYDIVKALQFLHSNGIIYCDLKPSNILLDENGCAKLCDFGLARKLKDISKAPSSSLPRAKRGTPSYMAPELFEDSGVHSYASDFWALGCVLYECYAGRPPFVGREFTQLVKSIISDPTPPLPGNPSRPFVNLINSLLVKDPAERIQWPELCGHAFWRTKFTLVSLPAQPAFDDMIGLHAKPCLSERNGDKSSHNRTPTKYREKDVKGFLRKDENSVLGSRGIETPTRATPIGHRTQTKGSGRIHEVKQKDNSNISKGVNLLRLSRIAKTNLQRENEKENYRRPLPNNSENDSEVKIENTDMELDFNENAEDDAHEETDGAEQTTPVPDEKMVNHFLNQGKAEEVENNTHQLDTPSVHPPVSDDPRSFDHESTPDHPDISAISPSVSPQVKKHRTKEDSGSGLDSDSSRLSNNLSQVLWHASDLSVRPVMPSRKVDKVSEVIPSLPFEALQASDFVKMPKEQLEAVHNRILSILNGNTSIGEKQNVIRYLEMLSSNADAANILTNGPIMLMLVKLQRQSKASALRVQLASLIGLLIRHSTFVDDSLASSGILGALTDGLRDRQEKVRRFSMAALDCRDNNQLESPSKDNRNAHGWQVPNSLISLVSSILRKGEDDITQLYALRTIENICSQGGSWVGRLSSQDVISNLCYIYRASGKQESMRLTAGSCLVRLVRFNPPSIQSVIEKLSFKDLSSALVKGSPREQQISLNLLNMAMLGSHMFTNIGRYLVSLAEDKNLIPSLLGLVEQGSEVLRGKALVLVALLCKHGRRWLPHFFCSQKLLSVVDRLGKEKDAYVRQCLDAFVHIVASSIPGLLDIITGDIQQMMGGRRHGHISALTSRSAPKPNIHLFPVVLHLLGTSTFKHKVVTPQVLRQLANLIKLVETSFQGRDDFQITLLRIFESLTEESPVIIGNPDIFIREILPSLTVLYKGNKDGDARFLCLKILFDVMIILLSEPIEEEQRLTDLKFVSNTRFLPLYPTLIEDEDPIPIYAQKLLVMLMEFSFITIPDILHLKTISQCFEFLLGDLSNANVNNVKLCLALASAPEMESKLLSQLKVVRRIGNFLEFVYAKGMEDLLEPTLGLCKAFLARSVSCTKGFSYTTELILLGDCPPELSGGAVDPQQCIKDIADFGSNVGVLLELSASAETSIADIASECVVLLLKAAPREATTGILTNLPKVTVILESWSRGIPHLIIQRMLHALGYACKQYLLHAMILSISKPEISRTEVIVSELKNSGVPALAKTAGLAALELQRLPRCI

SEQ ID NO: 183637 - protein, 968 aa, Glycine max
  Coding DNA Sequence Number=SeqID_66859
  Gene Ontology: Mol. function=heat shock protein binding; Cellular component=integral to membrane; Biological process=protein folding
  Homolog annotation: Hit_ID=Q5Z5F4; Match level="QueryCoverage=99%, HitCoverage=99%, E-value=1e-161, Identity=34%"; Hit description =Putative DNAJ heat shock N-terminal domain-containing protein
  Pfam annotation: Domain name=DnaJ; Domain location=67-128; Score =92.0; E_value=1.8e-24; Accession=PF00226.21; Description=DnaJ domain
MECNKEEAIRAKELAEKKMQNKDFNGARKFAIKAQQLYPDLENITQMLIVCDVHCSAEQKLFSNEMDWYKILQIELTANDTTIKKQYRKFALQLHPDKNKFAGAEAAFKLIGEAQRVLLDREKRSRLDMNLRRVPMNRTTMPSHHQQNVQMNFNPVMQTSVRPNFTNLNPQQPQPSRQASQQVPNGGCPTFWTVCSFCSVRYEYYREVLNRSLRCQHCSRPFIAYDVNMQGTTPATNSSQQAFGVQNHSQNHGAFNVGAGSQGNLHTRRSNTESHKKKGPTADVSVKPNGKRKRKQVAESSESAESVGSTDSESEEDILYDKDGFSTLREENPRRSTRQKHQVSYNENVSDDDEGGGSPSGAGENTGEPSKMNNQNGLAADLKGNKQGEKRKQNFYSEESLQNIDEEIKEVREKEAVGSSKIDKASEHSPSKSTNRPDDFVYPDAEFSDFDKDKKEGSFAVGQIWAIYDTIDGMPRFYAVIRKVFSPGFKLRITWFEPDPDEQDQVHWVEEELPIACGKHKLGITDTTEDRLMFSHLIVCEKIGRCTYKVYPRKGETWALFKNWDIKWHMDAESHREYDFEFVEILSDYVEGVGVVVSYLAKLKGFVCLFSRMEGGNRTFQIPSSELFRFSHRVPSFKMTGQERAGVPVGSYELDPVSLPMNLEEIAVPEHLEVKDGHCPSSGVGTRSSDMWKFTMNSEGDASTAKVKLQRNNSAEENKDPVNHIGNDSDPSASAADAFEIPDPEFCNFDAKRSLEMFQVGQIWAFYGDEDGLPKYYGHIKKVRTSPDLELQVTYLTNCWLPEKCVKWEDKDMLISIGRFKIKAGAHPCTYANTYYVSHQVQVINDGKKKEYEIFPRKGEIWALYRNWTTKIKRSDLLNLEYDIVEVVGEQDLWMDVLPLELVSGYNSVFKRKSNAGSARATKIYWKDLLRFSHQIPAFELTEEQDGNLRGFWELDPGAVPLHYFNSK

SEQ ID NO: 183638 - protein, 1108 aa, Glycine max
  Coding DNA Sequence Number=SeqID_66860
  Gene Ontology: Cellular component=intracellular
  Homolog annotation: Hit_ID=Q1RWU7; Match level="QueryCoverage=34%, HitCoverage=72%, E-value=1e-135, Identity=64%"; Hit description=BRCT
  Pfam annotation: Domain name=BRCT; Domain location=854-930; Score =17.6; E_value=0.046; Accession=PF00533.16; Description=BRCA1 C Terminus (BRCT) domain
MSPIDSTGNGDRKIHQDFDFVDTQPFDADGEEDDVCGFFEDTVPFGDDGVLETEAVNLAGETQALDDGDAFDDDDGVLETEALNLAGETQALDDGDTQLLEEESDSDRTQVLENVDDDDVDEVSVGNVNGEAVDSKKGESSQQNSSGSMPPRFTVLRAESLRQAALACNMDLKETQDVTNSVEGTSQFCQVPQAVKDNGGSFLRCSEKDDGVDQENKHRKYSVEVGGFKSKSMCKVANSTVRKLFNDVLPVETNQPSLRSNDFNEGDDLDKLPIYHDELTGLSYVESQEPGVLSQDNALDFVDRFLKDNTLEFDQETNSVKKIEEKSKSIPSTKRQHSLAKTVNDRGKSGRTGIYDWDDNREDEGGGDIFLRRKEDFFKGEMHRPRSLPGFQKSKVCRLNDDKEDKKQLSIPNRRKTAVHSDSKLGMHILKARDNIIPEATMLKRNLANELDEQFNTDCSRGEMEPNANACAPEMLDVGLDTQMAAEAMEALCNVGDIVDHVANDATHVTRSGLMYKVNNSSTGKVGSGSSKERLGQYDKKRKVDVKSKLQTSGLSKKSTKEVRQWTKDNMMTRSKRSKLNAEGNQTSSANENGRVSLSPLIAQRKSAGALKRHQLDELNNPGGNNGEGRGSSVGKRHLQDDVLLFTPIARRTRRSLAVNPLINVSDDAEMDTLDCPKGRRSLRIRKLSNDDKRSETLVGSSKPSAQPEDIGKHTAGKRKMRTDSVVKSHVNCQARSSLSLYDGSAISSVDRKQGKISELNSDKANPGDNINNSEVTTLDESPRERYKSSDLASATPAKCKTPANDASPVCMGDEYYKQSCNRNLSRSCKELHRELQSLRDIRSELLTPSKDSRKRRDMTDVRILYSHHLDEDIVKHQKKILARLGVSVASSIADATHFIANQFVRTRNMLEAIAFGKPVVTHLWIESCGQASCFIDERNYILRDVKKEKELGFSMPVSLAHAIQHPLLKGRRVLVTTNTKPSKEIVSNLTRAVQGQVVEKVGRSVFKGDTISDDLLILSCEEDYASCVPFLEKGQKLFHSALKTCYLLKIKNTMFCICRGNGVQFRTVAEWHRYSEAGVSEVIFCSIARITNEFEEYKLLLYTDLVP

SEQ ID NO: 183639 - protein, 44 aa, Glycine max
  Coding DNA Sequence Number=SeqID_66861
MLQHQSTYKSFHMMKASAAGAHMDNIFGYIKDGKRDVLNLISSE

SEQ ID NO: 183640 - protein, 131 aa, Glycine max
  Coding DNA Sequence Number=SeqID_66862
  Gene Ontology: Cellular component=endoplasmic reticulum
  Homolog annotation: Hit_ID=Q2PGG6; Match level="QueryCoverage=91%, HitCoverage=19%, E-value=8e-37, Identity=62%"; Hit description =Generative cell specific-1
MALRFAITLMIIFILSSFHVVGIQIISKSKLEKCEKNSNSDDNLNCTTKILLNMIVPSGSSGGEASIVAELVEVEENSSRKMQTLRIPPVITDVPYKPEEYYVKTRKCEPDAGANVVKICERQTMFIAILL

SEQ ID NO: 183641 - protein, 178 aa, Glycine max
  Coding DNA Sequence Number=SeqID_66863
  Subcellular localization annotation: CTP_CleavageSite=58; ConfidenceScore=5.36e-01
MWISHSPLPPLEVSSPEAKSGKYSGSSLSRLGSRSLPAVKMTEPPCGCSLWQNVNAVLCGEGEARGNVEGGNGGGGGLTKPMELRRRRWRLARSGGTLSIKRWPFNVSDENKRDDSEPGPLIWPTMQVLPPWLPNPSTKWTSKTSPQVNDGLSHIGSFKQQSVLLAHDATELNFTSYL

SEQ ID NO: 183642 - protein, 84 aa, Glycine max
  Coding DNA Sequence Number=SeqID_66864
  Homolog annotation: Hit_ID=Q2PGG6; Match level="QueryCoverage=74%, HitCoverage=8%, E-value=4e-20, Identity=71%"; Hit description =Generative cell specific-1
MVQEQFLIMKPNEVTTQSCKIYPTTDQASKYFCAAVLKDSDYNEVDRAECQFATTATVLDNDTQDDKEDFTAVLLSAVSLHKYI

SEQ ID NO: 183643 - protein, 471 aa, Glycine max
  Coding DNA Sequence Number=SeqID_66865
  Gene Ontology: Mol. function=monooxygenase activity; Cellular component=membrane; Biological process=electron transport
  Homolog annotation: Hit_ID=Q1SB83; Match level="QueryCoverage=99%, HitCoverage=98%, E-value=0.0, Identity=83%"; Hit description=E-class P450, group I
  Pfam annotation: Domain name=p450; Domain location=31-468; Score =108.9; E_value=1.5e-29; Accession=PF00067.12; Description=Cytochrome P450
MWALCLGALVIIGITHWVYRWRNPSCNGKLPPGSMGFPLLGESLQFFSPNTTSGIPPFIKQRMKRYGPIFKTNLVGRPVVVSTDPDLNHFIFQQEGKVFQSWYPDTFTEIFGKQNVGSLHGFMYKYLKNMVLNLFGHESLKKMLPELEQTTCRTLEQWSCEDSVELKEATARMIFDLTAKKLISYDSTKSSENLRDNFVAFIQGLISFPLDIQGTAYHKCLQGRKRAMKMLKNMLQERRRMQRKQQTDFFDYIVEELKKEGTILTEAIALDLMFVLLFASFETTSLALTYAIKLLSDNPLVLKRLQEEHEAILKQREDPNSGITWKEYKSMTFTFQFINETVRLANIVPGIFRKALREINFKGWAVMVCPPAVHLNPDKYQDPLAFNPWRWEGVELQGASKHFMAFGGGMRFCVGTDFTKVQMAMFIHSLVTKYRWRPIKGGNILRTPGLQFPNGFHVQIMKKDQRKQQEP

SEQ ID NO: 183644 - protein, 419 aa, Glycine max
  Coding DNA Sequence Number=SeqID_66866
  Gene Ontology: Cellular component=endoplasmic reticulum
  Homolog annotation: Hit_ID=Q2PGG6; Match level="QueryCoverage=94%, HitCoverage=59%, E-value=1e-169, Identity=68%"; Hit description =Generative cell specific-1
MALCSAITLMIIFILSSFHVVGIQIISKSKLEKCEKNSNSDDNLNCTTKIVLNMAVPSGSSGGEASIVAELVEVEENSSRKMQTLRITPVITVNKTSAYALYQLTYIRDVPYKPEEYYVKTRKCEPDAGANVVKICERQAILRDEEGHIIEYTQPICCPCGPQRWMPSSCGNFFDKLTKGKANTAHCVHFPGDWFHVFGIGQRTLGFSVQIQVKSGTKVSEVVVGPQNRTVISDDKFFRVNLIGDFVGYTNIPSFEDFYLVVPRQGSPGQPQDLGRNISMWMLLERVRFTLDGIECNKIGVNYEAFNQQPNFCPSPFWTCLHNQLWNFRESAGSYSFSIGITEVLNTNLVLELSANDVEYVYQRSPGKIISVSVPTFAALTQFGVATITTKNTGEVEASYSLTICIILISILVAQFFKA

SEQ ID NO: 183645 - protein, 161 aa, Glycine max
  Coding DNA Sequence Number=SeqID_66867
  Pfam annotation: Domain name=QLQ; Domain location=13-49; Score=43.4; E_value=7.7e-10; Accession=PF08880.1; Description=QLQ
MSVPPPLAAVMWMSFMVAQWPWLEHQALIFKYLKAGLSVPLDLLLPIYKSLQLMSSHPSSNGVLWEELVEEVTNLDTTFGTYEESITQSTEREATTLKTTKTEEEQSETSASPRKNKSSTSHWFKGGPMRVGELMEEWGSDGRSEGRGKRKKEMDFLRKKK

SEQ ID NO: 183646 - protein, 230 aa, Glycine max
  Coding DNA Sequence Number=SeqID_66868
  Gene Ontology: Mol. function=metal ion binding; Cellular component =integral to membrane; Biological process=ubiquitin cycle
  Homolog annotation: Hit_ID=Q6EPF2; Match level="QueryCoverage=59%, HitCoverage=34%, E-value=5e-26, Identity=47%"; Hit description=Ring zinc finger protein-like
  Subcellular localization annotation: CTP_CleavageSite=64; ConfidenceScore=5.34e-01
MATTRSSSEDIVDSTPLLANSAGSSDDLTSGRRFARRQRLRQAAQFLRQASGRRMMREPSMLVREAAAEQLEERQSDWAYSKPVVVLDIVWNLAFVVVAGTVLVLSASEAPGMPLRLWIVGYAMQCVLHMVFVCVEYRRRRRQQPAAASSVQDRVGSSSGNLSVSSREGSASASASAQNVLLGQLDDESTRANVSTVIRLLPFDLEVNMDLNPGSSLSACEDMVVYNDHP

SEQ ID NO: 183647 - protein, 191 aa, Glycine max
  Coding DNA Sequence Number=SeqID_66869
  Gene Ontology: Mol. function=protein serine/threonine kinase activity; Biological process=regulation of transcription, DNA -dependent
  Homolog annotation: Hit_ID=O82754; Match level="QueryCoverage=74%, HitCoverage=22%, E-value=7e-13, Identity=38%"; Hit description =Putative serine/threonine kinase
MVTKTPLYEDGELVGVITVSSDAAILNTTNSDNQRAYQSGNNGQPGVQRLNLKRIQWPPRPMIAPMPHIASCVSNLASKLLPVLNSTDNTVSKNTSTDANDEKLEKRGIYAARVLAKLQTGAPAKSDSSGSNRVNKENDSFGGLLPLNQHQDVAIGADKEEDLNKCNSLFAMKRADTNVCACRASNVVKDS

SEQ ID NO: 183648 - protein, 141 aa, Glycine max
  Coding DNA Sequence Number=SeqID_66870
  Gene Ontology: Mol. function=metal ion binding; Cellular component =integral to membrane; Biological process=ubiquitin cycle
  Homolog annotation: Hit_ID=Q7XIK9; Match level="QueryCoverage=83%, HitCoverage=32%, E-value=1e-41, Identity=64%"; Hit description =Putative RES protein
  Pfam annotation: Domain name=zf-C3HC4; Domain location=86-126; Score =37.1; E_value=6.2e-08; Accession=PF00097.15; Description=Zinc finger, C3HC4 type (RING finger)
MGSELGQFLIDCESKLGDSRCLSYTWNRSEGASKEDIEQLSKFKFRRIESNEKLTGTIQGPVGGIMTECQADSPIEHALAEEDAECCICLSSYDDGVELRELPCGHHFHCVCVDKWLYINATCPLCKYNILKSSNLSQEEV

SEQ ID NO: 183649 - protein, 119 aa, Glycine max
  Coding DNA Sequence Number=SeqID_66871
LPCACELQRYDGGNILLDAVHMYWRRLSFSDQGLCEAEVSIKEEMDRIYKRFEKLYVCGKVNTKGALKKLMKRSQRSTKCELSYWEYVDAYHSVQNSNTSIRRTTSSSEPPKPARMISM

SEQ ID NO: 183650 - protein, 88 aa, Glycine max
  Coding DNA Sequence Number=SeqID_66872
MDDLHGTLGYSRRKGSKNLRELASGDYLTFGALIWRGKLTGLTLLLLTGSETIVFGVGSLGERRTHAYNQQLLGLGDVKGVAPTTSLA

SEQ ID NO: 183651 - protein, 267 aa, Glycine max
  Coding DNA Sequence Number=SeqID_66873
  Gene Ontology: Mol. function=transferase activity; Biological process= flavonoid biosynthetic process
  Homolog annotation: Hit_ID=O64470; Match level="QueryCoverage=92%, HitCoverage=55%, E-value=2e-43, Identity=39%"; Hit description =Putative anthranilate N-hydroxycinnamoyl/benzoyltransferase
  Pfam annotation: Domain name=Transferase; Domain location=1-265; Score=-66.4; E_value=9.7e-08; Accession=PF02458.6; Description =Transferase family
MSTVTASYNVTPNEPTPNVSMGLSESDQVVRWTHAPTIYIYKENQTQNALERMRDSLSRILVHYYPLAGRLTWIEGGRVALNCNTKGVTLIEAESPKTMDDYGDITTNEKLMSELIPMVDYSQPIEELPLLLVQLTRLKGSSNQGLAIGVAISHVLCDGVAAITFINAWAKLTRGEALDSIEMFPFLDRTIINSTYPPRTPRFDHPALKPLPLKLGSTDTKEEQEKEKTSMMLRLTSQQVEKLKKKANDERPKKDGITSKHTEIDYF

SEQ ID NO: 183652 - protein, 133 aa, Glycine max
  Coding DNA Sequence Number=SeqID_66874
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=70%, HitCoverage=6%, E-value=6e-45, Identity=98%"; Hit description=DNA -directed RNA polymerase beta'' chain
MDLEKRVDTWNGRITKILGIPWGFLIGAELTISAKSYFFAERAGRSLEEAICYRVLLLGITKTSLDTQSFISEASFQETARVLSKAALRGRIDWLKGLKENVVLGGMIPVGTGFKRIMNRSKQRQYNKMTSET

SEQ ID NO: 183653 - protein, 237 aa, Glycine max
  Coding DNA Sequence Number=SeqID_66875
  Homolog annotation: Hit_ID=Q7N9N3; Match level="QueryCoverage=32%, HitCoverage=37%, E-value=2e-27, Identity=74%"; Hit description =Similar to putative membrane protein YicG of Escherichia coli
DRRLQPSQLAFAGLLLELPLGAGGGGPVRVFAHGQHAQRRPGPGVARALAGLVGGETRLHIGADAGVIAAIAAFEQERGAALVPAEGAGSHDRSGRWAGIPPTMHSTRRAGERQKDSGSGTGHRHPVIAQAVAVVAHGRPHRARSLSHAAVHHLPDCHFRRGHDRRTVRRPPPHGPVRRGHDRLRHRPRRRITARHPARPLSAGLGEASRVPGLHRMRGADRHLGRTLDAPLPPDLP

SEQ ID NO: 183654 - protein, 94 aa, Glycine max
  Coding DNA Sequence Number=SeqID_66876
MTAFFVSENVILDVTPSNTCADIVSSLKWRLKLEGKFGAKASSVQGNALKIVAKPEFQAKLKFRQRAKDSSLAKQELVAEEEFCCVHLRSVYFG

SEQ ID NO: 183655 - protein, 211 aa, Glycine max
  Coding DNA Sequence Number=SeqID_66877
  Gene Ontology: Mol. function=DNA binding
  Homolog annotation: Hit_ID=Q9LTJ8; Match level="QueryCoverage=33%, HitCoverage=9%, E-value=7e-10, Identity=42%"; Hit description =Arabidopsis thaliana genomic DNA, chromosome 5, BAC clone:F17P19
  Pfam annotation: Domain name=MBD; Domain location=148-207; Score=5.5; E_value=0.01; Accession=PF01429.10; Description=Methyl-CpG binding domain
  Pfam annotation: Domain name=MBD; Domain location=25-113; Score=0.2; E_value=0.035; Accession=PF01429.10; Description=Methyl-CpG binding domain
  Pfam module annotation: Pfam domain module=MBD::MBD; Domain location =148-207::25-113
MNTLNGYLMTGMWTSELEKVVQIWVMGIRQSKGPLAKCSILRLFMAGTSQGHPQICIEYCYIAPSGHKFYSKPEVLRYLDTVNINSNSHTSKKEKICKSNLPFFFLLSLVIHYTSKDTVEKSTIEDLPPGQIKEVKIRKGSNDNRDVVEKSPVEDLPPGWITEAKVRKGDTGNRKDMFYIDPVSGYVFRSKKDALRYVKSGDIMVAFIKYV

SEQ ID NO: 183656 - protein, 126 aa, Glycine max
  Coding DNA Sequence Number=SeqID_66878
MGEEVSYKTEPESELHSVPQEHNSSAQEKELEKPEPPNDKVTPPSPVAAQEVADHASKKDTEESVDKGHSLINKLKLLKVQEKRNIFHIVLPDAMLAKVLTEKRLALIKAWEESEKTKAENRQVLI

SEQ ID NO: 183657 - protein, 741 aa, Glycine max
  Coding DNA Sequence Number=SeqID_66879
  Gene Ontology: Mol. function=protein binding; Cellular component =membrane; Biological process=defense response
  Homolog annotation: Hit_ID=Q1S607; Match level="QueryCoverage=97%, HitCoverage=57%, E-value=0.0, Identity=49%"; Hit description=Disease resistance protein; AAA ATPase
  Pfam annotation: Domain name=LRR_1; Domain location=356-377; Score =8.5; E_value=7.4; Accession=PF00560.23; Description=Leucine Rich Repeat
  Pfam annotation: Domain name=LRR_1; Domain location=379-401; Score =12.7; E_value=1.2; Accession=PF00560.23; Description=Leucine Rich Repeat
  Pfam annotation: Domain name=LRR_1; Domain location=403-424; Score =4.4; E_value=43; Accession=PF00560.23; Description=Leucine Rich Repeat
  Pfam annotation: Domain name=LRR_1; Domain location=535-556; Score =4.8; E_value=36; Accession=PF00560.23; Description=Leucine Rich Repeat
  Pfam annotation: Domain name=LRR_1; Domain location=621-644; Score =10.2; E_value=3.6; Accession=PF00560.23; Description=Leucine Rich Repeat
  Pfam annotation: Domain name=LRR_1; Domain location=712-735; Score =1.4; E_value=1.5e+02; Accession=PF00560.23; Description=Leucine Rich Repeat
  Pfam annotation: Domain name=NB-ARC; Domain location=1-215; Score =76.4; E_value=8.9e-20; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=356-377::379-401::403 -424::535-556::621-644::712-735::1-215
MEESFGLALQKKRHQNGGQLDALRVELKNNLKDKKFLLVLDDLWNEKYNDWHHLIAPFSSGKKGSKIIVTTRQQKVAQMTHTYPIYELKHLTDENCWCILAEHAFGNEGYNEYPILEETGKKIAKKCNGLPLAAKTLGGLLRSNVDEKEWDRILNSNLWAHEEVLPALHISYLHLPAHLKRCFAYCSIFPKQHLLDRKELILLWMAEGFLQQIHGEKAMESVGDEYFNELLSRSLIEKDNTKAEEKFRMHDLIYDLAKLIYGKSCCCFESGEISGTVRHLAFHSNLYDVSKRFEGLYEQKFLRTFLAARNYLYGEYCVTKKVSHDWLQKLRYLRTLSLLKYENITELPESVSILVLLRYLDLSYTSIKRLPDATCRLYNLLTLKLSHCEFLTQLPEQIGNLVNLPHLDIRDTNLLAMPAQISKLQDLRVLTSFIVGREDGVTIGELRKFPYLQGMLSILKLQNVVDPKDAFLAALKKKEHIEELTLEWGSEPQDSSIEKFVLKNLQPSTNLKKLNIRSYSGTSFPKWLGDSSYSNVIVLCISDCNYCFSLPPFGQLPSLKELVIKSMKMVKTVGEEFYCNDGGSLSFQPFQLLESIEFEEMSEWEEWLQFEGEGSKFPFPCLKRLSLSKCPKLRGNLPKHLPSLTEISIKECNQLAIESCHLHWNTSIESVKVSEVGEGLLSLLDNFSYRELSIEKCDSLSCLPRMILAANCLQKLTLGNIPTLISFPAEGFPTSLKTVRT

SEQ ID NO: 183658 - protein, 165 aa, Glycine max
  Coding DNA Sequence Number=SeqID_66880
  Subcellular localization annotation: CTP_CleavageSite=86; ConfidenceScore=5.64e-01
MNLLPSAVHVSSTFESGARRIHCLAKFANSPFSSFIRSPMNSLPSAVHVSSTFESGAPRIDRLALFANSPFSTFIRSPMNSLTSVVHAYSTNESGAPRIDCLALFANSPFSTFIRSPMNSLPSAVHVSSTNESGAPRIHCQAKFASSPFSTFIRSPMNFLPSVVH

SEQ ID NO: 183659 - protein, 85 aa, Glycine max
  Coding DNA Sequence Number=SeqID_66881
FDEFRIELVKRNSHRTLTNLMEGSIDVALVKEFYANLYVPGDKPPKHVRVRGHLIKFDVDSLKTFLETPIVLEPGETDRGRTRIK

SEQ ID NO: 183660 - protein, 136 aa, Glycine max
  Coding DNA Sequence Number=SeqID_66882
  Gene Ontology: Mol. function=helicase activity
  Homolog annotation: Hit_ID=Q9LTU4; Match level="QueryCoverage=97%, HitCoverage=9%, E-value=5e-32, Identity=48%"; Hit description =Helicase-like protein
MGESERLSYIRNNQKKLRVDKYSSLQTSLDTRTAKGLTKGKRVILPSMLVGSPRYMDQLYFDGMAICSHVGFPNLFITLICNPNWPEIRRLLSPLNLKPTDRPDIVSRIFRLKYKHMLPDLTKGQLLGKVVAYIHG

SEQ ID NO: 183661 - protein, 50 aa, Glycine max
  Coding DNA Sequence Number=SeqID_66883
MRTRSPLKAKACSPLQARMCSPLMARTYSPLKVIAGNLLGENFSSAPRFA

SEQ ID NO: 183662 - protein, 82 aa, Glycine max
  Coding DNA Sequence Number=SeqID_66884
MEINYEPWGTPRYHSSKGGVVLAEVLLADSRFTRPDMGFHPTKLNFVPSDADEAPLDVSICLHAFGIVGCGSFSGVKSCERE

SEQ ID NO: 183663 - protein, 70 aa, Glycine max
  Coding DNA Sequence Number=SeqID_66885
  Subcellular localization annotation: CTP_CleavageSite=39; ConfidenceScore=5.01e-01
MTHQDFQVQAIGQFAQATCAPEFGLPRPFNQRLLVLHVGGVAVKQRVKKFVFLEKRVVKNRMLDKWPQLS

SEQ ID NO: 183664 - protein, 90 aa, Glycine max
  Coding DNA Sequence Number=SeqID_66886
MGFPSPAVTYPAENLSAFYSLSLEVIPLSFASGERMRIPFLQAKVQKGLRLCFNGVFYRGNPILISGAKQIWVSRCRCRAELPYHSIRHA

SEQ ID NO: 183665 - protein, 204 aa, Glycine max
  Coding DNA Sequence Number=SeqID_66887
  Gene Ontology: Mol. function=protein binding; Cellular component =integral to membrane; Biological process=defense response to fungus
  Homolog annotation: Hit_ID=Q1SWI6; Match level="QueryCoverage=79%, HitCoverage=73%, E-value=3e-44, Identity=56%"; Hit description =Leucine-rich repeat, plant specific
  Pfam annotation: Domain name=Conotoxin; Domain location=7-66; Score =5.9; E_value=0.051; Accession=PF02950.8; Description=Conotoxin
  Pfam annotation: Domain name=LRRNT_2; Domain location=26-66; Score =51.6; E_value=2.6e-12; Accession=PF08263.3; Description=Leucine rich repeat N-terminal domain
  Pfam annotation: Domain name=LRR_1; Domain location=115-140; Score =8.7; E_value=6.7; Accession=PF00560.23; Description=Leucine Rich Repeat
  Pfam annotation: Domain name=LRR_1; Domain location=142-164; Score =11.4; E_value=2.1; Accession=PF00560.23; Description=Leucine Rich Repeat
  Pfam annotation: Domain name=LRR_1; Domain location=190-204; Score =1.8; E_value=1.3e+02; Accession=PF00560.23; Description=Leucine Rich Repeat
  Pfam module annotation: Pfam domain module=Conotoxin::LRRNT_2::LRR _1::LRR_1::LRR_1; Domain location=7-66::26-66::115-140::142-164::190 -204
MNSSIYILVFVHLLLLSLPCRESVCIPSERETLLKFKNNLIDPSNRLWSWNPNHTNCCHWYGVLCHNLTSHLLQLHLNTTVPAFEFDGYPHFDEEAYRRWSFGGEISPCLADLKHLNYLDLSGNVFLREGMSIPSFLGTMTSLTHLNLSATGFYGKIPPQIGNLSNLVYLDLSYVFANGRVPSPIGNLSKLRYLDLSHNYFLGE

SEQ ID NO: 183666 - protein, 67 aa, Glycine max
  Coding DNA Sequence Number=SeqID_66888
LGRIDGDPVLRKTRIWATWEYVSSVGGGQQGMSGTWRYVAGVRRPWGRQVGCYCPKPSLTNPDPTRA

SEQ ID NO: 183667 - protein, 445 aa, Glycine max
  Coding DNA Sequence Number=SeqID_66889
  Gene Ontology: Mol. function=signal transducer activity; Cellular component=membrane; Biological process=signal transduction
  Homolog annotation: Hit_ID=UPI00005F7B3B; Match level="QueryCoverage =65%, HitCoverage=52%, E-value=6e-71, Identity=52%"; Hit description =COG0840: Methyl-accepting chemotaxis protein
  Pfam annotation: Domain name=HAMP; Domain location=105-174; Score =25.2; E_value=0.00024; Accession=PF00672.15; Description=HAMP domain
  Pfam annotation: Domain name=MCPsignal; Domain location=205-427; Score=229.3; E_value=8.4e-66; Accession=PF00015.11; Description =Methyl-accepting chemotaxis protein (MCP) signaling domain
  Pfam module annotation: Pfam domain module=HAMP::MCPsignal; Domain location=105-174::205-427
MAGIYGSTVLRDMHQRELHNATLTSQLLFLNRASLVMASGTTAAKAAVATDAPADSDWAPLRTALTASPADFAVPAAERLHFLQRDIAANNHADQSDRQRLQMAFGIAALLMLALLLFCDRFLVTHLVRPLGALREHFRGIAAGDLTREPQDFGRNCVGQLIPLVRLMQQSLLTTVRAVHDNTDVLRKESADIASGNADLSDRTTRQAAALEQTSASMEQLSATVEKNAHSAGEARELAEDAARTTRDGEALVKSVSAMMADIAAEADKIRQFTATVNSIAFQTNILALNAAVEAARAGEQGRGFAVVAAEVRTLAQRSASAAKEIEGLINGTVTRVGEGAQTAQRAGAIMDSATQSVSAVTSLIGQIALASDEQSKGIAQVTLAVTDLDRVTQQNAALVKEIATSAGSLNGRTGTLAAPTARGSIRVTTSGTGTAAVAASLASL

SEQ ID NO: 183668 - protein, 302 aa, Glycine max
  Coding DNA Sequence Number=SeqID_66890
  Gene Ontology: Cellular component=outer membrane-bounded periplasmic space; Biological process=cell adhesion
  Homolog annotation: Hit_ID=UPI00005F7465; Match level="QueryCoverage =52%, HitCoverage=84%, E-value=1e-71, Identity=83%"; Hit description =COG2335: Secreted and surface protein containing fasciclin-like repeats
  Pfam annotation: Domain name=Fasciclin; Domain location=31-167; Score= 119.7; E_value=8.6e-33; Accession=PF02469.12; Description=Fasciclin domain
MAAMHADSVMVGGAAMYPQKNIIENALNSKDHTTLVAAVKAAGLVDTLQGKGPFTVFAPTNAAFAKLPAGTVDALLKPENKAKLTSVLTYHVVAGKYDMKALEQKIKQGGGKAELKTVNGQPLWIMSNGPHNIQLKDGQGNVANISTYDVNQKNGVIDAEQQIALIQAVAKRDRLAFEQLYRLTSPHLFAVALRMLRQRAWAEEILHECYITVWHNAAGYARQFHADEAWLDDLSSTPVNSASRLRWPIIRAYHIATLPGGCSSRSARLKAGFDVAWTICGTQTAGRAGAGGAGRPLADAAG

SEQ ID NO: 183669 - protein, 261 aa, Glycine max
  Coding DNA Sequence Number=SeqID_66891
  Gene Ontology: Cellular component=periplasmic space
  Homolog annotation: Hit_ID=Q8ZPL8; Match level="QueryCoverage=98%, HitCoverage=51%, E-value=3e-65, Identity=50%"; Hit description =Putative periplasmic protein
  Pfam annotation: Domain name=DUF945; Domain location=2-245; Score= -40.4; E_value=2.1e-09; Accession=PF06097.2; Description=Bacterial protein of unknown function (DUF945)
TITLDKLDASINGQEGLTLEKLDGKSSFDNKDGKIGGQIDYQVDSISLQKQPFGEAKLAMKFAQFDAQAVKTFSDQYNAQMQDLLNQPGVVDDPIRYQASVQTILRNNLPTLLKGSPTVSVAPLSWKNDKGESTFNLNVGFNDPATVTGEPQSLGAAVDRVLKTLDGKLSINMPMATEVMRHVGLAEGYQGDDAQKLADQQVKGLAAMGQMFRLTQQQDDNITTSLQYANGQVTMNGDKMTLEQFLSRYMLGAPTSEGMPE

SEQ ID NO: 183670 - protein, 67 aa, Glycine max
  Coding DNA Sequence Number=SeqID_66892
GLVGACALSTTLDCLARISEFRLNACLFAQQMDLSGALSGISLRSVNMHSSSFFQILPRAQPKEWCT

SEQ ID NO: 183671 - protein, 118 aa, Glycine max
  Coding DNA Sequence Number=SeqID_66893
NEDKGYVGVRELIWRWATRDGGLYVICGCGELLCTIARPPPSTTCDGMVPGDMSQGSGDLGDVRRAPDSQQIKGTKTTKQGGLCGGWPAVNFVLENEVRKLGELLVIDYQRGVIDYQA

SEQ ID NO: 183672 - protein, 104 aa, Glycine max
  Coding DNA Sequence Number=SeqID_66894
MGVQIATRPTWAIQKIPPEGGCFWRKPPCSPGRARGRSEVEKGSALRVIQNHLKLLRKIISVKKIQAEALPKRFRNISVSNYAKILDRSSTFIVRSSFSSVFNG

SEQ ID NO: 183673 - protein, 64 aa, Glycine max
  Coding DNA Sequence Number=SeqID_66895
FRWQGGSLVEWCFARMKLVSYLYFPFISNKSKEGQLSYPNFVRGPTIVGMRPSFDHFEVFGTHR

SEQ ID NO: 183674 - protein, 290 aa, Glycine max
  Coding DNA Sequence Number=SeqID_66896
  Homolog annotation: Hit_ID=Q47522; Match level="QueryCoverage=21%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIHAWLERRNTVARIHNYTVNFGPQHPAAHGVLPYFGARRRKNFTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 183675 - protein, 167 aa, Glycine max
  Coding DNA Sequence Number=SeqID_66897
MDDEVPLQAPPSPIHLDHFIHQGPPAIDPNLSKEDLARLWFPMAFLSENAYNIQKRIEVLPPPIWKHLHPMISKPTSAAALHKSVYKISSRAYREIVQYDKDIIGLCRKINAQQIDPSFDDFVPPFLHPKNIQLFTPMSQFVPLVYDHQAIPLTKEDIFNIGMILMQ

SEQ ID NO: 183676 - protein, 113 aa, Glycine max
  Coding DNA Sequence Number=SeqID_66898
MPNRVALRLPPLDLQKRKGNVLPHSKPMPHSGPKDNLALHPIPYDWDKYFTRDAATKTFTLKPDIELNQNNALLFYFKDMYEKLTSCIHFKVRQGRHLQSHAYGADPTSNKDL

SEQ ID NO: 183677 - protein, 79 aa, Glycine max
  Coding DNA Sequence Number=SeqID_66899
MRGYIMVTRTFRQPGENEPVDARRLTSSSAPFVVLTREVSDMRGDFMVTRTFRQPGANEPVDARRLTSSSAPFVVLTRE

SEQ ID NO: 183678 - protein, 253 aa, Glycine max
  Coding DNA Sequence Number=SeqID_66900
  Gene Ontology: Mol. function=oxidoreductase activity, acting on NADH or NADPH; Cellular component=membrane; Biological process=electron transport
  Homolog annotation: Hit_ID=Q1XV28; Match level="QueryCoverage=74%, HitCoverage=45%, E-value=3e-68, Identity=64%"; Hit description=NADH dehydrogenase
  Pfam annotation: Domain name=Complex1_30kDa; Domain location=8-76; Score=101.1; E_value=3.4e-27; Accession=PF00329.9; Description =Respiratory-chain NADH dehydrogenase,
MTNFRIRLKVFMSRENIEVDSLTDLYAGANWMERETYDFFGIKFKGHPDLRPILNMEDLGYHPMLKEYRLEDDNSLSNILNQYESKEQIDGQLYTLNLGPTHPATHGIFQNVLTMDGERILHAEQTVGYIHRAFEKISERRNYTQITTLTDRMNYCSAPINNLGWHMTVEKLIGIEVPKRVDYIRVILMELARIGDHLICNGVTGMDSGAITGLTYMFIERERIYDIYEQICGARMTTNMGRIGGFERDLTPK

SEQ ID NO: 183679 - protein, 280 aa, Glycine max
  Coding DNA Sequence Number=SeqID_66901
  Gene Ontology: Mol. function=protein binding; Cellular component =integral to membrane; Biological process=xylan catabolic process
  Homolog annotation: Hit_ID=Q1SWI7; Match level="QueryCoverage=99%, HitCoverage=90%, E-value=8e-72, Identity=33%"; Hit description =Leucine-rich repeat
  Pfam annotation: Domain name=LRR_1; Domain location=104-126; Score =3.7; E_value=58; Accession=PF00560.23; Description=Leucine Rich Repeat
  Pfam annotation: Domain name=LRR_1; Domain location=128-150; Score =10.5; E_value=3.1; Accession=PF00560.23; Description=Leucine Rich Repeat
  Pfam annotation: Domain name=LRR_1; Domain location=152-175; Score =13.3; E_value=0.88; Accession=PF00560.23; Description=Leucine Rich Repeat
  Pfam annotation: Domain name=LRR_1; Domain location=177-199; Score =10.8; E_value=2.8; Accession=PF00560.23; Description=Leucine Rich Repeat
  Pfam annotation: Domain name=LRR_1; Domain location=201-223; Score =14.5; E_value=0.4; Accession=PF00560.23; Description=Leucine Rich Repeat
  Pfam annotation: Domain name=LRR_1; Domain location=31-54; Score=3.2; E_value=71; Accession=PF00560.23; Description=Leucine Rich Repeat
  Pfam annotation: Domain name=LRR_1; Domain location=7-29; Score=6.8; E_value=15; Accession=PF00560.23; Description=Leucine Rich Repeat
  Pfam annotation: Domain name=LRR_1; Domain location=80-101; Score =12.6; E_value=1.3; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=104-126::128-150::152- 175::177-199::201-223::31-54::7-29::80-101
MWEALSQVLYLNLSRNHIHGEIGTTLKNPISIPTIDLSSNHLCGKLPYLSSDVFRLDLSSNSFSESMNDFLCNDQDEPMQLEFLNLASNNLSGEIPDCWMNWTLLVDVNLQSNHFVGNLPQSMGSLAELQSLQIRNNTLSGIFPTSLKKNNQLISLDLGENNLSGTIPTWVGENLLNVKILRLRSNSFAGHIPSEICQMSHLQVLDLAQNNLSGNIRSCFSNLSAMTLMNQSTDPRIYSQAQSSMPYSSMQSIVSALLWLKGRGDEYRNFLGLVTSIDLS

SEQ ID NO: 183680 - protein, 87 aa, Glycine max
  Coding DNA Sequence Number=SeqID_66902
  Gene Ontology: Mol. function=zinc ion binding
ISSWYGSGEGNTVNVTTRRSNNKGFRLFWSFKPCIDGFQYCKPMVKVDGTSLYNKYKGTLLVKVTQDDNNKILRIAFAVVDSETTGA

SEQ ID NO: 183681 - protein, 97 aa, Glycine max
  Coding DNA Sequence Number=SeqID_66903
  Homolog annotation: Hit_ID=Q6Q2Z9; Match level="QueryCoverage=54%, HitCoverage=5%, E-value=4e-16, Identity=75%"; Hit description =Phosphoenolpyruvate carboxylase
MTDITDDIAEEISFQGFEDDCKLLGNLLNDILQREAGSTFVDKLEKIRVLSQSLVLFGCGGNGRRLKHDMRNAHACGVLVLCKDSNNDGAKPLMLEI

SEQ ID NO: 183682 - protein, 125 aa, Glycine max
  Coding DNA Sequence Number=SeqID_66904
MLAFPFQNVAKLYRLRNKACLDFRNVAKLYGLCNNACFDFQIVAELHGLCNNAWFDFWSVTKLYGLCNKAYFDFRRDQTKFASRPPVSPDEIRKEQKGSRKVSTNLSALEAVKPDVQDVPACHQT

SEQ ID NO: 183683 - protein, 199 aa, Glycine max
  Coding DNA Sequence Number=SeqID_66905
  Gene Ontology: Mol. function=peptidase activity; Cellular component =membrane; Biological process=proteolysis
  Homolog annotation: Hit_ID=Q1SAR7; Match level="QueryCoverage=95%, HitCoverage=43%, E-value=1e-56, Identity=54%"; Hit description =Eukaryotic aspartyl protease, putative
MKTSSPSTLALVLFYLCNIFYLEAFNGGFSVEMIHRDSSRSPFFSPTETQFQRVANAVHRSINRANHLNQSFVSPNSPETTVISALGEYLISYSVGTPSLQVFGILDTGSDIIWLQCQPCKKCYEQTTPIFDSSKSQTYKTLPCPSNTCQSVQGTFCSSRKHCLYSIHYVDGSQSLGDLSVETLTLGSTNGSPVQFPGT

SEQ ID NO: 183684 - protein, 426 aa, Glycine max
  Coding DNA Sequence Number=SeqID_66906
  Gene Ontology: Mol. function=peptidase activity; Cellular component =anchored to membrane; Biological process=proteolysis
  Homolog annotation: Hit_ID=Q1SAR7; Match level="QueryCoverage=90%, HitCoverage=94%, E-value=1e-115, Identity=53%"; Hit description =Eukaryotic aspartyl protease, putative
  Pfam annotation: Domain name=Asp; Domain location=98-421; Score= -110.6; E_value=4.5e-07; Accession=PF00026.14; Description=Eukaryotic aspartyl protease
MKREWARESEWEERKRARRTCNRGKNNEHLDRRGKGESEKDNGNVEMIHRDSSRSPFFRPTETQFQRVANAVHRSVNRANHFHKAHKAAKATITQNDGSDMIWLQCKPCEKCYNQTTRIFDPSKSNTYKILPFSSTTCQSVEDTSCSSDNRKMCEYTIYYGDGSYSQGDLSVETLTLGSTNGSSVKFRRTVIGCGRNNTVSFEGKSSGIVGLGNGPVSLINQLRRRSSSIGRKFSYCLASMSNISSKLNFGDAAVVSGDGTVSTPIVTHDPKVFYYLTLEAFSVGNNRIEFTSSSFRFGEKGNIIIDSGTTLTLLPNDIYSKLESAVADLVELDRVKDPLKQLSLCYRSTFDELNAPVIMAHFSGADVKLNAVNTFIEVEQGVTCLAFISSKIGPIFGNMAQQNFLVGYDLQKKIVSFKPTDCSKQ

SEQ ID NO: 183685 - protein, 59 aa, Glycine max
  Coding DNA Sequence Number=SeqID_66907
  Gene Ontology: Mol. function=peptidase activity; Biological process =proteolysis
  Homolog annotation: Hit_ID=Q1SAR7; Match level="QueryCoverage=95%, HitCoverage=13%, E-value=5e-14, Identity=63%"; Hit description =Eukaryotic aspartyl protease, putative
VTLNAINTFVQVADDVVCFAFQPTETGAVFGNLAQQNLLVGYDLQMNTVSFKHTDCTKQ

SEQ ID NO: 183686 - protein, 70 aa, Glycine max
  Coding DNA Sequence Number=SeqID_66908
MAINNTRHPIGKDMGYNDGDGSRMWWCWVVLGFVRGKLPPLACYCTMLSMSSSGVVSGWYGVLGNQYSYK

SEQ ID NO: 183687 - protein, 385 aa, Glycine max
  Coding DNA Sequence Number=SeqID_66909
  Gene Ontology: Mol. function=transferase activity, transferring glycosyl groups; Cellular component=phagocytic vesicle; Biological process='de novo' pyrimidine base biosynthetic process
  Homolog annotation: Hit_ID=Q1RU71; Match level="QueryCoverage=99%, HitCoverage=82%, E-value=1e-172, Identity=80%"; Hit description =Phosphoribosyltransferase; Orotidine 5-phosphate decarboxylase (Uridine 5'-monophosphate ...
  Homolog annotation: Hit description=synthase (Ump synthase) [includes: orotatephosphoribosyltransferase (Ec 2.4.2.10) (Oprtase); orotidine 5'-phosphate decarboxylase (Ec 4.1.1.23) (Ompdecase)])
  Pfam annotation: Domain name=OMPdecase; Domain location=153-372; Score=286.9; E_value=3.9e-83; Accession=PF00215.14; Description =Orotidine 5'-phosphate decarboxylase  HUMPS family
  Pfam annotation: Domain name=Pribosyltran; Domain location=1-70; Score=-5.4; E_value=0.017; Accession=PF00156.17; Description =Phosphoribosyl transferase domain
  Pfam module annotation: Pfam domain module=OMPdecase::Pribosyltran; Domain location=153-372::1-70
MVMRRKEIKDYGTSKAIEGDFKHGQSCLIIEDLVTSGTSVLETAAPLRATGLKVSDTVVLIDREQGGRENLESNGIKLHAILKLTEMVKILREKGKLDKQMLGVVMRFLEENQKVAALATTAKVKAFTFMERAKLSKNPTGKRLFEIMAKKESNLCLAADVGTAAELLEIADKVGPEICLLKTHVDILPDFTPDFGSKLRLIAEKHNFLIFEDRKFADIGNTVTMQYEGGIFHILEWADIVNAHIISGPGIVEGLKLKGLPRGRGLLLLAEMSSAGNLAKGDYTTAAVKIAEDHSDFVIGFISVNPASWPGAPINPSFVHATPGVQMVTGGDALGQQYSTPHSVVYDGGSDIIIVGRGIIKAANPAQAAREYRLQGWNAYLAKCS

SEQ ID NO: 183688 - protein, 353 aa, Glycine max
  Coding DNA Sequence Number=SeqID_66910
  Gene Ontology: Mol. function=zinc ion binding; Cellular component =nucleus; Biological process=ubiquitin-dependent protein catabolic process
  Homolog annotation: Hit_ID=Q1SAT0; Match level="QueryCoverage=85%, HitCoverage=99%, E-value=1e-161, Identity=87%"; Hit description =Seven in absentia protein family, putative
  Pfam annotation: Domain name=Sina; Domain location=98-297; Score =411.4; E_value=1.3e-120; Accession=PF03145.7; Description=Seven in absentia protein family
MASSNLFFDDIRSKVDVDPPQNEESTDVGELLNDPAQTALKPNGTVSSSVRELLECPVCLNAMYPPIHQCSNGHTICSGCKPRVHNRCPTCRHELGNIRCLALEKVAASLELPCKYQGFGCIGIYPYYSKLKHESQCAHRPYNCPYAGSECSIMGDIPYLVAHLKDDHKVDMHNGSTFNHRYVKSNPQEVENATWMLTVFSCFGQYFCLHFEAFQLGMAPVYIAFLRFMGDDDEAKNYSYSLEVGGNGRKMIWQGVPRSIRDSHRKVRDSFDGLIIQRNMALFFSGGDRKELKLRVTVARKWELHQMDVHNGFLHMDLEEEKCSWLTVVKIRDFNQVVPDFGKLATRTSLSFP

SEQ ID NO: 183689 - protein, 58 aa, Glycine max
  Coding DNA Sequence Number=SeqID_66911
MDMPLQFATSWPPLTFIHFEKQLTYGWSQIVAPYFPLGFRYWRPVGFQILEARYVYTT

SEQ ID NO: 183690 - protein, 241 aa, Glycine max
  Coding DNA Sequence Number=SeqID_66912
  Gene Ontology: Mol. function=phosphatidylserine decarboxylase activity; Cellular component=integral to membrane; Biological process=regulation of GTPase activity
  Homolog annotation: Hit_ID=Q8L7A4; Match level="QueryCoverage=80%, HitCoverage=50%, E-value=8e-85, Identity=78%"; Hit description =Putative GTPase-activating protein
  Pfam annotation: Domain name=C2; Domain location=87-166; Score=107.9; E_value=2.9e-29; Accession=PF00168.20; Description=C2 domain
MQQFVDCDDNLSCPIIPSQGRSISLALAQSSTSYYNSFMDKKPSEKQQSKHRIGNAFRNSWGRKDSEHKAAKKSTSLAGMVEFVGLIKVNVVKGTHLAIRDVMTSDPYVILSLGHQSVKTRVIKSNLNPVWNESLMLSIPENIPPLKVLVYDKDTFSTDDFMGEAEIDIQPLVIAAKAYEKSNINESMQLGKFVASNDNTLVRDGIISLDEGKIKQEISVRLQNIERGELELELECVPLTQ

SEQ ID NO: 183691 - protein, 182 aa, Glycine max
  Coding DNA Sequence Number=SeqID_66913
MTIPELFLRPYQVTWDATIFGVFNPNFPLYIKHEDLSKIAHGCQCLSILVHLTERSMRVGNSDIYGFLEPQSIQRFGQSQFETKSYIKSWMQSSKCDVYLGAYLNGGHWQMVVILPKEHLVVWFCSLHNRPNNYLKGINNRQKGSTECGFYVMHWMSIIILGSFRNNWKRILTILDHWSQRD

SEQ ID NO: 183692 - protein, 291 aa, Glycine max
  Coding DNA Sequence Number=SeqID_66914
  Gene Ontology: Mol. function=protein disulfide oxidoreductase activity; Biological process=cell redox homeostasis
  Homolog annotation: Hit_ID=Q1RU64; Match level="QueryCoverage=80%, HitCoverage=85%, E-value=6e-60, Identity=53%"; Hit description =Thioredoxin fold
  Pfam annotation: Domain name=Glutaredoxin; Domain location=117-193; Score=55.6; E_value=1.6e-13; Accession=PF00462.14; Description =Glutaredoxin
  Subcellular localization annotation: CTP_CleavageSite=46; ConfidenceScore=5.61e-01
MAEFGNNNNNGANTTSSRFSFFNRSLTTLRNEKPPQLDRSVTKLVESSRGGGGGGSVVKRLCSFFESAKSSSSEHQKLKPSKSIENSDPSVKSLDSPAKSIDSSPAIRLPGTEDRIVLYFTSLRGIRRTYEDCYAVRMIFRGFRVWVDERDISMDANYRKELMSVLFGENNNNNNKKKGHVALPQVFIRGRHVGGADVIKHMWEVGELEKVLEGLPRTKGGFVCESCGDVRFVPCGNCSGSRKVFDEDEGVLKRCGSLHDSGVVVRSVLEFQINLDYRSEAQNWGFMCVIE

SEQ ID NO: 183693 - protein, 328 aa, Glycine max
  Coding DNA Sequence Number=SeqID_66915
  Gene Ontology: Mol. function=sulfotransferase activity; Cellular component=integral to membrane; Biological process=thyroid hormone metabolic process
  Homolog annotation: Hit_ID=Q1S1F5; Match level="QueryCoverage=95%, HitCoverage=90%, E-value=1e-106, Identity=61%"; Hit description =Sulfotransferase
  Pfam annotation: Domain name=Sulfotransfer_1; Domain location=59-321; Score=335.6; E_value=8.6e-98; Accession=PF00685.17; Description =Sulfotransferase domain
MTSMGGIQENEDEKLILSLPKEKPWAQPYDLYLFQNFWCPGIHIQAVNRFQKYFEAVKDSDVVVASFPKSGTIWIKALTFSIANHHRFSPLENHPLLTTNPHELVPFLEFSFGGNIQDQILHLSNMTEPRIFGTHTPFTSLPKSIKESNCKLVYICRDPFDNFVSAWNYFNKVKPMSLPALTMEEAFEKYCNGIMDYGPWWSHMLGYWNESIANPNKVLFLKYEDLKEDTHFHVKRIAKFLGCPFTQEEESNGVIQSIIKLCSFENMKSLEVNKSGKIGRGNIEKKDFFRKGEKGDWVNYFTPSMQEKLSAIVEEKLSGSGLSFKKCF

SEQ ID NO: 183694 - protein, 132 aa, Glycine max
  Coding DNA Sequence Number=SeqID_66916
  Gene Ontology: Mol. function=sulfotransferase activity; Cellular component=integral to membrane
  Homolog annotation: Hit_ID=Q1T3I3; Match level="QueryCoverage=92%, HitCoverage=77%, E-value=4e-33, Identity=56%"; Hit description =Sulfotransferase
MASMGGIQENEDEKLILSLPKEKPWAQPYDLYLFQNFWCPGIHIQAVNRFQKYFEAVKDSDVVVASFPKSGTIWIKALTFSIANHHRFPSLENHPLLTTNPHELVPFLEFSFGGNIQDQILHLSNMTEPRIF

SEQ ID NO: 183695 - protein, 259 aa, Glycine max
  Coding DNA Sequence Number=SeqID_66917
  Gene Ontology: Mol. function=molecular_function; Cellular component =nucleus; Biological process=postreplication repair
  Homolog annotation: Hit_ID=Q1RU54; Match level="QueryCoverage=78%, HitCoverage=66%, E-value=2e-82, Identity=86%"; Hit description =Quinonprotein alcohol dehydrogenase-like
  Pfam annotation: Domain name=WD40; Domain location=117-155; Score =12.5; E_value=1.3; Accession=PF00400.22; Description=WD domain, G -beta repeat
  Pfam annotation: Domain name=WD40; Domain location=159-197; Score =25.2; E_value=0.00024; Accession=PF00400.22; Description=WD domain, G-beta repeat
  Pfam annotation: Domain name=WD40; Domain location=201-239; Score =33.2; E_value=9.3e-07; Accession=PF00400.22; Description=WD domain, G-beta repeat
  Pfam module annotation: Pfam domain module=WD40::WD40::WD40; Domain location=117-155::159-197::201-239
MTVMHDGGREIFGSKVVTRLEDKCSSDEKLSMLRWSIHWRERLEEMMIELTVIFMVQKEYGSLLKGKRLIIQAQLCVICSGIQGIGQYCNPRRQQQLMSMLPAVGYPDNPSTSFAAKFVHTSLNKNRCPINRVLWTPTGRRLITGSQTGEFTLWNGQSFNFEMILQAHDQAIRSMVWSHNDNWMVSGDDGGAIKYWQNNMNNVKANKSAHKESVRDLSFCRTDLKFCSCSDDTTVKVWDFARCQEECSLTGNVLWMDHI

SEQ ID NO: 183696 - protein, 155 aa, Glycine max
  Coding DNA Sequence Number=SeqID_66918
  Gene Ontology: Mol. function=sulfotransferase activity; Cellular component=integral to membrane; Biological process=amine metabolic process
  Homolog annotation: Hit_ID=Q1S5L2; Match level="QueryCoverage=94%, HitCoverage=46%, E-value=1e-50, Identity=64%"; Hit description =Sulfotransferase domain
  Pfam annotation: Domain name=Sulfotransfer_1; Domain location=1-146; Score=75.5; E_value=1.7e-19; Accession=PF00685.17; Description =Sulfotransferase domain
MSLPALTMEEAFEKYCNGIMDYGPWWSHMLGYWNESIANPNKVLFLKYEDLKEDTNFHVKRIAEFLGCPFTQKEESSGVIQSIIKLCSFENMKDLEVNKSGKIGRGGIEKKDFFRKGEKGDWVNYFTPSMQEKLSAIVEEKLSGSGAILEIWGYL

SEQ ID NO: 183697 - protein, 46 aa, Glycine max
  Coding DNA Sequence Number=SeqID_66919
MDWWQHWNGDGDERIMEKEERENGYLEEGVTEEGGYPTDLAIIQYQ

SEQ ID NO: 183698 - protein, 105 aa, Glycine max
  Coding DNA Sequence Number=SeqID_66920
  Gene Ontology: Mol. function=isomerase activity; Cellular component =nucleus; Biological process=carbohydrate metabolic process
  Homolog annotation: Hit_ID=Q1RU53; Match level="QueryCoverage=93%, HitCoverage=18%, E-value=5e-47, Identity=89%"; Hit description=WD40 -like
  Pfam annotation: Domain name=WD40; Domain location=43-81; Score=38.6; E_value=2.2e-08; Accession=PF00400.22; Description=WD domain, G-beta repeat
PGHGWDVKSVDWHPTKSLLVSGGKDNLVKLWDAKTGRELCSFFILVSCSHGHKNTVLCVKWNQNGNWVLTASKDQIIKLYDIRAMKELESFRGHRKDVTMVNCGG

SEQ ID NO: 183699 - protein, 208 aa, Glycine max
  Coding DNA Sequence Number=SeqID_66921
  Homolog annotation: Hit_ID=Q1RU53; Match level="QueryCoverage=92%, HitCoverage=38%, E-value=3e-44, Identity=52%"; Hit description=WD40 -like
GSSDHTTKFWCRNRPGDPARDRFNTGMQGYAEQSPVAGRTGGNFPIAEGPTTPGPFAPGLTRNEGTIPGVGVAMPLSIPSLDMPQGEQKQPHPVSMGAPPLPPGPHPSLINANQQQPYQQNPQQMPQHQHQALPQQMGSLPMPPNMQQLQHPSHSPFPNMPRPPPQMPIGMPGSIPGISSVPTSHPMPMPGPMKICIENSGNLGSPDT

SEQ ID NO: 183700 - protein, 115 aa, Glycine max
  Coding DNA Sequence Number=SeqID_66922
MRREKVGCDEVVLKGRIRRRRLLSARKSLSLQQEHKNKHYKTRGKVANEEEVTSFKTTSLGQQPQRMKQSSLAAKRKRLLWTAEEEKVLKLKFNQGYGGSGMEVLIISAQENRPE

SEQ ID NO: 183701 - protein, 93 aa, Glycine max
  Coding DNA Sequence Number=SeqID_66923
  Homolog annotation: Hit_ID=Q1RU52; Match level="QueryCoverage=36%, HitCoverage=2%, E-value=8e-07, Identity=73%"; Hit description =Disease resistance protein; AAA ATPase
MLWLMKQNKIRNRYLKAWLDDVKDAVFEAEDLLDEIDIKVNKRDMRVTVVRSSTIVKTTSRIVFVGKIDLVSFLIRGILLCEYEDCNEQPAQC

SEQ ID NO: 183702 - protein, 210 aa, Glycine max
  Coding DNA Sequence Number=SeqID_66924
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-29, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTHTFRGLHTLAFRGLHALAFRGLHALAFRGLHALAFTGLHALAFTGLHALAFRGLQVIAFRGLHVLAFRGLHILSFRGLQVLAFRGLHVLAFRGLHILTFRGLHVHTFRGLHALTFRGLHVLAFKGLHALTFRGLHVLAIRGLRALTFRGLHAPTSPSEDYTSSLSEGCMSSPLLGYTPSPSEDYTSSPSEGYTLLDKWPQIS

SEQ ID NO: 183703 - protein, 58 aa, Glycine max
  Coding DNA Sequence Number=SeqID_66925
  Gene Ontology: Mol. function=transcription factor activity; Biological process=regulation of transcription, DNA-dependent
  Homolog annotation: Hit_ID=UPI00005F9E6D; Match level="QueryCoverage =98%, HitCoverage=19%, E-value=3e-18, Identity=74%"; Hit description =COG0583: Transcriptional regulator
TEAGSGVAQIRRQRHAAAGRDAAVQRGAAGVIESGGSALSATRLSRFRHERRSTAGSA

SEQ ID NO: 183704 - protein, 228 aa, Glycine max
  Coding DNA Sequence Number=SeqID_66926
  Gene Ontology: Mol. function=transcription factor activity; Biological process=regulation of transcription, DNA-dependent
  Homolog annotation: Hit_ID=UPI00005F9E6D; Match level="QueryCoverage =50%, HitCoverage=45%, E-value=1e-24, Identity=54%"; Hit description =COG0583: Transcriptional regulator
MAGLDDAVWLLVHDAQALYGWATLRQRLEAYGGEEEQLAQAVSARVLGCRRQFAQLANGWRTRLLHDVDQASDDNLTQQVIALSAQLTRLPERFSAAHLQPLLNAGWGSERLSAATAATPCPARQSPAPPGVPSARYQSAGAPDGAAFPLHHRGAFYNHPRQHAGFTQLSVKVTPEIARGLGQAQRLARQRVQRQPLMLQQRREMIGMENGFDAAIVEQRGLEMQFPQ

SEQ ID NO: 183705 - protein, 96 aa, Glycine max
  Coding DNA Sequence Number=SeqID_66927
  Homolog annotation: Hit_ID=Q1SDG1; Match level="QueryCoverage=67%, HitCoverage=5%, E-value=4e-11, Identity=51%"; Hit description =Integrase, catalytic region; Zinc finger, CCHC-type
MEKSEKKLKKAYITWDDNDMESSEDSENEVINLCLMAKSYESDEEVSLKKKWYIDSGCSKHMTGDASKFTHISPKKSKHVTYGDKNKGRILGVGKI

SEQ ID NO: 183706 - protein, 90 aa, Glycine max
  Coding DNA Sequence Number=SeqID_66928
VVPGDMSRGSGDLGDVRQAPGSQLIKEQSPQSKEACVAAGQLRILSGIWKLASGNRLPRDVKMASGNRLPRSNRALVIDYQLGVIDYIGR

SEQ ID NO: 183707 - protein, 218 aa, Glycine max
  Coding DNA Sequence Number=SeqID_66929
  Homolog annotation: Hit_ID=Q47FR0; Match level="QueryCoverage=27%, HitCoverage=27%, E-value=1e-07, Identity=47%"; Hit description =Regulatory protein, LuxR:Response regulator receiver
  Pfam annotation: Domain name=GerE; Domain location=135-192; Score =44.0; E_value=4.9e-10; Accession=PF00196.10; Description=Bacterial regulatory proteins, luxR family
MIKIALFDENRYFSAGWQEALALHFSTYGKRTLLLDAQQVHEADLVFCYFPPGVQSCFCHFFEAQAAGRQTLYFSLRTPEGRHKRTAGTRCALEAGVVYHDTPLVSALYQVNAELERRSKWPGRPSCGMNCVCQHRGLTLREQEIMRCMTREMGVTQIARMLDISVKTVSNHKMSVMRKMGFRRNAELYGWLRHSARPGAVGARAGIQPGIAAGKAQY

SEQ ID NO: 183708 - protein, 66 aa, Glycine max
  Coding DNA Sequence Number=SeqID_66930
MVTFSSLGEDFGRLCKQSFHTDKYMNLEARLGRRRAGRCLQVVGVGLGERMASQGPCSPIRNWVID

SEQ ID NO: 183709 - protein, 42 aa, Glycine max
  Coding DNA Sequence Number=SeqID_66931
MEVTKPRANTSLVQGSTNPRFTLDGPFPLLSSIFIGTQDYAS

SEQ ID NO: 183710 - protein, 236 aa, Glycine max
  Coding DNA Sequence Number=SeqID_66932
  Subcellular localization annotation: CTP_CleavageSite=23; ConfidenceScore=5.10e-01
MRSDCLVQFSMCSTLFRSPMNCVFDQVSSTIEFGAMRTDCLVQFSILNLFWSPMNCVFVHVSSTFKFGAMRSDCLVQFSILNLFRRPMNCVFVNVSSTFEFGSMRSDCLAQFSILNLFRSPMNCVFVHVTSTFKFGAMRSDCLVQFSILNLFRSPMNCVFIHVSSTFEFGAMHSDCLVQFSILKLFRSPMNCVFVHVSSTFEFGVMRTDCLVQFSIRNLFRSHHELRFCSCDLHLQ

SEQ ID NO: 183711 - protein, 209 aa, Glycine max
  Coding DNA Sequence Number=SeqID_66933
MDISKDIDIPVILGRSFMLIASCIVDIGNRKPELGFEDQKIDFDLFVEDKPALEHNVCLQIMGEGQEVLKRLTNFADSSFDLALVKELYANLYSPEGPSPKQVRIRGHLIRIGADSLNAFLETPVVLAEGFILNAEGHLGKILRKDLTTLAQVWSVLSYSNLAPTSHTSDLTVDRARLIFGLVTQLDMNVGALISGQITSMAQSNSSRL

SEQ ID NO: 183712 - protein, 92 aa, Glycine max
  Coding DNA Sequence Number=SeqID_66934
MGFRIGSKIPLAIYTLGMIAKYLDVLEIPRGAHVQFLVPQNALSMHVCEFSQGDVCDEMAPRKLASKRSRKDKAAEGTSSAPEYDSHRFRSA

SEQ ID NO: 183713 - protein, 84 aa, Glycine max
  Coding DNA Sequence Number=SeqID_66935
MHQLQTLRSIYSRPAPRSQWHLTPSTCDDYDEYEAIAQRLERVLNLRMVNTELYEIMQDCLMIARGGASADGSVRARQRRRTEH

SEQ ID NO: 183714 - protein, 234 aa, Glycine max
  Coding DNA Sequence Number=SeqID_66936
  Gene Ontology: Mol. function=RNA-directed DNA polymerase activity; Cellular component=chromatin; Biological process=chromatin assembly or disassembly
MKGFGKSRMPSEKGGMKFLQEELDEWAIRGKPNLLVEENEVAIHCEAIVVLKIFQTLMIRSNDEVIAKQVVAPLPDCRRDGMSTTPMADPEAFVSNIIGMVKSGEASTRACVINFFRDHSLGRYYVNKVLKLAPSEQALGTTKFVHGCPKYGWHDAKFIVPLVCAKRGLRNVFLGNAYLLESLVEPDNPCNNAICHPSSSPEEHGPVTRVMSKRLQEDLARAVEEGPRVLMDLR

SEQ ID NO: 183715 - protein, 223 aa, Glycine max
  Coding DNA Sequence Number=SeqID_66937
MYVLQFLWTPYDTPEIRFESQYYPGHHQHQSYVEPNVPPVHVLGFMSQHHPSQAQYQSTSFSSHASQGCQQSFQPLGFLSCIPQYSFQVPSTSNVFYGSSQMFATTFNTPPSTYNLASSSSCYRPSLPTQICYMSHEDEDEGEDNNNNNDDDDDGDGDDDDDDDNDGYHVPQQQRIITREHRRTRGGKDCRPSKQQTQTNPVQQDKRPRRISRRTRCGTSSHY

SEQ ID NO: 183716 - protein, 133 aa, Glycine max
  Coding DNA Sequence Number=SeqID_66938
  Gene Ontology: Mol. function=ubiquitin-protein ligase activity; Cellular component=ubiquitin ligase complex; Biological process =protein ubiquitination
MKVTGSWKISRHSASLARARHLDRSGLGGVDGKLLVAESEKNKKCLLEAGVPRAMIMFVVNCYEKGQIQKGIEEALSILQFAKIPREECALLLKDNDQILDSLTWLLTLDEMENSMVIKSHAVQVLKNNHQQG

SEQ ID NO: 183717 - protein, 87 aa, Glycine max
  Coding DNA Sequence Number=SeqID_66939
  Gene Ontology: Mol. function=isomerase activity
  Homolog annotation: Hit_ID=Q53B71; Match level="QueryCoverage=59%, HitCoverage=37%, E-value=8e-19, Identity=86%"; Hit description =Chalcone isomerase 4B
MDLGITDIEIHFIHVKFYSIKVYLESEVVGHLEQFKGKSTKELEDNDEFFNALISVRGKWENSMRRHTTWALPQLLLWEILGLTLRL

SEQ ID NO: 183718 - protein, 206 aa, Glycine max
  Coding DNA Sequence Number=SeqID_66940
  Gene Ontology: Mol. function=DNA binding; Cellular component =chromatin; Biological process=DNA integration
  Homolog annotation: Hit_ID=Q1SAV4; Match level="QueryCoverage=43%, HitCoverage=23%, E-value=7e-30, Identity=65%"; Hit description =Integrase, catalytic region
MRRDIRDFISKCPTCQQTKYETKKLTGLLQTLPIPTTPWEDLSLDFITCLPKSQGYSTILVVVDRFSKGTHFGALPPCHTAYSVSLLFFDMALAIPPNFTCIHLQQVVKALFWFFSGQNTCCPTPDRVGLEVEHRYISSLKIGVGPVGGIIPRRIYLGNLEELQKAYALEDKDIFREGGVDSNNKDTGSNRPKKISNRPTYLTDFV

SEQ ID NO: 183719 - protein, 333 aa, Glycine max
  Coding DNA Sequence Number=SeqID_66941
GCNTCFSRKLSSFKYFGMGVSLAIRGVKGHGQLSIVSGDRTQVFKPLHPKHHIHAAKGQGIEGEELLNSSLNKILATPTVNEDDDTMVVDVPVNAEGVIASGVLNREGSKVRVGLAFRDYSGDPISIVPRNVRLRMSGSLTTIVELVFLKLGEDEAVEEERRGHRGGHSRRWQSMTLMPEAWQATWRGTRCVSSTDTNKDPDRQTEAPQVLVEDVGLGMVVVVPGKHSREAQTLILRNNGKHSKTSWDNTTRGECFTSCPVGSLFDDTTQNHDGGSWAKFISHERSIVVVTKRILKETLRVGTVAKLCMVLQVDHAKYLKDKVMEILKWHSEV

SEQ ID NO: 183720 - protein, 157 aa, Glycine max
  Coding DNA Sequence Number=SeqID_66942
MTGVLNFYRPCGIFKGALCSSWTGGGSLHGVVFSDIAPFCHIDRGDCWDETSASPSSRGLRRATHPRGYYRRRSAEPSSVGSRGRSFRSFFRRNPQKNLPHFFHGSSRSPFPTRRRRFFSWKNLRLQPPAINVVYPKVPTAIYTIHAIETVTRRLED

SEQ ID NO: 183721 - protein, 176 aa, Glycine max
  Coding DNA Sequence Number=SeqID_66943
MEDTNNSFFSKFQIQNEMRARRKKLNEGEEEEQARMEIAGCTRKKQVQKQGYFRYFIELLGAPAILLGAPSNSPKTICMLLKVYCILKVLHEDKYRALWVFFYVSSSVSFIVVHFLSFVVVFASVVRGSGSVKMDKDQWTYDNTMPQEVDMDYENEQECGVNQPHVDCSDVYNTLE

SEQ ID NO: 183722 - protein, 118 aa, Glycine max
  Coding DNA Sequence Number=SeqID_66944
  Subcellular localization annotation: CTP_CleavageSite=30; ConfidenceScore=5.35e-01
MIRGRTSVGSSVRIKCSLRKKLQQDLPRVRGRQGFSAGSRGRSCRTFFRWITRKILQKLLSQESAEEPSTLLPREFQKPLSYAWKKVQPPAINVVYPKVPTAIYTIHAIETVTRRLED

SEQ ID NO: 183723 - protein, 421 aa, Glycine max
  Coding DNA Sequence Number=SeqID_66945
MDVPGKILNGYTKNLHRPEASIIERYIAEKAIEFCSKYVEKAKPIGLPESQHDDRVVGKGSQGLHVITLGLKALQQVHLYILNNNNEVLPYIVRHEALVKESNQKMTKNRVFKEYNKTFLSWFKATIFGDDNPFETLRKLGDGPKRNVITWQGYNINKFILHQVIRQQEYNTKQWAKQVFYVQDPIDERWSMVLHRKTIGLNLKDDDSTLDTCFSPFSMQMPNVNEEEKVDDINANHNNHDEGELINISTPSSSSSKKTRKPTWLKSLATKPVGMERPVVHVDPTTEKTDGSHRKKLTTYLGIIARDNAEFDIPEVSNQRTKKKLMKTVGERWRQFKSDLTSKWALAQGKEEDNDTIYEKTVSTGQLFAHRCQDVLTAAIGQPEHSGRVRAAKVNVTINQYFGLTSRSSCTSTSMTPEDLE

SEQ ID NO: 183724 - protein, 76 aa, Glycine max
  Coding DNA Sequence Number=SeqID_66946
  Subcellular localization annotation: CTP_CleavageSite=47; ConfidenceScore=5.07e-01
MATRPTTHMRAQRSAAKITTKSDSTAAATASGGGAAADWRSLSPRVMCDGRYSQDKSEVKTLDSKRLEREVKTGDA

SEQ ID NO: 183725 - protein, 105 aa, Glycine max
  Coding DNA Sequence Number=SeqID_66947
GSSGKVFRKFESSSGILPDEPFLPESSRKRFSGSLPEEVFFRKTFGYFRKNTSSGNFPENVLPELPEEPLTGLPEDFSVSLFHHFFRHTLVFSPLVFYPKVPLLC

SEQ ID NO: 183726 - protein, 133 aa, Glycine max
  Coding DNA Sequence Number=SeqID_66948
MSRNSTNCATMLSFDFRHVTELQELPNDGCQVPRSGQTKVACHETMVPGGNSVAGDHKISPHATDSLSLDDHKISSHATDSLSLDDKGTVFVYARLPPNLLLLNDKGKNAGPTGSRISSGLAPLDDKRCRRQR

SEQ ID NO: 183727 - protein, 253 aa, Glycine max
  Coding DNA Sequence Number=SeqID_66949
  Gene Ontology: Mol. function=transcription factor activity; Cellular component=membrane; Biological process=regulation of transcription, DNA-dependent
  Homolog annotation: Hit_ID=UPI00005EE93E; Match level="QueryCoverage =99%, HitCoverage=90%, E-value=8e-94, Identity=68%"; Hit description =COG0583: Transcriptional regulator
  Pfam annotation: Domain name=HTH_1; Domain location=5-64; Score=80.2; E_value=6.6e-21; Accession=PF00126.17; Description=Bacterial regulatory helix-turn-helix protein, lysR family
  Pfam annotation: Domain name=LysR_substrate; Domain location=88-253; Score=65.3; E_value=1.9e-16; Accession=PF03466.10; Description=LysR substrate binding domain
  Pfam module annotation: Pfam domain module=HTH_1::LysR_substrate; Domain location=5-64::88-253
MKMSIKQLRAFLAVAHTLNFAQASERLNISQPALSLAIRGLEDALGGPLLLRTTRRVTLTPEGETFFPMARQLLADWDNAEEAMRQRFTLQMGKVAIAAMPSFAGNPLPPILKAFRDRYAGINVAVHDVINEQVFEMIREGRVEMGIAFEPEPSDTLHFTPLCRDRFLAVVPKDSALARKAQRPSAVRLLLEQELARSGRTLEVAFESHQLVTVGRMVANGLGASAVPALCEQQMDELGAVCVPLIGPIIERR

SEQ ID NO: 183728 - protein, 129 aa, Glycine max
  Coding DNA Sequence Number=SeqID_66950
MTSLSLSLSLSFSLPHSRSSSREKKTIPESTILTYGKIILEGKIAIQNILSGSTICAFPNVFHNNYPFRRVITHEYLYPYITPILETSSQREREWIKMYLRSEELEKEKDFCSVELDLLYTFNDCKKKK

SEQ ID NO: 183729 - protein, 88 aa, Glycine max
  Coding DNA Sequence Number=SeqID_66951
  Gene Ontology: Mol. function=ribonuclease H activity; Biological process=DNA integration
MSHGHLYQRWVKNSSEKKVRSHKFNEGDLVLKKVSQAQKDNRGKWAPNYKGPFIVKKAFSGRALVLASLDDEELPSPVNVDIAKQYYA

SEQ ID NO: 183730 - protein, 227 aa, Glycine max
  Coding DNA Sequence Number=SeqID_66952
  Gene Ontology: Mol. function=metalloendopeptidase activity; Biological process=proteolysis
  Homolog annotation: Hit_ID=Q7W1Q5; Match level="QueryCoverage=99%, HitCoverage=43%, E-value=4e-79, Identity=71%"; Hit description =Putative peptidase
MVRMAGWLLAVMLAGGVLPAGAVSNDLAGRQSDAEKQQAQLRDRIENLQKDIDTREAARKEAADALKQSESAISRINLRLKELAEANRQAAADLSGLEKQITAQQAVLAKRRVELADQLRTQYTSGLSPWTALLSGDDPQVLGRNLGYLDYVSQARARAVEALRADIDRLAALQGRADARRAEIEKLDAETSEQKTALVAQQKERATLLAQLEGQIAAQRAEANKLG

SEQ ID NO: 183731 - protein, 148 aa, Glycine max
  Coding DNA Sequence Number=SeqID_66953
  Subcellular localization annotation: CTP_CleavageSite=48; ConfidenceScore=5.52e-01
MPISPCGSISWSVSSRHRGRAHKTPSGPGEVQQGPRVSSSSYGPLSVLQGARSNQQGITPARHLVDPKKSNRVLELPALITGLCQFYEVPVAPSKVIRPPTNRAFIKKHYAPRQAQGETPQQPRDGRQRATDAPPPPLEFTSARPQKG

SEQ ID NO: 183732 - protein, 153 aa, Glycine max
  Coding DNA Sequence Number=SeqID_66954
MAGTNFAELYGGSNSELKLRKGRKGTSRGHMAWSKRSLSQCLCETETNMLAIIAKYEEELGLATAHEHRIADEYAQVYAEKEARGRVIDSLHREATMWVGRFALTLNGSQELPRLLAKAKAMADTYSAPEEIHGLLGYCQHMIDLMAHIIRNR

SEQ ID NO: 183733 - protein, 88 aa, Glycine max
  Coding DNA Sequence Number=SeqID_66955
MIQNASMIKTTTNPKEKLPLAKMEPEFWDKNPFKATTKAFPSGFHYKPTTILKSRTFYELILVIPIGIMLMLGLRCFGTKIPASSIHG

SEQ ID NO: 183734 - protein, 356 aa, Glycine max
  Coding DNA Sequence Number=SeqID_66956
  Gene Ontology: Mol. function=oxidoreductase activity, acting on single donors with incorporation of molecular oxygen, incorporation of two atoms of oxygen
  Homolog annotation: Hit_ID=Q1D1H0; Match level="QueryCoverage=69%, HitCoverage=89%, E-value=2e-34, Identity=36%"; Hit description =Putative 1H-3-hydroxy-4-oxoquinaldine 2,4-dioxygenase
  Pfam annotation: Domain name=Abhydrolase_1; Domain location=138-352; Score=-1.6; E_value=0.011; Accession=PF00561.10; Description =alphabeta hydrolase fold
MFMGYVAGVFDTYSMQGNRNICPEAGMSIGTAADAVMRYLNEHPEQLHYSAPSVIMLALSAAYPCINLRGAVTLASSASPERVGERRAGGYMTTFHSANIALDYQDIGSGPLTLVLLPGWCEPKTVFDPFIALAAERYRVLSIDWRGHGLSSKTAEMSLAAVDLLEDVRQLLTALRLDNVVTLSVAHASWLAVALAEALPQRVRGMVFLDWIMTQPEPAFFTAVSRMQQPQQWLAARDALFAFWQGGIRHERVKRHLEVEMAQEDYRLWRAAGVAIEQAYRQFGSPLQRLAGMSAPPPCRHIYSLDRRDDYLRRQQAFAAEQPFFSVVRLGEARTHLGILERPDAVLWAVEDFLAP

SEQ ID NO: 183735 - protein, 180 aa, Glycine max
  Coding DNA Sequence Number=SeqID_66957
MTYELADSWFPPFLDALALSPSHPLREEALKAAEQAVYDSYQDAASETAEGGSLDERYEEIAEDVVKVLRGVADWSCASERSWHGSRNGCVAPMAEYLTYREAAARTKRSIRSINRWRRGGMPMEWEKRDGQRVRVVRLDILLAWWRERLNSDPGHQYRLRKMRADATRDTPNDSSLPPS

SEQ ID NO: 183736 - protein, 77 aa, Glycine max
  Coding DNA Sequence Number=SeqID_66958
MDKSLKEKEEDEWRERKIRSMKFYASKEREVTYTRYASPSPAKHTHSNRISYLKLNLEIEECGVFLRVLAVERPGEK

SEQ ID NO: 183737 - protein, 257 aa, Glycine max
  Coding DNA Sequence Number=SeqID_66959
  Gene Ontology: Mol. function=sequence-specific DNA binding; Cellular component=nucleus; Biological process=regulation of transcription
  Homolog annotation: Hit_ID=Q1SVZ6; Match level="QueryCoverage=66%, HitCoverage=50%, E-value=2e-31, Identity=46%"; Hit description=DNA -binding WRKY
MTNTEAFQIKSISELLIHPLLWRLTGFVSSVFGFSCYAFSPSFHDLFGHWNPLKISFYTVVSSLLSIFMLFVKRCSGEHGKGFLLKAHVGFVVLGLTSLWSFLEDRGQQGKVEHGFGKMMNLTSTGAFALMAMSLSRQLQFGFDVGVFNFLVGCFLVTTMKMSLKLAPVAAFFCYVLVNIRSISDFLLDLRAHAATQHADDATNAESLDQNIADSSEYNDLLEVHTQHADGKNTDSGDQNTHSSEHDEQLFAPMIHI

SEQ ID NO: 183738 - protein, 95 aa, Glycine max
  Coding DNA Sequence Number=SeqID_66960
  Gene Ontology: Mol. function=nucleotide binding; Cellular component =phagocytic vesicle; Biological process=response to heat
  Homolog annotation: Hit_ID=P26413; Match level="QueryCoverage=100%, HitCoverage=14%, E-value=3e-40, Identity=83%"; Hit description=Heat shock 70 kDa protein
MAPGNVKAIGIDLGTTYSCVAVWQHNHVEVIPNDQGNRTTPSYVAFTDTQRLLGDAAINQRSMNPQNTVFDAKRLIGRRFSDQSVQQDMKLWPFK

SEQ ID NO: 183739 - protein, 104 aa, Glycine max
  Coding DNA Sequence Number=SeqID_66961
MMIWKQRAKLVMATTKWALKHPVYGIVILWLGLLSFGTNVRGANTFLKCKYNSLIWNILYDRFPSVFPTFSTNKRWWPESLASLARKRVGCDSWRLHWGLFSVS

SEQ ID NO: 183740 - protein, 73 aa, Glycine max
  Coding DNA Sequence Number=SeqID_66962
MCEANKSPTHRISVCNQRERATLGRGVANYPSEGGRRVTRGMRLPRKEYARSRHQRLLEENVGKTKKDVVYEF

SEQ ID NO: 183741 - protein, 553 aa, Glycine max
  Coding DNA Sequence Number=SeqID_66963
  Homolog annotation: Hit_ID=Q1SJP8; Match level="QueryCoverage=39%, HitCoverage=13%, E-value=1e-64, Identity=55%"; Hit description=D -galactoside/L-rhamnose binding SUEL lectin; Integrase, catalytic region; ...
  Homolog annotation: Hit description=Galactose-binding like; Peptidase aspartic, catalytic
  Pfam annotation: Domain name=TLD; Domain location=270-392; Score =23.7; E_value=1.6e-07; Accession=PF07534.6; Description=TLD
MGKMHKNRKQAGGHGTPREETDMQEQEMDIRKIMKDPQKNQRLPLSVARPMMKKQKEREQKMLQERLILGQFGGKLGGSSKRSAGKHKPENRGLKSSEGHFRNGILNVKHLLNSAPSRDRETGTNMSNAWKGKGGKKKNSNKGGEGGSDDDDDDVTIDGPDTSSFTAFLCSLLSTSDSGDKVGEADEKNDGGRAIHQVARMGGFRNKDGNYTDEGVEMKHIVKTPVAVAVARIGDHLPEISEPSMLVSEDVRNVVYASLPALIHGRKWLMLYSTWKHGISLSTLYRRSMFWPGLSLLVVGDRKGAVFGGLVEAPLRPSNKRKYQTIKETYSVNQDASRAYQLYHERLWQEYDAIAYCTMECTKDVEKYTNTVNSPRVYVFLAGLDSHLDGVGGHILGTTPLLNVKVVYTIVCAEANRQEAMLGSVSIEGTAFAVKKSSKKGVPKCSHCNGDNHVIETCSKLHGYLDWHPKGKTTSNNKAENLSQIATAAGFVIKSGMSNSVINLSVVTGSSDWIIDMGAADHMTCDPHTFTHLSPGLLKLSLLMPMKFHLLLK

SEQ ID NO: 183742 - protein, 81 aa, Glycine max
  Coding DNA Sequence Number=SeqID_66964
MVMQKEGPGVIQIEGSEVSRKTSPIAFRATGLECDGIAPWLRAMDEQSRDAAAPAPRTERTARDERTRKLGFVFASNSKMT

SEQ ID NO: 183743 - protein, 409 aa, Glycine max
  Coding DNA Sequence Number=SeqID_66965
  Gene Ontology: Mol. function=ubiquitin thiolesterase activity; Cellular component=intracellular; Biological process=ubiquitin -dependent protein catabolic process
  Homolog annotation: Hit_ID=Q93X76; Match level="QueryCoverage=93%, HitCoverage=81%, E-value=1e-175, Identity=76%"; Hit description =Putative carboxyl-terminal proteinase
  Pfam annotation: Domain name=DUF239; Domain location=173-367; Score =353.0; E_value=4.7e-103; Accession=PF03080.5; Description =Arabidopsis proteins of unknown function
MEEEKEEEEDKANVNKVTRIYIGNIGNTPVANQTFKPQEEAHKMNIIRTRLQQINKPAVKTIQSPDGDVIDCVVSHQQPAFDHPMLKGHKPLDPPERPKGHNQMDMSENFQLWTMSGESCPEGTIPIRRTTEQDMLRASSVSRFGRKIRRRVRRDTNSNGHEHAVGYVSGEQYYGAKASINVWAPRVANQDEFSLSQINSIHKVDSMLNYLQFIFVHVSPELYGDRYPRFFTYWTSDAYQATGCYNLLCSGFVQTNNRIAIGAAISPTSSYAGGQFDISLLIWKDPKHGNWWLEFGSGILVGYWPSFLFTHLRDHASMVQFGGEIVNSRQSGSHTSTQMGSGHFASEGFGKASYFRNMQVVDWDNNLVPLSNLRVLADHPNCYDIQGGINNVWGNYFYYGGPGRNVRCP

SEQ ID NO: 183744 - protein, 461 aa, Glycine max
  Coding DNA Sequence Number=SeqID_66966
  Gene Ontology: Mol. function=hydrolase activity, acting on glycosyl bonds; Cellular component=amyloplast; Biological process =carbohydrate metabolic process
  Homolog annotation: Hit_ID=Q38958; Match level="QueryCoverage=88%, HitCoverage=88%, E-value=1e-154, Identity=62%"; Hit description =Polygalacturonase-like protein
  Pfam annotation: Domain name=Glyco_hydro_28; Domain location=92-422; Score=307.0; E_value=3.4e-89; Accession=PF00295.8; Description =Glycosyl hydrolases family 28
MKRNRSFSLLFFLSLLVIIFVTFSIVSVEARKTNIKKKLHKRHKGGHTQGSHSPCPVPTPQGSTFDVLSFGAKGNGVSDDSEAFLAAWNGACKVAGATVKIPAQLKFLIKPVTLQGPCISDLTLQIDGTLLAPPEASTWPKSSLFQWINFKWVRNFTIKGSGTVDGQGYNWWSSSEFYDIQKSYSKHIPGMKPTAIRFYSSNFVTVRDIRIINSPLCHLKFDNSKGIKVNNITISSPENSPNTDGIHLQNTQDVEIQRSIISTGDDCVSIQTGCSNIHVHHINCGPGHGISLGGLGKDKSAACVSDITVEDISMKNTLYGARIKTWQGGIGMVKNVTFSRIQVYDVMYPIMIDQYYCDKQICKNHTSTVVISGVKFDQIHGTYGMQPVHLACSNSIPCTDVDLTDIQLSPSPKYRGLQQAVCWNSYGKSQGPFLPSSIDYCLRSGGGLIKRIARSHDKVCY

SEQ ID NO: 183745 - protein, 102 aa, Glycine max
  Coding DNA Sequence Number=SeqID_66967
MRKIKSQLRPQRDMSNIQCYYCRRYNKQKGAEIKEKKENQKKPKSSKALSAGRAQRARSQGAKRTTRAEHDVALSTRLCAQRDYEKPKPKFAPINKRVSLGK

SEQ ID NO: 183746 - protein, 173 aa, Glycine max
  Coding DNA Sequence Number=SeqID_66968
  Gene Ontology: Mol. function=protein serine/threonine kinase activity; Biological process=protein amino acid phosphorylation
  Homolog annotation: Hit_ID=Q9M0G5; Match level="QueryCoverage=41%, HitCoverage=13%, E-value=6e-07, Identity=33%"; Hit description =Serine/threonine kinase-like protein
  Pfam annotation: Domain name=DUF26; Domain location=118-161; Score =22.4; E_value=9.3e-06; Accession=PF01657.8; Description=Domain of unknown function DUF26
MSLASFFLIFLCYHALPALADPSATEVAVLSTNTTAPIPQRQAFLTNFYDALEALTALVTRQKYALIVKGTTQNNATVYAFDFCGNWSVYKANTVELVRNLSIEAPKNEGFFVGYKFVNGSACQNCLDEAVTRINSCAPKVEGKALNVGCYLRYSIHNFYNSSNNNAPQENHG

SEQ ID NO: 183747 - protein, 355 aa, Glycine max
  Coding DNA Sequence Number=SeqID_66969
  Gene Ontology: Mol. function=protein serine/threonine kinase activity; Cellular component=membrane; Biological process=protein amino acid phosphorylation
  Homolog annotation: Hit_ID=Q9FNE1; Match level="QueryCoverage=91%, HitCoverage=48%, E-value=6e-66, Identity=40%"; Hit description =Receptor-like serine/threonine kinase
  Pfam annotation: Domain name=DUF26; Domain location=135-188; Score =52.9; E_value=1.1e-12; Accession=PF01657.8; Description=Domain of unknown function DUF26
  Pfam annotation: Domain name=DUF26; Domain location=25-78; Score =52.6; E_value=1.3e-12; Accession=PF01657.8; Description=Domain of unknown function DUF26
  Pfam annotation: Domain name=Pkinase_Tyr; Domain location=266-355; Score=-173.3; E_value=0.077; Accession=PF07714.7; Description =Protein tyrosine kinase
  Pfam module annotation: Pfam domain module=DUF26::DUF26::Pkinase_Tyr; Domain location=135-188::25-78::266-355
MEKISDEMRKTGFGTAIVGTGPDTNYGLAQCYGDLSLLDCVLCYAEARTVLPQCFPYNSGRIFLDGCFMRAENYSFFNEYTGPGDRAVCGNTTRKNSSFHAAAMQAVLRAVQDAPNNKGYAKGNVAVAGTTNQSAYVLADCWRTLDKSSCKACLENASSSILGCLPWQEGRALNTGCFMRYSDTDFLNKEQENGSSRGNVVVIVIAVVSSVTVLVVGVTIGVYIWKQRYIQKKRRGSNDAKKLAKTLQNNNLNFKYSTLDKATESFHENNKLGQGGFGTVYKGVLADGREIAVKRLFFNNRHRAADFYNEVNIISSVEHKNLVRLLGCSCSGPESLLVYEFLPNRSLDRYIFGNY

SEQ ID NO: 183748 - protein, 114 aa, Glycine max
  Coding DNA Sequence Number=SeqID_66970
  Gene Ontology: Mol. function=protein serine/threonine kinase activity; Cellular component=membrane; Biological process=protein amino acid phosphorylation
  Homolog annotation: Hit_ID=Q9FNE1; Match level="QueryCoverage=99%, HitCoverage=17%, E-value=1e-33, Identity=65%"; Hit description =Receptor-like serine/threonine kinase
  Pfam annotation: Domain name=Pkinase_Tyr; Domain location=1-114; Score=-157.1; E_value=0.0078; Accession=PF07714.7; Description =Protein tyrosine kinase
MAIKRLSFNTSQWAYHFFNEVNLISGIHHKNLVKLLGCSITGPESLLVYEFVPNHSLYDHLSGRRNSQQLTWEVRHKIILETAEGLAYLHEESKRIIHTDIKLANILIDDNFTP

SEQ ID NO: 183749 - protein, 102 aa, Glycine max
  Coding DNA Sequence Number=SeqID_66971
MSVVVEMINNNHEITRPTQPPFLSCSSAEFSKSILQGESFQPRSMKHRHRHRIRHGHVDTCNIQNIKRSTGIVSVSDTHTDTCQTPDTTRDWSIRDRKSHST

SEQ ID NO: 183750 - protein, 106 aa, Glycine max
  Coding DNA Sequence Number=SeqID_66972
MRKEHGVWGFAFNMTMLWKQAIHGVASTLHEWWSKKVVDGDLVMESDENPKTVQIQGPMIRSKTKQSVDTLQQMVADILNKVQVENDEDPEIEALLRILVIAEGSD

SEQ ID NO: 183751 - protein, 136 aa, Glycine max
  Coding DNA Sequence Number=SeqID_66973
  Gene Ontology: Mol. function=methyltransferase activity; Cellular component=nucleus; Biological process=menaquinone biosynthetic process
  Homolog annotation: Hit_ID=Q8YLP4; Match level="QueryCoverage=64%, HitCoverage=38%, E-value=1e-25, Identity=63%"; Hit description =Menaquinone biosynthesis methyltransferase ubiE
  Pfam annotation: Domain name=Ubie_methyltran; Domain location=34-136; Score=-101.8; E_value=6.3e-05; Accession=PF01209.9; Description =ubiECOQ5 methyltransferase family
  Subcellular localization annotation: CTP_CleavageSite=34; ConfidenceScore=5.37e-01
MNIKNRCGKRRTCHMAMTFVPSSTSSTFRPTLIRCASANERQALFSRIAPVYDNLNDLLSLGQHRIWKRMAVSWTGAKMGDCVLDVCCGSGDLSFLLSDKVGSHGKVIGLDFSKDQLSFALSRQQSLSKNCFMNIE

SEQ ID NO: 183752 - protein, 250 aa, Glycine max
  Coding DNA Sequence Number=SeqID_66974
  Gene Ontology: Mol. function=RNA-directed DNA polymerase activity; Biological process=RNA-dependent DNA replication
MEASLWHTLQHAFDSLEDMHSIIFYILGKFSTSKVEEIVTVLWCLWRRRNEKLWEGVSKPVGLSLQQVFKHLQEWKTQHKRPNTATSHSPHRNSKWSKPPINYMKCNIDAVLFHEENKFGVAACIHEEEGMFAVAATSWFHGQPTPQEAEAVAFLFALNGIKEQQLGNIVIETDCKAISDAFKAQQFDNFEAGCILKICNTQISDIHNCSIQFVSKQANQVAHSLARASRSYVCPQMFDFNPSCIDLSDS

SEQ ID NO: 183753 - protein, 102 aa, Glycine max
  Coding DNA Sequence Number=SeqID_66975
  Homolog annotation: Hit_ID=Q2HS44; Match level="QueryCoverage=89%, HitCoverage=49%, E-value=2e-10, Identity=32%"; Hit description =Hemopexin
MEEQSTINKVEERLDRALARQDWIDVFPHHSLMNGVAGISARWLKEQELDMLVHYCWTQNATSDILSKLHTCSDGLLTWGQRIHARFMNAIKQCKARLEELS

SEQ ID NO: 183754 - protein, 63 aa, Glycine max
  Coding DNA Sequence Number=SeqID_66976
MASVEASAMARSQILPNAYDTDAFYEYGSPRDCPLLRYNIRIAWRPMYAFKKATRTLRRFVTK

SEQ ID NO: 183755 - protein, 226 aa, Glycine max
  Coding DNA Sequence Number=SeqID_66977
  Gene Ontology: Mol. function=transferase activity, transferring groups other than amino-acyl groups; Biological process=lipid A biosynthetic process
  Homolog annotation: Hit_ID=Q1H149; Match level="QueryCoverage=87%, HitCoverage=56%, E-value=2e-76, Identity=68%"; Hit description=UDP-3- O-(3-hydroxymyristoyl) glucosamine N-acyltransferase
  Pfam annotation: Domain name=Hexapep; Domain location=102-119; Score =7.4; E_value=18; Accession=PF00132.14; Description=Bacterial transferase hexapeptide (three rep
  Pfam annotation: Domain name=Hexapep; Domain location=120-137; Score =12.5; E_value=1.6; Accession=PF00132.14; Description=Bacterial transferase hexapeptide (three rep
  Pfam annotation: Domain name=Hexapep; Domain location=138-155; Score =13.0; E_value=1.1; Accession=PF00132.14; Description=Bacterial transferase hexapeptide (three rep
  Pfam annotation: Domain name=Hexapep; Domain location=156-173; Score =5.1; E_value=34; Accession=PF00132.14; Description=Bacterial transferase hexapeptide (three rep
  Pfam annotation: Domain name=Hexapep; Domain location=25-42; Score =18.8; E_value=0.02; Accession=PF00132.14; Description=Bacterial transferase hexapeptide (three rep
  Pfam annotation: Domain name=Hexapep; Domain location=43-60; Score =18.6; E_value=0.022; Accession=PF00132.14; Description=Bacterial transferase hexapeptide (three rep
  Pfam annotation: Domain name=Hexapep; Domain location=7-24; Score =16.8; E_value=0.078; Accession=PF00132.14; Description=Bacterial transferase hexapeptide (three rep
  Pfam annotation: Domain name=Hexapep; Domain location=80-97; Score =16.2; E_value=0.12; Accession=PF00132.14; Description=Bacterial transferase hexapeptide (three rep
  Pfam module annotation: Pfam domain module=Hexapep::Hexapep::Hexapep:: Hexapep::Hexapep::Hexapep::Hexapep::Hexapep; Domain location=102 -119::120-137::138-155::156-173::25-42::43-60::7-24::80-97
MVSIGERVKLGHGVRIGAGCVIEDDVTIGANTVLEPRVVIKHGTVIGNHCHLFSGCVIGNDGFGYAEEQGQWVKIPQIGRVVIGDHVDIGANTTVDRGALDDTVIEDGVKLDNLIQVAHNVRIGAHTVIAGCVGIAGSAVIGAHCKIGGAAMILGHLQIVDGVTISPGSMIMRSIQQAGTYTALMPFQKHEDWLRTAANIRHLEQYQLKLKQLEQAISNIQKHSED

SEQ ID NO: 183756 - protein, 410 aa, Glycine max
  Coding DNA Sequence Number=SeqID_66978
  Gene Ontology: Mol. function=RNA-directed DNA polymerase activity; Cellular component=intracellular; Biological process=RNA-dependent DNA replication
  Pfam annotation: Domain name=RnaseH; Domain location=290-409; Score =2.3; E_value=3.6e-05; Accession=PF00075.14; Description=RNase H
MAVEDREKTSFITPWGTFCYRVMPFGLINAGATYQRGMTTLFHDMMHKEIEVYVDDMIVKSGTEEEHVEYLLKMFQRLRKYQLRLNPNKCTFGVRSGKLLGFFVSQKGIEVDPDKVRAIREMPVPQTEKQKILWGCVLGQQDETGRKEHAIYYLSKKFTDCESRYSLLEKTCCALAWAAKRLRHYMINHTTWLISKMDPIKYIFEKPALTGRIARWQMLLSEYDIEYRTQKAIKGSVLADHLAHQPIEDYQPIKFDFPDEEIMYLKMKDCDEPLLGEGPDPESRWGLIFDGAVNVFGNGIGAVIITPEGNHLPFAARLQFDCTNNMAEYEACILGIEKAIDLRIKNLDIYGDSALVINQIKGEWETRQPGLIPYKDYAKRLLTFFNKVELHRIPRDENQMARCVSNFILH

SEQ ID NO: 183757 - protein, 65 aa, Glycine max
  Coding DNA Sequence Number=SeqID_66979
MAVVGTTGSYGGHDGGQGTAICVRKNNPYSYTLARKIRLEPPPPTGNLFCKNNETPSLLSMPSEE

SEQ ID NO: 183758 - protein, 97 aa, Glycine max
  Coding DNA Sequence Number=SeqID_66980
MALSCTTFIIIESFVTKENGGTKFTCGTTWKYSKYISKMRKPEATKQQLASLCCIALPNRLFQLIWGRKGRREEGRGLVTLVPDGSLWQWWVVTGGE

SEQ ID NO: 183759 - protein, 364 aa, Glycine max
  Coding DNA Sequence Number=SeqID_66981
  Gene Ontology: Mol. function=ribose phosphate diphosphokinase activity; Cellular component=mitochondrion; Biological process =nucleotide biosynthetic process
  Homolog annotation: Hit_ID=Q9XGA0; Match level="QueryCoverage=99%, HitCoverage=88%, E-value=1e-137, Identity=70%"; Hit description =Ribose-phosphate pyrophosphokinase 3, mitochondrial precursor
  Pfam annotation: Domain name=Pribosyltran; Domain location=247-363; Score=20.2; E_value=0.00011; Accession=PF00156.17; Description =Phosphoribosyl transferase domain
  Subcellular localization annotation: CTP_CleavageSite=61; ConfidenceScore=5.62e-01
MAATPPLQSFSVLHSNKPSHSLLRPSSNKNRTFFSFTSNLRCEIKGFDFESHRGWTIERVSDMSKDSTNSHTNPSSPLLSVSAVTSASQFPTKNAKKVVLFYCAETKALAEKIAAETDAIELRSISWGKFPDGFPNIFIPNAQGIRGMHVAFLASFSSPAVIFEQIPVIYALPKLFIASFTLVLPFFPTGTSERMEDEGDIATAFTLARLLSNIPISRGGPTSLVTFDIHALQERFYFGDNILPCFESGIPLLKRRLQDLPDSDNISVAFPDDGAWKRFHKQLQHFPTIVCAKVREGDQRIVRIKEGDPRGRHIVIVDDLVQSGGTLIECQKVLAAHGATKISAYVTHGIFPNKSWARFGHDNG

SEQ ID NO: 183760 - protein, 619 aa, Glycine max
  Coding DNA Sequence Number=SeqID_66982
  Gene Ontology: Mol. function=protein serine/threonine kinase activity; Cellular component=membrane; Biological process=protein amino acid phosphorylation
  Homolog annotation: Hit_ID=Q5JNK2; Match level="QueryCoverage=52%, HitCoverage=79%, E-value=3e-92, Identity=52%"; Hit description =Putative Nod-factor receptor 1b
  Pfam annotation: Domain name=LysM; Domain location=163-208; Score =17.3; E_value=0.0085; Accession=PF01476.10; Description=LysM domain
  Pfam annotation: Domain name=Pkinase; Domain location=315-591; Score =175.4; E_value=1.4e-49; Accession=PF00069.15; Description=Protein kinase domain
  Pfam annotation: Domain name=Pkinase_Tyr; Domain location=315-591; Score=149.3; E_value=1e-41; Accession=PF07714.7; Description=Protein tyrosine kinase
  Pfam module annotation: Pfam domain module=LysM::Pkinase::Pkinase _Tyr; Domain location=163-208::315-591::315-591
MASSLVALLSLLLTLLATSCLSATVFSLQVSIKTTYLEPFKCSPKITTCNASLYHISYGNNIDDIATFYSVSTSQIKPIMRTTEQDYLITVPCSCNDTNGLGGYFYDTTYKVKSNDTFVNINNFVYSGQAWPINGELDQNEELTIHLPCGCSEKSDSQIVVTYTVQRNDTPVSIAALLNATLDDMVSMNEVLAQNPSFIDVTWVLYVPRELNGLPLSKGKDKKQKLEIIIGILAGVTLLSIITLIILSVVLRRSRANKTAKNDPSVVSKRSITNRTISIKNRDFHTEYIEDATTFESERPVIYALEEIEDATNNFDETRRIGVGGYGTVYFGMLEEKEVAVKKMRSNKSKEFYAELKALCRIHHINIVELLGYASGDDHLYLVYEFVPNGSLCEHLHDPLLKGHQPLSWCARIQIALDAAKGLEYIHDYTKARYVHRDIKTSNILLDEKLRAKVADFGLAKLVERTNDEELIATRLVGTPGYLPPESVKELQVTIKTDVFAFGVVLAELITGKRALFRDNQEASNMKSLTSVVGQIFKDDDPETVLADAIDGNLQRSYPMEDVYKMAELAHWCLCEDPNVRPEMREIVVALSQIVMSSTEWEASLGGDREVFSGVLDGR

SEQ ID NO: 183761 - protein, 85 aa, Glycine max
  Coding DNA Sequence Number=SeqID_66983
  Subcellular localization annotation: CTP_CleavageSite=52; ConfidenceScore=5.39e-01
MVLNSLFSIFLAHFQRTTKARLPSFFGDFGKPKTNKFGRTQKLNHLQQSICPCNSYQNGTQFDRTATSTSKVFRQCNSNDTFIKA

SEQ ID NO: 183762 - protein, 393 aa, Glycine max
  Coding DNA Sequence Number=SeqID_66984
  Gene Ontology: Mol. function=oxidoreductase activity; Cellular component=vacuole; Biological process=response to oxidative stress
  Homolog annotation: Hit_ID=Q5U1M3; Match level="QueryCoverage=75%, HitCoverage=88%, E-value=1e-55, Identity=38%"; Hit description=Class III peroxidase 70 precursor
  Pfam annotation: Domain name=peroxidase; Domain location=90-342; Score=273.3; E_value=4.7e-79; Accession=PF00141.13; Description =Peroxidase
MTRIFLTTLSLWLLVLAPSKAEEGFPDKLPSTFHSLFPFLGRQDDLNKPQKGPNDESQQQNVPQQAADQNPQILSQDFYIKTCPNAQKIVADALAKIVKTNPGALGNLLRLQFHDCFVNGCDASILLDYSPSGDAVEKSSMVNGLLLKGADMIDEIKLKLEEQCPQTVSCADTLAFTANEVMTMAGLAPQKPLGGRRDALVSLATAAETDNIPMPNWTMEQMVKLFNKKGFNIEEMVILLGAHSIGMAHCDLFIERAYNFQNTGKPDPSLTVEVLEELRKACPNLNTPKYRNPPVNFDATPTVLDNLFYKDMVERKRTLLITDSHILEDPRTLPIVQQFAHDASLFPRRFPEVMLKMSSLNVLTGNEGEPPVLGGMRQALAVVQDKSDARESQ

SEQ ID NO: 183763 - protein, 359 aa, Glycine max
  Coding DNA Sequence Number=SeqID_66985
  Gene Ontology: Mol. function=protein binding; Cellular component =clathrin vesicle coat; Biological process=intracellular protein transport
  Homolog annotation: Hit_ID=Q5KDW0; Match level="QueryCoverage=98%, HitCoverage=89%, E-value=1e-113, Identity=53%"; Hit description =Clathrin assembly protein AP47, putative
  Pfam annotation: Domain name=Adap_comp_sub; Domain location=159-359; Score=233.2; E_value=5.7e-67; Accession=PF00928.11; Description =Adaptor complexes medium subunit family
  Pfam annotation: Domain name=Clat_adaptor_s; Domain location=4-142; Score=-57.4; E_value=0.018; Accession=PF01217.10; Description =Clathrin adaptor complex small chain
  Pfam module annotation: Pfam domain module=Adap_comp_sub::Clat _adaptor_s; Domain location=159-359::4-142
MAGAASALFLLDIKGRVLIWRDYRGDVSALDAERFFTKLIEKQADPQAQDPVVHDNGVTYMFIQHSNVYLMIATRQNCNAASLLFFLHRIVDVFKHYFEELEEESLRDNFVVVYELLDEIMDFGYPQYTEAQILSEFIKTDAYRMEVTQRPPMAVTNAVSWRSEGINYKKNEVFLDVVESVNILVNSNGQIIRSDVVGALKMRTYLSGMPECKLGLNDRVLLEAQGRTTKGKAIDLEDIKFHQYVKPLIWVEASVEKHSKSRIEIMSLFYSTATNVEIELPVPVDATNPNVRTSMGSASYAPEKDALIWKIRSFPGGKEYMLRAEFRLPSITDEEATPERKAPIRVKFEIPYFTVSGIQ

SEQ ID NO: 183764 - protein, 64 aa, Glycine max
  Coding DNA Sequence Number=SeqID_66986
  Gene Ontology: Mol. function=carbon-sulfur lyase activity
  Homolog annotation: Hit_ID=Q1S4J9; Match level="QueryCoverage=86%, HitCoverage=12%, E-value=8e-11, Identity=54%"; Hit description =Alliinase EGF-like; Allinase, C-terminal
FIWLKCEEGIEDCGSYLLEKLKIRARGGERFGVSPKYARISMIGTDDEFHEFLNRVSNAKKECD

SEQ ID NO: 183765 - protein, 115 aa, Glycine max
  Coding DNA Sequence Number=SeqID_66987
  Gene Ontology: Mol. function=RNA-directed DNA polymerase activity
  Homolog annotation: Hit_ID=Q1SKN5; Match level="QueryCoverage=51%, HitCoverage=5%, E-value=6e-13, Identity=55%"; Hit description =Integrase, catalytic region; Zinc finger, CCHC-type; Peptidase aspartic, catalytic
MVWELQMNEGRKLRHIDVLRDAFGNKVSFVLGIITISDTFESEDPFVLDDIKIWLWRDKCPGSISNERIEFFGHGFFPLKSESPWGELRVKLWSMGKNIYIGESDKHVYRQLGLD

SEQ ID NO: 183766 - protein, 240 aa, Glycine max
  Coding DNA Sequence Number=SeqID_66988
  Gene Ontology: Mol. function=carbon-sulfur lyase activity; Cellular component=vacuole
  Homolog annotation: Hit_ID=Q9S7N2; Match level="QueryCoverage=89%, HitCoverage=55%, E-value=2e-78, Identity=63%"; Hit description =Putative alliinase; 54807-57232
  Pfam annotation: Domain name=Alliinase_C; Domain location=26-240; Score=244.4; E_value=2.4e-70; Accession=PF04864.4; Description =Allinase, C-terminal domain
MAVATNSFPSSSVTIPPTNISPNAILPLERGDPIVFGEYWKKMSETCTVVIKGWELMSYLSDMNNVCWYMLPETKEAIKRLHHVVGNAVTEDRYIVVGNGATQLLQGAVFALTPSEASKPINVVVAAPYYSEYQDEVDILRSGLYQWAGDAALYEKNEPYIEVVTSPNNPDGTMRGPVVKSEAEGKLIHDLAYYWPHYTPITHQADHDIMIFTFSKCTGHAGSRIGWAIVKDIEVAKKMT

SEQ ID NO: 183767 - protein, 199 aa, Glycine max
  Coding DNA Sequence Number=SeqID_66989
  Gene Ontology: Mol. function=nucleic acid binding; Cellular component= mitochondrion; Biological process=DNA integration
  Homolog annotation: Hit_ID=Q1T1E6; Match level="QueryCoverage=99%, HitCoverage=39%, E-value=7e-50, Identity=50%"; Hit description=Zinc finger, CCHC-type; Peptidase aspartic, catalytic
  Subcellular localization annotation: CTP_CleavageSite=44; ConfidenceScore=5.02e-01
MDYFSVNITIFVIFSKPTTCMMMLDQSTPIYRPHAISHQVMSPLAMTLSIASLSTHCNISLTCPVNKLSQYMKAPIEIHMQAAKRVLRSIGVYLIYFGPNVISWSCKKQSTIAKSSTEVEYRTIATTVTELLWLQQLLKELHVHPDRSPMVYSDNIGTTYLCVNMVFHSRKKYLAIDYHFVLDLVAKKKLGVSHVPSSH

SEQ ID NO: 183768 - protein, 200 aa, Glycine max
  Coding DNA Sequence Number=SeqID_66990
MKHVEVSNQIKIITSWLLRHVGFNTPFYPSFFPHGSYVMWDFQQTMSEGGFFMGLTQSYKDRLERTCLLVMGRQKPDQNMMENEKHNFHMNLTLLFHPWILRDERNGFHLSNRSKPKSDPIINLVDASKSLVLKDQTFHVDCDASVFVVNNFTLYIAVQDIYEIVQHRAMLNIAVIHLWMLYMDKIRQQLGHGDLAIWIP

SEQ ID NO: 183769 - protein, 70 aa, Glycine max
  Coding DNA Sequence Number=SeqID_66991
MKGDVQSQVVIDFWRCGTHESSKGKSQESQEKAQLRVEGRENGDSLGQPEQEEKWWKRTASRRFQYYGVG

SEQ ID NO: 183770 - protein, 568 aa, Glycine max
  Coding DNA Sequence Number=SeqID_66992
  Gene Ontology: Mol. function=guanyl-nucleotide exchange factor activity
  Homolog annotation: Hit_ID=Q93ZY2; Match level="QueryCoverage=99%, HitCoverage=100%, E-value=0.0, Identity=65%"; Hit description=Rop guanine nucleotide exchange factor 1
  Pfam annotation: Domain name=DUF315; Domain location=8-461; Score =672.4; E_value=3.4e-199; Accession=PF03759.4; Description=Domain of unknown function (DUF315)
MGSVSSEDGSDRCGSYSLSADVSESESCSSFSARRFDAEGASSSANLSPRPVAAHFNFPPAQVMLPVIGGKDVVVWDHKRDLDLSEQLHFAEVEMMKERFAKLLLGEDMSGGGKGVCTALAISNAITNLSATVFGELWRLEPLAPQKKTMWRREMEWLLCVSDSIVELVPSVQQFPGGGTYEVMATRPRSDLYINLPALKKLDGMLLNMLDGFHDTQFWYVDRGIILGDSKDCDAYGRPSVRQEEKWWLPSPKLPPNGLSEESRKRLQQCRDCTNQILKAAVAINTSVLAEMEIPGAYIESLPKNGKACLGDIIYRYITADQFSPECLLDCLDLSTEHHTLDIANRIEAAIHVWRLKDHKKHLSSAKSRRSWGGKVKGLVADGEKNKNNFLAQRAETLLESLKHRFPGLPQTALDMAKIQYNKDVGQSILESYSRVMESLAFNIMARIDDVLYVDDSIKRCAAADSLSLFSRGGFGGMPIQKRFSPSPFSIQHTPYASPFATPTFCSSTPVTGSPCSPARIHDVKRNAPKEGADSKTEKLATSEFERVWSYAGNLSARRASGDAPERD

SEQ ID NO: 183771 - protein, 107 aa, Glycine max
  Coding DNA Sequence Number=SeqID_66993
MKADDSSTQKEEQMKPMRNKQNALHHKVARSIKFNQMIGWEKDIPVDLATVSVFACWRSTLATVVSVVLQEYESGSESVRLGVGCARVREWEREYESARAVQFWFLN

SEQ ID NO: 183772 - protein, 102 aa, Glycine max
  Coding DNA Sequence Number=SeqID_66994
  Gene Ontology: Mol. function=chromatin binding; Cellular component =signal recognition particle, endoplasmic reticulum targeting; Biological process=chromatin assembly or disassembly
  Homolog annotation: Hit_ID=Q8LSQ2; Match level="QueryCoverage=68%, HitCoverage=20%, E-value=1e-13, Identity=53%"; Hit description =Probable signal recognition particle 43 kDa protein, chloroplast precursor
  Pfam annotation: Domain name=Chromo; Domain location=38-79; Score =27.2; E_value=5.9e-05; Accession=PF00385.14; Description='chromo' (CHRromatin Organisation MOdifier
MIFVRGNNYNGFVASGTFYAKFVAEDLVKDYEAGLEYAVAEAVLAKRVADEGTPEFLVKWADLEEPTWEPELVKAFEETNNQAQPSNNGPAVVASNQDSPSP

SEQ ID NO: 183773 - protein, 317 aa, Glycine max
  Coding DNA Sequence Number=SeqID_66995
  Gene Ontology: Mol. function=protein-tyrosine kinase activity; Cellular component=integral to membrane; Biological process=protein amino acid phosphorylation
  Homolog annotation: Hit_ID=Q6RZV9; Match level="QueryCoverage=53%, HitCoverage=62%, E-value=7e-41, Identity=48%"; Hit description =Hypothetical protein G9-6
  Pfam annotation: Domain name=Hin1; Domain location=147-295; Score =35.2; E_value=2.3e-07; Accession=PF07320.4; Description=Harpin -induced protein 1 (Hin1)
MGGRMHTKSDSEVTSNSMEQSSPARSPPRRPLYYVQSPSNHDVEKMSYGSSPMGSPHHHFHYYLSSPIHHSRESSTSRFSASLKNPRNFSSSSSWKKLHPHPNRDVDPDDHDDADHHLKQSSRNLRLYLWFFLLFLLLLTLFSFILWAASKTYKPRIIVKSIVLENLYVQSGNDGTGVPTDMLSLNSTVRILYRNPATFFGVHVTSTPLLISYYQLAIASGQMQKFYQSRKSRRSLAVVVSGHQIPLYGGVSVLGNTKEHLESVALPLNLTFVVRSRAFILGRLVKSKFFRRIRCSVTLHGNKLGKHLNLTDSCVYK

SEQ ID NO: 183774 - protein, 492 aa, Glycine max
  Coding DNA Sequence Number=SeqID_66996
  Gene Ontology: Cellular component=plastid; Biological process =peroxisome organization and biogenesis
  Homolog annotation: Hit_ID=Q9SXF7; Match level="QueryCoverage=86%, HitCoverage=84%, E-value=1e-108, Identity=47%"; Hit description =Amino acid transporter-like protein 1
  Pfam annotation: Domain name=Aa_trans; Domain location=77-478; Score =119.9; E_value=7.1e-33; Accession=PF01490.8; Description =Transmembrane amino acid transporter protein
MEEVAEEAQYFRSEIALLNFSDATFKPPLSPLLIHIDPLLPNGHTCSASESDPSPTSQHQQEQHHPKDAWLPITESRNGNAYYAAFHILNSNIGFQALMLPVAFATLGWAWGTVCLSLAFVWQLYAIFLLVQLHEYVPGIRHSRYLFLAMAAFGKKLGKVGALFPVMYLSGGTCVMLIITGGGTMKQLFKTLCENDNGKTCNAHALSGAEWFLVFTCVAILIAQLPNLNSMAMVSLVGAVTSITYCTLFWVLSVKKGKPNNVSYSSSLSQEHTPVAKISDVLNAIGIIVLAFRGHNVLLEIQARDAAFKFGTNIQNTNAKRSEHVICTHFHINDGGLLYSFPEFHKRQITKFSMGAIYVLVIIHCLTSFQIYAMPVFDNLEIRYTSIKNQRCSPLVRTCIRLFFGGLTFFISVTFPFLPRLSTLLGSMTLVPITYAYPCFMWLSLKKPRPRGIICCFNVALGSVGMLLSALLVAAAIRTLALNGLDANFFRP

SEQ ID NO: 183775 - protein, 110 aa, Glycine max
  Coding DNA Sequence Number=SeqID_66997
MPISPCRCINWDRAHKTPNGPEEVQQGPGVSSSGYGPLTVLQGTRSPSEESHPQRHPVDPEKSNRALGFPALVTGLCSPTGCPFPPARDRARKTPSGPEEVQQGLGVAKL

SEQ ID NO: 183776 - protein, 246 aa, Glycine max
  Coding DNA Sequence Number=SeqID_66998
  Gene Ontology: Mol. function=transporter activity; Cellular component= outer membrane; Biological process=nutrient import
  Homolog annotation: Hit_ID=Q79AD2; Match level="QueryCoverage=99%, HitCoverage=27%, E-value=1e-142, Identity=98%"; Hit description=HasR protein
MISRRKAHCHPGVQLAMEGAAAQRHRAAIARQVGGGAELRPPVTRDEVIGSGIRLNIEVAAARSVAVAQTPSQPGLVRAELVFADHVGVGQVGVEHPGVIVELVLQPAEAGFRQVVDVSGIADARLHQPRFIAVYRQVDVVIHFGVEVGHLGHQPIALKPQIRLLHVEPDFPGARALGLQERVGVLRGRTVCAAVSQRFGDRRRPPGFAVGGIQLKPLHAGAHRHRQRRRQLALIAIHVPIFAGSG

SEQ ID NO: 183777 - protein, 106 aa, Glycine max
  Coding DNA Sequence Number=SeqID_66999
  Gene Ontology: Mol. function=oxidoreductase activity; Cellular component=integral to membrane; Biological process=potassium ion transport
  Homolog annotation: Hit_ID=Q8PQN5; Match level="QueryCoverage=84%, HitCoverage=27%, E-value=3e-27, Identity=68%"; Hit description =Oxidoreductase
MPASGRHYNSGFRAGGIQLRDVLHAQRQVGRCQQIVQLFDGGGADDRRSDRRPRDLPRQRDLRSAGAVLAGHVIQRLQDAQATRVQIALHHGLSTRRALGCIGRRA

SEQ ID NO: 183778 - protein, 117 aa, Glycine max
  Coding DNA Sequence Number=SeqID_67000
  Subcellular localization annotation: CTP_CleavageSite=36; ConfidenceScore=5.31e-01
MFGCDADNVQALPCTRRNSPGGAGKTWVSERRVAARGAVLASRVLVPTQTKTPPGLAFRGRRQASEIGVADLRRAGIRPLSAGLPCRTRAPARPCAGMAVVWRWRRNARSREFSSGR

SEQ ID NO: 183779 - protein, 203 aa, Glycine max
  Coding DNA Sequence Number=SeqID_67001
DTLYDALTELVLRARVMGEVEEIQEKMKADMEAIKEKMATMMEAMMSVKKIMEANAVAIAATSVVAKVNPTSPSGLKQMNHPTSNMVGKDLGSTGGPHDVQIQNKHAFPSYGLPLNYTPPNVAYTPNKNVNNSTPIPIESQQPQTDHAHGKQLVVYPYKTLWRALSITHNCTSCIPQRLKTLMTMAGMGKLDHLEERLRAIEG

SEQ ID NO: 183780 - protein, 58 aa, Glycine max
  Coding DNA Sequence Number=SeqID_67002
MEKCFTSVLHWATKVCFLDHQETRLGPRNTQDTYVKIPTSQVKCLINITVGLENKGKS

SEQ ID NO: 183781 - protein, 150 aa, Glycine max
  Coding DNA Sequence Number=SeqID_67003
  Gene Ontology: Mol. function=hydrolase activity
  Homolog annotation: Hit_ID=Q62I70; Match level="QueryCoverage=65%, HitCoverage=25%, E-value=4e-31, Identity=62%"; Hit description =Metallo-beta-lactamase family protein
  Subcellular localization annotation: CTP_CleavageSite=22; ConfidenceScore=5.08e-01
MKTVKRTGIALAIALTFPLALPAATAAQPSLTNSKAATMTEKHGQFIAVGKVVQVTFGDFAFKLDFTDDKTMTFTGIGEASQGITDTVQYTAVEIRPKVYMVYWHEPQSGDNVTHIEDFERGEVYTNIAAKDGSFTHLKGQLKIVGHSGK

SEQ ID NO: 183782 - protein, 120 aa, Glycine max
  Coding DNA Sequence Number=SeqID_67004
MSSSSEERREIGHRSKRSLAQHLETTEQSMLAIIGQYKEELNQSMAHEQKLVEDFAQVYAEKEARGRVIDALHQEATMWMDRFALTLNGSQDLPRLLAKAKSMAEVCTAPEEIHRLINYC

SEQ ID NO: 183783 - protein, 238 aa, Glycine max
  Coding DNA Sequence Number=SeqID_67005
QSSWYDFNNGNIEYGIDFEPLTLTVSRDKKVLLSQDAKSNIHYDTKNVAQADEDIAVLTVHKAIRDNKLSLLRDHCLAYDYDDVSDSKYFIVDVREDKRYAICVMAFGMMSARADVVMSDYNSLDKVSSVFSNKDVLLKLKSILGPDYDTFSQNFDVYGEPHLTSAGGLFVEGWLRDLYLEQASAFVIQPDGRTYAAWTDAKTGKISYRCNVNTEKNPQPDIAAWAKRFNSDPAGDSA

SEQ ID NO: 183784 - protein, 228 aa, Glycine max
  Coding DNA Sequence Number=SeqID_67006
  Homolog annotation: Hit_ID=Q0LVQ4; Match level="QueryCoverage=89%, HitCoverage=78%, E-value=1e-41, Identity=44%"; Hit description =Hypothetical protein precursor
MALVVACSGVANARDKDAPASPVAAVDELPADQSVSETVIELAGWVVASKDNQGYPFAVMDKAAAQVLIFSGDGKLRGAAPALFGSAIGDHSAPGVAKLALSAIPGHDRTTPAGRFIGGYGPSDDAGRVLWVDYDSAVSMHPLPPGSPKEKRAERLASPTPDDNRVTHGCINVSPAFYGQIVQPMFEKGGVFYILPDKDSIAKTFPEFAQSRGDAKDEDEKGARRASK

SEQ ID NO: 183785 - protein, 242 aa, Glycine max
  Coding DNA Sequence Number=SeqID_67007
  Gene Ontology: Mol. function=oxidoreductase activity
  Homolog annotation: Hit_ID=Q1LRL2; Match level="QueryCoverage=89%, HitCoverage=86%, E-value=4e-82, Identity=71%"; Hit description=NADPH- dependent FMN reductase
  Pfam annotation: Domain name=FMN_red; Domain location=34-209; Score =187.5; E_value=3.3e-53; Accession=PF03358.6; Description=NADPH -dependent FMN reductase
MNKPITSPDLPNLVESSLPQPNHHQLAAADLGPPRILLLYGSLRPQSFSRKLALEAERLLRHLGCETRMFDPHALPMLDSVDTSHPEVQRLRAWSQWSEGQVWVSPERHGTVTGVFKNQIDWLPLEDGSVRPTQGRTLAVMQVSGGSQSFNTVNTLRVLGRWMRMLTIPNQSSVAKAWQEFDDDGRMKPSPYYDRVVDVMEELVKFTLLTRGRSDYLVDRYSERKGDAHAAVLARAAGAAAS

SEQ ID NO: 183786 - protein, 304 aa, Glycine max
  Coding DNA Sequence Number=SeqID_67008
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=65%, E-value=1e-142, Identity=75%"; Hit description =Photosystem II P680 chlorophyll A apoprotein
  Pfam annotation: Domain name=PSII; Domain location=1-304; Score =394.7; E_value=1.4e-115; Accession=PF00421.9; Description =Photosystem II protein
MGLPWYRVHTVVLNDPGRLLSVHIMHTALVAGWAGSMALYELAVFDPSDPVLDPMWRQGMFVIPFMTRLGITNSWGRLEYHRRDYNESGYLELRRCGRSTYCVFGLVLFSGYLALGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDG

SEQ ID NO: 183787 - protein, 97 aa, Glycine max
  Coding DNA Sequence Number=SeqID_67009
  Gene Ontology: Mol. function=structural constituent of ribosome; Cellular component=ribonucleoprotein complex; Biological process =translation
  Homolog annotation: Hit_ID=Q2PMP7; Match level="QueryCoverage=92%, HitCoverage=42%, E-value=2e-44, Identity=97%"; Hit description =Chloroplast 30S ribosomal protein S3
  Pfam annotation: Domain name=Ribosomal_S3_C; Domain location=11-94; Score=168.5; E_value=1.7e-47; Accession=PF00189.10; Description =Ribosomal protein S3, C-terminal domain
MGFPKFLIEEFIAGQLKNRVSFRKAMKKAIELTEQAGTKGVQVQIAGRIDGKEIARVEWIREGRVPLQTIRAKIDYCCYTVRTIYGVLGIKVWIFSK

SEQ ID NO: 183788 - protein, 101 aa, Glycine max
  Coding DNA Sequence Number=SeqID_67010
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q6UA03; Match level="QueryCoverage=92%, HitCoverage=33%, E-value=1e-36, Identity=81%"; Hit description=Fiber protein Fb33
MSPLPYAICWIFQVSVLADDILKNVEYDALRIVFNKFHSVVQFLPTVATVLSPEVIEREAESGGKLGELDSYEIEGGETKAEILQNLAEFQFSCVSNFQKL

SEQ ID NO: 183789 - protein, 378 aa, Glycine max
  Coding DNA Sequence Number=SeqID_67011
  Gene Ontology: Mol. function=RNA-directed DNA polymerase activity; Cellular component=chromatin; Biological process=chromatin assembly or disassembly
  Pfam annotation: Domain name=rve; Domain location=34-174; Score=51.7; E_value=2.5e-12; Accession=PF00665.16; Description=Integrase core domain
MRVDVTQFFATCIDCQHTKYERKQIAGLLCPLPVPHRPWEDLSLDFITGLPPYHGHTVILVVVERFSKGIHLGMLTPSHTVHTVACLFIETMAKLHGIPRSLVSDRDPLFVNNFWQELFRLSGTKLRMSSAYHLQSDGQTERLGTWGKLLLWVEWSHNTSWNVGTGTTPYEITFGRKPCTIPDYIIGISDIAIVEAMLTDREDTFKYIRKKLLKAQGLMKQYADTRRRDVEYQEHVGKLAKRFYGPFSITKRIGQVAYRLQLPAGARIHPVFHCSLLIPFKGTPPSDTTGQLPEKFFGTQPIIAPLAILDHRQISNDPPRWEDYHLEDKVLLQGPWSVSKASDTEANSGAITRNHTEMQIAKEGKKRIAKPAYLQDYV

SEQ ID NO: 183790 - protein, 544 aa, Glycine max
  Coding DNA Sequence Number=SeqID_67012
  Gene Ontology: Mol. function=RNA-directed DNA polymerase activity; Cellular component=chromatin; Biological process=chromatin assembly or disassembly
  Pfam annotation: Domain name=RVP; Domain location=125-229; Score= -12.4; E_value=0.064; Accession=PF00077.10; Description=Retroviral aspartyl protease
  Pfam annotation: Domain name=RVP_2; Domain location=110-243; Score= -27.4; E_value=0.00014; Accession=PF08284.2; Description=Retroviral aspartyl protease
  Pfam module annotation: Pfam domain module=RVP::RVP_2::RVT_1; Domain location=125-229::110-243::366-543
MAQYLAEFEELANRVVWLPTQFLLSCFIFGLTPEIQWEVQALQPLTLKHLSPEELASRWDRGLCFNCDEKYHRGHSCASRVFFLVGDAEDPSLSNIDSPNPPSNPPYVSDPTQAQINFHSLASHLAPKTLHLLGSITDHPVVILVDGGNTHNFIQESLIAHLGFSSRETRPLRVMVGNGQHLECTRWCEAVTIDIQSTQFTLDLYVLPISGANVVLGVQWLKSLGPVLTNYNTLCMKFFYAGQLVELKGDRETTFHLMSPPQFNKVLRKQSPGVFYHIVVLRDDTSASSRDEHPPKIQELLIRFQVLFQPPSALPLERLTNHHIHMLPQATPVNMRPYRYPHYQKCEIELQVEMMLQKGLIQLSTSPFSSPVLLVRKNDGSWRFYVDYQALNTLTVHDRFPIPTIDELLDELGHTRWFSMLDLLQGYNQIRMHANDIPKTAFRNHHGHYELKSQVEYLGHIVSQGGVAPIAAKIGTIDQWPTPQTTKALCSFLGLLGFYRRFIQGYATIAAPLVKATTTEPLKWNAEAQSSFDQLKRALSQAPV

SEQ ID NO: 183791 - protein, 126 aa, Glycine max
  Coding DNA Sequence Number=SeqID_67013
MYACKNLQIMVRIRGLGRVLGRVIGRVMGREDRYSDDVLQRRRSTPSARKQREAAPVAEDAPDVADVTEDVTWLTWLKMYSNMLKKQLMILRGFQERPELKLSSHGRKVQKFGRPAPKIEGLVAAT

SEQ ID NO: 183792 - protein, 121 aa, Glycine max
  Coding DNA Sequence Number=SeqID_67014
  Homolog annotation: Hit_ID=Q1T159; Match level="QueryCoverage=37%, HitCoverage=37%, E-value=1e-07, Identity=60%"; Hit description=Beta tubulin
MDDDQWMYDSIISEEVDMDDENEHDVGVNEEQHVDCSDAFNTSRLLKKTDLWWSHIYSDKYLIATISSLEVVGCAYNRKMKQRDHIIKGDGHLSNRKMETVRFLMSSLHKSIYKSPIVSVH

SEQ ID NO: 183793 - protein, 301 aa, Glycine max
  Coding DNA Sequence Number=SeqID_67015
  Gene Ontology: Mol. function=phosphoric monoester hydrolase activity; Cellular component=chloroplast; Biological process=amino acid biosynthetic process
  Homolog annotation: Hit_ID=O82796; Match level="QueryCoverage=69%, HitCoverage=63%, E-value=9e-48, Identity=54%"; Hit description =Phosphoserine phosphatase, chloroplast precursor
  Subcellular localization annotation: CTP_CleavageSite=78; ConfidenceScore=5.03e-01
MEELLHKKRYPYHHPVYGSLTRSETLRFNLSHQPSQIFTRASNAFTSNICRSFFFVPGFGKQLVSMEGLVSSGINTVRVFGITKHQSRFLPSSTLHLRNNSVCGFGIGVEKKKKKQCFVVAASVGGSKVVHFENTLPSKEVLELWRNGDAVCFDVDSTVCLDEGIDELAEFCGAGKAVAEWTARAMGGSVPFEEALAARLSLFNPSLSQLQDFLEQKPPSRSQVLESACKVACNRPVMGLTFPRLSPGIEELVQKLKANGIVVYLISGGFRQMINGGGIKSDIGILIRASSIALKPAASLF

SEQ ID NO: 183794 - protein, 249 aa, Glycine max
  Coding DNA Sequence Number=SeqID_67016
  Homolog annotation: Hit_ID=P52780; Match level="QueryCoverage=28%, HitCoverage=8%, E-value=6e-28, Identity=80%"; Hit description =Glutaminyl-tRNA synthetase
MRRRCRPPASLRRSPSTILETHDSCDGDDWRPVVAGSPSKTLPARGTTLKGKLLRSGYGSTDVVYNNQCLKGKVYYVVDRQRLPLNGWSTTSLLLKATTSKGTLLRRFQGRNVVECMALTSCLGEERRGMHGYYAVSRRRPPLTAWEKLRRCCHIIRFNRYDDTNPEAEKKEYIDHIEESVQWMGWKPFKITYTSDYFQELYELAVELIKKGHAYVDHQTPDDPGVYNQVINKGCYGEEEDQFYVPTRN

SEQ ID NO: 183795 - protein, 220 aa, Glycine max
  Coding DNA Sequence Number=SeqID_67017
  Gene Ontology: Mol. function=diacylglycerol kinase activity; Cellular component=phosphoribosylaminoimidazole carboxylase complex; Biological process=protein kinase C activation
  Homolog annotation: Hit_ID=UPI00005F9170; Match level="QueryCoverage =79%, HitCoverage=59%, E-value=2e-62, Identity=68%"; Hit description =COG1597: Sphingosine kinase and enzymes related to eukaryotic diacylglycerol kinase
  Pfam annotation: Domain name=DAGK_cat; Domain location=47-170; Score =94.9; E_value=2.4e-25; Accession=PF00781.14; Description =Diacylglycerol kinase catalytic domain
VDSRGSHGGAGRWSSRLDQRAGGGRSGLCAAAAQFYRREAIMQNKPLTLLILNGKGAGNEELRAAVNTLRDEGFNLAVRVTWEKGDGDRYVQEALQLQAETVVAGGGDGTINEIATALAALPPAQRPVLGILPLGTANDFATSAGIPAEMEAALRLAVLGKATPIVMGRVNCDRYFINMPTGGFGTRITTETPEKLKSALGGVSYFIHGLMRVDALKPNS

SEQ ID NO: 183796 - protein, 55 aa, Glycine max
  Coding DNA Sequence Number=SeqID_67018
VEIAGAGSLNIRNCINYWEFVRNWKGGLVPYLEEFESRGKGPTTLRAIGLRSTSN

SEQ ID NO: 183797 - protein, 317 aa, Glycine max
  Coding DNA Sequence Number=SeqID_67019
  Gene Ontology: Mol. function=transferase activity, transferring hexosyl groups; Biological process=carbohydrate biosynthetic process
  Homolog annotation: Hit_ID=Q48484; Match level="QueryCoverage=95%, HitCoverage=65%, E-value=1e-87, Identity=57%"; Hit description=WbbM protein
  Pfam annotation: Domain name=Glyco_transf_8; Domain location=20-251; Score=136.7; E_value=6.5e-38; Accession=PF01501.10; Description =Glycosyl transferase family 8
MEVQTGWEELFIEYSQWLFSVLEDFEKDFALKNYTTQEKRVIGHIAESEMKGVYTRAHFSAATYARLFIPSLFSDFEKVVFIDADTIVEHDISELLNLNLGNELVAAVKDIVMEGFVKFGALTHIDGESKNITAEYYLKNVLDMKDTQKYFQAGILLFNIKQMNAENTFAALMKGMKARKYWFLDQDIMNMVFYERVYYLPMEWNVYHGNGNTDDFFPNLNFSTYMRFLESRKRPKMIHFAGENKPWDTTSVDFSENFISYISDTPWNKELFDRLNGIKYSLSSNSDNKKVLFQTKVKRKVMPYLNKFAPVEVSVGK

SEQ ID NO: 183798 - protein, 232 aa, Glycine max
  Coding DNA Sequence Number=SeqID_67020
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGRQRRPPSGGARAISEIPLWKS

SEQ ID NO: 183799 - protein, 149 aa, Glycine max
  Coding DNA Sequence Number=SeqID_67021
  Gene Ontology: Cellular component=cellulose and pectin-containing cell wall
  Homolog annotation: Hit_ID=Q153F8; Match level="QueryCoverage=72%, HitCoverage=34%, E-value=4e-36, Identity=66%"; Hit description =Pectin acetylesterase
  Pfam annotation: Domain name=PAE; Domain location=7-142; Score=-58.7; E_value=3.2e-12; Accession=PF03283.4; Description=Pectinacetylesterase
MRCRFGILLVFLVFISMLLGAGSSFWMLGWWSGYYYTLMNSEVFSQKLPKIDVSWGHTIKNLFSGVVRLQGVQKNLPHFCTNHLDPTSCFFPQNLIAGIRTPLFILNTAYDSWQVQTSLAPSSADPHGFWHDFRLNHDQNSGNNAKQDQ

SEQ ID NO: 183800 - protein, 140 aa, Glycine max
  Coding DNA Sequence Number=SeqID_67022
  Gene Ontology: Mol. function=glutamine-tRNA ligase activity; Cellular component=soluble fraction; Biological process=tRNA aminoacylation for protein translation
  Homolog annotation: Hit_ID=P52780; Match level="QueryCoverage=54%, HitCoverage=10%, E-value=1e-32, Identity=92%"; Hit description =Glutaminyl-tRNA synthetase
  Pfam annotation: Domain name=AT_hook; Domain location=33-45; Score =14.9; E_value=0.061; Accession=PF02178.9; Description=AT hook motif
MVENRLRWFGHVERRPVDSVVRRVDQMERRQTIRGRGRPKKTIREVIKKDLELNGLDRSMTPDEIKEHREKKLNSPWRDRPISESLKLFEDMKNGSIEEGKATLRMKQDMQSDNYNILPHTLMLETNGVSIQVMIMHFSH

SEQ ID NO: 183801 - protein, 178 aa, Glycine max
  Coding DNA Sequence Number=SeqID_67023
  Gene Ontology: Mol. function=catalytic activity; Biological process =cellular metabolic process
  Homolog annotation: Hit_ID=Q9C8J3; Match level="QueryCoverage=69%, HitCoverage=15%, E-value=4e-17, Identity=42%"; Hit description =Cinnamyl alcohol dehydrogenase, putative; 82967-79323
MQGRIKICEGKNVDMVLDEEIHELTLKLQRLHRRSKVKDLGARKNRNFDKQVSVLQRRLEQIGGSSDEICLREFQEMENISLSIKRSSIVDDNVVASGKLNVEILRRKMEGLSKGILLQRMEEEYNSLLSTASSSLASSGSNSKRLEYQDSSSVRVPHQCTQCTVHTQCFCYGVPNPV

SEQ ID NO: 183802 - protein, 63 aa, Glycine max
  Coding DNA Sequence Number=SeqID_67024
MALFLFYLFLQIWNFAVLQIEGEVFFMWRKRAWNLEGRCETNHKLGQNGKDTLLWGKIANKNI

SEQ ID NO: 183803 - protein, 182 aa, Glycine max
  Coding DNA Sequence Number=SeqID_67025
MLFPSHFSYCIGIITTIIPKDWLCEPCQSKHVPTSPCKVNQDIGSWASKKHRAVKTAKVKFRHLDEVIRLSSQKASAVSKNVTFSLAPKSNPQTSPPKVLGKLPRNDEVHKKPMTNQHVSCSLAKSENFSSSLLPSLFFFSLQKERKFLLTLRIHVLKSANFKWMLNLMQLKCCALVLAPVK

SEQ ID NO: 183804 - protein, 309 aa, Glycine max
  Coding DNA Sequence Number=SeqID_67026
  Gene Ontology: Mol. function=zinc ion binding
  Homolog annotation: Hit_ID=Q9FNQ3; Match level="QueryCoverage=49%, HitCoverage=41%, E-value=3e-14, Identity=30%"; Hit description =Arabidopsis thaliana genomic DNA, chromosome 5, P1 clone:MAF19
MDLVGPTKECIGENQQPLGGLVADKKVRPHVPQKEKPTKRAPFEGLSAKKSSPLVNSGGIFSAAAESNQFNIDKSNRQRIQKNLNLHRKFLPSSIPSWRGQIQILQTAASGETYDGFEAQPPCVVKRKAYEFSREMPSVLQLESLSASNVLTDIFWDGSPKLQDIALYFFPSKQTEKSKENLNSILKFMNAKKSMLRSYIDGVELMVFTSNQLDMDSRGAIAAVNAGHFLWGLFRQNKIDKAIKRIPDMEPVDMDIDMIGGKDVVGRVDHVRKDKPESASMTEYRNKLDVPPGFEAFSKMSSCNIVVED

SEQ ID NO: 183805 - protein, 165 aa, Glycine max
  Coding DNA Sequence Number=SeqID_67027
MGVQDPGTKLRVELFQGMGLMEDRVKPKHHNKGGSGDEKLYFQCAGAFGIGHRYPEKSLRVVILAEDEQINEEGEITSIKTEMGGEEDDNEEVEVLVLIDSGASHNFIFIELVQWLGLVVEPTKPYKGGCDIMSSMASYFGISQSELENSYNEICKARTSSRGKG

SEQ ID NO: 183806 - protein, 190 aa, Glycine max
  Coding DNA Sequence Number=SeqID_67028
MAIEGSKCRLRNIRRMNPNLMVAQTKINFKKHGSLAQFIKELIHSPEMVGECWMGETEDVKVLYEQLVRKVENKGVKCHCVKCRSVRVAKKSTIKDVTNGIRANISPSMVWFENELGRSWWACNTPIETHQNERDLEAVQVWNCTVEDDLKELIGTIYTNNMHLLFSSPSLKNFIVRRVWLGVVVGWMTF

SEQ ID NO: 183807 - protein, 201 aa, Glycine max
  Coding DNA Sequence Number=SeqID_67029
  Homolog annotation: Hit_ID=Q1T1Y0; Match level="QueryCoverage=47%, HitCoverage=25%, E-value=1e-08, Identity=39%"; Hit description =Ankyrin
  Pfam annotation: Domain name=DUF1723; Domain location=77-126; Score =45.6; E_value=1.7e-10; Accession=PF08330.1; Description=Protein of unknown function (DUF1723)
MVRTRGLSRALGRVIGRALGREEVAHVAVDVEHVDHEADELSSHGRKVEKLGRLAPEIEGLVASTRLSPLIAYSLDTSDRGLISALAKRWKKETCSFYLLVGEVTITLDDVESLLYLPITDAFHSFEAVHVDEVVDLNDFQDYFDDAKESRVKQVPKNQESKSFKNQDSRIIKFQDSIKFQESRFKTQDSRIKRRLNQDKY

SEQ ID NO: 183808 - protein, 376 aa, Glycine max
  Coding DNA Sequence Number=SeqID_67030
  Gene Ontology: Mol. function=hydrolase activity, acting on glycosyl bonds; Cellular component=cellular_component; Biological process =carbohydrate metabolic process
  Homolog annotation: Hit_ID=Q40312; Match level="QueryCoverage=97%, HitCoverage=88%, E-value=1e-141, Identity=65%"; Hit description =Polygalacturonase precursor
  Pfam annotation: Domain name=Glyco_hydro_28; Domain location=37-376; Score=483.6; E_value=2.4e-142; Accession=PF00295.8; Description =Glycosyl hydrolases family 28
MSILVLHNKGDLDISRFGGKPNSDISQAFLGAWTQACASTTAVKIVILAGTYQMGAVDVKGPCKAPIEVQVDGTIQAPTNLANLKGAEQWFKVQHVNSFTLSGKGVFDGQGPIAWKQNDCTTNKNCKMLCMNFGFNFLNKSIVRDLTSRDSKNFHVNVLACNNLTFDGFKISAPEDSPNTDGIHIGRSTDVKVLNTNIATGDDCVSLGDGCKNITVQNVNCGPGHGISVGSLGRYDNEEAVEGLLVKNCILTDTDNGLRIKTWPSTPLTITVTDMHFEDITMKNVSNPVIIDQEYCPWNQCSKKSPSKIKISKVSFKNIKGTSGTKEGVIFICSSGAPCEGVEMTDVDLTFNVAATTAKCANVKPVITGKAPTCAA

SEQ ID NO: 183809 - protein, 208 aa, Glycine max
  Coding DNA Sequence Number=SeqID_67031
  Gene Ontology: Mol. function=RNA-directed DNA polymerase activity; Cellular component=chromatin; Biological process=chromatin assembly or disassembly
  Subcellular localization annotation: CTP_CleavageSite=63; ConfidenceScore=5.19e-01
MTLTLCIKKGLQTRQLMLYQGKVRRRSFKVYLGLNRSYQGAVRCTPFKVVGGRVPSSLARFISGEMLVEVVAQDMMERDKALKQLKYHLGRAQDHMTRYANAHRVPSKIKVEDWVYLKIRPLRKTSMPIRLYPKLVVRYYGPYQVVQANWSSGFSTTTTRTCSYSSNFSCLPTQVSCWRSSGRSRAVSRAARPFQWCATASRVGERLG

SEQ ID NO: 183810 - protein, 167 aa, Glycine max
  Coding DNA Sequence Number=SeqID_67032
  Gene Ontology: Mol. function=transferase activity; Cellular component= intracellular; Biological process=translation
  Homolog annotation: Hit_ID=Q67V33; Match level="QueryCoverage=69%, HitCoverage=47%, E-value=1e-29, Identity=48%"; Hit description =Ribosomal protein-like
MDPTIDLDEVLDQVINEELEDNTDEEIIRLILESQQQLHGNTTRHSQRRRVKCAAAIRILAYGSPADSVDEYVRVGETTTVECLQRFVLGICTIFGNEYLRRPNNEDTECLLQMGAARGFPVLSGRAPAVQFTVNKTQYNMRYYLADDIYPDFATFVKTISMPQGEK

SEQ ID NO: 183811 - protein, 142 aa, Glycine max
  Coding DNA Sequence Number=SeqID_67033
MDVVGPPKEFIRENQLPLGGATPGKKVQTHDAQKENPTKGAPFEALSAGKSSPIVGSGRMLFSLCLMLFSIVCCIYSSLFVQMWACGIPRAAAECNKSNIEKSGLQSVQENLNLHCKFLPSSFPAWSDIFQAISEMTMYMGA

SEQ ID NO: 183812 - protein, 149 aa, Glycine max
  Coding DNA Sequence Number=SeqID_67034
  Homolog annotation: Hit_ID=Q9FNQ3; Match level="QueryCoverage=66%, HitCoverage=27%, E-value=7e-11, Identity=35%"; Hit description =Arabidopsis thaliana genomic DNA, chromosome 5, P1 clone:MAF19
MPPVLQLESLPVLNALTDIFQDNSPRLQDIALYFFPSELTERSRKNLDSILKFMNAEKSMLRSYINGVELLVFTSNQLDMDSKGAIAAVKTRHFLWGLFRQKKIDKAVERVPDLELVDMDIDMIGGKNMVGRADDVQNYKPKSDIPLGF

SEQ ID NO: 183813 - protein, 168 aa, Glycine max
  Coding DNA Sequence Number=SeqID_67035
MWLRGRESLRVAGNFNSSIFDVSEGAGEATRGGTNEGTVEDEEGFKEGLWGGPGPFGGGGEGESGGVGRKVCEERREIERCGEREADLTREACPKSHPRDRKDKEKSFMIYCECKKPRHFKFECLDLEKTKDKKKHFKTRDKKVLMRIWEDWTAHRLTKRQKKKQISA

SEQ ID NO: 183814 - protein, 111 aa, Glycine max
  Coding DNA Sequence Number=SeqID_67036
  Gene Ontology: Cellular component=chloroplast
MNGAKRSAEAVGCKKESVGERSALEGRTRASSAGRSGSENVGLSNANVGENPMPRKPKGSSARVIRGRENASSQSSSTRRYSAEVIHAILPGKARTTFNKWVPVPETDTGG

SEQ ID NO: 183815 - protein, 64 aa, Glycine max
  Coding DNA Sequence Number=SeqID_67037
MDMAWGSAEHANKDMIHDLGKDGFQQAHAPLYDKIQSHSKKSLYSRCTSFTRLSAVLSLVNLKA

SEQ ID NO: 183816 - protein, 59 aa, Glycine max
  Coding DNA Sequence Number=SeqID_67038
VRACNPLKARACSPLKVRASNPLEARTYSPPKGRTCSPLKVRECVEANDFDVLMMIMMI

SEQ ID NO: 183817 - protein, 99 aa, Glycine max
  Coding DNA Sequence Number=SeqID_67039
MKFQRISIGGSERGVKNRKIGFYGTRFGEDLSKIRSLEDLGMEETSNKPSGNRLQDIVIDYKLPVHVCDQEACHSQIIVASSIKSMHNNYQQRYTPLQQ

SEQ ID NO: 183818 - protein, 105 aa, Glycine max
  Coding DNA Sequence Number=SeqID_67040
MWLRMPPASWVTVTKSRVVDKSRAFAPTISFLNDHLEETLGPTKIGENHSKCINLTQGKDYGELGFWLKACRAAGHDTCQDLASGSGIKGMSPHYSHDTHATNDD

SEQ ID NO: 183819 - protein, 56 aa, Glycine max
  Coding DNA Sequence Number=SeqID_67041
MEKTKKLKSGEWVNDKSREFASIIPAPSLSPTIADGTEHHANDAQVDRPYDMGNNH

SEQ ID NO: 183820 - protein, 76 aa, Glycine max
  Coding DNA Sequence Number=SeqID_67042
MRSRHYRIATVIDFYIVLHSFFVHHSLGEPTMKSKRKHHTKRNFSELSMTENLADHSFQGRALSAEGTLNQAERKR

SEQ ID NO: 183821 - protein, 151 aa, Glycine max
  Coding DNA Sequence Number=SeqID_67043
MLRAIRSHALRCPHRTCARARVMGEVEEIQEKMKADMEAIKEKMATMMEAMMSVKKIMEANAVAIAATSVVAKVNPTSPSGINQMNHPTSAMVGKDLGSTGGPHYVQSQNKHAFPPYGLPPNYTPPNVAYTPNEDVNNSTPIPIESQQPQN

SEQ ID NO: 183822 - protein, 225 aa, Glycine max
  Coding DNA Sequence Number=SeqID_67044
  Gene Ontology: Mol. function=monooxygenase activity
  Homolog annotation: Hit_ID=Q6DB30; Match level="QueryCoverage=99%, HitCoverage=76%, E-value=1e-53, Identity=47%"; Hit description =Putative monooxygenase
  Subcellular localization annotation: CTP_CleavageSite=36; ConfidenceScore=5.26e-01
TAGVSCSRGRAHTSYPPRHRHHHPAAGKCPARGRRRGGAGSAERRTPGSGARLRRHANLIFAVWPDQRTARRRVCRPVAYAAQRVARRHAGPSGQSSLSAGSHAGAAPAKPDDRCLSRGAAVGRGAPHPRFTHRVCCRLERLRAPPCRARSAAPGGAVSQGGPRHHRQHAGESCAPARCAYRRCRRGAGFAAGRQHADARHRHHLPGALYRSAARRYAAFGGVNC

SEQ ID NO: 183823 - protein, 92 aa, Glycine max
  Coding DNA Sequence Number=SeqID_67045
MEAWRKCLVSQPTLRWEGDARLTIASFEEGKTRGVTTNVYLKKILEKQKTGLQILRNKGSGVVYARESFLGSTRAGLLLLRILNCDEELRPT

SEQ ID NO: 183824 - protein, 124 aa, Glycine max
  Coding DNA Sequence Number=SeqID_67046
  Homolog annotation: Hit_ID=Q84MH2; Match level="QueryCoverage=33%, HitCoverage=13%, E-value=1e-10, Identity=71%"; Hit description =Putative inosine-uridine preferring nucleoside hydrolase
MANVNPTVEVNIFGYSEAADVVFTSGVDVLAVGINVTHQVVLTEFMHKTPVPPWSLIVTVFGVSSTNSASRPSRDGLSTGRDKYPDFQGDISCRHWARLVTPMAKFDPEIVIEFYANAWPTEEG

SEQ ID NO: 183825 - protein, 79 aa, Glycine max
  Coding DNA Sequence Number=SeqID_67047
MSKYCLNVNIVGRYCLNSGGNIAASSKILSPRWCVVLCLYDGDFRGGGAVLRCRDGALLSGFCVSVAEVQNSKSQDRIK

SEQ ID NO: 183826 - protein, 167 aa, Glycine max
  Coding DNA Sequence Number=SeqID_67048
MGEVEEVQEQIKIDMEAMKEQMATIMEAMMSMKKIMEVNAAAIATTSTIAEVDLTSPSGLNQMNHPTSDMVCLGGKELEDPGGPHLVRKNKHAFLPYGLPPNYTPPNMAYNPNENVNNSTPILIENQQPQSDHAHVSRPMGETHEMPQHNLADFESRLGYAAKGQTV

SEQ ID NO: 183827 - protein, 299 aa, Glycine max
  Coding DNA Sequence Number=SeqID_67049
  Homolog annotation: Hit_ID=Q12M36; Match level="QueryCoverage=99%, HitCoverage=80%, E-value=7e-13, Identity=22%"; Hit description =Hypothetical protein precursor
MLEPLLQRLEAWRPTAIAVENLSGLQCDFMRRNPARYAESVADYCVDPAPAQAATGLDVPSANVEMERLLAEWPKAPTAAQRRRLAAVFLAAGESSSAVVQWLRLPREERRASDSLTPELVRFLDTRMTRRNEAGLVAGVLAARLGLERLWSVDDHTADSPTPESQQKAYAAAIRGAWDNSFVKARRAADERLEANLDQADGLLAMYRAYNAPEAVMAAFNSDFGATLVEPSPEGFGRNYVGYWETRNLRMVANIRDILGQQPGTRMLTIVGASHKGYYEAYLNLMHDVQLVSSDEVLR

SEQ ID NO: 183828 - protein, 182 aa, Glycine max
  Coding DNA Sequence Number=SeqID_67050
  Homolog annotation: Hit_ID=Q1T493; Match level="QueryCoverage=94%, HitCoverage=31%, E-value=1e-21, Identity=30%"; Hit description =Nucleic acid-binding, OB-fold, subgroup
MVVFRGEILSCTLWENYCTQFLSYLNERGDDGPMVIILTHARIKDAQGSYPASVSNSFKASKLLINDPILEIQEFKERLLDLGVEVSRVLLPGDQATSQVSGGSQLSSKDSFLSKAEAKTILEIDAISEDVVCVTVGTISKIVMDNHSWSYPACAQCHRKTDIQTGPFTCGCGKDNDQPVLR

SEQ ID NO: 183829 - protein, 94 aa, Glycine max
  Coding DNA Sequence Number=SeqID_67051
MGVQVPQSGQAKVTSHQTDGPRTKLGYDTCASGVLCSVGDWRWTSETVPPLVAGVAHLQLVVGPPLAAATLGPALAWGAVFLDEGDVPLSSPIS

SEQ ID NO: 183830 - protein, 332 aa, Glycine max
  Coding DNA Sequence Number=SeqID_67052
  Gene Ontology: Mol. function=chitin binding; Cellular component =extracellular region; Biological process=chitin metabolic process
  Homolog annotation: Hit_ID=UPI000044A8F0; Match level="QueryCoverage =73%, HitCoverage=99%, E-value=3e-39, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLTFSGLYALTFRGLHILAIRGLQVLAIRGLHALTIRGLHVLAIKGLHAFTIKGLHVHTFRGLHALTFRGLQVLAIRGLHALTFRGLHVLTIRGLDALTFRRLHALAFRGLQALAFRGLHALSFRGLHVLAIRGLHALTIRGLHVLAIRGLHALNFIGLHVLTFRGLHVLAFRGPHVRAFRGLHALASRELHALTSRGLHAFAFRGLQILAFRGLHVFTFRGLHVVAFIGLHAFSFSGLDTLAFKGPPPDIGGRPMVRAHPEREQHSAKRPQCRSPPAEVLVGLYRSDIGPWGFQLGLWASVSPTGDHACKTPSGPEEVQQGLEVASSDYGP

SEQ ID NO: 183831 - protein, 162 aa, Glycine max
  Coding DNA Sequence Number=SeqID_67053
  Gene Ontology: Mol. function=RNA-directed DNA polymerase activity; Cellular component=signal recognition particle, endoplasmic reticulum targeting; Biological process=RNA-dependent DNA replication
GAIVHILNITPKEGKGIEGLKRIHEDPPVEYWNDPKSDLRKRHVPSYYERELMNKLQRLVQGSMSVEEYRQQMELLLLRAGLREEERTSIARFLSGLNMEVRDKVELLPYRDLDELVQLCIRVEQQLKRKPSSKSYGSHSYPRKDQAHGILGAAPSKPKEDQ

SEQ ID NO: 183832 - protein, 82 aa, Glycine max
  Coding DNA Sequence Number=SeqID_67054
MENLHGFAHGNVSEALLKHLGLDFLHGNNFFSPKTVEMHSQGGKGGGGCRPARLGVAQASWVASSISNPASKIFWKGLDSKI

SEQ ID NO: 183833 - protein, 54 aa, Glycine max
  Coding DNA Sequence Number=SeqID_67055
MAEYVCPYANKLGEVPPQATPLSHSPLAGSLHWLGTGSYLTQWKAGSSGFYRLN

SEQ ID NO: 183834 - protein, 197 aa, Glycine max
  Coding DNA Sequence Number=SeqID_67056
  Gene Ontology: Mol. function=alcohol dehydrogenase activity; Cellular component=membrane; Biological process=electron transport
  Homolog annotation: Hit_ID=Q2XF97; Match level="QueryCoverage=99%, HitCoverage=16%, E-value=9e-85, Identity=75%"; Hit description =Aldehyde dehydrogenase family protein, putative/cytochrome c family protein, putative
IRFVGEGVRQGGNTAHPGGAHDRRHVLDADAQRRIFIRRHRGTVAHFIGHRQRFNPAGQQQRQRRRAVGRIIGAKIVGDRMSGGVQPAVHLHQLRGALWFPHMLLLAGQLHPHRPAHRARQQRRVGADVIGAIAAIATGRLHANDLDLRFRVFQQPSQIGAQQVRVLAARPDLQALRPVVRQRAGRANRGMQLIRPQ

SEQ ID NO: 183835 - protein, 55 aa, Glycine max
  Coding DNA Sequence Number=SeqID_67057
MKFGLCGKKFGQELSEIWLEEKLGARVFERVRSCRIEVSRSLKMRIMLFLLVFHP

SEQ ID NO: 183836 - protein, 106 aa, Glycine max
  Coding DNA Sequence Number=SeqID_67058
VDKSEAFAPTYPPSKRKSDLRSSFEGESSESFYLEGDHFKALDLKNDPFTWRENGLNDRLKLVKNGRKETEIERNKNESQETRNELKVSDLETYPLKNEERMKNGE

SEQ ID NO: 183837 - protein, 247 aa, Glycine max
  Coding DNA Sequence Number=SeqID_67059
  Gene Ontology: Mol. function=chitin binding; Cellular component =extracellular region; Biological process=chitin metabolic process
  Homolog annotation: Hit_ID=UPI0000612705; Match level="QueryCoverage =47%, HitCoverage=91%, E-value=2e-13, Identity=25%"; Hit description =UPI0000612705 related cluster
LHALTFRGLYVLPLRGLHVLAFGGLHALIFRGLNVLPFRGLHALAFRGLRVLTFKGLYAFAIRGLHGLTFKGLHVLTFRGLHCLTFRGLHVLTFRGLHALAFKGRHILNFRGLHALAFKGLFPGPPPDIGRRPTVRAQPEREAIAQLLCIPGQDLTRATAKRRVRVMCTNMTTLTQIWMTLLLSNIPPDDHNADLPPAEVSVGIAPTRHPVDPEKSNRALGDRAHKAPSGPGGVRQGPRVFSLGYGP

SEQ ID NO: 183838 - protein, 180 aa, Glycine max
  Coding DNA Sequence Number=SeqID_67060
  Homolog annotation: Hit_ID=Q5XM22; Match level="QueryCoverage=47%, HitCoverage=74%, E-value=9e-18, Identity=51%"; Hit description =Resistance-like protein HAAS-2
MDCSSSCLSPTPEAFRDLGQSGGYAWGATALVHMYDQLDETSRTTTRQIGRYLTLLQCWIYEYFSSVHQCVTDDAYEETSPRASRWLTTKAHMKGIIGASYRARCDALTVIDVCWLPYTEMGPMVVTVQPERVLCQFRYIQSIPPPPVSASLSYDDMDDRWMHFSDHVAAVGDICVMPRQ

SEQ ID NO: 183839 - protein, 79 aa, Glycine max
  Coding DNA Sequence Number=SeqID_67061
MGARHLEAVKQRLHAIKQWSRTKLGYGNGVNGLMPGIYAKFHPMAFLCFLSTSNNFSSCAAVREAEMITGNFSFFLVLQ

SEQ ID NO: 183840 - protein, 119 aa, Glycine max
  Coding DNA Sequence Number=SeqID_67062
MARLAASSGCMGYISVLDGDDVLVMRMYHGRFFTQLVTPPGTRVDNWQTASINSPLNIDALCKELALIRQQGWALARNETLPGISSLAVAEAAPGYPEALLSELRATAALMAEKYGAAS

SEQ ID NO: 183841 - protein, 374 aa, Glycine max
  Coding DNA Sequence Number=SeqID_67063
  Homolog annotation: Hit_ID=Q393D8; Match level="QueryCoverage=96%, HitCoverage=67%, E-value=1e-92, Identity=51%"; Hit description =Membrane protein
  Pfam annotation: Domain name=MFS_1; Domain location=41-326; Score= -47.0; E_value=0.045; Accession=PF07690.6; Description=Major Facilitator Superfamily
  Pfam annotation: Domain name=OPT; Domain location=13-371; Score= -196.9; E_value=0.00038; Accession=PF03169.6; Description=OPT oligopeptide transporter protein
  Pfam module annotation: Pfam domain module=MFS_1::OPT; Domain location=41-326::13-371
MRLDNPIKNIGVGLMLVLLSVAGAIIGVQLITTIGVTPNTSIIGALFAMLLARIPLQWFRRYRSVEVQNLAQTAISSATFGAANSLLMPIAVPWALGEPQLVLPLFVGVSAAMLLDAWLLYRLFDTRVFPASNAWPPGVAAAEAIKAGDKGGRQAWLLVAGIVGGVAGSMLKIPMSAFGTAFIGNIWALTMLGIGFLLRAYAQPVAGIDINALYIPHGVMVGAGLVALIQVVQVIRSRRHDNLNVSRSDNEVKRALGLGTVGYIVISALLALGGGLWSEMGLPMLLLFIIYAAFAAFVHELIVGIAAMHSGWFPAFAVALITLILGILLGFPPLGLCLLCGFTAATGPAFADMGYDLKAGFILRGNGADVQQEL

SEQ ID NO: 183842 - protein, 421 aa, Glycine max
  Coding DNA Sequence Number=SeqID_67064
  Homolog annotation: Hit_ID=UPI00005FA2AA; Match level="QueryCoverage =31%, HitCoverage=75%, E-value=8e-41, Identity=64%"; Hit description =COG0703: Shikimate kinase
YPDVDGQPGGLVGIVFPLMSGFHTDSGDPLPAIEYRQSRIADIFHLFRDGPAGQGGTLCRFWLTLQPIGQYVRGRVEPDDLAMLAHEVAIDVSQHHAAAGGDYAGRRGNRSQRFTFTRAKAVPAFRCHNLCHATLCGELQVVVGVTKGIAQRLRQRLANGGFTATACADQIDGQRTSCWSPEEQHAMPNRRFTMQSQEQQLIESLFSRLKQAESQSGPRDAGAEQLINQHLQSQPGAPYYMAQAILIQEAAMKKLNAQVSELESRLAQAQQQAPQQSSGGFLSSLFGGGSRPAQPQQPAWNSAPQQPQYAAPPQQQYAAPARGTGFLGGALQTAVGVAGGVVMADMLTSLFHHSQPEEIVNIINEPALPQVDDNLDTFNGNDSNNAFLNDNSGWDNNSFADNNDFNDFGSGGDFDDDDSFV

SEQ ID NO: 183843 - protein, 469 aa, Glycine max
  Coding DNA Sequence Number=SeqID_67065
  Gene Ontology: Mol. function=oxidoreductase activity, acting on single donors with incorporation of molecular oxygen, incorporation of two atoms of oxygen; Cellular component=integral to endoplasmic reticulum membrane; ...
  Gene Ontology: Cellular component=Biological process=peptidyl-amino acid modification
  Homolog annotation: Hit_ID=Q9KGX6; Match level="QueryCoverage=53%, HitCoverage=82%, E-value=1e-124, Identity=81%"; Hit description =Putative dioxygenase for synthesis of lipid
  Pfam annotation: Domain name=Asp_Arg_Hydrox; Domain location=31-186; Score=299.6; E_value=5.8e-87; Accession=PF05118.5; Description =AspartylAsparaginyl beta-hydroxylase
  Pfam annotation: Domain name=Rieske; Domain location=253-345; Score =61.0; E_value=3.8e-15; Accession=PF00355.16; Description=Rieske [2Fe- 2S] domain
  Pfam module annotation: Pfam domain module=Asp_Arg_Hydrox::Rieske; Domain location=31-186::253-345
MAPINMFMTGLSRLPAKQPYFPVEDFPELRQLTDNWQVIRDEAIRLQDHIKAAQTHNDAGFNTFFKRGWKRFYLKWYSDAHPSARELCPVTTELVSNIPGVKAAMFAELPPGSHLGKHRDPYAGSVRYHLGLQTPNDDRCFIEVDRQRHSWRDGQAVIFDETYVHWAQNESEQTRIILFCDIERPMKWRWAQAVNHWVGSTLMSAAASPNDENDRTGFLNRIFKYVYALRDAGQNLKKRNRRLYYWVKHGLIVAIFALIIALAQRKPTKVTVGETDMVLIRDGDRVQALQAKCPHAGAPLEQGAVCGDKLVCPWHKAVFELRDGKMCEPLALANLKRYPVRIEQGQVLINPQAMSPASAPVAQGEAPVCLILGSGAAGSAAIWTLRDEGFSGRIVRIERESDAPYDRTTLSKFVPSGKMAIDEGEVVQLKAQEQTLVLKDGQQVKFDQLLIATGGVPQPLDIPGKDLDG

SEQ ID NO: 183844 - protein, 289 aa, Glycine max
  Coding DNA Sequence Number=SeqID_67066
  Gene Ontology: Mol. function=tetracycline:hydrogen antiporter activity; Cellular component=integral to membrane; Biological process=tetracycline transport
  Homolog annotation: Hit_ID=Q5PFU9; Match level="QueryCoverage=75%, HitCoverage=54%, E-value=1e-72, Identity=64%"; Hit description =Possible efflux pump
MTHQQGLHRRHHRAIGKAEQKAQDAQLRGAGDKRHGNQQQQRGDHGRQQNTLGTDAIAEFAETRCGDECRHAGQRGNHTTEKRDILRIRRQLTHEQRQDRIHRAVTHLNHHGGDEQAEHQAWIIEAAHHLASAQFVLLAHRRVAGLLNQKQRHQKADHQQYRGNDKHHAQAQPVGQQTANHWPEDHAANLSGRHAAQRPAAALTRHLRGHQRHGVGNITGHTERVAATDTQLFHPNQTDIRLIFQDSMERNMSADVGKNETRVQSNNLVTLPDGKTWHEDENAVFRCRA

SEQ ID NO: 183845 - protein, 316 aa, Glycine max
  Coding DNA Sequence Number=SeqID_67067
  Gene Ontology: Mol. function=protein binding; Cellular component =integral to membrane; Biological process=protein amino acid phosphorylation
  Homolog annotation: Hit_ID=Q949G9; Match level="QueryCoverage=99%, HitCoverage=82%, E-value=3e-54, Identity=35%"; Hit description =HcrVf1 protein
  Pfam annotation: Domain name=LRR_1; Domain location=117-139; Score =12.6; E_value=1.3; Accession=PF00560.23; Description=Leucine Rich Repeat
  Pfam annotation: Domain name=LRR_1; Domain location=141-163; Score =1.3; E_value=1.6e+02; Accession=PF00560.23; Description=Leucine Rich Repeat
  Pfam annotation: Domain name=LRR_1; Domain location=165-187; Score =10.6; E_value=3; Accession=PF00560.23; Description=Leucine Rich Repeat
  Pfam annotation: Domain name=LRR_1; Domain location=189-211; Score =19.4; E_value=0.013; Accession=PF00560.23; Description=Leucine Rich Repeat
  Pfam annotation: Domain name=LRR_1; Domain location=213-235; Score =17.1; E_value=0.064; Accession=PF00560.23; Description=Leucine Rich Repeat
  Pfam annotation: Domain name=LRR_1; Domain location=237-259; Score =19.4; E_value=0.013; Accession=PF00560.23; Description=Leucine Rich Repeat
  Pfam annotation: Domain name=LRR_1; Domain location=261-283; Score =17.1; E_value=0.064; Accession=PF00560.23; Description=Leucine Rich Repeat
  Pfam annotation: Domain name=LRR_1; Domain location=285-307; Score =20.9; E_value=0.0047; Accession=PF00560.23; Description=Leucine Rich Repeat
  Pfam annotation: Domain name=LRR_1; Domain location=40-61; Score=9.2; E_value=5.4; Accession=PF00560.23; Description=Leucine Rich Repeat
  Pfam annotation: Domain name=LRR_1; Domain location=66-88; Score=8.2; E_value=8.4; Accession=PF00560.23; Description=Leucine Rich Repeat
  Pfam annotation: Domain name=LRR_1; Domain location=90-115; Score =3.4; E_value=65; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =117-139::141-163::165-187::189-211::213-235::237-259::261-283::285 -307::40-61::66-88::90-115
MGKIPSQIGNLSNLVYLDLGSYLSEPLFAENVEWLSSMWKLEYLYLTNANLSKAFHWLYTLQSLPSLTHLYLSDCKLPHYNEPSLLNFSSLQTLHLSFTSYSPAISFVPKWIFKLKKLVSLKLWGNKFQGRIPGGIRNLTLLQNLYWSGNSFSSSIPDCLYGLHRLKFLNLRANYLHGTISDALGNLTSLVKLDLSYNQLEGNIPTSLGNLTSLVELDLSYSQLEGNIPTSLGNLTSLVKLDLSYNQLEGNIPTSLGNLTSLVELDLSYSQLEGNIPTSLGNLTSLVELDLSGNQLEGNIPTSLGNLTSLVELDLS

SEQ ID NO: 183846 - protein, 241 aa, Glycine max
  Coding DNA Sequence Number=SeqID_67068
  Gene Ontology: Mol. function=alkylbase DNA N-glycosylase activity; Cellular component=nucleus; Biological process=response to DNA damage stimulus
  Homolog annotation: Hit_ID=UPI00006BE237; Match level="QueryCoverage =86%, HitCoverage=94%, E-value=2e-35, Identity=42%"; Hit description =3-methyladenine DNA glycosylase
  Pfam annotation: Domain name=Pur_DNA_glyco; Domain location=11-217; Score=148.5; E_value=1.8e-41; Accession=PF02245.7; Description =Methylpurine-DNA glycosylase (MPG)
MSASTPLRRATRDDVLRSAVEVAPTLLGGELRTVVMEDAGPVEVRVRITEVEAYHGQGTGDLLDPGSHARMGRTARNATMWGEPGHLYVYLSHGIHSCINVACGPEGQGDGVLLRAGEIVSGEEAAARRRRALLPLSRAARRDLARGPGRLGQAVGLRHPLHDGIDAIVAEERQGATAELWLGEPRDDVVSGPRVGVAGVAGTDAFPWRFWIEGDPSVSAFRWGRGAAEAAALRAASAVLD

SEQ ID NO: 183847 - protein, 95 aa, Glycine max
  Coding DNA Sequence Number=SeqID_67069
DCARKTPSGPGEAQQGPRVSSSGYGPLLVLQGARSPQQGIAPARHPVDLEKYNRVLGFPALITGLYQFYGVSITPNKVIRPPTNRAFIKRYCAPR

SEQ ID NO: 183848 - protein, 185 aa, Glycine max
  Coding DNA Sequence Number=SeqID_67070
  Gene Ontology: Mol. function=protein serine/threonine kinase activity; Cellular component=membrane; Biological process=protein amino acid phosphorylation
  Homolog annotation: Hit_ID=Q9FE20; Match level="QueryCoverage=89%, HitCoverage=38%, E-value=4e-65, Identity=72%"; Hit description =Serine/threonine-protein kinase PBS1
  Pfam annotation: Domain name=Pkinase_Tyr; Domain location=79-184; Score=-118.8; E_value=3.5e-05; Accession=PF07714.7; Description =Protein tyrosine kinase
  Subcellular localization annotation: CTP_CleavageSite=72; ConfidenceScore=5.19e-01
MGCFSCFDSSSKEDHNLRPQHQPNQPLPSQISRLPSGADKLRSRSNGGSKRELQQPPPTVQIAAQTFTFRELAAATKNFRPESFVGEGGFGRVYKGRLETTAQIVAVKQLDKNGLQGNREFLVEVLMLSLLHHPNLVNLIGYCADGDQRLLVYEFMPLGSLEDHLHDKSQQYLFTLWEGRIPLGG

SEQ ID NO: 183849 - protein, 73 aa, Glycine max
  Coding DNA Sequence Number=SeqID_67071
MEESNRENNKYHISQSRGSALGGEEHIGEWRNPIGKITKITFPSQEGPLLTVKNTLGKGGFNRENNKDHISQS

SEQ ID NO: 183850 - protein, 98 aa, Glycine max
  Coding DNA Sequence Number=SeqID_67072
  Gene Ontology: Mol. function=DNA binding; Biological process=DNA integration
  Homolog annotation: Hit_ID=Q8LM78; Match level="QueryCoverage=98%, HitCoverage=26%, E-value=4e-14, Identity=35%"; Hit description =Putative retroelement
MAHFIPCKKNNDACDVAVLFFKEVVYLHTKKHHFKPRHQVRTKLLFSTTCNPQTDGQTKHKDAQAKVEYVKAQIAKKNESYAKQANKNKKEVILEPGD

SEQ ID NO: 183851 - protein, 95 aa, Glycine max
  Coding DNA Sequence Number=SeqID_67073
MQTSSTHVAESTQLLKVRKVQRINEALGLNPELGLDLKRAKSPALFSLEDQAQLSLRNMATPPSSPRPLLESTTPSSPSTLKKTRKETRLRSLAT

SEQ ID NO: 183852 - protein, 74 aa, Glycine max
  Coding DNA Sequence Number=SeqID_67074
MDIDSYRETIFGSYLTSSCMRSSLSEFQVIKAFNINIHAPKAGKIISWFPSLCSFQRLGKALAGGGFSFSPQGF

SEQ ID NO: 183853 - protein, 197 aa, Glycine max
  Coding DNA Sequence Number=SeqID_67075
MFQGYAMCAYLDKQFRATIINSRLWELGNILDKQFCHTCVACTHSWCHRIFPIQATCNLNEKELQEVVSMLVKKFLADKQDKLERPLKFAVGFNRRGIEETTLAKENSNDSKAFSLLDRNKCFGVVASAVNHVVEDSVVDLRSPELSVLVELLPLSGVPDASIIVAVSVLPRNLVSTKPRLCIKALNSNTKEGSVAT

SEQ ID NO: 183854 - protein, 98 aa, Glycine max
  Coding DNA Sequence Number=SeqID_67076
MDVSLAQVTKLNEGKSTSQPSNVLVNTTTETAIAEVEDELSLSLTLPNPSPQSSGSEISEAISSCPGFGNNYKDCSSSSTHTLKERINLDLSLALCGN

SEQ ID NO: 183855 - protein, 80 aa, Glycine max
  Coding DNA Sequence Number=SeqID_67077
MHVDVRMTTWCDLGNWEEQQNVEETSTIREQPNVEKEPNSKAIQEAELAEAGSNTGASTEKAQRPKRTITKPCYLRDFVE

SEQ ID NO: 183856 - protein, 212 aa, Glycine max
  Coding DNA Sequence Number=SeqID_67078
  Gene Ontology: Mol. function=DNA binding; Biological process =regulation of transcription
  Homolog annotation: Hit_ID=Q10S98; Match level="QueryCoverage=37%, HitCoverage=20%, E-value=4e-28, Identity=77%"; Hit description=Myb -like DNA-binding domain, SHAQKYF class family protein, expressed
  Pfam annotation: Domain name=Myb_DNA-binding; Domain location=20-71; Score=44.6; E_value=3.4e-10; Accession=PF00249.21; Description=Myb -like DNA-binding domain
MGSCGREGSVRQYVRSKVPRLRWTPELHRCFVHAIDSLGGHHKATPKLVLQLMDVKGLTISHVKSHLQMYRSMRGDLGRQGRTSSQHRNQSFEEHDDGCVDEGNDVGVEYSCSKPMGRESDSFFGHSNLPPKRARIETRSSISESLQCSQRLCDAVQNPYCFYDYLQQKKPMADEHKEFSTWQQAQPHSLLFPEFPNHTSFNSPNQQSDFLQ

SEQ ID NO: 183857 - protein, 408 aa, Glycine max
  Coding DNA Sequence Number=SeqID_67079
  Gene Ontology: Mol. function=RNA-directed DNA polymerase activity; Cellular component=chromatin; Biological process=chromatin assembly or disassembly
MKVDVPRFDGSDPSGWIFKISHFFAYHSTSESERLTIASFYMEGSALAWFQWMTRNHQLTTWASFLEAIEARFAHSPYEDPTGILFKLTQKGCFVSGFDPEIRREVQALQPLTLVHVAGLAHLQEEKLTETRPPSNPTIFPPRSPSPPTLPLLPTPPKLPPLPFKRLTPAELASCREWGLCFNCDEKFTRGHHCAPRFFLLVADEDSPNEPLDPLIPCPNPDPEDQPQPEPPKAQISFYVLRARLVRHLDLAAQPTPPLRVFFGNGNMIDSHQLCVGATIQVQGHAFTTDLHVLPICGADVVLGVHWLKSLGPILTNYTTLTMKFVHHGKIIELRGDTTQDLESALRHPHPKPSSQKFNPSSINSPSCSKHCPHYPRPDQPTIISTFFPRLPRHHSPEHEPLLVAGAT

SEQ ID NO: 183858 - protein, 85 aa, Glycine max
  Coding DNA Sequence Number=SeqID_67080
MERINSFSLSLSLSLILKCVSVIMMEMAEESRLGKPRGRRYLWRDQPNDFESGMVMEKKGRKRRKRLNDVKACVRKVKEGSKIFL

SEQ ID NO: 183859 - protein, 313 aa, Glycine max
  Coding DNA Sequence Number=SeqID_67081
  Gene Ontology: Mol. function=DNA binding; Biological process =regulation of transcription, DNA-dependent
  Homolog annotation: Hit_ID=Q1T1E6; Match level="QueryCoverage=24%, HitCoverage=19%, E-value=3e-25, Identity=84%"; Hit description=Zinc finger, CCHC-type; Peptidase aspartic, catalytic
  Pfam annotation: Domain name=B3; Domain location=149-239; Score=65.3; E_value=2e-16; Accession=PF02362.12; Description=B3 DNA binding domain
MAAHRPGRDATLPILFFKIILKTNLERLKIPNKFTSKYGGGLPNPVFIKPLDGTQWKVNWTKQNGTSQIDVLILDQSALEIDYLCDTCDENEILDHTHEAPNMIFGEWPDQKAEKIRGEEPIERTSSLNMPTQSRAKEVARNFISYNPFFTVFIKPVHVADGRLPLPDLKGIIENKEKYLKLQLGERSWNVKLLNNRLSAGWTSFASESELQPGDVCVFELINREDSVFKVHVFKRQCSERLGKQVRKLMTRWNVRDFELILGGKVTHKMIINGKMFHPGMKDGPMVRYSASIDERATVDYFLQDHEMAFGPR

SEQ ID NO: 183860 - protein, 444 aa, Glycine max
  Coding DNA Sequence Number=SeqID_67082
  Gene Ontology: Mol. function=DNA binding; Biological process =regulation of transcription, DNA-dependent
  Homolog annotation: Hit_ID=Q1SCZ2; Match level="QueryCoverage=60%, HitCoverage=55%, E-value=3e-17, Identity=25%"; Hit description =Transcriptional factor B3
  Pfam annotation: Domain name=B3; Domain location=204-300; Score=32.7; E_value=1.3e-06; Accession=PF02362.12; Description=B3 DNA binding domain
MATPPLVQRKASLPIHFFKTILESNVEWMKIPNKFTRRYGGGLSNPVFLRPPDSKEWEVHWTKENGEYNGTSLIDVLILDRSAIEIDDEMGTVDPNVEKLHADKGVRSDHHQTKVRVRPRSPLVSSEPRNKMPSGSHRNVERNFNLQKLDADAVVHSDEGAKFRKSVKHQPRGEKAIERTSSLNTPKLLRAKKVARNFVSNNVFFTVVIARPQLEEGAWKVVPKFLDMERKKQNVMLQIENRMWPVKLTNGGGDMQYDRFTSGWSLFAKESKLQAGDICIFELIDPDGPTLEQIPNKFTKRHGDRLSNPVFMKPPDGTEWEVQWTKQNGTSQIHVLILDHTTLEIHYPSSHTREENDNLVQSDDESVQVLEEGPDKNAEENDNLVNKSRFWMKGLTRILLMNQFKFWMNGITRMLHKSKYVPDLKSYIGNTKIVMLQVGENHGV

SEQ ID NO: 183861 - protein, 176 aa, Glycine max
  Coding DNA Sequence Number=SeqID_67083
MNKEVSGNQFTLSIKPNPSYHEPIPLELIRNLGIDNVNDVNLHIGERSWPVRFPKHNYDVAGNVKLEYVGDDIVIMEGISDERIVEEMKNEEDSLLSIFHSAHKWNDEEYSGNRLALVQCLGIPLKAWNEVCFSKLVSEFGKFIFVDKVTASREKIDVARVMVQIATPSTIIFCDN

SEQ ID NO: 183862 - protein, 168 aa, Glycine max
  Coding DNA Sequence Number=SeqID_67084
  Gene Ontology: Mol. function=DNA binding; Biological process =regulation of transcription, DNA-dependent
  Homolog annotation: Hit_ID=Q2HSK1; Match level="QueryCoverage=79%, HitCoverage=38%, E-value=4e-14, Identity=37%"; Hit description =Transcriptional factor B3
  Pfam annotation: Domain name=B3; Domain location=9-104; Score=30.6; E_ value=5.7e-06; Accession=PF02362.12; Description=B3 DNA binding domain
MSSICSDIHFFKRIEEDAIRNGELRIPRSFVNKCWEGMSNPVVLLLRNGAEWKVKWKKLDVDVWLIDDWKEFADFCCLDQDHLLVFKYMGKSRFQVVIFYQNGLEMQYPLMEETIDGNSLCQPKRAKSPLPFSSSIKKVKTNPRKEPSSYPGHDHDVKTEPAQSQRRK

SEQ ID NO: 183863 - protein, 223 aa, Glycine max
  Coding DNA Sequence Number=SeqID_67085
  Gene Ontology: Mol. function=DNA binding; Biological process =regulation of transcription, DNA-dependent
  Homolog annotation: Hit_ID=Q1SCZ2; Match level="QueryCoverage=91%, HitCoverage=46%, E-value=5e-19, Identity=31%"; Hit description =Transcriptional factor B3
  Pfam annotation: Domain name=B3; Domain location=131-220; Score=49.1; E_value=1.5e-11; Accession=PF02362.12; Description=B3 DNA binding domain
  Pfam annotation: Domain name=B3; Domain location=16-83; Score=13.3; E_ value=0.0023; Accession=PF02362.12; Description=B3 DNA binding domain
  Pfam module annotation: Pfam domain module=B3::B3; Domain location =131-220::16-83
MPGNFITEDQQKEDDHVFLWISNERAWHVKFYLSHSSGQILLSIGWMDFVKDNNLKIGNVCVFEQIKKPGISFRVVIFRDPEESSPFKFPGLQNIIAKSGSDGIPKEHSGRNVFDDSESRRFNNNKVSENHFTISIKPSQLCHMNVPKKFIKNHDIDNTKEVTLQVGKRSWNVTLDCYGRFTSGWSEFMSQCDLEAGDVCYFELIDKKKFVFEVRFKRCISID

SEQ ID NO: 183864 - protein, 261 aa, Glycine max
  Coding DNA Sequence Number=SeqID_67086
  Gene Ontology: Mol. function=nucleic acid binding; Cellular component= cytoplasm; Biological process=DNA integration
  Pfam annotation: Domain name=rve; Domain location=1-116; Score=10.5; E_value=0.00078; Accession=PF00665.16; Description=Integrase core domain
SGKRYGLLIVDDYSRWTLVMFLAYKDESFGVFFKFYKRIKNEKGVCIASIRSDHVESLKMKAERKNRSLHEMARTMLNDNYTPKHFGVEAVSTVCYLRNKFYIRPILKKIPYEIWKGPKPNIAYFHPFGCQCFILNTKHHLGKFDSKCDNGRLLGYSQTSKAYRVYNFRTLAMEEAIQIRFNDTKPDTKISELDESIADLRLGDGIGPSTSTYQPIEVDNDVRTLVELHKGKKALGAKWLLRNKLEEVGKVVSNKARSVAK

SEQ ID NO: 183865 - protein, 424 aa, Glycine max
  Coding DNA Sequence Number=SeqID_67087
  Gene Ontology: Mol. function=DNA binding; Biological process =regulation of transcription, DNA-dependent
  Homolog annotation: Hit_ID=Q1SCZ2; Match level="QueryCoverage=94%, HitCoverage=89%, E-value=2e-36, Identity=27%"; Hit description =Transcriptional factor B3
  Pfam annotation: Domain name=B3; Domain location=2-92; Score=27.7; E _value=4.1e-05; Accession=PF02362.12; Description=B3 DNA binding domain
  Pfam annotation: Domain name=B3; Domain location=207-304; Score=35.2; E_value=2.3e-07; Accession=PF02362.12; Description=B3 DNA binding domain
  Pfam annotation: Domain name=B3; Domain location=328-417; Score=30.8; E_value=4.7e-06; Accession=PF02362.12; Description=B3 DNA binding domain
  Pfam module annotation: Pfam domain module=B3::B3::B3; Domain location=2-92::207-304::328-417
MQYTILTISSSQRIPRSFVNKCWEGISNPVLLLLPNGVEWKVKWKKLDADILLIEDWKEFAEFCSLDKDHLLVFEYLRKSQFLVVIFDQNGLEMEYPLMGGTLDGDEKGNSLCQHKRAKSPLPFSSSIKKVKGKTLTSYPSHGVRTERAQSQRTKVEFSKEFLAEDLERGGRGRGMMNAKRRCSNSNALKSSTALERAKAFRSENPFFIREMHPSYIHKYIMVMPGNFLTEDQQKENDSVTLWISEERAWHVKFYTNRSSGQINLSTGWVDFVKDNNLKIGNVCVFEQIKKTRISFRVFIFRDGEESSPSNFSDSEFRGCNNEVSENHFTLSIKPCQFYCMNVPKKFIRNHEMDGINEVTLQVGKRSWNVKLDCYGRFTSGLHDFMSQHNVEAGDVIHFELIDKKKFVFQVRVTRCISIDFELL

SEQ ID NO: 183866 - protein, 155 aa, Glycine max
  Coding DNA Sequence Number=SeqID_67088
  Gene Ontology: Mol. function=electron carrier activity; Cellular component=membrane; Biological process=electron transport
  Homolog annotation: Hit_ID=Q8SB26; Match level="QueryCoverage=62%, HitCoverage=57%, E-value=7e-19, Identity=49%"; Hit description =Putative blue copper-binding protein
  Pfam annotation: Domain name=Cu_bind_like; Domain location=28-94; Score=33.9; E_value=1.7e-08; Accession=PF02298.8; Description =Plastocyanin-like domain
MSGLVFTLLVTKKNEVAKQIMLHGQRDTILAVAMFLYVKGQHNVYEVTEDTFRSCDASSGVLAKFETGEDQVALSEVKRYWFICNVAGHCLGGMRFGIEVKDGNNNVTNSTDVAFNPPIEPTPSDNSCTSYYVSERWGVIKNLTPLGLLLFNYYF

SEQ ID NO: 183867 - protein, 415 aa, Glycine max
  Coding DNA Sequence Number=SeqID_67089
  Gene Ontology: Mol. function=transcription regulator activity; Cellular component=nucleus; Biological process=regulation of transcription
  Homolog annotation: Hit_ID=Q84WX1; Match level="QueryCoverage=98%, HitCoverage=79%, E-value=2e-74, Identity=38%"; Hit description=BHLH transcription factor
  Pfam annotation: Domain name=HLH; Domain location=177-226; Score =44.0; E_value=5e-10; Accession=PF00010.16; Description=Helix-loop -helix DNA-binding domain
MDPNILEETIGTQVLISVPGGLVELFVTKQVPEDHQLIDYVINQCIEAVNHSMSFHIDENSMSNMQSNPLIGDENEGNNNSRDTSTLQNMSSQWTSAVLQTNQEDQEHEHEHDTYQKSLMTTTDSQYVEPLEAKEKQEEDKDLLKNVVGRSDSMSDCSDQNEEEEDGKYRRRNGKGNQSKNLVAERKRRKKLNDRLYNLRSLVPRISKLDRASILGDAIEYVKDLQKQVKELQDELEENADTESNCMNCVSELGPNAEHDKAQTGLHVGTSGNGYVSKQKQEGTTVIDKQTQQMEPQVEVALIDGNEYFVKVFCEHRPDGFVKLMEALNTIGMDVVHATVTSHTGLVSNVFKVEKKDSETVEAEDVRDSLLELMRNRYRGWTHEMTATSGNSVESDQHQLHNHNQMGAYPHEFHS

SEQ ID NO: 183868 - protein, 346 aa, Glycine max
  Coding DNA Sequence Number=SeqID_67090
  Gene Ontology: Mol. function=oxidoreductase activity; Biological process=electron transport
  Homolog annotation: Hit_ID=O81816; Match level="QueryCoverage=89%, HitCoverage=73%, E-value=3e-83, Identity=50%"; Hit description =Monooxygenase
  Pfam annotation: Domain name=FAD_binding_3; Domain location=1-271; Score=-153.3; E_value=0.047; Accession=PF01494.9; Description=FAD binding domain
MEKKKMDKKWLVMECDYIFDYGATNIKLVFRGHRKTLMLEAIANVLPSGTIRFLSKVVAIEESGFSKIKIVRLADGTSIKTKVLIGCDGINSVVAKWLGFKEASFTGRYVIRGYKKVMDNHGLEPKFMHYFGKGFRSGVMPCDDKTVYWFLTWTPTSEEKELANNPSKMKQLVLRKVEKMPSNIKTFIEKTDPKDILTSPLRYRHQWELMLGNISKGNVCVVGDAFHPMAPDLGQGGCCALEDGIILARYLAEAFSRKTCKHVVKKMGEEGKAKEQYKKIDASLRKYAKERRWRNIDISVTSYVLGFVLQGDLKMVAHFRDKVLPDFLAELLLKKSDFDCGKLNAS

SEQ ID NO: 183869 - protein, 462 aa, Glycine max
  Coding DNA Sequence Number=SeqID_67091
  Gene Ontology: Mol. function=nucleic acid binding; Cellular component= nucleus; Biological process=mRNA processing
  Homolog annotation: Hit_ID=Q9ZVW9; Match level="QueryCoverage=85%, HitCoverage=70%, E-value=1e-149, Identity=69%"; Hit description =Putative splicing factor
  Pfam annotation: Domain name=RRM_1; Domain location=194-264; Score =85.5; E_value=1.6e-22; Accession=PF00076.12; Description=RNA recognition motif. (a.k.a. RRM, R
  Pfam annotation: Domain name=RRM_1; Domain location=391-446; Score =7.4; E_value=0.03; Accession=PF00076.12; Description=RNA recognition motif. (a.k.a. RRM, R
  Pfam annotation: Domain name=RRM_1; Domain location=90-160; Score =51.0; E_value=3.9e-12; Accession=PF00076.12; Description=RNA recognition motif. (a.k.a. RRM, R
  Pfam module annotation: Pfam domain module=RRM_1::RRM_1::RRM_1; Domain location=194-264::391-446::90-160
MIFLAIGPGTGTSGHGFQKFLPPGINAGGGVMGLCLREAIHLLMPVAKNNVHLGMLVTVSVTACNRLVRHKEKKEETTEPADPERDQRAVFAYQISLKADERDVFEFFSRAGKVRDVRLIMDRNSRRSKGVGYIEFYDVMSVPMAIALSGQPLLGQPVMVKPSEAEKNLVQSTTSVANGLTGLIGPYSGGARKLYVGNLHISITEADIRRVFEAFGQVELVQLPLDESGHCKGFGFVQFARLEDARNAQSLNGQLEIGGRTIKVSAVTDQSGMQEFGGNTGDFDDDEGGGMSLNACSRAMLMQKLDRSGTASSMVGSLGNSVVNNTGLNLPATGNILAAAPVGELAGGGLQIPTATIPSIDTIGVASECLMLKNMFDPKDEIEPDFDLDIKEDVEAECSKLGTLKHIYVDKKSAGFVYLRFEDTQSAISAQQALHGRWFAGKMITASFMVPQSYEDKFPDSR

SEQ ID NO: 183870 - protein, 214 aa, Glycine max
  Coding DNA Sequence Number=SeqID_67092
MTGSHNNQTNAAPEASPVSENRYRRTNHHGENNVQSNAHVPPAVTENRYKRVEPRGRFQQTSNNAGMNYQGPGTRDAFRSPLPNWNQTRHAPVNANVNPRIENNRQAFTLPGSRHSMPSHENIRSPPPNAPNTPRPGYGNFSSPNESIPTHPGATNTPRSSSYGNFSAPNEGIPRHPSAPNSPRPSNYGTFSTPNGPETQGLKAGMHRNREGNK

SEQ ID NO: 183871 - protein, 75 aa, Glycine max
  Coding DNA Sequence Number=SeqID_67093
MGVQIAIFKFSNVGPSRSYWKLAVLGEKNCFREENPSRGASVTLPKRFHEQIREGFPSFFTVPHPLFVRSSFFNQ

SEQ ID NO: 183872 - protein, 145 aa, Glycine max
  Coding DNA Sequence Number=SeqID_67094
MLVFLPECCETLRIVQQCSFSFWSVAKLYGLRNDACFEGSEGSKQGSKTNHKYSRTKLGEWKPKEHEMELQWQNQNEETDKRKRSITLKASSSMQEENEDEEFEDEEDFSLFVKKFHKFFKNRRIKRRQNFNHGKRFQEGSPTLT

SEQ ID NO: 183873 - protein, 48 aa, Glycine max
  Coding DNA Sequence Number=SeqID_67095
MVFILPKDNVIIWFCSLHNRSDNYLNGIINSALKGFNDNQGRLLLDGS

SEQ ID NO: 183874 - protein, 311 aa, Glycine max
  Coding DNA Sequence Number=SeqID_67096
  Gene Ontology: Mol. function=protein binding; Cellular component=1 -2nm peptidoglycan-based cell wall; Biological process=barrier septum formation
  Homolog annotation: Hit_ID=Q7WCX4; Match level="QueryCoverage=93%, HitCoverage=81%, E-value=2e-97, Identity=67%"; Hit description =Putative membrane protein
MSDLQIGLIALGVLLILLVLGFNWWQDRRVRRKMQSHFPTSEQDPLLGAGANAAAGAAAVRREPGMGDAPKAHPEQPKPVDPGSDADDAEEPDPACEVVIEINFAEPVRGADLLPYMQSLRQVGRKPMRVFAETDQRRHRARVHAGESYASMQLAVLLANRSGPLTAIEWSQAWARAQDMAERFDATIEGPDQQAVLEQAARLDDTCAALDTQVGLTLLLGTAQPAAEVLNVARDAGFVADGNRLAWPAENGVARFTLARADGAAFDAGMGGIERLYPAGWDRAPAARPTAAPSAAWWTWAVNWPAGCAPT

SEQ ID NO: 183875 - protein, 71 aa, Glycine max
  Coding DNA Sequence Number=SeqID_67097
  Gene Ontology: Mol. function=RNA-directed DNA polymerase activity; Biological process=RNA-dependent DNA replication
MGGTNSCSTSRCKDRYSHPKEKHLFKKVLQHYSVRHKVASPYHPQTNGQAEVSYKEVKKIYEKTDAQSRMD

SEQ ID NO: 183876 - protein, 76 aa, Glycine max
  Coding DNA Sequence Number=SeqID_67098
MGLRKKCREWRITLSNHYAWLQTRGRRMHERSKLKGGGCMNENAIHEAPKKGREWRNAQINTMHGSKLLGGGCMNT

SEQ ID NO: 183877 - protein, 184 aa, Glycine max
  Coding DNA Sequence Number=SeqID_67099
  Homolog annotation: Hit_ID=Q2HRX8; Match level="QueryCoverage=53%, HitCoverage=14%, E-value=2e-10, Identity=36%"; Hit description=IMP dehydrogenase/GMP reductase
  Pfam annotation: Domain name=DUF1723; Domain location=96-145; Score =42.0; E_value=2e-09; Accession=PF08330.1; Description=Protein of unknown function (DUF1723)
MAPADSEEIVADIPADTGVEAAEDEHEGFSGGPSDPSVLTQYADHIACSVWTGERPELKLSSHGRKVHSLGRPVPAIDGLVAGTGLSPLIACSVDTGDWGLLSSFVERWHRETSSFYLSVGELTITLDDVSSLLHLLVVGDLHAFQPLHVDDVVQMLVDLLMVSAESAMAKTAQCRGPYVRLQW

SEQ ID NO: 183878 - protein, 98 aa, Glycine max
  Coding DNA Sequence Number=SeqID_67100
HGSKLVGGGCMNENAIHGAPKKGREWIIALSNHYAWLQTRWWRTHELKCNSWGSEKRLRMENFTKQSLRMTPNSWVEDAWRKMQFMGLRKRVENGELH

SEQ ID NO: 183879 - protein, 118 aa, Glycine max
  Coding DNA Sequence Number=SeqID_67101
MEVSVGLCRHDIGIASTRHPVDPEKSSRALRFPALVTGLYQSYRMPVPPARSCHCDIGIAPARHLVDPEKSNRVLGFPALITGLCQFYRVPVAPNKVIRPPFNRTFIKKYCAPQASAG

SEQ ID NO: 183880 - protein, 130 aa, Glycine max
  Coding DNA Sequence Number=SeqID_67102
MAEPSKKRKGSSSRSQRHSETQETPIPSSIPSASLFSSEEQRIRYTNLFSSRSIIDPKFIDMNFFSNESFECIQAFENSNLIPFMSLKLPVYFDLVKAFYSNLEIQEGTLISEVYGIKMVIDQSLFYDLT

SEQ ID NO: 183881 - protein, 286 aa, Glycine max
  Coding DNA Sequence Number=SeqID_67103
  Gene Ontology: Mol. function=tRNA isopentenyltransferase activity; Cellular component=intracellular; Biological process=protein metabolic process
  Homolog annotation: Hit_ID=Q1X6M9; Match level="QueryCoverage=99%, HitCoverage=67%, E-value=1e-140, Identity=88%"; Hit description=ClpX
  Pfam annotation: Domain name=AAA_2; Domain location=1-177; Score =206.2; E_value=7.8e-59; Accession=PF07724.4; Description=ATPase family associated with various
TLAKRLNVPFAVADATALTEAGYVGEDVENILLKLIQAADYDVKRAEQGIIYIDEVDKIARKAENPSITRDVSGEGVQQALLKIIEGTVASVPPQGGRKHPHQEFLQIDTSNVLFIVAGAFAGLEDIVSARVGKHGIGFGAPLHDKGKDLDLFSEVLPEDLHKFGLIPEFIGRLPVVTNVSPLDQAALIDILTGPRNALVKQYQRMFEIDGVQLEFEDDALRSIADLAVERKTGARGLRAILEDVLGPIMFEIPSAEDVAKVIVTRAAVEEGAPPTIVMERKRKSA

SEQ ID NO: 183882 - protein, 63 aa, Glycine max
  Coding DNA Sequence Number=SeqID_67104
MVAITPTKVHQPPFLREYDSNATCACHGEAPGRSIEHCRALKRKVQGFSSASHWSVCSSNLRS

SEQ ID NO: 183883 - protein, 141 aa, Glycine max
  Coding DNA Sequence Number=SeqID_67105
  Subcellular localization annotation: CTP_CleavageSite=67; ConfidenceScore=5.12e-01
DHVYKAPSGPEGVRQGPGVFSSGYGPLLVSSIRCPSPQQGITPSRHPVNPEKSNRVMGFPTLITSLCQFYGVPVTPSKVIKPYINRAFIKKYCTPKQAEGETPQQPGDGQQQATNAPPPPPEPLNSSIKRLERCLRHMADQ

SEQ ID NO: 183884 - protein, 102 aa, Glycine max
  Coding DNA Sequence Number=SeqID_67106
MAQLISDVIYCLHGSRPQDTQWTRRSPTGPWGFQLWLRASIVLQGARSPARSRHHGIGIAPARHPVDPKKSNRVLQLSSSNYGPLSVLRSACLPQQDHQAPY

SEQ ID NO: 183885 - protein, 168 aa, Glycine max
  Coding DNA Sequence Number=SeqID_67107
MASMMDAMLGMRRLMENNAVAAAAAAVSSAAEADPTLPATVHHPIPNVVGRERSTLGHISNPHSGYNRVAYPYGLPTNYTPPVLRDDAGHVPPPILEGEPPQQPNEIHKDRREHAQGDIDSYSLFPAEGPAPVGERIEVGLKRGKFDYVSSTGTNGRRIGATGAKRKE

SEQ ID NO: 183886 - protein, 99 aa, Glycine max
  Coding DNA Sequence Number=SeqID_67108
WVASGGSNPARLGELTSPGRAGRQPPPPFSYKKAEGGCSKDPSAPWLCISAVLGEKNCFREENPSRGASVTLPRCFRKQIREGFRPFFIVLHPFFILQR

SEQ ID NO: 183887 - protein, 140 aa, Glycine max
  Coding DNA Sequence Number=SeqID_67109
MALKKLSAKRSRRDAMAEGTSAAPEFDSHCFRSAEHQQRFEAIKGWSFHRERRVQLRDDEYTDFQEEIARQHWTSLVTPMAKFDPDIWIPFDADALSQFLGDPLVLEEGQECEEASADHAHQHDHPDPDMDDVAAQQCPA

SEQ ID NO: 183888 - protein, 69 aa, Glycine max
  Coding DNA Sequence Number=SeqID_67110
MVTSILQLDSMNLFVKARAWFNPITQGMAILIANTSSTIHRDARLGNMHAMHGKCNYEIEMPEETSFLS

SEQ ID NO: 183889 - protein, 584 aa, Glycine max
  Coding DNA Sequence Number=SeqID_67111
  Gene Ontology: Mol. function=hydrolase activity, acting on acid anhydrides, catalyzing transmembrane movement of substances; Cellular component=integral to endoplasmic reticulum membrane; Biological process=calcium ion transport
  Homolog annotation: Hit_ID=P92939; Match level="QueryCoverage=97%, HitCoverage=53%, E-value=0.0, Identity=79%"; Hit description=Calcium- transporting ATPase 1, endoplasmic reticulum-type
  Pfam annotation: Domain name=Cation_ATPase_C; Domain location=374 -569; Score=249.5; E_value=6.9e-72; Accession=PF00689.11; Description= Cation transporting ATPase, C-terminus
  Pfam annotation: Domain name=Hydrolase; Domain location=32-278; Score= 63.9; E_value=5.4e-16; Accession=PF00702.16; Description=haloacid dehalogenase-like hydrolase
  Pfam module annotation: Pfam domain module=Cation_ATPase _C::Hydrolase; Domain location=374-569::32-278
MGLPEGSKVAQSASTRTLLRCCEWWSEHDQRLATLEFDRDRKSMGVIVDSGLGKRSLLVKGAVENVLDRSSKIQLRDGSIVNLDDNARNLVLQALHEMSTSALRCLGFAYKDELPKFENYSGNEDHPAHQLLLNPSNYSSIESELIFVGLVGLRDPPREEVYQAIEDCREAGIRVMVITGDNKNTAEAICREIGVFSPDEDISSKSLTGRDFMELRDKKTYLRQPGGLLFSRAEPRHKQEIVRLLKEEGEVVAMTGDGVNDAPALKLADIGIAMGIAGTEVAKEASDMVLADDNFSSIVAAVGEGRSIYNNMKAFIRYMISSNIGEVASIFLTAALGIPEGLIPVQLLWVNLVTDGPPATALGFNPPDKDIMKKPPRHSDDSLINLWILFRYLVIGIYVGLATVGIFIIWYTHGSFFGIDLSGDGHSLVTYTQLANWGQCSSWQNFTASPFTAGAKTITFDNPCDYFSTGKVKAMTLSLSVLVAIEMFNSLNALSEDGSLLTMPPWVNPWLLLAMSVSFGLHFLILYVPFLAQVFGIVPLSFNEWLLVLVVALPVILIDEILKFVGRCTSSRASSARKSKQKSE

SEQ ID NO: 183890 - protein, 846 aa, Glycine max
  Coding DNA Sequence Number=SeqID_67112
  Gene Ontology: Mol. function=nucleoside-triphosphatase activity; Cellular component=integral to membrane; Biological process=transport
  Homolog annotation: Hit_ID=Q9ZUT0; Match level="QueryCoverage=81%, HitCoverage=95%, E-value=0.0, Identity=63%"; Hit description=White -brown complex homolog protein 2
  Pfam annotation: Domain name=ABC2_membrane; Domain location=429-639; Score=150.7; E_value=3.8e-42; Accession=PF01061.14; Description=ABC -2 type transporter
  Pfam annotation: Domain name=ABC_tran; Domain location=123-313; Score= 144.6; E_value=2.7e-40; Accession=PF00005.17; Description=ABC transporter
  Pfam module annotation: Pfam domain module=ABC2_membrane::ABC_tran; Domain location=429-639::123-313
MSRLTPSPTNPVHEDRLPFFNQSMELVQPPTRTRSRTLGDLLKRVEDAQNDTPLAPPHHVLDLSSSSATHPFVLSFTNLTYNVNLRRKFTFFPATTASAPDHETKPNGTKTLLNDISGEARDGEIMAVLGASGSGKSTLIDALADRISKESLRGTVKLNGDVLESSLLKVISAYVMQDDLLFPMLTVEETLMFAAEFRLPRSFSKSKKKARVQALIDQLGLRSAASTVIGDEGHRGVSGGERRRVSIGTDIIHDPIVLFLDEPTSGLDSTSAFMVVKVLQRIAQSGSIVIMSIHQPSYRILSLLDHLIFLSHGNTVFSGSPANLPAFFSEFGHPIPENENRTEFALDLIRELEQEATGTKSLVDFNKSWQLKNKNQAQAQNEYDSKLSLKDAISASISRGKLVSGTNGNGRNNSTALVSVPAFANSFWMEMLVIGKRSLTNSRRMPELFGIRLGAVLVTGAILATIFWHLDDSPKGVQERVGFFAFAMSTTFYTCAEAMPVFLQERYIFMRETAHNAYRRSSYVLAHAIISLPSLLFLSLAFAATTFWAVGMTGGTSGFLFYFITILASFWAGNSFVTFLSGVVSHVMIGFTVVVAILAYFLLFSGFFISRDRIPPYWIWFHYLSLVKYPDSDVREHAAGDGAGSPEGGAAQEHEPDSRNEHHEVHLRGHRRGCAEAAGDHAADQVELLVDHAGLGVLLSLPLLFGAALWEQEQEEAKCLFLNDDVLPWVIVTNKDLPLMNALEVVFSSSTNLLCEFHIFKNVRGKCKILVTKVLSISDIDNTNDSWGDLTLTNEGVALLKRLSLLDMDRKMTLHNKFIVKVVDARLDGSCGYMAIATLLGQGEES

SEQ ID NO: 183891 - protein, 57 aa, Glycine max
  Coding DNA Sequence Number=SeqID_67113
MTKGNLPAYEAETKALLAAITWVVEKPYQNVTFELDCRQVIDAHSSNVSCTLRLVLS

SEQ ID NO: 183892 - protein, 150 aa, Glycine max
  Coding DNA Sequence Number=SeqID_67114
  Gene Ontology: Mol. function=unspecific monooxygenase activity
  Homolog annotation: Hit_ID=O04892; Match level="QueryCoverage=77%, HitCoverage=21%, E-value=2e-22, Identity=56%"; Hit description =Cytochrome P450 like_TBP
DGGHGSRNPLRRRGGRCKTQGASPGGAVVGADLGGTGEARLIALCARTPKGNRPAHPGNGSAGGRVQRLEEHRTSRGVRQGKSAKWIRNLGKRIGSEGWARGSQSRTRRLSVDCSSCFRGESGSSRAGRGTDWDGPLRGSSPGVEQSTQN

SEQ ID NO: 183893 - protein, 351 aa, Glycine max
  Coding DNA Sequence Number=SeqID_67115
  Gene Ontology: Mol. function=binding; Cellular component=membrane; Biological process=photosynthesis, light reaction
  Homolog annotation: Hit_ID=Q9ZUS6; Match level="QueryCoverage=59%, HitCoverage=62%, E-value=9e-64, Identity=57%"; Hit description =Chloroplast lumen common protein family
  Pfam annotation: Domain name=TPR_2; Domain location=145-178; Score =1.9; E_value=20; Accession=PF07719.7; Description=Tetratricopeptide repeat
  Pfam annotation: Domain name=TPR_2; Domain location=179-212; Score =7.9; E_value=4; Accession=PF07719.7; Description=Tetratricopeptide repeat
  Pfam annotation: Domain name=TPR_2; Domain location=254-287; Score =17.6; E_value=0.045; Accession=PF07719.7; Description=Tetratricopepti de repeat
  Pfam annotation: Domain name=TPR_2; Domain location=288-321; Score =14.3; E_value=0.43; Accession=PF07719.7; Description=Tetratricopeptid e repeat
  Pfam module annotation: Pfam domain module=TPR_2::TPR_2::TPR_2::TPR _2; Domain location=145-178::179-212::254-287::288-321
  Subcellular localization annotation: CTP_CleavageSite=94; ConfidenceScore=5.83e-01
MLTLTSPSMALSMDSLPKLRHPSPFPTPLSSSISFRSLPPPHFPSSSSSSFRLHSIRPSSQNHPSFRTPSLPPLLQTLTSFLSPVVETTCIVIAAAALFFMRFHHTPPAIAAPLTPPAAESDTAFTEEEAESLLEERLSTNPRDTDALHALMEVKIRARKMDEAFGVLDRLIELEPEELEWPLLKANMHIYNDDHASARELFEEILKKDPLRVEAFHGLVMATSQSNEPLKGLLKRVEEAIEVCKKQKRDSDVRDFRLLIAQVKVMEGDFSEALKAYQELVKEEPRDFRPYLCQGIIYTLLRKKDEADKQFDKFRRLVPKDHPYKDYFEDNMFATKFFSQKLEREGAGARG

SEQ ID NO: 183894 - protein, 277 aa, Glycine max
  Coding DNA Sequence Number=SeqID_67116
  Homolog annotation: Hit_ID=Q10N70; Match level="QueryCoverage=92%, HitCoverage=23%, E-value=2e-19, Identity=31%"; Hit description =Expressed protein
MKRKESNKRIKELSVGSSSRNSEPLQPPVSGLESACCKDADQPSPVSVLESSFTDDLSSCSDCFESLNVDIQGLRMQLQLLKLESEEFVDEPVLIQSDEDGGEASTGISEDNELHKTGDSWESSYMIDVLYESGIDRAQPDAFLEVWDSQECPVSLSVFDELEKRYSDWTNCPRSERRLLFDRINSGIISLNEQFMGVQPWVSPTTATNLCSKLIKNGLQDGLYSMLGSQGKVKDTALGKVLVSEMQWLNLRDDINGIGREVESLLLDDLVTEIAVT

SEQ ID NO: 183895 - protein, 290 aa, Glycine max
  Coding DNA Sequence Number=SeqID_67117
  Gene Ontology: Mol. function=metal ion binding; Biological process =metal ion transport
  Homolog annotation: Hit_ID=Q94CS5; Match level="QueryCoverage=46%, HitCoverage=65%, E-value=2e-21, Identity=45%"; Hit description=Heavy- metal-associated domain-containing protein-like
  Pfam annotation: Domain name=HMA; Domain location=213-272; Score =52.0; E_value=2e-12; Accession=PF00403.16; Description=Heavy-metal -associated domain
  Subcellular localization annotation: CTP_CleavageSite=67; ConfidenceScore=5.46e-01
MKGIDIFCASQASTAICLSMDQPSSSYSSSSSSISNTAQFGGRAIDRHNPIITDPRRTPSRDLISPSSSSQSPIEPKPLHDHLQKTKKNSTSKPSGQKKKSAAKGHDQKKKSAAGKLTEHITNNYSSKPIDSILRRSWARPPSDLITPPGSSRYLLIDTPSLDRVSSVYDPVLALTDVNKEKAQVIHLDQTKHSSKPSSSTLPKSDSSDQVVELRVSLHCKGCEGKVRKHLSRMRGVTSFNIDFAAKKVTVVGDVTPLSVLASISKVKNAQFWPEHASIVGSETKRTNLI

SEQ ID NO: 183896 - protein, 52 aa, Glycine max
  Coding DNA Sequence Number=SeqID_67118
  Homolog annotation: Hit_ID=Q10N71; Match level="QueryCoverage=81%, HitCoverage=55%, E-value=5e-08, Identity=60%"; Hit description =Uncharacterized plant-specific domain TIGR01589 family protein, expressed
MEDSSSSAAYIRLVHRLIEECILFNMSKEECMEALSKHANIKPVITSTGKVI

SEQ ID NO: 183897 - protein, 72 aa, Glycine max
  Coding DNA Sequence Number=SeqID_67119
  Subcellular localization annotation: CTP_CleavageSite=63; ConfidenceScore=5.29e-01
MGVQIATRPTWAFQDVPPEGGRFWRKQPSSPGRAGKSKPRRFRNISVDDFAKIFNCSSTFFVRSSSFFGLQL

SEQ ID NO: 183898 - protein, 325 aa, Glycine max
  Coding DNA Sequence Number=SeqID_67120
  Gene Ontology: Cellular component=membrane; Biological process=UDP -glucose metabolic process
  Homolog annotation: Hit_ID=Q44417; Match level="QueryCoverage=100%, HitCoverage=46%, E-value=1e-147, Identity=80%"; Hit description=CelB protein
  Pfam annotation: Domain name=BcsB; Domain location=1-325; Score=73.7; E_value=5.6e-19; Accession=PF03170.4; Description=Bacterial cellulose synthase subunit
MDRRQWSIYLTPEQVNAAVSLNVGYQNAIVVAPESSNFQVSVNNVGLGAARIEAPDSQGNISLKIPPGVLQVGANVVSLGVQQRHRTDCTIQSTYDLWTDVDPANTFIGFNADVAGSFANIDDIQATGPDGKATTSIEIVAPALGNPAFADSLLRLSQALALRTQMPNQTVRFVTAPPVERKAGTLSVLVGTAREIAGMAGTLPPEASAGAFAGFGSAVAGGASPLLVTGPTPQAVQAAIETLFSSISRTPGAQRATFSTRSWHAPDVPLIMSDRRIALSELGIESSEFSGRRFRNEFYIGMPADFYASAYGEASLLLDAAYSSQ

SEQ ID NO: 183899 - protein, 133 aa, Glycine max
  Coding DNA Sequence Number=SeqID_67121
  Gene Ontology: Mol. function=RNA-directed DNA polymerase activity; Biological process=RNA-dependent DNA replication
  Homolog annotation: Hit_ID=Q1SNL3; Match level="QueryCoverage=64%, HitCoverage=22%, E-value=2e-10, Identity=35%"; Hit description =Immunoglobulin/major histocompatibility complex
MYPLLVPQRMYPPMCWDKEFTGGIASTACHPIQPQKGDQWVWKADSSGQYTTKSTYDMVWGKTSEQQQDGVFKEPWKIKLPPKITMFAWRLIRDRLPTKANLRRRQIQVGESTSHSTEKWRRGQVIYSFIVAR

SEQ ID NO: 183900 - protein, 105 aa, Glycine max
  Coding DNA Sequence Number=SeqID_67122
  Subcellular localization annotation: CTP_CleavageSite=35; ConfidenceScore=5.21e-01
MDMNIGELISSQMTSIAQSNTSRLGFPTLITTLCRARGVVSDSLTFERLSPIINLAYIRKNCWNPEDLTVSIRGARRARARPAELPSTSAAPTPASTSAAPSVPA

SEQ ID NO: 183901 - protein, 178 aa, Glycine max
  Coding DNA Sequence Number=SeqID_67123
  Gene Ontology: Mol. function=protein serine/threonine kinase activity; Cellular component=nucleus; Biological process=protein amino acid phosphorylation
  Homolog annotation: Hit_ID=P51566; Match level="QueryCoverage=94%, HitCoverage=46%, E-value=4e-46, Identity=50%"; Hit description =Serine/threonine-protein kinase AFC1
  Pfam annotation: Domain name=Pkinase; Domain location=3-177; Score= -81.2; E_value=0.001; Accession=PF00069.15; Description=Protein kinase domain
MMLTVHDAKRECCILVVDAKRECCISGFILCSCVQIRNWFDYLNHICIVFEKLGPSLYDFLRKNNYRSLSIDLVREFGRQLLESVAFMHHTDLKPENILLVSSEFIKVPDYKVLGGTMIFGVWAAYWLLSFALGFIVLLFIAYEQGEAVFQTHENLEHLAMMERVLEPLPPNMVVRVE

SEQ ID NO: 183902 - protein, 273 aa, Glycine max
  Coding DNA Sequence Number=SeqID_67124
  Pfam annotation: Domain name=DUF1635; Domain location=2-246; Score =27.1; E_value=5.3e-11; Accession=PF07795.2; Description=Protein of unknown function (DUF1635)
NEDINHRFVCAKLELIVAKMEANAKIKKYEETVKHLYKLLKKVCQERDEARGQLQLIRNFQASTPAETSSTIPQVDHPCLQYKTKPSLNSTKVSNSSSKVFSNHPCDLSLSSLHPNEKHSSQSLSHTRIAEPSNLTLTKQPNHMKADIGASRDNNMVDGASLVFDKLVCGKPLPQIGRLLQSVTEAGPLLQTLLVAPAPQWQNPPSLSSSGLTLGTQDNSSSTNTDDKANVNPNGFIPTSLGLVFPGNSHVPSQMSYASGFGLALKNELVSYV

SEQ ID NO: 183903 - protein, 105 aa, Glycine max
  Coding DNA Sequence Number=SeqID_67125
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=86%, HitCoverage=18%, E-value=1e-37, Identity=89%"; Hit description=ATP synthase subunit alpha
  Pfam annotation: Domain name=ATP-synt_ab_N; Domain location=12-80; Score=71.6; E_value=2.4e-18; Accession=PF02874.13; Description=ATP synthase alphabeta family, beta-barrel domain
MCIYGKKQIFMVTIRAGTVLQVGDDIARIYGLDEVMTGELVEFEEGTIGIALNLESKNVGVVLMGDGLMIQEGSSVKATRRIAQILVSEAYLGRVINALAKPIDG

SEQ ID NO: 183904 - protein, 260 aa, Glycine max
  Coding DNA Sequence Number=SeqID_67126
  Gene Ontology: Mol. function=diaminopimelate epimerase activity; Biological process=lysine biosynthetic process via diaminopimelate
  Homolog annotation: Hit_ID=Q9LFG2; Match level="QueryCoverage=79%, HitCoverage=57%, E-value=3e-82, Identity=67%"; Hit description =Diaminopimelate epimerase-like protein
  Pfam annotation: Domain name=DAP_epimerase; Domain location=85-207; Score=156.5; E_value=7.1e-44; Accession=PF01678.10; Description =Diaminopimelate epimerase
MCGNGVRCFAKFVSQLENLHGRHSFTIHTGAGLIIPEVLEDGNVRVDMGEPVLKALDVPTKLPANKDNAVVKSQLVVDGVIWHVTCVSMGNPHCVTFSREGSQNLLVDELKLAEIGPKFEHHEVFPARTNTEFVQVLSNSHLKMRVWERGAGATLACGTGACATVVAAVLEGRAGRNCTVDLPGGPLQIEWREEDNHVYMTGSADFPFSLYFNQGKQTYALGYSNAEPRVHDHGNEEIDSMRGTRWQYIKYPCPSRKVPC

SEQ ID NO: 183905 - protein, 226 aa, Glycine max
  Coding DNA Sequence Number=SeqID_67127
  Gene Ontology: Mol. function=diaminopimelate epimerase activity; Biological process=lysine biosynthetic process via diaminopimelate
  Homolog annotation: Hit_ID=Q9LFG2; Match level="QueryCoverage=74%, HitCoverage=41%, E-value=1e-34, Identity=50%"; Hit description =Diaminopimelate epimerase-like protein
MSCTKLDQKVSIKRDLSKQGPSPINQKHAGITVRKKNYLRLTTIRVKNPHGIIGAIDARQYKDNSVSSNAEVPITQLHRFLCTDPGLGRVSIVNLFKITRQNRTRLFCKEKRSGTWTHQNEVVSEAVVLGEMEKAGLLEVEEGGGGGFDGGFGAHRGRDEARIRVFESALRCGQSGSGRMGREAIDGGESAAGGGCERNGNGGGYGHRCSFEWRRKFHSASVTVSV

SEQ ID NO: 183906 - protein, 83 aa, Glycine max
  Coding DNA Sequence Number=SeqID_67128
MKGLNWIDEWVEGASLTIKFPRLFLISEQREEVPREEVDSWIWLYNPNGLYTSNSAYASRLQEEVLENWNTILQEVWKLKIPS

SEQ ID NO: 183907 - protein, 290 aa, Glycine max
  Coding DNA Sequence Number=SeqID_67129
  Gene Ontology: Cellular component=nucleus
  Homolog annotation: Hit_ID=Q1T0L2; Match level="QueryCoverage=87%, HitCoverage=36%, E-value=5e-80, Identity=61%"; Hit description=WD40 -like
  Pfam annotation: Domain name=NUC153; Domain location=96-125; Score =51.3; E_value=3.2e-12; Accession=PF08159.2; Description=NUC153 domain
MCLACWTWMNILAKALVDPFEYEAYIEQQKREKMEAERASRITVRKKLPKVNRALAARLLETEEAENEKRDEDADDGETKKASKKKKGLSMQDLQDDRFKAIFTNEEFEIKDSSQEYLALHPMGSKKQTSLLKEHFEPVMSDDGQSLSDSDASTSSQDEPANGMKDKSRVPRMYEIKNEQHAEAFWSQKSLAGEDSLPMGDRVAALRDDQQSSRVPKGIKQGPGGSREITFATRSSAKYKEDEEDKEVPNRKKRGVQSLGLKPNRPVFRGQGRGKRGNGRRGRRYDLYIM

SEQ ID NO: 183908 - protein, 52 aa, Glycine max
  Coding DNA Sequence Number=SeqID_67130
MAVKGSLRFVYAHFPIKASIGNNNKSIKIKNFLGEKKRFKLVTLRQTLGRNH

SEQ ID NO: 183909 - protein, 141 aa, Glycine max
  Coding DNA Sequence Number=SeqID_67131
MTYREHEKHSVEVAELLLFDSEIESRRRESRDSEWKRTEGTKSPRSEKIDGEDNRSNTRAKSFNEMTSRDTAHYKLGFLKQRRLLRSFSRISFRSNSSSSSSSRNSNLLNDQDNQTQEVAPKHNLFDEEVRFEDINQNMDD

SEQ ID NO: 183910 - protein, 76 aa, Glycine max
  Coding DNA Sequence Number=SeqID_67132
  Gene Ontology: Mol. function=glycerone kinase activity; Biological process=glycerol metabolic process
  Homolog annotation: Hit_ID=O04059; Match level="QueryCoverage=74%, HitCoverage=9%, E-value=2e-20, Identity=84%"; Hit description =Putative 3,4-dihydroxy-2-butanone kinase
MAFPTKKLIDDPNDVVTEFIEGLVETYPGLQYLDGFPQVKVVLRADVSAATYDKVAIHIRSCAIRILFKACNNCHV

SEQ ID NO: 183911 - protein, 186 aa, Glycine max
  Coding DNA Sequence Number=SeqID_67133
  Gene Ontology: Mol. function=N-acetyltransferase activity; Cellular component=nucleus; Biological process=metabolic process
  Homolog annotation: Hit_ID=Q60E62; Match level="QueryCoverage=89%, HitCoverage=64%, E-value=8e-51, Identity=62%"; Hit description =Putative N-acetyltransferase
  Pfam annotation: Domain name=Acetyltransf_1; Domain location=52-135; Score=32.7; E_value=1.3e-06; Accession=PF00583.14; Description =Acetyltransferase (GNAT) family
MEGPYGSEWPEEEKVKRKEMVLPEAHYVFVHEVANSNADEMTTVLTAAETSTCLEDSGPLVGFVQYRFVLEEEIPVLYVYELQLEPRVQGKGVGKFLMQLVELMAQKSRMSAVMLTVQKANVLAMDFYINKLRYIISAMSPSRVNPMMQLEKSYEILCKAFNDEAKTILEDREDELDQLDKDGSSY

SEQ ID NO: 183912 - protein, 76 aa, Glycine max
  Coding DNA Sequence Number=SeqID_67134
  Homolog annotation: Hit_ID=Q6ZHF5; Match level="QueryCoverage=55%, HitCoverage=16%, E-value=7e-07, Identity=53%"; Hit description=GCN5 -related N-acetyltransferase protein-like
MEFESLQRRRSSSVSANQNNASIREKRPKRSEVIAKNKTIEELIKTARAEKDHLAPFPDFRRFHVNGNRFGFVSCF

SEQ ID NO: 183913 - protein, 51 aa, Glycine max
  Coding DNA Sequence Number=SeqID_67135
MSLRKLEIAALYFPSRLLLVSTWQGRNQFQSMYALYLQFCGEMQFVDFPTS

SEQ ID NO: 183914 - protein, 442 aa, Glycine max
  Coding DNA Sequence Number=SeqID_67136
  Gene Ontology: Mol. function=receptor activity; Cellular component =integral to membrane; Biological process=ion transport
  Homolog annotation: Hit_ID=Q8S1S0; Match level="QueryCoverage=89%, HitCoverage=89%, E-value=1e-122, Identity=53%"; Hit description =Putative lung seven transmembrane receptor 1
  Pfam annotation: Domain name=Lung_7-TM_R; Domain location=137-419; Score=123.4; E_value=6.6e-34; Accession=PF06814.3; Description=Lung seven transmembrane receptor
MSMAKMRPALPLLLLLLLFLFSPSAAEIKSLTINSDSRPMILLEKFGFTHKGHVSIAVSSVSVGVLSSSVQPESSRLGFFLLNEEALLQVLMEIQQNPSFCVLDSHYILLLFTFRDLSPPPFASFNRSYPVTSPNEYSLFFANCAPETSVSMSLHTESYNLDSDSSRDYLSAGQTHLPSLYFLFFLTYLSFFSLWLYIYFSNKLSVHPIHLLMSLLLLVKALNLICAAEDKHYVKVSGLPHGWDVLFYIFQFIRVVLLFTVIVLIGTGWSFLKPFLQDREKKVLMIVIPLQVLANLASVVIGETGPFIKDWVTWNQIFLLVDIICCCAIIFPIVWSIRSLRETSKTDGKASRNLAKLTLFRQFYIVVIGYLYFTRIVVFALRTIAAYKYQWVSNAAEETASLAFYVVMFYMFRPVEKNEYFVLDEEEEEAAEMALKDEEFEL

SEQ ID NO: 183915 - protein, 98 aa, Glycine max
  Coding DNA Sequence Number=SeqID_67137
MGSVFMDAARKTGDIVVPPLQIARTMLSWRVYVGAATENGEMHDPLMQLARSVERNTFSASPTALADHASASFSSFTMAEQLCYQFFWRHPYRNKSLF

SEQ ID NO: 183916 - protein, 75 aa, Glycine max
  Coding DNA Sequence Number=SeqID_67138
MSMPPHLLNPATSLPQIRTGSYELQLFNKSTRAEQENSINSAISHCKKSQLQGSSNNVCSQSLVCGNKETTRLTH

SEQ ID NO: 183917 - protein, 227 aa, Glycine max
  Coding DNA Sequence Number=SeqID_67139
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-22, Identity=29%"; Hit description= UPI00006A17C9 related cluster
GLHLLALRGLHAHAFRRLHALTFRRLHALTFRGLHATFRGLHVLAFRGLHVLAFRGLHALAFRGLHVLLFKWLYTLAFKGLHVLLFRGLHALAFRGLHVLTFKGLHALTFRRGLHVLTIRGLRILPFRGLYALTFRGLNVLHFKGLHALPFRGLHVLLFRGLCALSFRGVHVLAFRWLHALAFKGLHVVAFRGLHALAFRRLPVLTFRGLHALLYRRLHDLTFRGLH

SEQ ID NO: 183918 - protein, 123 aa, Glycine max
  Coding DNA Sequence Number=SeqID_67140
  Subcellular localization annotation: CTP_CleavageSite=19; ConfidenceScore=5.00e-01
MANSFWQREKGMKKMNSTTCFYTTPSRGRRLVSRPGHLCVKLPHAHNGGQAQALKALHNDGLPSMDTLEHGVKIKYAGPTERGAGSGIYEGVERNHWNICGGRRRKCRRRGCWCDVPSFSSIF

SEQ ID NO: 183919 - protein, 208 aa, Glycine max
  Coding DNA Sequence Number=SeqID_67141
  Homolog annotation: Hit_ID=Q47522; Match level="QueryCoverage=20%, HitCoverage=51%, E-value=9e-18, Identity=100%"; Hit description=LacZ protein
  Subcellular localization annotation: CTP_CleavageSite=57; ConfidenceScore=5.67e-01
TDGVVRNGKSTAGTSALASVAVTLRVTTTPAALNAPLQGASHSPFRLRNCWEGRSVRASSLLRQLAKGGCAARRLSWVTPGFSPVTTFALGIEKGNKYVIPAFLAAVYQQSLDDNASWDKVRSARNYVAIGAAVIAAPFTEIKLIDTVDLEGGPVGKPVVPAALMNRPTRGERRFAYWALAECILAYYVGTDEGVSEVLHVAGEKRLH

SEQ ID NO: 183920 - protein, 507 aa, Glycine max
  Coding DNA Sequence Number=SeqID_67142
  Gene Ontology: Mol. function=nucleobase transporter activity; Cellular component=membrane; Biological process=nucleobase, nucleoside, nucleotide and nucleic acid transport
  Homolog annotation: Hit_ID=Q9LZD0; Match level="QueryCoverage=96%, HitCoverage=81%, E-value=0.0, Identity=65%"; Hit description=Uracil transporter-like protein
  Pfam annotation: Domain name=Transp_cyt_pur; Domain location=30-475; Score=357.8; E_value=1.8e-104; Accession=PF02133.6; Description =Permease for cytosinepurines, uracil, thiamine, allantoin
MKCSNSSSYTAPPDFELESDPTLTNEDLKPTAPSQRTFSGFEIASLWVGLVVGVPSYYLAGSLVDLGMAWWQGIATVVAANMVLLVPLVLTGHAGTRYGISFPVLVRSSFGINGAHIPTLIRALIGCGWYGIESWIGGEAIFLLLPKAMKETSLSQSLPWLGTSPLEFACFLVFWFAQLTFVWKGIDGIRKLEKYSAPILVALTSCLLIWSCVKAGGIGHMLSLSSRLSTSEFWSVFFPSLTANISFWATVAINIPDFTRYAKSQKDQVIGQIGLPIFMGAFTFVGLAVTSSTKVIFGQVISDPIQLLGQIGGLTTRIIAILGISLAIITTNIAANVVAPANALVNLSPKWFTFRRGALLTALLGIAFQPWRLLKSSESFVYTWLVGYSALMGPIAGIVLADYYIIQKTYLNISDLYSRSPYGAYRYSRGFNVAAILALVVGVLPVVPGFLQKVGIATSVPNTFVVIYNNAWFISFFSAGFLYLVLSNLRGKPGNSAARDPLLPTAK

SEQ ID NO: 183921 - protein, 142 aa, Glycine max
  Coding DNA Sequence Number=SeqID_67143
MRELDEDPNMTRLRRDPTPYKCSQCGATGHNTKRCTFPPLVELEEVNEEANGAIKGVAEGVAQGADVGVQTGQLNVVEGGTEGATKGGNEGATSGVQTGQVNVVEGGTKGATEGGTKGEGDGVQTSPIQHQKNDITQIKCTN

SEQ ID NO: 183922 - protein, 73 aa, Glycine max
  Coding DNA Sequence Number=SeqID_67144
MAGRVRQAWSFFGGWCHWGEKRSSGVVVCRMLWYVMEMDDEWWAMAKRQSFIYSFFAFIVNEVNLKREARIGH

SEQ ID NO: 183923 - protein, 47 aa, Glycine max
  Coding DNA Sequence Number=SeqID_67145
MALKHHISMLSASIYRKRTVLVQWLLKLKRGDTGFAVQAGSKSSGSK

SEQ ID NO: 183924 - protein, 132 aa, Glycine max
  Coding DNA Sequence Number=SeqID_67146
  Pfam annotation: Domain name=zf-GRF; Domain location=21-66; Score =25.1; E_value=2.7e-05; Accession=PF06839.3; Description=GRF zinc finger
  Subcellular localization annotation: CTP_CleavageSite=63; ConfidenceScore=5.56e-01
MGERMNGNGGSSSSPSSPSMVKCKCEVPVIMFTSSNVNHPGRRFWRCPHWNESSSCRFFQWICDTKVGNKMSVEWSELIWYVWENEELKLKVASLMKETKANAEEITNLRGKNCCTRGRMSSILSSSCAIEE

SEQ ID NO: 183925 - protein, 75 aa, Glycine max
  Coding DNA Sequence Number=SeqID_67147
MYAKNVGTPRRGREANTRSAQQGGSCKESHVAAQEWRKRATSFAKLAQQPNSYGRKKMYFNLGIQKNSSKEQCLN

SEQ ID NO: 183926 - protein, 271 aa, Glycine max
  Coding DNA Sequence Number=SeqID_67148
  Gene Ontology: Mol. function=glycerone kinase activity; Cellular component=cytoplasm; Biological process=glycerol metabolic process
  Homolog annotation: Hit_ID=O04059; Match level="QueryCoverage=93%, HitCoverage=42%, E-value=1e-108, Identity=77%"; Hit description =Putative 3,4-dihydroxy-2-butanone kinase
  Pfam annotation: Domain name=Dak1; Domain location=1-232; Score =296.6; E_value=4.8e-86; Accession=PF02733.7; Description=Dak1 domain
NYTGDRLNFGLAAEIAKSEGYKVETVIVGDDCALPPPRGIAGRRGLAGTILVHKVAGAAAAGGLSLADVAAEAKHASEIVGTMGVALTVCTIPGQVASDRLGPGKMELGLGIHGEPGAAVADIQPVNVVVSHVLQQILSTETNYVPITRGERVVLMVNGLGGTPTMELMITAGKTVPKLQLEHGLAVDRVYTGSFMTSLDMAGFSISIMKADPVILQRLDAPTKAPYWPVAADGNHPPAKIPVPIPASRTAKTDEDFIIECGIAVHATNNV

SEQ ID NO: 183927 - protein, 359 aa, Glycine max
  Coding DNA Sequence Number=SeqID_67149
MATKKVSSVHVDEDYIDIELRSSSPNSFSYSLDTPQQNNNREFEFQNKEESTTSPADELFYKGKLLPLHLPPRLEMVEKLLENADATFGFSRSQSSLEDSRFRLHSTNATSPLESCNISPSESRRVSSCESLPSEYQFDWSSEIEGLVSDHHHHQHVPNKHTKQKQFWLAQRFKASKIYLKSLFSKSGCSDKSCASDAAASKVGEVKKPKCKDDATKSKNKNKSPFELFCDNKHRSQRSCAVKNSDMHENGFFDSSSRRSFSGVIQRHYASKASSLSTSSSGSSSSSSSFSLSSAGSYELQLFNRSISAELENSIESAIAHCKKSQQKGGSDKVCSQSAVCGKKGIMEKTLVRKDEFLI

SEQ ID NO: 183928 - protein, 227 aa, Glycine max
  Coding DNA Sequence Number=SeqID_67150
  Gene Ontology: Mol. function=glycerone kinase activity; Cellular component=cytoplasm; Biological process=glycerol metabolic process
  Homolog annotation: Hit_ID=Q8L7L9; Match level="QueryCoverage=89%, HitCoverage=62%, E-value=5e-68, Identity=66%"; Hit description =Dihydroxyacetone kinase, putative
  Pfam annotation: Domain name=Dak2; Domain location=39-219; Score =190.8; E_value=3.4e-54; Accession=PF02734.7; Description=DAK2 domain
PRSRPQQLNEQGQILEVAIEAAANAIINLKDNLNEWDGKVGDGDCGSTMYRGAKAILEDIKDYPLNDASETVGEIGSSIGRSMGGTSGIIYTIFFKAAHSVLKASSHSGVTSKQWAEALATSIAAVSKYGGASAGYRTLLDALIPASSVLEEKLNSGDDPCTAFVLSSEAALAGAQSTVDMQAQYMQAGRSTYISGEILSTIPDPGAMAAATWYRAAALAVKAKYQS

SEQ ID NO: 183929 - protein, 589 aa, Glycine max
  Coding DNA Sequence Number=SeqID_67151
  Gene Ontology: Mol. function=transmembrane receptor activity; Cellular component=exocyst; Biological process=exocytosis
  Homolog annotation: Hit_ID=Q1SHQ5; Match level="QueryCoverage=86%, HitCoverage=84%, E-value=1e-127, Identity=46%"; Hit description =Exo70 exocyst complex subunit
  Pfam annotation: Domain name=Exo70; Domain location=63-589; Score =561.5; E_value=8.3e-166; Accession=PF03081.6; Description=Exo70 exocyst complex subunit
  Subcellular localization annotation: CTP_CleavageSite=90; ConfidenceScore=5.71e-01
MKGQYSSKHPFSPSAKHSKFHSWNPESKTLGHFDRVANMRKLCFNPQTESFALARSSPSSPLSLTSSPTPPRLSFSEAEALILKWNPDTSAYAKVTSLFYEDKTEAKHYIDSVNQLQKSMHSLLSQNPSSEKLILAHNLMQMAMKRLKKEFYQILSMNRAHLDPESVSARSSRTSANSSASDYDDDFAAEDDDIRAAGDSISEVEQVSSGAMADLKLIADCMVSSGYAKECVSVYILIRKSIIDEGIYRLGVEKLSSSRANKMDWNVLDLKIKSWLEAIRISVRTLFNGERILCDHVFSYSDSVRESCFAEISRDGASLLFGFPELVAKTKKSSLEKLFRVLDMHAVVSELWPEIESIFSSDYNSGARSQVLVSLQRLTESAQILLAEFESTIQKDSSKSAVNGGGVHPLTIQTMNYLSVLADYINVLSDIFPRDWLPPPKSSSLPESYLYSPESDYSASKPALTARFAWLILVLLCKLDGKAKHCKDVSLSYLFLANNLWYVVARVRSSNLQYVLGDDWILKHEAKAKRFVANYEKVAWGEVVSSLPENPAAAEAREVFESFNRKFEEGYRKQNSFVVADRELRDEIK

SEQ ID NO: 183930 - protein, 229 aa, Glycine max
  Coding DNA Sequence Number=SeqID_67152
  Homolog annotation: Hit_ID=Q1S0A6; Match level="QueryCoverage=41%, HitCoverage=6%, E-value=1e-27, Identity=61%"; Hit description=Zinc finger, CCHC-type; Peptidase aspartic, catalytic; Polynucleotidyl transferase, Ribonuclease H fold
MTLFSVEKTLKMLKELEVLFVNIMRRENCFLMRIMKLVKYRLKTQVEKDEGPSGEGQSPRVEKDEGPSNPCGVYPDLSSFTGSGVYPDLSSFTGSGVYPDLSSFIGSGVYPDLSSFTESGVIQISVTCIKRSAPLRARKKFGFVDGTTKQHVEKSPNLEDWWTKNLLLVSWIMNTIEPTLHSTISHMEMAQDLWIDMLEHFSIANEPHIQQLKAELTECKQKGMIIVAY

SEQ ID NO: 183931 - protein, 107 aa, Glycine max
  Coding DNA Sequence Number=SeqID_67153
  Gene Ontology: Mol. function=DNA binding; Biological process=DNA integration
  Homolog annotation: Hit_ID=Q0KIG7; Match level="QueryCoverage=99%, HitCoverage=10%, E-value=4e-28, Identity=57%"; Hit description =Integrase core domain containing protein
MATIVCELKWLKDLFSCLGCAHMRHMNLYCDNQVALHITTNHVSHEHTKHIEVDYHFVLDELSQGTIATSHVSSHAQLVDIFIKALGKTQFDFIFSKLGICNPYAPT

SEQ ID NO: 183932 - protein, 57 aa, Glycine max
  Coding DNA Sequence Number=SeqID_67154
  Subcellular localization annotation: CTP_CleavageSite=38; ConfidenceScore=5.06e-01
MPPHKLGPQTGPFAQRGPRGRGGPIYLVRVKSRGRLTRSAANAGGPYAEWANLLTHP

SEQ ID NO: 183933 - protein, 74 aa, Glycine max
  Coding DNA Sequence Number=SeqID_67155
MPEDGLDVLNLTIEEIMQDEEVAPMHGSVDEIVTMLRPILEEIINRRIGGLSSPYSIGLSAYLENKEVITYYAH

SEQ ID NO: 183934 - protein, 163 aa, Glycine max
  Coding DNA Sequence Number=SeqID_67156
  Homolog annotation: Hit_ID=Q9FKM4; Match level="QueryCoverage=78%, HitCoverage=20%, E-value=5e-22, Identity=49%"; Hit description =Arabidopsis thaliana genomic DNA, chromosome 5, P1 clone:MUA2
MREKRERESEKQQRRGRVRSRRVGPFYCSQGSTGARLVVTLSPVSRVFGCNSKVAMKKALMPTWCSRADLDGGPGFDAKDLVLNVNGRVDHFGDVLVVHGCEHGNEVDVANVTKYNVEGHVDLSILVIELHRCDISVATGCDNIAHNLDEFKDVDNVVLHKVD

SEQ ID NO: 183935 - protein, 121 aa, Glycine max
  Coding DNA Sequence Number=SeqID_67157
MDIFYKPIHCKVIGDDEFELDEVNSVVNGHVRDTLLPSSIYCNALFSLRVRHIFTNQIRLMSPWIRREGVRRSRSEEWVWVVRRCYMGVIDINMKKEKRWRQRHLFNDVSINNGNDNIEAF

SEQ ID NO: 183936 - protein, 79 aa, Glycine max
  Coding DNA Sequence Number=SeqID_67158
MSCANEQKTTSRWKKCTGSGTKSDKSDKNTTSEKEAPRPTHMSDKRHKSDKRQPLPKGLRYERYTSLTIALYSSRRLST

SEQ ID NO: 183937 - protein, 86 aa, Glycine max
  Coding DNA Sequence Number=SeqID_67159
MSEQHITFWAFMDTMKSIISDLKTTYKDEVVLTQRQLLRLWQVHQIVTSSKARKSECRVRRDFIALIQYLSIYVLLGVTLSQAYNP

SEQ ID NO: 183938 - protein, 245 aa, Glycine max
  Coding DNA Sequence Number=SeqID_67160
  Gene Ontology: Mol. function=guanyl-nucleotide exchange factor activity; Cellular component=nucleus; Biological process=response to DNA damage stimulus
  Homolog annotation: Hit_ID=Q9STA6; Match level="QueryCoverage=76%, HitCoverage=50%, E-value=1e-48, Identity=56%"; Hit description=RAD23 protein
  Pfam annotation: Domain name=UBA; Domain location=148-190; Score =36.9; E_value=7.1e-08; Accession=PF00627.21; Description=UBATS-N domain
  Pfam annotation: Domain name=ubiquitin; Domain location=6-78; Score =78.1; E_value=2.8e-20; Accession=PF00240.13; Description=Ubiquitin family
  Pfam module annotation: Pfam domain module=UBA::ubiquitin; Domain location=148-190::6-78
MKINVKTLKGTHFVLQVNPQDTVAVVKKNIETAQGADVYPAAQQMLIHQGKVLNDATTLEENKVVENNFVVIMLSKNKVSSGASSAPSNLGTQPQSSLPPTSSTSQPPASAVGQGESNSEQSPVITPPTIAVPSIYDHAASNLMAGSNLETTIQQILEMGGGNWDRDTVTGALHAAFNNPERAIEYLYSLLIGTLLSVGLETPVAAHVIFKLTGLMLQRIKPSKLVLLVNYAILCQYSFKLMMVV

SEQ ID NO: 183939 - protein, 307 aa, Glycine max
  Coding DNA Sequence Number=SeqID_67161
  Gene Ontology: Mol. function=tRNA isopentenyltransferase activity; Cellular component=intracellular; Biological process=tRNA processing
  Homolog annotation: Hit_ID=Q09Q94; Match level="QueryCoverage=88%, HitCoverage=84%, E-value=4e-67, Identity=47%"; Hit description =Isopentenyltransferase
  Pfam annotation: Domain name=IPPT; Domain location=44-240; Score =15.3; E_value=6.5e-12; Accession=PF01715.8; Description=IPP transferase
MAPLSLAEKKKVLFIMGATGTGKTKLSINLGTQFPSEVINSDKIQVYKGLDIITNKVPESERNGIPHHLLGIIDDPDYDFTVDDFCKHVLIALDLIIENGHLPIIVGGSNTYLATLLEDPNIAFRSKYDCCFIWVDVSLPVLFQYLDKRVDEMLDKGVVDEIRETFVPGADYSRGVRRAIGVPELGEYFLVEKKIDDETKKEKMLQGAIARTKENTCKLAEAQLLKIHKMNYEFGWGMTKIDSTQVFEAVLKGMDYKHLYHEIVFKPSVDIVKRFLHETTSGKGKALRQNGEQVTVVLQKSLKLAKD

SEQ ID NO: 183940 - protein, 159 aa, Glycine max
  Coding DNA Sequence Number=SeqID_67162
  Gene Ontology: Mol. function=RNA-directed DNA polymerase activity; Biological process=RNA-dependent DNA replication
  Homolog annotation: Hit_ID=Q1SP50; Match level="QueryCoverage=90%, HitCoverage=23%, E-value=1e-17, Identity=34%"; Hit description=RNA -directed DNA polymerase
MASCIKDIEVKALKVILNTYGKAYGQLINPNKSKFFFSTNTQHSHRKRISSFLGIKDLIGKGKYLGLPSLIGRNKKVVFDFMKDKVWKCINHWSSKHLSKADQIQKMMNNFGGVLKRQIQEKEYCIMGCQDLHGFNLAILGKLRWKFSTDHDGYTNLQS

SEQ ID NO: 183941 - protein, 90 aa, Glycine max
  Coding DNA Sequence Number=SeqID_67163
MGATVLSSRWWETAKGGGADVDAVGGGGLRRDGDGDGVGVVKVSTGGGASVGDELGGKGVGVRVESREAWMLDRRVMASSSLLIVVFRVA

SEQ ID NO: 183942 - protein, 96 aa, Glycine max
  Coding DNA Sequence Number=SeqID_67164
  Homolog annotation: Hit_ID=Q00M75; Match level="QueryCoverage=30%, HitCoverage=4%, E-value=3e-08, Identity=96%"; Hit description=PPR -repeat containing protein
MIQAHYFFSFHVPKGSDSDEEEEDMFSYDLTIAECQEEKGGAGWFRGEGGFAEGFQSGKKKEMMEGWASPGAAVKLCLGDLLVMGSNPETVSLHMQ

SEQ ID NO: 183943 - protein, 128 aa, Glycine max
  Coding DNA Sequence Number=SeqID_67165
  Homolog annotation: Hit_ID=Q5YJL6; Match level="QueryCoverage=52%, HitCoverage=40%, E-value=2e-08, Identity=48%"; Hit description =Autophagy protein AGP6
MGRQETKDREMGKILKTGSQEHHHGSSSSSTSTSHVPPGQAAGLVAILKDKSVDELRKLLSNKDAYQQFLSSLDEVKIQNDVSKMPRSHGDDNAENSQIIELNNPFPTHGAYHGSATWWFDPTNGYKA

SEQ ID NO: 183944 - protein, 251 aa, Glycine max
  Coding DNA Sequence Number=SeqID_67166
  Gene Ontology: Mol. function=heat shock protein binding; Cellular component=integral to membrane; Biological process=protein folding
  Homolog annotation: Hit_ID=Q4T5P8; Match level="QueryCoverage=57%, HitCoverage=50%, E-value=4e-15, Identity=35%"; Hit description =Chromosome undetermined SCAF9165, whole genome shotgun sequence
  Subcellular localization annotation: CTP_CleavageSite=73; ConfidenceScore=5.82e-01
MATCLLRVGRFTSIDSRSLFVSTASFSSSFSSPSSSGKSKTGKKLTDRLSSVIDAVNDRKLPPELRGQHNNVRSETDMINVVEQRIWHSMEEGQFENLPGKGKPLKLDTNPHADPAEDTLYRILSKNGCAPEWVELNKEIRSKISEWRKSLKKAWATKCSGDHSEWVESTEALKSQLREINDKVFRYNLIVPFGRQMFGLKWEKELDDWNEMGEGFSNGSAIVCTAFAIYLPALIIKLYVLQVLYLLEDDC

SEQ ID NO: 183945 - protein, 151 aa, Glycine max
  Coding DNA Sequence Number=SeqID_67167
MVDHLDLEAMVGVLNWWRVGEEWPKEMEGCLIITESQSGGQLGGVTVCKGTRNWICKGVVYYVLTDSRLGGGVFNWGGDGSVVNWVILTVTGIVPITIAKLEGLSSYRELVLLFQYGELLRDEKMKGLPPTGRQRSTSISEVEKVTLLHYE

SEQ ID NO: 183946 - protein, 189 aa, Glycine max
  Coding DNA Sequence Number=SeqID_67168
  Gene Ontology: Mol. function=pepsin A activity; Cellular component =cellulose and pectin-containing cell wall; Biological process =proteolysis
  Homolog annotation: Hit_ID=Q5ZAZ8; Match level="QueryCoverage=83%, HitCoverage=32%, E-value=6e-36, Identity=51%"; Hit description =Putative aspartic proteinase nepenthesin II
MGSEVFDLEIDVLRFMLVVFCGVQIELNFFDTVGSSTAALIPCSDPICTSRVQGAAAECSPRVNQCSYTFQYGDGSGTSGKCGICLVGVKIRGNGREEGIKVTMCSISQSGDLTKTDKAVDGIFGFGPGPLSVVSQLSSRGITPKVFSHCLKGDGDGGGVLVLGEILEPSIVYSPLVPSQNVQGISERN

SEQ ID NO: 183947 - protein, 296 aa, Glycine max
  Coding DNA Sequence Number=SeqID_67169
  Gene Ontology: Mol. function=pepsin A activity; Cellular component =cellulose and pectin-containing cell wall; Biological process =proteolysis
  Homolog annotation: Hit_ID=Q9FFC3; Match level="QueryCoverage=63%, HitCoverage=35%, E-value=6e-62, Identity=63%"; Hit description =Protease-like protein
  Pfam annotation: Domain name=Asp; Domain location=7-222; Score= -193.1; E_value=0.033; Accession=PF00026.14; Description=Eukaryotic aspartyl protease
MEDQRKDKDLQMVIWMSMQRMTPEPKRNKPFKKREAHTFQRKWEEEHSNEQAVVFSAYRERMRFVTPHYNLNLQSIAVNGQLLPINPAVFSISNNRGGTIVDCGTTLAYLIQEAYDPLVTAINTAVSQSARQTNSKGNQCYLVSTSIGDIFPSVSLNFEGGASMVLKPEQYLMHNGYLDGAEMWCIGFQKFQEGASILGDLVLKDKIVVYDIAQQRIGWANYDCSLSVNVSVTTSKDEYINAGQLHVSSSEIHILSKLLPIWIEALTIGDFDERLRRENFDKILISGNFDGSSKND

SEQ ID NO: 183948 - protein, 474 aa, Glycine max
  Coding DNA Sequence Number=SeqID_67170
  Gene Ontology: Mol. function=nucleic acid binding; Cellular component= intracellular; Biological process=chromatin modification
  Homolog annotation: Hit_ID=Q9C9X7; Match level="QueryCoverage=94%, HitCoverage=93%, E-value=1e-108, Identity=50%"; Hit description =Putative C2H2-type zinc finger protein; 11906-10073
  Pfam annotation: Domain name=zf-C2H2; Domain location=134-156; Score =22.1; E_value=0.002; Accession=PF00096.16; Description=Zinc finger, C2H2 type
  Pfam annotation: Domain name=zf-C2H2; Domain location=161-182; Score =14.5; E_value=0.28; Accession=PF00096.16; Description=Zinc finger, C2H2 type
  Pfam annotation: Domain name=zf-C2H2; Domain location=57-79; Score =27.3; E_value=5.3e-05; Accession=PF00096.16; Description=Zinc finger, C2H2 type
  Pfam module annotation: Pfam domain module=zf-C2H2::zf-C2H2::zf-C2H2; Domain location=134-156::161-182::57-79
  Subcellular localization annotation: CTP_CleavageSite=19; ConfidenceScore=5.13e-01
MLANNLSPSSVPTSEPFPCTENGTATNKRKRRPAGTPDPDAEVVSLSPKTLLESDRYVCEICNQGFQRDQNLQMHRRRHKVPWKLLKRETPVVRKRVFVCPEPTCLHHDPCHALGDLVGIKKHFRRKHSNHKQWVCERCSKGYAVQSDYKAHLKTCGTRGHSCDCGRVFSRVESFIEHQDACNMGRLRPESQPLQPSACLSRTASSPSPSSETNFSTAPWPTRMIIPKPSEPPTIFMNNPITAITTAETSSKSNNKLLHPNLDLQLSTPTTTNNTSNVANRIDAAISPKRDHHHHHENHSTHLQLSIGSSDMSEKNESNRNSSEKSSNSNINDQNNNNKQSNNMALLRVQEQAREHLRIAMAEKAYAEEARKQAKRQIELAEQEFTNAKRIRQQAQAELDKAYSLKEHAMKQINSTMLQITCHGCKQQFQARNAATTPDENSLVLSYVSSAITTEGGGEVENDNNAKDHGKDNN

SEQ ID NO: 183949 - protein, 180 aa, Glycine max
  Coding DNA Sequence Number=SeqID_67171
MEDNVLLDKEDIVAEEEVGEEECVPRVDLGFLCSCIPAQLKGSPRVNLGFNEPWTGNVFALSFDKPVELHRGLPWTNPEFCEPVKLTNGGPWRTCQAITYMSLVEWYILEMWCRALAYMSLVEWHTLETNDTYWRRGGMLLHVSLMEWHVLETWWREPGGLTKGKPWVLQALWRNNQKRV

SEQ ID NO: 183950 - protein, 60 aa, Glycine max
  Coding DNA Sequence Number=SeqID_67172
MDKSWILKPQNSIEYEEGIMIDDALGVDRQHTNEVSIAPNVEVDRDEVVPNDTQERNEAK

SEQ ID NO: 183951 - protein, 125 aa, Glycine max
  Coding DNA Sequence Number=SeqID_67173
  Homolog annotation: Hit_ID=Q2R5G9; Match level="QueryCoverage=72%, HitCoverage=32%, E-value=4e-11, Identity=38%"; Hit description =Uncharacterized plant-specific domain TIGR01615 family protein, expressed
  Pfam annotation: Domain name=DUF506; Domain location=1-85; Score= -57.3; E_value=6.8e-05; Accession=PF04720.3; Description=Protein of unknown function (DUF506)
MKMQGLHCVWMRKFNQFEIARPTQRFLKALATVPDVFIRGAEELKHTISTTCDTVRRCFRSRGLLVPPWRKNRFMQNKWLGPCHRTTRDTSMGFNGGVSCRVVGFDNVVSEAGSGSSSGVVVRTR

SEQ ID NO: 183952 - protein, 162 aa, Glycine max
  Coding DNA Sequence Number=SeqID_67174
  Gene Ontology: Mol. function=single-stranded DNA binding; Cellular component=nucleus; Biological process=response to DNA damage stimulus
  Homolog annotation: Hit_ID=Q84L30; Match level="QueryCoverage=60%, HitCoverage=26%, E-value=2e-25, Identity=56%"; Hit description =Putative DNA repair protein RAD23-4
  Pfam annotation: Domain name=XPC-binding; Domain location=14-72; Score=73.9; E_value=5.2e-19; Accession=PF09280.1; Description=XPC -binding domain
GLPNMSAIDNRGDLDSLRNREEFQALRETMRENPQILQPMIQELGQQNPQLMQIIQDHQEDILDLMNEPEGDENLQSQLDSMISGTVTITPEENEAIQRTKVKKKFMSSIKYVRPSVRLSLAGSIPIHIHDRGYIEIDFFKHFFFSSQGLATNVYTFDMSCF

SEQ ID NO: 183953 - protein, 92 aa, Glycine max
  Coding DNA Sequence Number=SeqID_67175
  Gene Ontology: Cellular component=mitochondrion
  Homolog annotation: Hit_ID=Q2QMA7; Match level="QueryCoverage=64%, HitCoverage=34%, E-value=9e-17, Identity=68%"; Hit description =Expressed protein
MAGLLGYRSLPPKAKNLVVAGGLTAFVFGAYFYTMRAVGGTDELQVAIDKFEADKSKNEGDANMPSKNVLKGMILNLVANKFQPALCTMTVW

SEQ ID NO: 183954 - protein, 173 aa, Glycine max
  Coding DNA Sequence Number=SeqID_67176
  Homolog annotation: Hit_ID=Q6S9W9; Match level="QueryCoverage=29%, HitCoverage=10%, E-value=4e-09, Identity=58%"; Hit description =Betaine-aldehyde dehydrogenase
MEKHIKVAIFISKTSWVQVEKVEKHIKVAIFISKASWIQRRWKKTLKLPFFTTKSFDFNLKRRWKETLKFPFLTPKTFDFYLIFISNRILFFVSLSTDKVEEDTKAVIFNSKKDDVIGSFNYYVELAAGVDTHQNGYVPLPMETFNTYVHKEPNGVAALITPCNLLPRTIFIN

SEQ ID NO: 183955 - protein, 774 aa, Glycine max
  Coding DNA Sequence Number=SeqID_67177
  Homolog annotation: Hit_ID=Q5JL61; Match level="QueryCoverage=13%, HitCoverage=16%, E-value=1e-29, Identity=62%"; Hit description =Putative NADPH-dependent FMN and FAD containing oxidoreductase-like protein
  Pfam annotation: Domain name=Flavodoxin_1; Domain location=639-761; Score=87.9; E_value=3.2e-23; Accession=PF00258.15; Description =Flavodoxin
MAAMADVAARRKMADAAATLDLEAPTQRDDPRPLQPATTSEPPTPATSDDEHGSDHPRQRERRTTDESFTQLCFVDEAEPDDSILPLRDMFGTCLSVVAALTKDCIEGFHLQEVQVIGLQFLKARIQRGVNTEDNSFIMFLVGELIGDIFTLIHKMLKAIVMIFLSTEDGFSQEVNDLRSTAVKLVSRLAQIPSSAIHFKDVLLSMPPLHRQQLQGVIRASVTHDKNPTDLKVPVLDIKMPKPSEGTEEKHSVPSSAAVMQTDENDKEEDEFSEDDWDAFQSFPVSKSEDGDDSKTEYVAEGKDPSTVKMSSEIESSIGGVEFQECSISKSINSEKELKGDECLEAVKEKHDQTYPSANKPHDNENQEMEEKLQTSVLQEEGTSIPGSELVSCDQKPEEEAKMEEKLQNSGLQEEGISILGNERVYCDHKPEVEAEMEEKLQNSGLQGEGTAIPRNERVSCDQMSEVEAVMEEKLQNLGLQEEGTSIPGNERVSCDQKPEVEAEIEEKLQNSGLQEEGTSIPGNEQVSCDQKREVEAEGSIEEEVVSDSPTLQQGFSEPGNSEQLNRCDEDAEKDSVNENESHHPQLEMSETPIECTKLEPFAEDHKDHNRAGVRLTLLGGGAVWFVKLKMKGMRKLLILYASQTGNALDAAERLSREAERRACPFNLLSVDQYDPSLLPQEEAVIFVVSTTGQGDTPDSMKVFWRYLLQRNLGQRWLSGVLYAVFGLGDSSYQKYNVLKYETGDVLEVLPGQDSAAVDAFIRRCNLDPDSFIT

SEQ ID NO: 183956 - protein, 427 aa, Glycine max
  Coding DNA Sequence Number=SeqID_67178
  Subcellular localization annotation: CTP_CleavageSite=68; ConfidenceScore=5.42e-01
MGLSKVKGGCQIEKRKKSCRQQKGVSSSKNKKKSFGPPTSISHGRGSGWVVFSVRVAVVHAVLVTAVRVALGGRCRARRHWLQGSWVVALCWSFEVEGCSCIRHFPPRRHIRHGRHGRHGAAIFNSSRHRYSVAFFQKTATQLRHGRHLTTLLLAILSISTQHHALPGGRDTQNDRLGNPLDQWIKISSRCSDCDASSEANKRQNEADEETRAGAEAEDRYEERKEVVNGSRTPDKKTKEEHEKGSIRAEGNGSEFEVAGFHQTYARDKEQVDLDGLILLPCTPNVLKTHQENKIEAHSNKKHPISVYARKKWRKKQPLENGVQRNLSGSLEIGKVPSQQELNSEDHNHENIQQQDSCHDDMGQVMEQDEMQDINNNSKEAEILWQLAKELGVTGWNDNVKQVQQMVELEERDIKESEKLGGMRKTP

SEQ ID NO: 183957 - protein, 477 aa, Glycine max
  Coding DNA Sequence Number=SeqID_67179
  Gene Ontology: Mol. function=calcium ion binding; Cellular component =mitochondrion; Biological process=protein amino acid phosphorylation
  Homolog annotation: Hit_ID=Q69L95; Match level="QueryCoverage=87%, HitCoverage=76%, E-value=2e-34, Identity=26%"; Hit description =Putative fertility restorer homologue
  Pfam annotation: Domain name=PPR; Domain location=112-146; Score =31.6; E_value=2.7e-06; Accession=PF01535.11; Description=PPR repeat
  Pfam annotation: Domain name=PPR; Domain location=147-181; Score =32.0; E_value=2.1e-06; Accession=PF01535.11; Description=PPR repeat
  Pfam annotation: Domain name=PPR; Domain location=182-216; Score =16.1; E_value=0.092; Accession=PF01535.11; Description=PPR repeat
  Pfam annotation: Domain name=PPR; Domain location=220-254; Score =22.1; E_value=0.0019; Accession=PF01535.11; Description=PPR repeat
  Pfam annotation: Domain name=PPR; Domain location=255-288; Score =22.2; E_value=0.0018; Accession=PF01535.11; Description=PPR repeat
  Pfam annotation: Domain name=PPR; Domain location=306-341; Score=4.4; E_value=2.3; Accession=PF01535.11; Description=PPR repeat
  Pfam annotation: Domain name=PPR; Domain location=77-111; Score=6.3; E_value=1.4; Accession=PF01535.11; Description=PPR repeat
  Pfam module annotation: Pfam domain module=PPR::PPR::PPR::PPR::PPR::PP R::PPR; Domain location=112-146::147-181::182-216::220-254::255 -288::306-341::77-111
IFREVDSATKKKCGVNAEDCLSNDDSFGADGNGRHAVFNALDTLLKDSLERLKMMSENLCLVKTGLTIGYACESKYAEDTATIRRLCLDGKLEAAVWLQGKMVQKGVVPDVFTHSHIVNGLCKIGLPDKADLVVREMLEFGPCPNCATYNTLIKGYCAVNGVDRALYLFSTMAYAGILPNRVTCSILVCALCEKGLLMEAKSMLVEILKDDDEKGIPDLVTSSIFMDSYFKNGAIIQALNLWNQMLQNCTKVDVVAYNVLINGFCKSQLMNLAYGYACEMFKKGKISEACYTIGVMSNMGIMPDQITYQIVIRGFCFDGEIVRAKNLLWYQMLDFGVCPNVFTYNALILAQVKSGNFHGRPDFALQLHNEMVQRGGKMKEAEELYAKILKSGLLNDHVPVQIIFNKYCKLEEPDADKVQEAVQVDTALEKVLDKVGADPNSKSGYTRAGHVGEWRREIHESWNEREKWLNGGGGGSN

SEQ ID NO: 183958 - protein, 43 aa, Glycine max
  Coding DNA Sequence Number=SeqID_67180
MAKSPRARLHPFLKDNLTTVLKVTTLCPWKSWDRLLKNKGIEE

SEQ ID NO: 183959 - protein, 323 aa, Glycine max
  Coding DNA Sequence Number=SeqID_67181
  Gene Ontology: Mol. function=protein binding; Cellular component =cytoskeleton; Biological process=electron transport
  Homolog annotation: Hit_ID=UPI0000D55467; Match level="QueryCoverage =97%, HitCoverage=15%, E-value=2e-28, Identity=30%"; Hit description =PREDICTED: similar to CG2747-PB, isoform B
MLLFFGIIFASQDSGGMLSLLGIIEQCLKAGKKQHWHKASLTNICVGLLAGFKALLSFRPQTLGQEILGLAQSIFLGILAEGDICASQRRASSESLGYLARFGNDIFTARMACSFNLTRSLLGDLNGATDPNYAGSIALALGCIHRSAGGIALSTLVPATVSSISSLAKSSVANLQIWSMHGLLLTIEAAGLSFVSHVQATLSLAMDILLSDENGLVDIQQGVGRLINAIVTVLGPELAPGSIFFSRSKSAIAEISSWQETSTMLESARFTQQLVLFAPQAVSVHSHVQTLLSTLSSRQPTLRHLAVSTLRHLIEKDPVGSPS

SEQ ID NO: 183960 - protein, 269 aa, Glycine max
  Coding DNA Sequence Number=SeqID_67182
MGSNLQFELDSLHGQATVLAALVSISPKLPLGYPARLPGLVFGVSKKMLTEHSRNPVAATVEKEAGWLLLSSLFASLPKEELEEDVFDILALWASLFTGNPENEITKTDDLKSRIFVWSAAVHALTAFIKCFISPNVANDGVLLQPVLVYLSSALSYISALRAKGLPHVKPAVDVFVIKTLIAYQSLPDPVSFKNDHPQIIQLCTFPFRHASECEESSCLRLLLDKRDAWLGPWIPGRDWFEDELRAFQGGKDGLMPCVWENEISSFPQ

SEQ ID NO: 183961 - protein, 125 aa, Glycine max
  Coding DNA Sequence Number=SeqID_67183
MPYFLLQACVLYVLRVAVTDQMTEPTQRSFLVFLGNQLQSPEAGPSMKVVALRTLSYTLKTLGEVPLEFKEVLDNTVVASVSHSSKLAALALRALAEVDPTCVGGLTSYGVTNLTALRESVSFEK

SEQ ID NO: 183962 - protein, 289 aa, Glycine max
  Coding DNA Sequence Number=SeqID_67184
  Homolog annotation: Hit_ID=UPI0000548B8B; Match level="QueryCoverage =77%, HitCoverage=17%, E-value=1e-09, Identity=27%"; Hit description =PREDICTED: similar to CG2747-PB, isoform B, partial
  Pfam annotation: Domain name=HEAT; Domain location=22-57; Score=1.2; E_value=30; Accession=PF02985.12; Description=HEAT repeat
  Pfam annotation: Domain name=HEAT; Domain location=64-100; Score =15.4; E_value=0.21; Accession=PF02985.12; Description=HEAT repeat
  Pfam module annotation: Pfam domain module=HEAT::HEAT; Domain location=22-57::64-100
MSNGAAQCLGELYKHFGRRITSGLPETTSIATKLMKSNEEFVRQEALYMLRNALEGSGGSAASTAYSEAFRLIMRSATGDKSFAVRIAAARCLKAFASIGGPGLGVAELDNSASYCVKADPVSSVRDAFAETLGSLLALGMNPEAQVQPRGKGPLPQAKKLEGGLQKHLILAFTKASGVKSRVIRVGLTLAWVFFLQVIRIKYLFPDSELQNFALQIMEMLRAENSVDAHALTILEFFFLILMRVNLGAMVRLPRKQPDARIKLHKSDPLQTPLWLEPCVLNHHFDDKK

SEQ ID NO: 183963 - protein, 319 aa, Glycine max
  Coding DNA Sequence Number=SeqID_67185
  Gene Ontology: Mol. function=carboxylesterase activity; Cellular component=nucleus; Biological process=metabolic process
  Homolog annotation: Hit_ID=Q0ZPV5; Match level="QueryCoverage=95%, HitCoverage=95%, E-value=1e-97, Identity=60%"; Hit description=CXE carboxylesterase
  Pfam annotation: Domain name=Abhydrolase_3; Domain location=90-314; Score=161.9; E_value=1.7e-45; Accession=PF07859.3; Description =alphabeta hydrolase fold
MAAISLRHNPQVNNTNQQREIIAEEIQGLIRVHRDGRVERPPIVPSVSCTVPSERGVTAKDVMINKETNLWARVYMPISCHHSKLLLPLLVYFHGGGFCVGSAAWSCYHEFLTNLASKANCVILSVDYHLAPENRLPMAYDDGSNALMWVKREALNGFSVQKWWLSHCNMSSLFLAGDSAGANIAYNVATRMGSTSNTPLSLKGVILIQPFFGGEDITFSEKHSLQPPNSALTLSVSDTYWRLALPLGATLDHPYCNPLAHGTVKLRDLRLPSTMIGTWSSQTLWPKQGKGLKQLFTKALAMHSKCCIIISFPIPEPKK

SEQ ID NO: 183964 - protein, 157 aa, Glycine max
  Coding DNA Sequence Number=SeqID_67186
  Gene Ontology: Mol. function=RNA-directed DNA polymerase activity; Cellular component=chromatin; Biological process=chromatin assembly or disassembly
MAVRHKKGLYFDCDEKFNHGQKCSAKFFLLISNEKDDAQGEPNLTDLQPKFPIATDSSQTQISFHAFSGHLAPKIVRLLGRISNQKVAILIDGGNTHNFVQEHMGQIFTVDLHVLPLCGADLVLGIQWLKSLGLILIEYNDLTMKFMYSDKVIEGIL

SEQ ID NO: 183965 - protein, 602 aa, Glycine max
  Coding DNA Sequence Number=SeqID_67187
  Gene Ontology: Mol. function=unfolded protein binding; Cellular component=cytoplasm; Biological process=cellular protein metabolic process
  Homolog annotation: Hit_ID=Q6ASR1; Match level="QueryCoverage=99%, HitCoverage=95%, E-value=0.0, Identity=75%"; Hit description =Putative chaperonin
  Pfam annotation: Domain name=Cpn60_TCP1; Domain location=29-601; Score=377.2; E_value=2.5e-110; Accession=PF00118.14; Description=TCP- 1cpn60 chaperonin family
MSLRVLNPNAEVLNKSAALHMNINAAKGLQDVLKTNLGPKGTIKMLVGGAGDIKLTKDGNTLLKEMQIQNPTAIMIARTAVAQDDASGDGTTSTVIFIGELMKQSERYIDEGRDLEKWKNASMHPRVLVDGFDIAKRATLQFLEKFKTPVVMGGEPDKEILKMVARTTVRTKLYESLADQLTDIIVDAVLCIRKPEEEIDLFMVEIMHMRHKFDIDTRLVEGIVLDHGSRHPDMKRRAENCYILTCNVSLEYEKRHNMLMSYSNEYAHMTGNVLISVGLCLLCLSKEGLVNLKQINEVNSGFFYSSAEQREAMVAAERRQVDEKVKRIIELKNKVCSGNDSNFVVINQKGIDPPSLDLLAREGIIALRRAKRRNMERLVLACGGEAVNSVDDLTPECLGWAGLVYEHVLGEEKYTFVENVKNPFSCTILIKGPNDHTIAQIKDAVRDGLRAVKNTLEDESVVLPLCICKGKAAYNIPPPYLRIAKSLWTMGLEENFLSHDQGAGAFEVAARQYLMNEVKKTVQGRAQLGVEAFADALLVVPKTLAENSGLDTQDVIIALTGEHDKGNIVGLSLNTGEPIDPAMEGIFDNYSVKRQIINSGYG

SEQ ID NO: 183966 - protein, 123 aa, Glycine max
  Coding DNA Sequence Number=SeqID_67188
  Subcellular localization annotation: CTP_CleavageSite=38; ConfidenceScore=5.12e-01
MAHLESSPHSPTSSAANPQSVSHPYNPHRMKLEVPRFDVSNPSGWIFKITKFFEYHFTPDHECLTIASFYMESLALARFQWMTCIAQISSWFGLLFGLTLEIHREVQALQPLTLILEAALARL

SEQ ID NO: 183967 - protein, 155 aa, Glycine max
  Coding DNA Sequence Number=SeqID_67189
  Gene Ontology: Mol. function=oxidoreductase activity; Cellular component=cytosol
  Homolog annotation: Hit_ID=Q8S0M7; Match level="QueryCoverage=87%, HitCoverage=38%, E-value=3e-38, Identity=56%"; Hit description =Putative allyl alcohol dehydrogenase
MAEEALLQNKQVLFKGYIDGVPKETDMELKVDSHIALKPPPQGSSAILVKNLYLSCDPYMRGRMRDFHGSYIPPFLPAQALEGFGVSKVIHSDNPNYKPGDFITGFTGWEEYSLIQRTEQLRKIHPDDAIPLSFHVGLLGMEHHMHPAHMPVSLF

SEQ ID NO: 183968 - protein, 347 aa, Glycine max
  Coding DNA Sequence Number=SeqID_67190
  Gene Ontology: Mol. function=DNA binding; Biological process =regulation of transcription
  Homolog annotation: Hit_ID=Q1S588; Match level="QueryCoverage=99%, HitCoverage=84%, E-value=1e-38, Identity=34%"; Hit description=Myb -like DNA-binding domain, SHAQKYF class, putative
  Pfam annotation: Domain name=Myb_DNA-binding; Domain location=235 -286; Score=43.3; E_value=8.6e-10; Accession=PF00249.21; Description =Myb-like DNA-binding domain
MPQNKIFHDQQSSNPIPDLSLHISLPNSAPSSICTEGDSPFDAEGFKSHSDGSIKGCSSPYHTDTQLSLANPTNTTSTPSEAESTWRKRNFVRLVAEGQIRLINGIPLYSNLSSLDTIPSIERNQPTNKFSFSSLYAFPHPPSAPNYGNNNGVVGGVAVEPISRFREIRTMESSSLRPQQFQYFDYPHQHQHHHQQQQFGSSNNIGASDFSSNGFVRSRMFSRQQSNKRNMRAPRMRWTSSLHNRFVHAVELLGGHERATPKSVLELMDVKDLTLAHVKSHLQMYRTVKNTDKPAASSDGDEDFMSLTVPNDQNNSFLPNQRGTSNASIDNDMGYTSSNLWVNSSSR

SEQ ID NO: 183969 - protein, 439 aa, Glycine max
  Coding DNA Sequence Number=SeqID_67191
  Gene Ontology: Mol. function=RNA-directed DNA polymerase activity; Cellular component=chromatin; Biological process=chromatin assembly or disassembly
  Subcellular localization annotation: CTP_CleavageSite=53; ConfidenceScore=5.20e-01
MWCPFYGKIAPIPLPEASVSTVKGTSKSRRDNTGAVRCNNGSIATEKMTAEIRQAQEASNGPYGLRHRPNELAVYKDLKHSCQVGQMPFKNTVYEDVVEEDDNKAVEVQNEVVSECGGHVVWTAARLGVHERGCGIGLKGFKLVMEVGGWHSLPASGQYGGAGVSHDRSKGLEPLHTQNHIGTTQGQDMKVHHKLNALDSNGDCFTKVITMKLLTIPDHDAKRSSGASSEAQFPHQWFLNKVVGVASINQDNQLGRDNVTQETQGLRCQMTREIVECDLGLRRVSGVGSKGVAIVDKGRGGGVARGGGQTVNPEIKKLKRNGGGKLTICFVRSSNSERYLVIVDRWAMLSLSCSSVAWYDVRSIGACRPRIFFINGFLCFLEDEWQRNGERKRERRRHFKEKMSLEEAHHHRRPWIRAWRKKEMNEGRGREDHEILCSN

SEQ ID NO: 183970 - protein, 461 aa, Glycine max
  Coding DNA Sequence Number=SeqID_67192
  Gene Ontology: Mol. function=RNA-directed DNA polymerase activity; Cellular component=chromatin; Biological process=chromatin assembly or disassembly
  Pfam annotation: Domain name=rve; Domain location=169-310; Score =57.3; E_value=5.1e-14; Accession=PF00665.16; Description=Integrase core domain
  Pfam annotation: Domain name=zf-H2C2; Domain location=110-151; Score =7.0; E_value=0.042; Accession=PF09337.1; Description=His(2)-Cys(2) zinc finger
  Pfam module annotation: Pfam domain module=rve::zf-H2C2; Domain location=169-310::110-151
METIFIRAPLHNSDRSSQIEGIAHSDALSRTPQYSQATLLVLYVPCLTFNDELKKHLLREPQFVQLLRDIQAHPENYSNYTITQELIMKGGRIWLPRGFLFIPSRLAEYHSTPSSGHMGAAKIAVRLMENFTWHGLRNDVESFVKACVDCQHAKYETKRVVGLLCPLPVPHRPWEDPSLDFITGLPLFRGNTTILVVVDRFSKGIHLGILPTSHSSLTVATLFIEIVGKIHEMPQSLVSDRDPLFLRMSFAYHPQSDGQIEVLNRIIEQCLRAFIHKKLTTWGKFLPWVEWSHNTSWNTKAGSTPFEITFGRKPFNFPEYLVGTDVEFKVGDLVMVRLRPFRQSTVTGNEGAYSKLDKKFCGLFEIMERIGPVAYKLHLPEGARIHLIFHCSLLKPFHGAPDSSLPKWEVLVQWEGLSPDDTSWEDWDQLRAGYHLEDKVFPQVAGNVSNQGVQTKGSKPG

SEQ ID NO: 183971 - protein, 86 aa, Glycine max
  Coding DNA Sequence Number=SeqID_67193
  Gene Ontology: Mol. function=transporter activity; Cellular component= integral to membrane; Biological process=oligopeptide transport
  Homolog annotation: Hit_ID=Q9C7H5; Match level="QueryCoverage=67%, HitCoverage=54%, E-value=4e-16, Identity=59%"; Hit description =Oligopeptide transporter, putative
MVFLTLSVSALKHKFLFFLALYVLAIGDGGHKPCVQTFAADQFDEDTPEEKDAKSSFFNWWYLGIVAGSTASVFVVIYLQAKGNVI

SEQ ID NO: 183972 - protein, 61 aa, Glycine max
  Coding DNA Sequence Number=SeqID_67194
MGPNLRKESMSKVGVYGLEEEIKVNWDATFLEWKKTTDGDTTAVNLFRPFTLPSHLDHIIN

SEQ ID NO: 183973 - protein, 68 aa, Glycine max
  Coding DNA Sequence Number=SeqID_67195
MDSGRSNRQIQDPMSLEGEKRKTSQQRRNLNKTLPPSLSLAAAGATKLCVQRRRFDLLSSLFGEQASK

SEQ ID NO: 183974 - protein, 236 aa, Glycine max
  Coding DNA Sequence Number=SeqID_67196
  Gene Ontology: Mol. function=transporter activity; Cellular component= integral to membrane; Biological process=oligopeptide transport
  Homolog annotation: Hit_ID=Q9M1I2; Match level="QueryCoverage=85%, HitCoverage=36%, E-value=2e-61, Identity=55%"; Hit description =Oligopeptide transporter-like protein
  Pfam annotation: Domain name=DUF975; Domain location=1-219; Score= -105.9; E_value=0.089; Accession=PF06161.2; Description=Protein of unknown function (DUF975)
  Subcellular localization annotation: CTP_CleavageSite=10; ConfidenceScore=5.07e-01
MAKLLNVHCCTSSRPHFQVPPASLQGLVGVTILFAVPFYDRVFVPLARKITGKPTGITVLQRIGVGLFLSILNMVVSALVEAKRVGVAKESGLIDDPKAVLPISIWWLLPQYMITGISDAFTIVGLQELFYDQMPEALRSLGAAAYISIVGVGSFVGNIVIVVVEGVTSRAGEKWLGNNLNRAHLDYFYWVLAGLSAVNLCVYVWLAIVYVYKKVDEGHQTSDQQGSSHKKYKPGV

SEQ ID NO: 183975 - protein, 72 aa, Glycine max
  Coding DNA Sequence Number=SeqID_67197
  Pfam annotation: Domain name=GRP; Domain location=6-72; Score=-22.5; E_value=0.015; Accession=PF07172.2; Description=Glycine rich protein family
MTLLGASKLMSFVVLLAILLLLMPSTLGSASQPSIILGRKLFQYPGGRGYGYADGESIYKKYPGGGGYRKRP

SEQ ID NO: 183976 - protein, 931 aa, Glycine max
  Coding DNA Sequence Number=SeqID_67198
  Gene Ontology: Mol. function=protein serine/threonine kinase activity; Cellular component=integral to membrane; Biological process=protein amino acid phosphorylation
  Homolog annotation: Hit_ID=Q9SD62; Match level="QueryCoverage=96%, HitCoverage=91%, E-value=1e-177, Identity=36%"; Hit description =Receptor protein kinase-like protein
  Pfam annotation: Domain name=LRR_1; Domain location=103-125; Score =11.5; E_value=2; Accession=PF00560.23; Description=Leucine Rich Repeat
  Pfam annotation: Domain name=LRR_1; Domain location=127-149; Score =7.9; E_value=9.6; Accession=PF00560.23; Description=Leucine Rich Repeat
  Pfam annotation: Domain name=LRR_1; Domain location=151-173; Score =10.2; E_value=3.6; Accession=PF00560.23; Description=Leucine Rich Repeat
  Pfam annotation: Domain name=LRR_1; Domain location=176-198; Score =11.1; E_value=2.4; Accession=PF00560.23; Description=Leucine Rich Repeat
  Pfam annotation: Domain name=LRR_1; Domain location=200-221; Score =12.4; E_value=1.3; Accession=PF00560.23; Description=Leucine Rich Repeat
  Pfam annotation: Domain name=LRR_1; Domain location=223-248; Score =9.5; E_value=4.7; Accession=PF00560.23; Description=Leucine Rich Repeat
  Pfam annotation: Domain name=LRR_1; Domain location=253-275; Score =15.2; E_value=0.23; Accession=PF00560.23; Description=Leucine Rich Repeat
  Pfam annotation: Domain name=LRR_1; Domain location=278-300; Score =9.8; E_value=4.2; Accession=PF00560.23; Description=Leucine Rich Repeat
  Pfam annotation: Domain name=LRR_1; Domain location=302-324; Score =9.7; E_value=4.4; Accession=PF00560.23; Description=Leucine Rich Repeat
  Pfam annotation: Domain name=LRR_1; Domain location=31-53; Score =14.8; E_value=0.31; Accession=PF00560.23; Description=Leucine Rich Repeat
  Pfam annotation: Domain name=LRR_1; Domain location=326-348; Score =4.5; E_value=41; Accession=PF00560.23; Description=Leucine Rich Repeat
  Pfam annotation: Domain name=LRR_1; Domain location=350-372; Score =6.4; E_value=18; Accession=PF00560.23; Description=Leucine Rich Repeat
  Pfam annotation: Domain name=LRR_1; Domain location=374-396; Score =6.7; E_value=16; Accession=PF00560.23; Description=Leucine Rich Repeat
  Pfam annotation: Domain name=LRR_1; Domain location=398-420; Score =10.7; E_value=2.8; Accession=PF00560.23; Description=Leucine Rich Repeat
  Pfam annotation: Domain name=LRR_1; Domain location=422-444; Score =14.1; E_value=0.53; Accession=PF00560.23; Description=Leucine Rich Repeat
  Pfam annotation: Domain name=LRR_1; Domain location=446-468; Score =11.4; E_value=2.1; Accession=PF00560.23; Description=Leucine Rich Repeat
  Pfam annotation: Domain name=LRR_1; Domain location=470-492; Score =21.6; E_value=0.0029; Accession=PF00560.23; Description=Leucine Rich Repeat
  Pfam annotation: Domain name=LRR_1; Domain location=494-516; Score =7.4; E_value=12; Accession=PF00560.23; Description=Leucine Rich Repeat
  Pfam annotation: Domain name=LRR_1; Domain location=517-540; Score =9.2; E_value=5.3; Accession=PF00560.23; Description=Leucine Rich Repeat
  Pfam annotation: Domain name=LRR_1; Domain location=55-77; Score=3.0; E_value=79; Accession=PF00560.23; Description=Leucine Rich Repeat
  Pfam annotation: Domain name=LRR_1; Domain location=79-101; Score =17.2; E_value=0.058; Accession=PF00560.23; Description=Leucine Rich Repeat
  Pfam annotation: Domain name=Pkinase; Domain location=614-921; Score =90.3; E_value=6e-24; Accession=PF00069.15; Description=Protein kinase domain
  Pfam annotation: Domain name=Pkinase_Tyr; Domain location=614-859; Score=43.9; E_value=3.7e-15; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain ...
  Pfam module annotation: Pfam domain module=location=103-125::127 -149::151-173::176-198::200-221::223-248::253-275::278-300::302 -324::31-53::326-348::350-372::374-396::398-420::422-444::446 -468::470-492::494-516::517-540:...
  Pfam module annotation: =:55-77::79-101::614-921::614-859
MLCLGGLQIPITAPGLGLSGKLPPLLSNLTYLHSLDLSNNYFHGQIPLEFGHLSLLSVIKLPSNNLRGTLSPQLGHLHRLQILDFSVNNLTGKIPPSFGNLSSLKNLSLARNGLGGEIPTQLGKLQNLLSLQLSENNFFGEFPTSIFNISSLVFLSVTSNNLSGKLPLNFGHTLPNLKDLILASNRFEGVIPDSISNASHLQCIDLAHNNFHGPIPIFNNLKNLTHLILGNNFFSSTTSLNFQFFDSLANSTQLQILMINDNHLAGELPSSFANLSGNLQQLCVANNLLTGTLPEGMEKFQNLISLSFENNAFFGELPSEIGALHILQQIAIYNNSLSGEIPDIFGNFTNLYILAMGYNQFSGRIHPSIGQCKRLIELDLGMNRLGGTIPREIFKLSGLTTLYLEGNSLHGSLPHEVKILTQLETMVISGNQLSGNIPKEIENCSSLKRLVMASNKFNGSIPTNLGNLESLETLDLSSNNLTGPIPQSLEKLDYIQTLNLSFNHLEGEVPMKGVFMNLTKFDLQGNNQLCSLNMEIVQNLGVLMCVVGKKKRKILLPIILAVVGTTALFISMLLVFWTINNKRKERKTTVSLTPLRGLPQNISYADILMATNNFAAENLIGKGGFGSVYKGVFSFSTGETATLAVKILDLQQSKASQSFNAECEAWKNVRHRNLVKVITSCSSLDYKGEEFKALVMQFMLNGNLDVNLYPEDVESGSSLTLLQRLNIAIDVASAMDYLHHDCDPPVVHCDLKPANVLLDEYMVAHVADFGLARFLYQNTSEMQSSTLGLKGSIGYIAPEYGLGGKASTQGDVYSFGILLLEMFIAKRPTDEIFKEGLSLSKFVSAMDENQVLKVADRRLIDDYAYSTQSSSTGDHSSSFCGNTNWTHKAEECIAGVIRVGLCCTVHQPKDRWSMREASTKLHAIKHSMLSL

SEQ ID NO: 183977 - protein, 44 aa, Glycine max
  Coding DNA Sequence Number=SeqID_67199
MSNIITPRETPYYGDTITAKALNVSNTNRWILFLIGQRKPNPQS

SEQ ID NO: 183978 - protein, 83 aa, Glycine max
  Coding DNA Sequence Number=SeqID_67200
  Subcellular localization annotation: CTP_CleavageSite=41; ConfidenceScore=5.09e-01
MAVGSSAGKDFKEMLSSSHNHSFVNMDVYTTKTSQVYFIKRAMLRANFPKAEAIRWNSMNGFISLTRNSRMGIVLHKFFSDIK

SEQ ID NO: 183979 - protein, 66 aa, Glycine max
  Coding DNA Sequence Number=SeqID_67201
MEIVFPLWHSKGGANVKKGTKGLGREGEVKVWEQVEKGMSWEGEGRVFRTLEGDTRERDARKVGCR

SEQ ID NO: 183980 - protein, 177 aa, Glycine max
  Coding DNA Sequence Number=SeqID_67202
  Gene Ontology: Mol. function=protein kinase activity; Cellular component=integral to membrane; Biological process=protein amino acid phosphorylation
  Homolog annotation: Hit_ID=Q2R440; Match level="QueryCoverage=42%, HitCoverage=7%, E-value=4e-23, Identity=60%"; Hit description =Leucine Rich Repeat family protein
  Pfam annotation: Domain name=LRR_1; Domain location=42-64; Score =21.4; E_value=0.0033; Accession=PF00560.23; Description=Leucine Rich Repeat
  Pfam annotation: Domain name=LRR_1; Domain location=66-89; Score=9.5; E_value=4.7; Accession=PF00560.23; Description=Leucine Rich Repeat
  Pfam annotation: Domain name=Pkinase_Tyr; Domain location=12-176; Score=-170.6; E_value=0.052; Accession=PF07714.7; Description =Protein tyrosine kinase
  Pfam module annotation: Pfam domain module=LRR_1::LRR_1::Pkinase_Tyr; Domain location=42-64::66-89::12-176
MSFAALLAILLLLMSFELGSAAQPSIKLARRHLRFNGSIPTKLETLDLSSNNLTGPIPQSLEKLEFIQTLSLSFNHLEGEVPMKGFFMNLIKYEELRSCLTPLQRLNVVIDVASALDYLHHDCDPPVVHCDLKPSNVLLDENMVAHVADFGLARLLSQTTSEMQSSTLGLKGSIGLY

SEQ ID NO: 183981 - protein, 302 aa, Glycine max
  Coding DNA Sequence Number=SeqID_67203
  Gene Ontology: Mol. function=nucleic acid binding; Cellular component= ribonucleoprotein complex
  Homolog annotation: Hit_ID=Q5N8W4; Match level="QueryCoverage=55%, HitCoverage=58%, E-value=8e-42, Identity=53%"; Hit description =Putative RRM-containing protein SEB-4
  Pfam annotation: Domain name=RRM_1; Domain location=91-161; Score =66.6; E_value=8e-17; Accession=PF00076.12; Description=RNA recognition motif. (a.k.a. RRM, R
MHHPKHKKQKGNKIEWITRNGNEMNIMFGVGVDSQCIFSFSAWSKRPIWHLHIIPRGRSNGINKVSHPRQQNKMMSPNLAKQVGDTTYTKIFVGGLAWETKRDTLKRYFDQFGEILEAVVITDRITGRSKGYGFVIFRDPNSAIRACHNPYPVIDGRRANCNLAALGAQKFDPSITTGRQKFSSPSWNMAPIPLQGTSTHYNQHIPHYPFPHPVYRYPGYPHPQDLYEMNYNNAYGGQQLPLCWFPAYCQPFYGLSRQFIPTAYVKKAQTPDVSPQEFTVVGFSEPISASPSICSTGSASKL

SEQ ID NO: 183982 - protein, 140 aa, Glycine max
  Coding DNA Sequence Number=SeqID_67204
  Gene Ontology: Mol. function=metal ion binding; Cellular component =integral to membrane; Biological process=ubiquitin cycle
  Homolog annotation: Hit_ID=Q5EAE9; Match level="QueryCoverage=60%, HitCoverage=21%, E-value=2e-29, Identity=69%"; Hit description=RING -H2 finger protein ATL5C precursor
  Pfam annotation: Domain name=zf-C3HC4; Domain location=44-85; Score =9.9; E_value=0.015; Accession=PF00097.15; Description=Zinc finger, C3HC4 type (RING finger)
IVVVMWTVALFARRKNSSIDRSVVESLSIFNFRALRGQKERLDCVVCLNKFEVVEVLRLLPKIKHVFHVECVDTWLDTHSMSPLCHCRMDPEDILLVEDAKPFRQEVGDSGVTTKAFVCYGGGRRKNGGAATESEVDDVV

SEQ ID NO: 183983 - protein, 386 aa, Glycine max
  Coding DNA Sequence Number=SeqID_67205
  Gene Ontology: Mol. function=nucleic acid binding
  Homolog annotation: Hit_ID=Q38915; Match level="QueryCoverage=66%, HitCoverage=88%, E-value=2e-88, Identity=57%"; Hit description=RNA -binding protein
  Pfam annotation: Domain name=PAM2; Domain location=111-128; Score =25.6; E_value=0.00017; Accession=PF07145.5; Description=Ataxin-2 C -terminal region
  Pfam annotation: Domain name=RRM_1; Domain location=195-263; Score =63.3; E_value=7.9e-16; Accession=PF00076.12; Description=RNA recognition motif. (a.k.a. RRM, R
  Pfam annotation: Domain name=RRM_1; Domain location=292-363; Score =15.3; E_value=0.0055; Accession=PF00076.12; Description=RNA recognition motif. (a.k.a. RRM, R
  Pfam module annotation: Pfam domain module=PAM2::RRM_1::RRM_1; Domain location=111-128::195-263::292-363
MAVAENVGAKIGSSSQNLENSVVSSDSGEVEKSKPRSGSINDDQKLNNGVFNHQDRVPGTMPVPNSNYNYNAQMGQMHANGVNNDGYGMNGVMSGENEGESFKRDMRDLEELLSKLNPMAEEFVPPSLSNTHGYLAGPGAGAGFGYPNNFILLNNFGNANGQTNRRRKNGYNQGKRRVNHKMDMEKREEMTRRTVYVSDIDQLVTEEQLAALFLNCGQVVDCRVCGDPNSILRFAFIEFTDEEGARAALNLSGTMLGYYPLRVLPSKTAIAPVNPTFLPRSEDEREMCSRTIYCTNIDKKLTQADVKHFFESICGEVQRLRLLGDYHHSTRIAFVEFTVHYLSVCEVITLAPENFFNLFVILVGALVSINAFVVITPHYLLKLSFS

SEQ ID NO: 183984 - protein, 223 aa, Glycine max
  Coding DNA Sequence Number=SeqID_67206
MAEQAEQVFHVQDSCDERRLVVLHGKIVGVNVEDDDSIVDTYLSPFSTQMSRNVNREEEVEDVHANCNDHDEGELINIKIKATRLKSLATRPVGEERPVAEFDIPEASNLRTKKKILQTVGERWRQFKSDLISKWALVDGKEGEDDRVCEKMFERRRGPFRNKTLPNHGGYDYLKEKFMEDKKKKRLEEASQSESTDIIIDPSSPIRRHMKWKMTHTKKFSQW

SEQ ID NO: 183985 - protein, 298 aa, Glycine max
  Coding DNA Sequence Number=SeqID_67207
  Homolog annotation: Hit_ID=Q9SJH8; Match level="QueryCoverage=36%, HitCoverage=36%, E-value=1e-22, Identity=47%"; Hit description =Expressed protein
  Pfam annotation: Domain name=Elongin_A; Domain location=16-133; Score= -16.2; E_value=0.0066; Accession=PF06881.2; Description=RNA polymerase II transcription factor SIII
MMRRDQIRAHKRPTPTLVDLCVQKVIHNVRYLGNVGSFDQHLLEQILPHCTADQLMHVEKSTKGRDLSPVTDKLWKKFFEKQFGTNSTDEVIKRMKEKRVSFRWMQLFEAGMLEVVSNPWRFTAGNWLCDSDLVSPTGIERVLTEKDLLADSYSDLEASILDEKEFLLLKVISTFPKTLDAQVFMTLYWILYIKAAGIDPSFMSVSESSSDSEAISAQVFLANFVDDSDLTVVVWVKDPSCFPFWVDDPVWVGDPEDVVVAFLVIGSGRASRTSLPFVLDLPPLPEELDTLGGIGNFL

SEQ ID NO: 183986 - protein, 210 aa, Glycine max
  Coding DNA Sequence Number=SeqID_67208
MFAPQQEERVVVLGQWMLQTYDWRQKQIPRPLEEKDGGSVAFGDNRKSLIKRATFETDKWLWHKRVGCNTLTNHTGMRGIQRLCSRTNAWLANNGQPLDMLTFSGCTQVVTVMSYYVILVEQAEREVELEHKAVESSTALARIQVIDQVGWSIFGLLWVGHIAFGILVGTMTKITLIDQALGMNVVRMADKPEYNVKFLLAYIFALAGTF

SEQ ID NO: 183987 - protein, 56 aa, Glycine max
  Coding DNA Sequence Number=SeqID_67209
MSIGLVYLLKKCFKTKFRLLKNANKAKLKVVTTLTRFICNFPQIKDHNETAIVTAI

SEQ ID NO: 183988 - protein, 265 aa, Glycine max
  Coding DNA Sequence Number=SeqID_67210
  Gene Ontology: Mol. function=nucleic acid binding; Cellular component= nucleus; Biological process=mRNA processing
  Homolog annotation: Hit_ID=Q9CA06; Match level="QueryCoverage=64%, HitCoverage=57%, E-value=8e-66, Identity=70%"; Hit description =Putative splicing factor; 53460-55514
  Pfam annotation: Domain name=RRM_1; Domain location=119-190; Score =42.5; E_value=1.5e-09; Accession=PF00076.12; Description=RNA recognition motif. (a.k.a. RRM, R
  Pfam annotation: Domain name=RRM_1; Domain location=18-72; Score =20.7; E_value=0.0018; Accession=PF00076.12; Description=RNA recognition motif. (a.k.a. RRM, R
  Pfam module annotation: Pfam domain module=RRM_1::RRM_1; Domain location=119-190::18-72
MELVEHGSPQGLLSCCVAMISSLQYGRIMDIELKVPPRPPCYCFVEFDNARDAEDAIRGRDGYNFDGCRLRVELAHGGRGPSSSDRRGYGGGGGGGGGGGGSGAGGGRFGISRHSEFRVIVRGLPSSASWQDLKDHMRKAGDVCFAEVSRDSEGTFGIVDYTNYDDMKYAIRKLDDTEFRNPWARAYIRVRKYESSRSRSHSRSPSRSRSPKRVRSRSLERSVSRSRSRSRSVSPIKSSRPRSRSRSGSPRQVVVEFLKKPVVLW

SEQ ID NO: 183989 - protein, 59 aa, Glycine max
  Coding DNA Sequence Number=SeqID_67211
MVWHCCHSSRRKRRCRRHPRQTLKDKVERGRKMDQIQKTYSQKILLPKYTVDTERGSSE

SEQ ID NO: 183990 - protein, 74 aa, Glycine max
  Coding DNA Sequence Number=SeqID_67212
MVAWPGTQPSLHREDEGPTAQHAADPSTPLLEMPEDPTTAVLAMDISPPATPVLHLIDEEDVQTQDTQDQSQEF

SEQ ID NO: 183991 - protein, 203 aa, Glycine max
  Coding DNA Sequence Number=SeqID_67213
MELLNIGFSKTDVNYFIFHKSHALENLALPLLFVILLPEIALLFLLPPEISQKPLPRHPHCPHSNPQNPLHCRKNYIVLARTHRTPYTVGKPTLSSLEPTEPPTLFLEVWLEENPTYTVATRVLKHSWVLKAQSFLREVLLLIEVRGKLKVSCHFVRSHCHCHCLGSRLLGAPVEITSDKDPVIVHNKLLTLLEIILEFGALV

SEQ ID NO: 183992 - protein, 380 aa, Glycine max
  Coding DNA Sequence Number=SeqID_67214
  Homolog annotation: Hit_ID=Q4UQS3; Match level="QueryCoverage=19%, HitCoverage=27%, E-value=4e-24, Identity=71%"; Hit description =Glycosyl transferase
PSHGLCESGHALVVGGGKAGIVRIADETHARVVAGMALHDIQRAIHRAIVDHPDLGHVLRLAQAREAGIDGAAALVGDDDGGNGNIQAGGSGAEDGTNSQPRHPARPARGQGLEIAIAADRLPCPADEGGLAQHVAPSQAGHAQAQVHQRRVPAGIAVHVQAPGTPTRVAPHQHRVGDRRRQLRVQRWQAGTGLRQQRGIVGFRIDLAQPGPRSGFAGIAPWGCGRDGGIAGEGVLQLLQPARCGHAVRCQHRHVHAIAGAQHLVQVGDFTQWPCTPGVLGLQWRVRQPVFHHRLRTRPGLRVVGQPDRGPRRGARIQCGQAAVERGIVHAQRQQHDRPHPASVVVGSHRLALGGYRPGCTRHPPQARATATAEAKLGSW

SEQ ID NO: 183993 - protein, 74 aa, Glycine max
  Coding DNA Sequence Number=SeqID_67215
MNCRNAACLAIYTPLAAAPFPLERQGEAFESGGSHRQIANVAETQVAGAVSYAVFVQVGYRRCRRHRRPGLLGH

SEQ ID NO: 183994 - protein, 63 aa, Glycine max
  Coding DNA Sequence Number=SeqID_67216
MDLVQTMADDANVEREGAGGGEGSLEKQFKVCGGENNNFLTLSPPYTKVTWIILSHHIPKCLI

SEQ ID NO: 183995 - protein, 97 aa, Glycine max
  Coding DNA Sequence Number=SeqID_67217
GGEEGGEEGGGVGGEVAEEVEGEGDWEREGEEGIGGEVERVGEGGFDGGREGEEGVVRGLRIDSGLEERQHREGGGGGGGGGGHGRVQLRVECHGSI

SEQ ID NO: 183996 - protein, 89 aa, Glycine max
  Coding DNA Sequence Number=SeqID_67218
  Subcellular localization annotation: CTP_CleavageSite=63; ConfidenceScore=5.31e-01
MEDYPLTFIGFLGTLLLMFVVTGTAQRPGGFGRCWPSTVSFNRMMITFTNGCNDTAQARQALCAEQLAERFGDPRTWRFLKIRSEHLGT

SEQ ID NO: 183997 - protein, 199 aa, Glycine max
  Coding DNA Sequence Number=SeqID_67219
MSIVSHPLEPGQSSVVHIERSNDKSFLLWSTVVLKKIGDLKDPTQGGLRLVVRGDEEAHRFWGHGLQGFSKGKLMGSEFEDNILEGWFRKPAPPEEMKKEKYQNWLCLSPLYDQHHSSKIFCTSSYVILKLDPEPEQRDLVHLAVINSISNLNNTLRSVWFVATVHGGGNCIIVCGGGVFGVIVLEVDESVLVFGFRRE

SEQ ID NO: 183998 - protein, 50 aa, Glycine max
  Coding DNA Sequence Number=SeqID_67220
MPDVVNQSIEILASGGPGMATSSLGICKIDHRTSRIIVILLGMLMALSYG

SEQ ID NO: 183999 - protein, 53 aa, Glycine max
  Coding DNA Sequence Number=SeqID_67221
  Homolog annotation: Hit_ID=Q9LHA3; Match level="QueryCoverage=83%, HitCoverage=10%, E-value=2e-07, Identity=47%"; Hit description =Arabidopsis thaliana genomic DNA, chromosome 3, BAC clone: T19N8
KDAARRNVLLTSLNYSITSAIDRWNLFKYKLNKAMSALSHLDFEIGSVLLAVF

SEQ ID NO: 184000 - protein, 306 aa, Glycine max
  Coding DNA Sequence Number=SeqID_67222
  Gene Ontology: Mol. function=chromatin binding; Cellular component =chromatin; Biological process=chromatin assembly or disassembly
  Homolog annotation: Hit_ID=Q1SAV4; Match level="QueryCoverage=87%, HitCoverage=92%, E-value=5e-58, Identity=37%"; Hit description =Integrase, catalytic region
  Pfam annotation: Domain name=rve; Domain location=10-161; Score=22.4; E_value=8.1e-05; Accession=PF00665.16; Description=Integrase core domain
MAGLLCPLPVPHRPWEDLSLDFIMGLPLYHGNSVILVVVDRFSKGIHLGMLPSSHTAHTVASLFMDNVGKIHGLPRSLVSDRDPLLSDGQTEVMNRIIEQYLRALQAANVGQATPLGHVERQRGNLPRHLKKLLKAQTAIKHFADTRRHEVSYQTGDWVLLKLRPHRQLSAKGPQEMQGKLAKRFYGPFRVVKRIGPVAYRLQLLDNARIHPVVHCSVLKPFRGSLELDEAIQLSSNFFQDQPGLSPDDTSWEDWDKLQKDYHLEDKVILQGLKGDSAVKEQVTEIGALVDISKAKRVSKNTCYRG

SEQ ID NO: 184001 - protein, 436 aa, Glycine max
  Coding DNA Sequence Number=SeqID_67223
  Gene Ontology: Mol. function=RNA-directed DNA polymerase activity; Cellular component=chromatin; Biological process=chromatin assembly or disassembly
  Pfam annotation: Domain name=RVP_2; Domain location=139-270; Score= -53.2; E_value=0.014; Accession=PF08284.2; Description=Retroviral aspartyl protease
MAQYLSDFEDLANRIIGLLPPFLLSYFVSGLTPKIRCEEKKLLDGCQVPRGRTSQPIPPPPLLPLPSRPSPPSLKRLSLEEIASQRERELCFNYDEKYHRGHRCASRVFLLITEDEDPSLSNIEASDPPLDPPDTVDPYPTQISFNSLAGNVAPETLHFLGLISDHQVVLLVDGGSTHNFIQHQLVTQLGLSPRATTPLRVMVGNGQQLECNCLCEAITVDIQDTKFTVDLHVLPISGANVVLSVQWLKSLGPILTDYNSLCMKFFHEGHLIELKGDNESTLNSLFLPQFRRFFRKQQDNMYFHIAVLSDDHSDGTSKDIPPTVQAFLNKFNSLFQAPHKLPSERDTNHHIHLLPNTTPVNVRPYRYPHYQKQEIESQVESMLQKGLIQPITSPFSSPVLLVKKQDGLWRLCGLSCLECTHDQGQIPHSHHRRTLG

SEQ ID NO: 184002 - protein, 351 aa, Glycine max
  Coding DNA Sequence Number=SeqID_67224
  Gene Ontology: Mol. function=glutamyl-tRNA(Gln) amidotransferase activity; Cellular component=cytoplasm; Biological process =translation
  Homolog annotation: Hit_ID=Q9FVA6; Match level="QueryCoverage=99%, HitCoverage=55%, E-value=1e-117, Identity=64%"; Hit description=Glu -tRNA(Gln) amidotransferase subunit A
  Pfam annotation: Domain name=Amidase; Domain location=2-346; Score =104.2; E_value=3.9e-28; Accession=PF01425.11; Description=Amidase
  Subcellular localization annotation: CTP_CleavageSite=67; ConfidenceScore=5.54e-01
VTANPWDESRVPGGSSGGSAAAVSARQFVVSLGSDTGGSVRQPASFCGVVGLKPTYGRVSRFGLMAYASSLDAIGCFGSSVADTGILLHAIAGHDRFDATSSKQDVPDFQSHFHSVSSLESKPLKGLRVGLICETIDDGIDAGVISAIRAAALHFEELGCSVNEVSLPSFSLGLPAYYILAVSESSSNLSRYDGIRYGNQVYADELDSLYGGSRAKGFGSEVIRVNRWQCWWLALTWSIWQHRNSILFSNAVFNGNKVKMRILMGTYSLSAGYYDAYYKRAQQVRTIIRNSFKEALNQNDILISPAAPSAAYKIVPAVLIVSLPLAFAGEKKNSPLAMYAGDIMTVSISFF

SEQ ID NO: 184003 - protein, 67 aa, Glycine max
  Coding DNA Sequence Number=SeqID_67225
MHFSNGGACLIKFDLTASKVIVTGEVKEGVSLAREVQEARNERPRREQLTPAYLEGYDRSHAEWRNA

SEQ ID NO: 184004 - protein, 1399 aa, Glycine max
  Coding DNA Sequence Number=SeqID_67226
  Gene Ontology: Mol. function=RNA-directed DNA polymerase activity; Cellular component=chromatin; Biological process=chromatin assembly or disassembly
  Pfam annotation: Domain name=Chromo; Domain location=1251-1302; Score= 24.4; E_value=0.00041; Accession=PF00385.14; Description='chromo' (CHRromatin Organisation MOdifier
  Pfam annotation: Domain name=RVP_2; Domain location=290-408; Score= -60.6; E_value=0.052; Accession=PF08284.2; Description=Retroviral aspartyl protease
  Pfam annotation: Domain name=RnaseH; Domain location=790-911; Score= -25.0; E_value=0.012; Accession=PF00075.14; Description=RNase H
  Pfam annotation: Domain name=zf-H2C2; Domain location=987-1028; Score= 10.3; E_value=0.015; Accession=PF09337.1; Description=His(2)-Cys(2) zinc finger
  Pfam module annotation: Pfam domain module=Chromo::RVP_2::RVT _1::Retrotrans_gag::RnaseH::zf-H2C2; Domain location=1251-1302::290 -408::532-701::105-195::790-911::987-1028
MADGTRSKASSERLEDAIAKLIASQLAMNSKIDDLLQRMSQLEANQPQPQSPSSSSAGHTPQTQTSFHRMKLDVPRFDGSDPTGWTFKITQFFEFHSTPDHERLTIASFYMEGPALAWFQWMHRNAQLSSWSAFLHAFHSRFATSTYEDPTGLLCKLQQRSSVSAYLSEFKFLANRIVGLPAPFVLSCFILGLNPTIHREVQVLQSISLAQAVSYARLQEEKLLDAHRPPPYRPLVSTGPSSTRSSSNNSTQPLLPTPVRTSSSIPFKRLTPEELASRREKGLCFHCDEKFSRGHKCASSLFLLVMDDEDITIEALIISSIIGVVLSLGLKTTETTPLRVTVGNGEEIHCNQLCTAIQVNIQQHSFTIDFHALPLCGVDVVLGVQWLKTLGPVLTDYGALTMKFITGGKLIELHGDREKGIEPVSPSQLRRFVHTNPTTTFFHIRVEIATTHNSSPNHPLSAINTLISKYASLFQPPTTLSPSQSTNHTINLLPNSTLVNVRPYRYPYFQKKEIEEHVAIMLEKGFIQPSSSPFSSPVLLVRKKDGSWRFCIDYRALNAITVRDRFPIPTVDELLDELGGAKWFSKLDLMQGYHQILMNTADICKTAFRTHQGHYEFRVMPFGLCNAPSSFQATMNQLFQPYLRKYIIVFFDDILIYSRTMHDHLLHLEKAFQVLVEGKFSLKLSKCTFAQEQLEYLGHIVSSSGVTPVPEKVQAVSRWPTPRTPRALGGFLGLAGFYRRFIKGYAALASSLTKLLCHGQFEWSHEAEIAFQNLKKALTEAPVLALPNFTTSFVVETDASGSGMGAVLTQKGHPLAYYSKQLCPKLINASTYVRELTAITTAVKKWRQYLLGHHFVILTDHQSLRELMNQTIQTPEQHRYLARLLGFDYSIQYRAGKTNVVADALSKSQEDYTASLFFLSMPRFVFLDDLHKELASLDTFQDLRRRIQENPTSYPDYALTEGLIMYKKRIWLPSNSSFIKQLLEEFHQSPIGGHMGIQKTLQRLHDNFTWASIKEDTRKFVTACATCQHTKYDNCKPVGLLCPLPMPTLPWEDLSMDFITGLPSYHGNTCIFVMVDRFSKGLHLALHTEWYEVALKLIISSAVRRTNGGRKPHYRAIFESFRALKTSNREEVFAMLHRKLLKDQSQMKTNADRHRRDQEFQVGDWVLVKLRPQRQVSVTGTTCSKLSKRYYGLFQIVERMGTVAYRLQLPEHSRIHPVFHVSLLKSYTANPTTATTVMDLPPLASDNHPIITPLAIVASKVIPSETGPMHMVLVQWQGLPPEETSWEDWASLKRTHHLEDKVLLDGQGSVMGEVREGVSLAREPCRMEERVKLLEGIASTIKALEGIDTFWKNDVILEFHVDDTTGANEMTENKNVGCLAVEVLSKVAGIELINSTSTI

SEQ ID NO: 184005 - protein, 78 aa, Glycine max
  Coding DNA Sequence Number=SeqID_67227
MSVDDRLYEEKMRQRKCIIEHDFSVVGHDTTFIQDKLCGRAQLPFADCGVVCGLQQLMKNLKLEESLQVANTPTREAP

SEQ ID NO: 184006 - protein, 1142 aa, Glycine max
  Coding DNA Sequence Number=SeqID_67228
  Gene Ontology: Mol. function=RNA-directed DNA polymerase activity; Cellular component=chromatin; Biological process=chromatin assembly or disassembly
  Pfam annotation: Domain name=zf-H2C2; Domain location=783-824; Score =9.7; E_value=0.019; Accession=PF09337.1; Description=His(2)-Cys(2) zinc finger
  Pfam module annotation: Pfam domain module=RVT_1::zf-H2C2; Domain location=328-497::783-824
MVNQPLTVAQAAGLARLHEEKLRNFHFDFRQNPRPRTPQLLPLAPPQPPLVTPFASPRVSSLPPLLPLPSCPTPPPPPTVRRLTPEELASRRERGLCFSCYEKFHKGHRCAPRVHLLIADEDDPLEHVGSNIDPPDPNNPIPDLSELPDTPAHISLNSLAGHLAPETLRLVGHISGNPVLVLIDGGSTHNFIQEQLVAQLGLPCRPTTPLKVMVGNGQMVELQGDPEAQRGLLSSPQFRRVCRNQPNSICFHIMVLPEEPEPVLTTIVDPQDPTTLLPARDTDHQIHLRPDATLVNVRPYKYPYYQKREIETQVETMLQRGIIQPSKSPFSSPVLLVKKSDNTWRFCVDYRALNALTIKDRFPILTIDELLDELGGASCFSKLDLLQGYHQIRMQPDGIPKTAFRTHHGHFEFKVMPFGLCNAPSSFQATMNNLLRPYLRRFIIVFFDDILIYIVSISDHLRHLQTTFQVLYENHFILKLSMCLFAQPQVEYLGHLISHRGVKPVASKIAAIAQWPTPRSVRALRSFLGLTGFYRRFIRGYATIAAPLVKETTMEPLQWTPSTQTAFEALKQALTSAPVLALPDFRLPFTVETDASAIGMGAVLSQQGHPIAFFSKPFSQKMLRASTYVRELFAITTAVKKWRQYLLGHSFTILTDHQSLKELMTQVVQTLEQHTYLVRLMGYDYHIQYRLGSHNQAANALSRLLEGAPQAFLILSVPCLTFLDELHDQLRTNSTFQQLMLDVQNHPDRHPEFSIANKLLLYKGCIWLPQGLPIFTTLLTEYHATPTGGHAGVAKTVARLMTNFYWPGLRDDLSCFVAHCVDCQVTKYETKKIAGLLCPLPVPSQPWYDLSLDFITGLPSCRGNTMILVVVDRFSKGIHLGMLPQSHSALTVARLFLEMVVKIHAMPRSLGRGTILACVCSPETHELGEIASMGGMVHNTSWMANIGTTPYEITFGRRPFNFPDYLAGSSKVDAVDDLLTERDMTFQLIHKKLLKAQSKMKLYADQHRRDVQFTPGDWVLVRLRPYHQSSAKGQHTTNAKLARRYYGPFQVATKIGPVAYRLDFPEGVRIHPVFHCSNLKPFRGEPESISPTPLPPTFHENQPLIAPLAILGSRRATSDPHSPRQVLVKWQGLPPEETSWED

SEQ ID NO: 184007 - protein, 45 aa, Glycine max
  Coding DNA Sequence Number=SeqID_67229
MGMHVSDFSEKGSKWRQEQIAGESSQQPLKLAGDMGCNCNLTDHK

SEQ ID NO: 184008 - protein, 67 aa, Glycine max
  Coding DNA Sequence Number=SeqID_67230
  Gene Ontology: Mol. function=nucleoside-triphosphatase activity; Cellular component=protein complex; Biological process=protein catabolic process
  Homolog annotation: Hit_ID=Q8W1R5; Match level="QueryCoverage=58%, HitCoverage=8%, E-value=9e-14, Identity=97%"; Hit description=26S proteasome regulatory subunit IV
  Subcellular localization annotation: CTP_CleavageSite=52; ConfidenceScore=5.37e-01
MATSYCDSYSNPAIKAFNLIGKKLTMTMPGRNKAGSRLSILLVARITLTSPLQSKPSNWFNNSNIVL

SEQ ID NO: 184009 - protein, 581 aa, Glycine max
  Coding DNA Sequence Number=SeqID_67231
  Gene Ontology: Mol. function=kinase activity; Cellular component =mitochondrion; Biological process=protein amino acid phosphorylation
  Homolog annotation: Hit_ID=Q2HTV1; Match level="QueryCoverage=81%, HitCoverage=74%, E-value=0.0, Identity=67%"; Hit description=Protein kinase-like
  Pfam annotation: Domain name=ABC1; Domain location=235-361; Score =140.0; E_value=6.4e-39; Accession=PF03109.7; Description=ABC1 family
MYTCAGFLLVETLEGLHVLFTRQAAWKYFIQWGPHTQDTIFSRTIDMYTKNNFYSCYLNQRMCFHKGPALPPVGQIAHVVTLALVKSNFVVHGVIAFIIGEFAWTQRKWAETESFPTRDSLYVHAQDGRVYLTAALLAVIEIFVLFLRAVYLVILFSPCIAMAPLVDFFGTQFRKTWIHVVRVTLEKAGPAFIKWGQWAATRPDLFPRDLCDELAEFQTKAPSHKFSYSRKCIENAFGQKLSEIFENFEEEPIASGSIAQVHRATLKYKFPGQRIKPVVVAVKVRHPGVSEAIKRDFILINLVAKISSLFPNLKWLRLDESVQQFAVFMMSQVDLSREAAHLSRFIYNFRRWKDVSFPMPLYPLVHPSVLVETFEQGESVLHYVDQPEGHEHFKSALAHIGTHALLKMLLIYLFFQVDNFIHADMHPGNILVRVGKRKSTPIPLLKSRPHVIFLDVGMTTELSKRERGYLVEFFKAIALQDGRTAAECTLRLSKRQNCPDPKFFIEEVDKSFEFWRSPEGESVHTADRMQQLLEHVRRCKVNIDGNVCAVIVTTLVLEVESVVEMWNTCLEMHNFSPPPEV

SEQ ID NO: 184010 - protein, 95 aa, Glycine max
  Coding DNA Sequence Number=SeqID_67232
  Gene Ontology: Mol. function=glutamyl-tRNA(Gln) amidotransferase activity; Biological process=translation
  Homolog annotation: Hit_ID=Q9FVA6; Match level="QueryCoverage=99%, HitCoverage=21%, E-value=7e-13, Identity=53%"; Hit description=Glu -tRNA(Gln) amidotransferase subunit A
  Subcellular localization annotation: CTP_CleavageSite=53; ConfidenceScore=5.74e-01
MLSLTPTSTPAKGPGSSPAAIWASRRRAWERRTSSSGRWGSVRRRRARWERTRSAAEARRERRTWRMDRISDCGGGEGVREAREAREGARGLKCG

SEQ ID NO: 184011 - protein, 260 aa, Glycine max
  Coding DNA Sequence Number=SeqID_67233
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=76%, HitCoverage=72%, E-value=8e-98, Identity=87%"; Hit description =Mitochrondrial voltage-dependent anion-selective channel
  Pfam annotation: Domain name=Porin_3; Domain location=25-253; Score =231.7; E_value=1.6e-66; Accession=PF01459.12; Description=Eukaryotic porin
MGIFEGFHWYYAWCLIFAQCQPKSSYASCHYVNLLLCSLIYTDLFYCMNFTKVDNAFALQLFTTITVNEPAPGLKTIFSFRVPDQRSGKVEVQYLHDYAGISTSVGLTANPIVNFSGVVGTNVLALGTDVSFDTKIGELTKFNAGLNFTKDDLVASLTVNNKGDSLNASYYHTVNRLTNTAVGAEVTHQFSTNENTLTLGTQHALDPLTTVKARVNNLGKANALIQHEWRPRSFFTISGEVDTKAIEKSAKVGLGLALKP

SEQ ID NO: 184012 - protein, 123 aa, Glycine max
  Coding DNA Sequence Number=SeqID_67234
MGRLWKQSFQAYFDDAKDSSQESRFKQVSRIKESFKSRIKIQKKLFKRPTLGDCFQEKRFIVRFWLTNQCHCHKPPVSLFAPGRSQIATHKVLILMGNGSTHNFIQKKVALKLDLSTNPTQAL

SEQ ID NO: 184013 - protein, 165 aa, Glycine max
  Coding DNA Sequence Number=SeqID_67235
MGDLLKMKDIFKRWTEYLDNTQSRVNNLLPVNCVFCGGEHVNDDYHLYSIKNSWWEQELLPYNQYEEERTPTLESVLTEFTTYHPSSTANQNPMQNLEIQVGKSYSMENYQWEQELQPYNQYEEEKISHNTYLEELGVRHHHTINSFFKKSTCKTKKQFPMEVMD

SEQ ID NO: 184014 - protein, 122 aa, Glycine max
  Coding DNA Sequence Number=SeqID_67236
MERFNGGIFGKPSEEDFAALKMENGKKNTREKNEETEKGLLFVLASINKDLANLLLGARNIAFMAIDLAKIAHIDNLRALLRKIIEGGEISHSGRGGAIDGGLKCHGCDVPKVLSVVLNNNT

SEQ ID NO: 184015 - protein, 269 aa, Glycine max
  Coding DNA Sequence Number=SeqID_67237
  Gene Ontology: Mol. function=RNA-directed DNA polymerase activity; Cellular component=chromatin; Biological process=chromatin assembly or disassembly
MSKARSDQIDDAVVVKAQTTETTRPKRNVVTLRKWTDYASYKPPIHSSTSNYNTANYYHHKHFLKLDIPSFDGYDPHGWIFKITQFFDYHETPEKERITIALFYLDGVALAWYQWMHCNGKIHSWSHFLQALEMRFAPTTYNDPRGKLLKLLQTSFVASYLSELEALVNRIVVGLAKLHENKFYDLLHLSRPCLEGQHSAPTMSCAITLLPPQFSSDLSSQKQLPPLLPTLASRTRYKRLFSEEIAKHREKGLCYGCDQKWLKSHHCST

SEQ ID NO: 184016 - protein, 134 aa, Glycine max
  Coding DNA Sequence Number=SeqID_67238
MADFHGGFSKKRHQIAVAWRVWDGGAMAVVAVMAGWRKMASLPHPTRAPSRVPPAPHTRTQPRHPQPHAHAAATTSGSDAPAQTAVTSSGSDASVTNGGLQRGVLAEKTKLLSRRRRRRREEEEGVGFSFIFAV

SEQ ID NO: 184017 - protein, 307 aa, Glycine max
  Coding DNA Sequence Number=SeqID_67239
  Homolog annotation: Hit_ID=Q1RU53; Match level="QueryCoverage=90%, HitCoverage=54%, E-value=3e-40, Identity=69%"; Hit description=WD40 -like
MANSNLLEYHIFLCSGSSDHTTKFWCRNRPGDPARDRFNTGMPGYADQNPVVGRMGGNFTIAEGPTTPGPFAPGLTRNEGTIPGVGVAMPLSIPSLDMPQGEQKQPHPVSMGAPPLPPGPHPSLLNANQQQPYQQNPQQIPQHQHQALPQQMGPLPMPPNMQQLQHPSHSPFPNMPRPPPQMPIGMPGSIPGISSVPTSHPMPMPGPMGMQGAMNQMGTPMPQGPYVGMNQMHSGSLPTSGGPPLGGFPGNLPNMQGPSNANYPQGASFNRPQGGQMPLMQGYSPYQVIAQKKKLNELDTTQVFKEF

SEQ ID NO: 184018 - protein, 64 aa, Glycine max
  Coding DNA Sequence Number=SeqID_67240
MDMEPPTLSSPTMQNQELHEDPVPSQIANTPPLSIGNDPLITPLTILDFKTSTTDGTPTRYALV

SEQ ID NO: 184019 - protein, 382 aa, Glycine max
  Coding DNA Sequence Number=SeqID_67241
  Homolog annotation: Hit_ID=Q2R496; Match level="QueryCoverage=24%, HitCoverage=11%, E-value=4e-09, Identity=35%"; Hit description =Expressed protein
  Pfam annotation: Domain name=PHD; Domain location=75-126; Score=15.0; E_value=0.0018; Accession=PF00628.19; Description=PHD-finger
MRRKSKGKRRRAAPATTLTSPSLSAIPILSDEHNNNAPTAFDTDCDDDNNALHHRGSEPEPEPELEPVDIFDKTICIHCDNKGEEAEGVLICGGRGCPVAVHATCLGFEPEFDDSGNFCCPYCWYKRAVDTCRRLREKAMKAKGELSRFFGQSRAGATDYSAAARVDPVVQDSEELMEETETEEQSEENKDEEGMVEESEKLVEGKETESEENKEEVEGKVQDSEELVEETETETEGQSEEKKDEEGKVAVMSSSVSETNDSESVAEAVKKRKDQKKKKVASSRKSLSRQQEHKNKHYKTRGKFANKDEEEVTSFKSISLRQQPQRMKQSSLTAKRRRLLWTAEEEKVLKVIESPFGVLEGTGEMNKKRGDISVMSVAVCVL

SEQ ID NO: 184020 - protein, 148 aa, Glycine max
  Coding DNA Sequence Number=SeqID_67242
  Gene Ontology: Mol. function=isomerase activity; Cellular component =nucleus; Biological process=carbohydrate metabolic process
  Homolog annotation: Hit_ID=Q1RU53; Match level="QueryCoverage=77%, HitCoverage=21%, E-value=9e-49, Identity=79%"; Hit description=WD40 -like
  Pfam annotation: Domain name=WD40; Domain location=32-70; Score=36.1; E_value=1.3e-07; Accession=PF00400.22; Description=WD domain, G-beta repeat
  Pfam annotation: Domain name=WD40; Domain location=81-119; Score =38.6; E_value=2.2e-08; Accession=PF00400.22; Description=WD domain, G-beta repeat
  Pfam module annotation: Pfam domain module=WD40::WD40; Domain location=32-70::81-119
MSNTNCMGKLSQFQIKWGQSIISTYFYVCSRYLVYCAKPGHGWDVKSVDWHPTKSLLVSGGKDNLVKLWDAKTGRELCSLFILVSCSHGHKNTVLCVKWNQNGNWVLTASKDQIIKLYDIRAMKELESFRGHRKDVTNAGWMFSVGCL

SEQ ID NO: 184021 - protein, 58 aa, Glycine max
  Coding DNA Sequence Number=SeqID_67243
MTSVVALPQRVRENTKNKVAFSKSGTERKKKEEILKQAQSNRGAQRASGAKRATNWRR

SEQ ID NO: 184022 - protein, 83 aa, Glycine max
  Coding DNA Sequence Number=SeqID_67244
MAISLVFIFTLTLSVFILPLKMNALEIFSCKAVSVCKCCEATPTPSTIFVGYVYFVLEVLCFKYSILDIKPGFQISISDFVNF

SEQ ID NO: 184023 - protein, 212 aa, Glycine max
  Coding DNA Sequence Number=SeqID_67245
MEEGYATSKPTLFKGVKYDYRKEMDEGVKKGKSLPLSTLKKRKTPSCKESSSRSLSKSASKALSMDNSSDAESEEKYTEDDKLAFIYRKIKKMCPVQVCKIGSGCWVPSKSVGFGCIIPGHMYEHSNNEICPVRPPGPSSIDQVKSGFITLVWTLQVKVPTTREIQGQVQEKEKSQSTWEDLDDTTFDEGEKKANLCMMDDTTSKQSKSEQE

SEQ ID NO: 184024 - protein, 260 aa, Glycine max
  Coding DNA Sequence Number=SeqID_67246
  Homolog annotation: Hit_ID=Q1RZK3; Match level="QueryCoverage=39%, HitCoverage=7%, E-value=4e-46, Identity=84%"; Hit description=WD40 -like
MILDDDGIAAPGEILRPYDIYINKQSPIDTRTPKTGSAANLPDSAYRSNAQSFNDNGGEVVDRVGKASFSLWFGNGQLMFFGVFHRIWNHEEVTLLNSFDNHDFPDKGISKLCLVNELDDSLFLAASSDGNIWIWKDYTLKGKQKLVTAFSSIHGHKPGVRSLNAVVDWQQQCGYLCLSVGKPHLCMMWFVLFVVLVEVLEKLRKRLVVTGKKLLITWAMFDLHSHHNITTSIDYGTPGDVLATKFGWLAVYLHHIPYGI

SEQ ID NO: 184025 - protein, 112 aa, Glycine max
  Coding DNA Sequence Number=SeqID_67247
  Gene Ontology: Mol. function=isomerase activity; Cellular component =nucleus; Biological process=carbohydrate metabolic process
  Homolog annotation: Hit_ID=Q1RU54; Match level="QueryCoverage=99%, HitCoverage=37%, E-value=7e-31, Identity=80%"; Hit description =Quinonprotein alcohol dehydrogenase-like
MVQKEYESLLKGKLLIIQAQLCVICSGIQGIGQYCNPPRQQQLMSMLPAVGYPDNPSTSFAAKFVHTSLNKNRCPINRVLWTPTGRRLITGSQTGEFTLWNGQSFNFEMILQ

SEQ ID NO: 184026 - protein, 91 aa, Glycine max
  Coding DNA Sequence Number=SeqID_67248
MLFAGIELNKGERWLFQEEERRHGGVVNDPLAEPSLFDYLTPQVGIVNNILFPELGDVNMELKLSKRQQEEKDNYLTKEMPRASARMEEAS

SEQ ID NO: 184027 - protein, 244 aa, Glycine max
  Coding DNA Sequence Number=SeqID_67249
  Gene Ontology: Mol. function=nucleic acid binding; Biological process= DNA integration
MQDENWVKAMQEELNQFQKNDVWKVVELPKDKKVVGANSVIDEVLYEVFKEKTITTLWLKEGTSLKEHPDELSFVLIKLCDIDVKIEDEDLTMIMLAFLPPSFENFLSSLSFTTQSITLEEVKSSLYSRELQLKVFGNGGEAFASRLSVTNSAKGRKKKKGKGNKKRKIGPKGIYNYCKEPGPSRVPSLGGARYFPSTINDYFEMTWVFMMKQKYKVFKCFKHWMILMKNQTGKTVKCLRTDND

SEQ ID NO: 184028 - protein, 46 aa, Glycine max
  Coding DNA Sequence Number=SeqID_67250
MGTRLHVIGDPMNGVQRSGGHNPLFEDSPSECGGGAATVRYGLISK

SEQ ID NO: 184029 - protein, 462 aa, Glycine max
  Coding DNA Sequence Number=SeqID_67251
  Gene Ontology: Mol. function=transferase activity; Cellular component= nucleus; Biological process=flavonoid biosynthetic process
  Homolog annotation: Hit_ID=O64470; Match level="QueryCoverage=98%, HitCoverage=99%, E-value=2e-84, Identity=38%"; Hit description =Putative anthranilate N-hydroxycinnamoyl/benzoyltransferase
  Pfam annotation: Domain name=Transferase; Domain location=1-456; Score=328.8; E_value=9.2e-96; Accession=PF02458.6; Description =Transferase family
MVTIKTSHTVVPNQPTPKGRLWLSNSDNSTRPAHTPVIYIYKAQLNIEYDIERMRDSLSKVLVYYYPVAGRLSLAESGRMEVDCNAKGVTLIEAATAKTFADFGDFSPSDSIKEELVPAIDYHSQPIQEIPLLFVQLTRFQGDQQQGLAIGVAFSHPVADGSAWIHFMNTWAMVNRGDMLDLNEMPFLDRTILKFPPSSLQSPPPPHFDHPELKPLPLILGKSDSTEEQNKKTAASMLKLTSKQVEMLKKKANDQLTKQGSRPFSRFEAVAAHIWRCACKARELHHNQPTLARFNVDFRNRLIPPLPRNYFGNALVATVTPECYVGEMTTRPLSYAAQKMREAVALLTDEYIRSHLEVVFGEEQLDCIKAFFLGQGEGRYAPFGGNPNLQITSWINMRAYETDFGWGKPVYFGLGYVCALDRGIIMRGPQDDGSVIVIMHFQIAHMQLLKKFFYEDIFTSRL

SEQ ID NO: 184030 - protein, 150 aa, Glycine max
  Coding DNA Sequence Number=SeqID_67252
MPFSMKLDINEDKWFFFELVGIKKDGIKCTSDFKLWWIGANDVGLKELAFYNHALELENFASSHKTQVKVYVKKLNGGEVVVIVGDVVAPGNGNEGVVTISESDGSDFESGSKNDNEDTLFEDSEEERAVAVDDDFDSEEEPLVNLTLKK

SEQ ID NO: 184031 - protein, 46 aa, Glycine max
  Coding DNA Sequence Number=SeqID_67253
MAAWASRQHVSPVPLAVPSMLLAICNGETPMSPVLLAASMEEQAPL

SEQ ID NO: 184032 - protein, 288 aa, Glycine max
  Coding DNA Sequence Number=SeqID_67254
MLPAFQWRHGLWVCLAGGIGEISARQQVSPVPLAAPSSSAYFSPSAMAEHLCRQFFWRHPWRNRTPSSIARFIGVVARSSAKSRLRSIRRSTNLSLQMRRMSSFSIVKCVSRSVAKVQDPMAKQQGLKLLLLFLSTLKLERPVSPGPSSPPHCATQHAIEVHVTAANCSTCNCAAPRVWVLNIVLALGWWVREFPGLKLPMMGGQSSTIPSSSDVPTPIKMGTHYLYPADLSSYEATCVEHPNLQSLDATIEECTNRVITSLAQGIEVHSISIESLGEVLSDSFSLFV

SEQ ID NO: 184033 - protein, 125 aa, Glycine max
  Coding DNA Sequence Number=SeqID_67255
  Subcellular localization annotation: CTP_CleavageSite=19; ConfidenceScore=5.50e-01
MATSPSSPPPPTGVAPHLSSTLKWTRKAIRLRSLATRPVGVERPLVHVDPTTRKVDDPHRKKLRTYLGIVAHDKVDVTYENWKQAEFDIPEASNYFNDARPLEPEILKALRIKWTKYYLKVKNET

SEQ ID NO: 184034 - protein, 84 aa, Glycine max
  Coding DNA Sequence Number=SeqID_67256
MWVSTERFLADFGREEKENSDFRREEKEKRTIGTLIDLKVSPWKLIYTMVGAYKEGVAVVPHNYHQDKKEVAKEKTTTQQASKG

SEQ ID NO: 184035 - protein, 154 aa, Glycine max
  Coding DNA Sequence Number=SeqID_67257
MECIPFDLPHIIYLNIVHITKTIGSLQDIYYATLLNKILWEQGVYQVFNILDDASNNEIMRKIIAQQQAPFAPKKEKVDKAIPSGKEPIIVAVVLRKMKVIATRANPTIFEKEWTLPYPSQGSSSNDVFSDATISQDHRPSSPPWQCPPHLLST

SEQ ID NO: 184036 - protein, 77 aa, Glycine max
  Coding DNA Sequence Number=SeqID_67258
MDEDFEDDRFISKMKELFMVFNDHVVQLHDIQNLDKGGGKKACQEIKGEEQTTSPAESNATTTDEVVQTRQPFPASK

SEQ ID NO: 184037 - protein, 245 aa, Glycine max
  Coding DNA Sequence Number=SeqID_67259
  Gene Ontology: Mol. function=oxidoreductase activity; Cellular component=membrane; Biological process=metabolic process
  Homolog annotation: Hit_ID=Q7WN40; Match level="QueryCoverage=99%, HitCoverage=100%, E-value=1e-102, Identity=80%"; Hit description =Probable short-chain dehydrogenase
  Pfam annotation: Domain name=Epimerase; Domain location=8-240; Score=- 50.3; E_value=0.0072; Accession=PF01370.11; Description=NAD dependent epimerasedehydratase family
  Pfam annotation: Domain name=KR; Domain location=7-187; Score=-53.3; E_value=0.00029; Accession=PF08659.1; Description=KR domain
  Pfam annotation: Domain name=adh_short; Domain location=6-173; Score =113.9; E_value=4.6e-31; Accession=PF00106.15; Description=short chain dehydrogenase
  Pfam module annotation: Pfam domain module=Epimerase::KR::adh_short; Domain location=8-240::7-187::6-173
MEFNGKAALVTGGTRGIGAAIVRGLAQRGAAVAFTYASSDSAANELARELGASGARVLGIKADSRDPAAVRAAVDHTARELGRLDILVNSAGVFPSGPIEDATLQEIDDTLAIHARAVFVASQAALAHMGSGGRIISIGSCFAQRVPYGGVTLYAMSKSALIGFTKGLAREVGERGITVNIVDPGSTDTDMNPADGPAASAELALMAVKRYARPAEIAAAVAYLASAESQFITGSSLAIDGGFTA

SEQ ID NO: 184038 - protein, 306 aa, Glycine max
  Coding DNA Sequence Number=SeqID_67260
  Gene Ontology: Mol. function=N-acetyltransferase activity; Biological process=metabolic process
  Homolog annotation: Hit_ID=Q10R02; Match level="QueryCoverage=70%, HitCoverage=70%, E-value=2e-55, Identity=50%"; Hit description=GCN5 -related N-acetyltransferase, putative, expressed
  Pfam annotation: Domain name=Acetyltransf_1; Domain location=196-297; Score=58.8; E_value=1.8e-14; Accession=PF00583.14; Description =Acetyltransferase (GNAT) family
  Subcellular localization annotation: CTP_CleavageSite=30; ConfidenceScore=5.29e-01
MPPMSTIPIHRPEFRTLFFNGSPSPCKCLRITASWTMWFFLACFCSMFDMSRTMDSKFSPTTKNSNDNNYNLKKKEELSVQIPTPPISKVETLNSNDLQFDRLQPSDQELGRVKRFEFGQFVAREAVLDEEYWTAAWLRAESHWEDRPYDRYVDNYKRKFAEQEFNALKRRCKVQNGDSCACIITVRKEQKNAKHSVLKSVVGTLDLNIRYLLQGETYPGERVKAPLFCSINRTPPSRYGYIANLCVIKSVRRQGIASNMMSFAIEAAKSNGLTQVYVHVDRNNRPAQILYQKMGFEMLDKWPHIS

SEQ ID NO: 184039 - protein, 33 aa, Glycine max
  Coding DNA Sequence Number=SeqID_67261
MAASKRSFGELVCKTTIYFQMDSLALMEGRPMR

SEQ ID NO: 184040 - protein, 73 aa, Glycine max
  Coding DNA Sequence Number=SeqID_67262
MASKRSPTNARSPRSSEKTSFMRAEEASCCGGGDGVRSRENRVDDRGNDKEGGTSAMAALDILWRRWAAAAVE

SEQ ID NO: 184041 - protein, 682 aa, Glycine max
  Coding DNA Sequence Number=SeqID_67263
  Gene Ontology: Mol. function=protein binding; Cellular component =nucleotide-excision repair complex; Biological process=nucleotide -excision repair
  Homolog annotation: Hit_ID=Q9C597; Match level="QueryCoverage=58%, HitCoverage=74%, E-value=2e-66, Identity=38%"; Hit description=DNA excision repair protein
  Pfam annotation: Domain name=LRR_1; Domain location=387-410; Score =3.1; E_value=75; Accession=PF00560.23; Description=Leucine Rich Repeat
  Pfam annotation: Domain name=LRR_1; Domain location=413-440; Score =6.1; E_value=21; Accession=PF00560.23; Description=Leucine Rich Repeat
  Pfam annotation: Domain name=LRR_1; Domain location=493-517; Score =3.1; E_value=75; Accession=PF00560.23; Description=Leucine Rich Repeat
  Pfam annotation: Domain name=LRR_1; Domain location=519-539; Score =0.7; E_value=2.1e+02; Accession=PF00560.23; Description=Leucine Rich Repeat
  Pfam annotation: Domain name=LRR_1; Domain location=545-567; Score =2.6; E_value=94; Accession=PF00560.23; Description=Leucine Rich Repeat
  Pfam annotation: Domain name=LRR_1; Domain location=597-620; Score =9.6; E_value=4.5; Accession=PF00560.23; Description=Leucine Rich Repeat
  Pfam annotation: Domain name=LRR_1; Domain location=623-653; Score =0.8; E_value=2e+02; Accession=PF00560.23; Description=Leucine Rich Repeat
  Pfam annotation: Domain name=LRR_2; Domain location=387-412; Score =7.0; E_value=1.8; Accession=PF07723.3; Description=Leucine Rich Repeat
  Pfam annotation: Domain name=LRR_2; Domain location=493-518; Score =5.1; E_value=3.2; Accession=PF07723.3; Description=Leucine Rich Repeat
  Pfam annotation: Domain name=LRR_2; Domain location=597-622; Score =6.7; E_value=2; Accession=PF07723.3; Description=Leucine Rich Repeat
  Pfam module annotation: Pfam domain module=LRR_1::LRR_1::LRR_1::LRR _1::LRR_1::LRR_1::LRR_1::LRR_2::LRR_2::LRR_2; Domain location=387 -410::413-440::493-517::519-539::545-567::597-620::623-653::387 -412::493-518::597-622
RRSDSAGSQREDFLCLRSRKNLEEQGNDKANEDDSVKINDDVAAAVVDCDVITPESKAENSGFNLNLIAVNSDSDSAFRVSTGNRKRKIHSTGSGCEGFLNKRPGKKAVKRAMTNDSEEQSNNNANDDDDNDVAVAVDENVMIPENTGGANVVADNSVPLRVRERPRNSNARERGSGYGRNDYMERFHDIARENASRFAFFAPEGEDHDRSPPVEPERDEIEDWPGPFSTAMKIIRDRGSKLQNAEASSQASLCESIKWVPNAKRGNAGVNVSVPSLQEMCLKILVKNVDAIASLESVPDALRHRLSQLLCDSRRINGHFLELLVRGTPTEIRLRDCSWLTEEQFTESFRTCDTENLVVLQLDQCGRCLPDYVVVSTLAQSPRHLSSLSTLSLSGACRLSDGGLRALVSSAPALRSINLSQCSLLTSSSVYILAESLKSLLKELYLDDCQGIDAALIVPALIELEHLEVLSVAGIQTVCDEFVKNYIVARGQNMKELVLKDCINLTDASIKAIVEHCPGLCVLDLMNLHKLTDLSIGHLANGCRALHTLKLCRNPFSDEAIAAFVETTGGSLKELSLNNIKKVGYHTTLSLANHAKNLHSLDLSWCRNLTDNALGLIVDSCLALRSLKLFGCSQVTDAFLNGHSNLQIQIIGLKMSPVLEHVKVPDPHQGALNYSSVSVDLV

SEQ ID NO: 184042 - protein, 230 aa, Glycine max
  Coding DNA Sequence Number=SeqID_67264
MVIDQSLFFSLTKLPSQGVPFEDTIVDDWKFDYFSHDARRMVCNDQANMTSRLLARSLTFDCHIMHYIIVRILLPCSSNPAQAFEEDLILMYRMHKALWTNAHLPYPQLVTLFLRHFQIPLDDESFVQVKRSFVIDAGAVTSFGYRKDHNGQWLRKQDLSHERIPSPPSQQDVSSAFMNDVLSELRGLRAFVGDCFDVMDARFTGMDTCITRLEDDMGFIRHCFDPPADP

SEQ ID NO: 184043 - protein, 196 aa, Glycine max
  Coding DNA Sequence Number=SeqID_67265
  Homolog annotation: Hit_ID=Q1SKD7; Match level="QueryCoverage=90%, HitCoverage=47%, E-value=6e-18, Identity=30%"; Hit description =Ankyrin
MAPRKLASQRSRKDKAVEGTSSAPEYDSHRFRSAVHQQRFEAIKGWSFLRERRVQLRDDEYTDFQEEIGRRRWASLVTPMAKFDPEIVLEFYANAWPTEEGVCDMRSWVRGQWIPFDADAISQLLGYPLVLEEGQECEYGQRRNRSDGFDEEAIAQLLCIPGQDFARTVAGRRVFHDCLREDPQGNPPFSSFSRAA

SEQ ID NO: 184044 - protein, 304 aa, Glycine max
  Coding DNA Sequence Number=SeqID_67266
  Homolog annotation: Hit_ID=Q1SDX7; Match level="QueryCoverage=95%, HitCoverage=43%, E-value=6e-23, Identity=26%"; Hit description =Cyclin-like F-box
MGGKSEKGEVMEWSVANTKAFIEKIYERVKNGQLQGSTFKTTTWEEINKDLFKMIQTNYGVNKLKSKFNRLRQMHCDFSTLLVRTQVTWEMESNKVNVPDEVWDELIKKGRHYKNFKKHGFEYNYDILSDIFNSSTATGKLSHASTQKPPNFDEERAMEGDFLTKGIHISVSDDEKDDIKGLRHKRKEIFSSGERCRKEGKTSNKEMLDKIVSIWSNSMSQKTTTSRAREERYKGKTSQASQATSPISDPYSAKACMELLDNMQDVPTSAYFKLMEKFTSEHWRQMFIVMDAERRKQLIKSLTE

SEQ ID NO: 184045 - protein, 342 aa, Glycine max
  Coding DNA Sequence Number=SeqID_67267
  Gene Ontology: Mol. function=nucleotide binding
  Homolog annotation: Hit_ID=Q9FH12; Match level="QueryCoverage=94%, HitCoverage=63%, E-value=4e-98, Identity=50%"; Hit description=Axi 1 (Auxin-independent growth promoter)-like protein
  Pfam annotation: Domain name=DUF246; Domain location=170-342; Score =71.7; E_value=8.1e-19; Accession=PF03138.5; Description=Plant protein family
  Subcellular localization annotation: CTP_CleavageSite=55; ConfidenceScore=5.42e-01
MAHNNINSTTMDGVPHRVNSPRYTGSMTRRAHSFKRNNNSNNEIELQINSPRSPLVSAEGSVLKRNQHHHKEKKNKFGHWVFLLFCGELSDSITSRNLMDQSSHGYAYREGANEVERTLKMVTTGVIDSQAGMAEESGVWSRPNYDNFTQCIDLPRNHKKLDEKTNGYILVNANGGLNQMRFGICDMVAVAKIMKATLVLPSLDHTSYWGDASGFKDLFDWKHFIETLKDDIHVVETLPPAYAEIEPFSKTPISWSKASYYKNEVLPLLKQHKVIYFTHTNSRLANNGIPSSIQKLRCRVNYRALKYSAPIEEFGSKLISRMRQNENPYLALHLRQVTTLIF

SEQ ID NO: 184046 - protein, 356 aa, Glycine max
  Coding DNA Sequence Number=SeqID_67268
  Gene Ontology: Mol. function=transposase activity; Cellular component= membrane; Biological process=transposition, DNA-mediated
  Homolog annotation: Hit_ID=Q1SUE7; Match level="QueryCoverage=65%, HitCoverage=83%, E-value=3e-59, Identity=43%"; Hit description =Transposase, IS4
MSLNSSNNSSSSIDSELDDYDDLMDLVLVMTIMECEHSFIGKTPCRASMLTGKMYTIEFLVGHETRCYENFRMKKDVFMNFCETLKEVGNLCDGKKVIIEEAIAMFLIIICHNLRHQVVAERFQPLLHTVNKWFQIILKAVCKLGTSIIHQRNQTSTHPHIRGNPKYYPYFKDCIGAIDGTHVSAWAPASKQTAFHGKSVGDTKYQFYLVDSGFPNMPGYLVPFRRNKYHLHDFHEGYGRPRGKEELFNYKHSLLRNVIERCFRVLKARFPILKLMPSYPIRRQRLISISCCTIHNFIRMQNGADTLFVQYAQQLVDMDEQWLSVEQQGVNENQEAEMTQVRQTITNEMWENYHRS

SEQ ID NO: 184047 - protein, 283 aa, Glycine max
  Coding DNA Sequence Number=SeqID_67269
  Gene Ontology: Mol. function=RNA-directed DNA polymerase activity; Cellular component=chromatin; Biological process=chromatin assembly or disassembly
MADLTHGKSIDRLKESIKLLSTSQSDLASKVDSILTQLATLIPTPSSPPRKHHLKLDVSRFNGADPIGWIFKISQFFEFHDTPKHKRPFVASFYMDGLALSWLWSLVSLLHFMRTLEAVALGKLQVEKLEDCRHFNCPKPISNPLPLPLPPAEPQPPPISSATAPTCSLVPSSPAAPRPRYRRLSPEEIADCHEKGLCYNCDEKFGPNHRYKAGFFLLIAEDETNQELPHPQISFNALSDHPIYEALRLQDSINHHPITILINGGSTHNFLQTKVAKFLGLPS

SEQ ID NO: 184048 - protein, 129 aa, Glycine max
  Coding DNA Sequence Number=SeqID_67270
  Homolog annotation: Hit_ID=Q9FH12; Match level="QueryCoverage=52%, HitCoverage=10%, E-value=2e-29, Identity=89%"; Hit description=Axi 1 (Auxin-independent growth promoter)-like protein
MLAGIDYIVALQSDVFLYTYDGNMAKAVQGHRHFENFKKTINPDKVNFVKLVDKLDEGKISWKKFSSKGCMYWPLWLCCLSTSVLRRWKFDCTKAWLFDKFYVLAWMMDMFTWGQEKGLRTEPLSCITN

SEQ ID NO: 184049 - protein, 664 aa, Glycine max
  Coding DNA Sequence Number=SeqID_67271
  Gene Ontology: Mol. function=RNA-directed DNA polymerase activity; Cellular component=chromatin; Biological process=chromatin assembly or disassembly
  Pfam annotation: Domain name=Mob1_phocein; Domain location=496-664; Score=324.5; E_value=1.8e-94; Accession=PF03637.7; Description =Mob1phocein family
  Pfam annotation: Domain name=rve; Domain location=264-395; Score= -10.9; E_value=0.049; Accession=PF00665.16; Description=Integrase core domain
  Pfam annotation: Domain name=zf-H2C2; Domain location=205-246; Score =15.5; E_value=0.0031; Accession=PF09337.1; Description=His(2)-Cys(2) zinc finger
  Pfam module annotation: Pfam domain module=Mob1_phocein::rve::zf -H2C2; Domain location=496-664::264-395::205-246
MTDWPIPSFVRALCRFLGLKGFYRKFIKGYAAIAHPVNQLLHMGFFQWSPSAQQAFDSLKRAMTEALVLALLDFALPFVLETDALGATMACASTYIRELHAITSAVKKWRQYLLGHPFIILTDHKSLKDLMTSVMQTLEQQVYLSKLMGYDYLIQYCIERHNVVANALSRSDGQCLILSVPQFAFLDELQRNLSSSEAFHNLEFHQTSVAGHMGVTKTLARLLENFFWKGMRKDVRNFVAQCITCQSTKYETKRPTDLLQPLPVPTAVWEDFFLDFITGLPLSNGNTIPLFLLLLTVSLRQLISVVFQAISQLSRLLNYSLNWSANTTRYPVACTAYHPETDGQTEILNRTLEQYLRAFVHFNLSRWGKFVALAEWSYDTAVHSATGHAKLCYELSTESSSKLKLLCKCKLTKSAGMCPIVLVTGFMFVCAPIAKHRSPGLSPEDTTWERWDDLSRTFHLEDKVILPGDGNVSDIVTTDSNKNGLREEETNGAQLQKHIDATLGSGNLREAVKLPPGEDINEWLAVNTVDFFNQVNILFGTLTEFCTPSNCPSMTAGPKYEYRWADGVTIKKPIEVSAPKYVEYLMDWIESQLDDETIFPQRLGAPFPTNFRDVVKTIFKRLFRVYAHIYHSHFQKIVSLKEEAHLNTCFKHFVLFTWGGEIIA

SEQ ID NO: 184050 - protein, 266 aa, Glycine max
  Coding DNA Sequence Number=SeqID_67272
  Gene Ontology: Mol. function=RNA-directed DNA polymerase activity; Cellular component=exocyst; Biological process=RNA-dependent DNA replication
GNGVSLDGVPFATITMEDNMEMECVFGEIEVKEAVLKDDIMRFMREFHSYGVLPRGGNPSFITLIPKTKCLLGDRKLLHSVVVTNEVADEARRRLGFQEKWVRWMRECLRSCSISVLVNENPTKEFNIHRKLRQRDPLTPFLFKMVAEGLSEMMRMTTLKNIFKGYMCGNVEVNLLQYADDTIFIAQVSIQNVEGLKLNFSKSICGTIGVDDLEPWGKGLEAIQRSSPSKVEVELVPPTKHFVGSHIEGKGGFGGENHECGLIMGY

SEQ ID NO: 184051 - protein, 466 aa, Glycine max
  Coding DNA Sequence Number=SeqID_67273
  Gene Ontology: Mol. function=transferase activity; Cellular component= nucleus; Biological process=flavonoid biosynthetic process
  Homolog annotation: Hit_ID=Q1S6U2; Match level="QueryCoverage=98%, HitCoverage=98%, E-value=6e-85, Identity=40%"; Hit description =Transferase
  Pfam annotation: Domain name=Transferase; Domain location=1-460; Score=340.8; E_value=2.2e-99; Accession=PF02458.6; Description =Transferase family
MVTIKASHTVAPNQPTPQGRLWLSNSDQTARPAHTPNLYIYKAKHNIIEYDIEKMIDSLSKVLVYYYPVAGRLSVTESGRMEVDCNAKGVTLIEAETAKTFDDFGDFTPSDSIKEELVPVIDYHSQPIEEIPLVLVQVTRFKGDRKQQGLAVAVAVSHPVADGYAWIHFINTWAKVNRGGMLDLNDMPCLDRTIRRSSSLSSPPPRFDHPELKPLPFKLGKSDSTEEQNKKTTAAVLKLTSEQVEMLRKKANENENLSTKQGSRSRPCSRFEAVAAHIWRCACKARELDRNQPTLVRFNADFRNRLTPPLPRNYFGNALAATVTPECYAGEITSKPLSYAARKMREAVEMLKEEYISSQLDIALGEEQLESIKALFSRQGERRNAPFAGNPNLQITSWINIPLYEADFGWGKPEHFVLGYVCPFDRGIIIQGPENDGSVIVIMYFQISHMQLFKKFFYEDVFTSRL

SEQ ID NO: 184052 - protein, 61 aa, Glycine max
  Coding DNA Sequence Number=SeqID_67274
MAFLCFLALNKSWEVVLESKQKLIVSSELHEEGKVECDGLEKRNRSEVPEGEVERYLQHKS

SEQ ID NO: 184053 - protein, 83 aa, Glycine max
  Coding DNA Sequence Number=SeqID_67275
MMLMTTTMMTMVAITIVMMVMTIETTMMVMIAKVMVVDDDSNDNNNHVTTIKIMATEVVGVVDGDDDYSGSCIGGHDSSPIKN

SEQ ID NO: 184054 - protein, 923 aa, Glycine max
  Coding DNA Sequence Number=SeqID_67276
  Gene Ontology: Mol. function=RNA-directed DNA polymerase activity; Cellular component=chromatin; Biological process=chromatin assembly or disassembly
  Homolog annotation: Hit_ID=Q8S6H8; Match level="QueryCoverage=46%, HitCoverage=76%, E-value=6e-56, Identity=32%"; Hit description =Putative retroelement
MVDGTRLSKIENELSRIEAQNSSFQECMAAQMTQLMSLLQKKKSDDENLDAESTHSILQIPARYSTTRISTKDFKIDLPKFDGINVDDWIFHFEEYFDVAQTPLEQCIKVASFYMIGPAYVWYKWMIHKNYSQDWTIFVDALYKHFGSNLYTNPQEALTELKQQGTVKEYQTQFEALSTRVNGLTKQWLVSFFVAGLNDYLKCQLRTLRTPAAHPATNPINQLPTSNAIASNKPHESSSMSTPQTLVASQTTTKPPYKRFTGTELRERCCLELCYYCDEKYNPSHNCQAKCHILLAPDDLVDVCHGLLDADASNNAAIEGTGVPDISFNSLSREYSPCTVHVTNIEPFKVFVGSDDFIWCNTGIYDVPILEQGIYFPLTECDFCKDSVHYLGHVISAKGLTGYYRRFVKGYATIAFPLMEMLKCNSFHWTSESEMTFKLLKQALTSTPILALPNFSLPFEVETDASTTGIGAVLTQQGHPLAFFSKKLSRRMSNASSYARELYAITQDVARWQHYLLGRKFTIKIDHKSLKELMSQPELLKFHALHGQNKLPPNFEVHNGLLLYHSCLYIPQDSPLVTKQSVKKYMATCIQCQQTKNITTKSQGLLQPLSIPTTPWTEISMDFIVDLPYSNGFTTIFVVVDHLTKTAHFMPLKTGFTAKIVALEELIFTTQRHIIHKAMARLRLLPSYTPRKTSVDEEDSMLINQQEIQNELEANLTRAQTRMKKCADSNQLDKNFEVDQWVWVKFHAYRQQSAARRLNFKLSKRYFGPFQILECIGKVAYQLDFPSNSRIHPVFHVSLLKAYSSPTPPVSITFLVEWANEPCKEATWKSWDILVNLYTEAAFEDKVLFRGRVTIVTTVATATIIVIVINRHPHCHNLCHHDLCHPCFKTIIVVVVMNIMVGVAMIIMMVIYTIVMDNMMMMD

SEQ ID NO: 184055 - protein, 390 aa, Glycine max
  Coding DNA Sequence Number=SeqID_67277
  Homolog annotation: Hit_ID=Q8W1D5; Match level="QueryCoverage=42%, HitCoverage=37%, E-value=9e-33, Identity=55%"; Hit description=CBL -interacting protein kinase CIPK25
  Pfam annotation: Domain name=NAF; Domain location=161-206; Score= -2.1; E_value=0.008; Accession=PF03822.5; Description=NAF domain
  Subcellular localization annotation: CTP_CleavageSite=89; ConfidenceScore=5.09e-01
MTTGLRGRSYGHCSSLPPPSSRGDVEEARSPVTAVLVVAAEEVPVVTRALPFGVSFRPVVFVTKVTSGTTSDTSGQHENLMTMYNKVLRAEFEFPPWFSPESKKLISKIVVADPAKRTTIFAITRVLWFGKGFSSFSAPDLCQLEKQEALTVTEEENNSKMPKFFNAFELISSMSFGFDLSGCSRARGRQQRCSHCDGDVGAEVPRGRGQGLQDLTAGCDRGEEEEADGHGGGVRGGTRGHFRDKDNRRRGLLIQPAIDLSVKFFNWVESPHEHSHFQPVVDNTINAFHCLIESNHKDHPDLQSQTRHHPKSNPNPFSILLFTKIYNPNPSRSLSFSACPTTLTPPTSSQFSQWKAWGRLLFFAHFWIVTIICEERSKGLMALVRMVRRP

SEQ ID NO: 184056 - protein, 87 aa, Glycine max
  Coding DNA Sequence Number=SeqID_67278
  Homolog annotation: Hit_ID=Q6K699; Match level="QueryCoverage=95%, HitCoverage=18%, E-value=2e-13, Identity=62%"; Hit description =Putative Arp2/3 complex 41kD subunit
MSFNQFSEAFGKFYGQSKHGVSNDAVETSRARGTVHENCINCIMPLGDHGTLIRRFSTSVSSRLLLLMPTPRIHRIGWKNCCMGFGK

SEQ ID NO: 184057 - protein, 89 aa, Glycine max
  Coding DNA Sequence Number=SeqID_67279
MRNIIKNKEISTFAQLHHNLGLGELVTHDQSKTSNLIKSKYRDINSESTTVVVGSDAKALSYYGLTMTLLIDHDHDEFITTIIGSLTLF

SEQ ID NO: 184058 - protein, 68 aa, Glycine max
  Coding DNA Sequence Number=SeqID_67280
  Gene Ontology: Mol. function=transporter activity; Cellular component= membrane; Biological process=oligopeptide transport
  Homolog annotation: Hit_ID=Q7XJQ3; Match level="QueryCoverage=66%, HitCoverage=8%, E-value=2e-07, Identity=56%"; Hit description =Putative peptide/amino acid transporter
MRLKVCIKVAELKQHCCKMEKVSLEVKAPEEGDEMKWVLDSSVDHKDRVPLRASTGSWKAALFIIGKD

SEQ ID NO: 184059 - protein, 248 aa, Glycine max
  Coding DNA Sequence Number=SeqID_67281
  Gene Ontology: Mol. function=protein disulfide oxidoreductase activity; Biological process=cell redox homeostasis
  Homolog annotation: Hit_ID=Q1RU64; Match level="QueryCoverage=88%, HitCoverage=81%, E-value=1e-57, Identity=54%"; Hit description =Thioredoxin fold
  Pfam annotation: Domain name=Glutaredoxin; Domain location=113-188; Score=54.4; E_value=3.7e-13; Accession=PF00462.14; Description =Glutaredoxin
  Subcellular localization annotation: CTP_CleavageSite=49; ConfidenceScore=5.51e-01
MAELGNNNNGANTTSSRFSFFNRSLTTLRNEPPPQKPPQLDRSLTKLVESGRGGSVVKRLCSFFESAKPSSPEKQQNPKLKPSKFIENSNSDSASKSLDSPAIRLPGTEDRIVLYFTSLRGIRRTYEDCYAVRMIFRGFRVWVDERDISMDANYRKELMSALFGENNNNNNKKGHVALPQVFIRGRHVGGADVIKHMWEVGELEKVLEGLPRTKGGFVCESCGDVRFVPCGNCSGSRKVFDEDEEVLK

SEQ ID NO: 184060 - protein, 58 aa, Glycine max
  Coding DNA Sequence Number=SeqID_67282
  Homolog annotation: Hit_ID=Q6K699; Match level="QueryCoverage=72%, HitCoverage=11%, E-value=6e-10, Identity=72%"; Hit description =Putative Arp2/3 complex 41kD subunit
MTRYVWNLEGSEWVPTLVILRLNRAALCVQWSPKEFKAKCVGVKSLLPSPPTALLDYT
